US008598333B2

(12) United States Patent
MacLachlan et al.

(10) Patent No.: US 8,598,333 B2
(45) Date of Patent: Dec. 3, 2013

(54) SIRNA SILENCING OF GENES EXPRESSED IN CANCER

(75) Inventors: Ian MacLachlan, Mission (CA); Adam Judge, Vancouver (CA); Vandana Sood, Vancouver (CA); James Heyes, Vancouver (CA); Lloyd B. Jeffs, Delta (CA); Lorne Palmer, Vancouver (CA)

(73) Assignee: Alnylam Pharmaceuticals, Inc., Cambridge, MA (US)

( * ) Notice: Subject to any disclaimer, the term of this patent is extended or adjusted under 35 U.S.C. 154(b) by 1422 days.

(21) Appl. No.: 11/807,872

(22) Filed: May 29, 2007

(65) Prior Publication Data
US 2009/0149403 A1 Jun. 11, 2009

Related U.S. Application Data

(60) Provisional application No. 60/808,859, filed on May 26, 2006, provisional application No. 60/817,556, filed on Jun. 28, 2006.

(51) Int. Cl.
C07H 21/04 (2006.01)

(52) U.S. Cl.
USPC ......................................................... 536/24.5

(58) Field of Classification Search
USPC ......................................................... 536/24.5
See application file for complete search history.

(56) References Cited

U.S. PATENT DOCUMENTS

| | | | |
|---|---|---|---|
| 4,426,330 A | 1/1984 | Sears | |
| 4,534,899 A | 8/1985 | Sears | |
| 4,837,028 A | 6/1989 | Allen | |
| 4,868,116 A | 9/1989 | Morgan et al. | |
| 4,980,286 A | 12/1990 | Morgan et al. | |
| 5,013,556 A | 5/1991 | Woodle et al. | |
| 5,139,941 A | 8/1992 | Muzyczka et al. | |
| 5,213,804 A | 5/1993 | Martin et al. | |
| 5,225,212 A | 7/1993 | Martin et al. | |
| 5,252,479 A | 10/1993 | Srivastava | |
| 5,264,221 A | 11/1993 | Tagawa et al. | |
| 5,328,470 A | 7/1994 | Nabel et al. | |
| 5,334,711 A | 8/1994 | Sproat et al. | |
| 5,356,633 A | 10/1994 | Woodle et al. | |
| 5,540,935 A | 7/1996 | Miyazaki et al. | |
| 5,543,152 A | 8/1996 | Webb et al. | |
| 5,556,948 A | 9/1996 | Tagawa et al. | |
| 5,595,760 A | 1/1997 | Cherif-Cheikh | |
| 5,627,053 A | 5/1997 | Usman et al. | |
| 5,665,710 A | 9/1997 | Rahman et al. | |
| 5,672,659 A | 9/1997 | Shalaby et al. | |
| 5,705,188 A | 1/1998 | Junichi et al. | |
| 5,716,824 A | 2/1998 | Beigelman et al. | |
| 5,854,038 A | 12/1998 | Sullenger et al. | |
| 5,902,880 A | 5/1999 | Thompson | |
| 5,976,567 A | 11/1999 | Wheeler et al. | |
| 5,981,501 A | 11/1999 | Wheeler et al. | |
| 6,054,299 A | 4/2000 | Conrad | |
| 6,110,745 A * | 8/2000 | Zhang et al. | 435/458 |
| 6,146,886 A | 11/2000 | Thompson | |
| 6,150,092 A | 11/2000 | Uchida et al. | |
| 6,395,713 B1 | 5/2002 | Beigelman et al. | |
| 6,534,484 B1 | 3/2003 | Wheeler et al. | |
| 6,586,410 B1 | 7/2003 | Wheeler et al. | |
| 6,680,068 B2 | 1/2004 | Campbell et al. | |
| 6,815,432 B2 | 11/2004 | Wheeler et al. | |
| 7,427,605 B2 | 9/2008 | Davis et al. | |
| 7,718,629 B2 | 5/2010 | Bumcrot et al. | |
| 7,919,473 B2 | 4/2011 | De Fougerolles et al. | |
| 7,947,659 B2 | 5/2011 | De Fougerolles et al. | |
| 2003/0143732 A1 | 7/2003 | Fosnaugh et al. | |
| 2003/0170891 A1 | 9/2003 | McSwiggen | |
| 2003/0203844 A1 | 10/2003 | Delfani et al. | |
| 2003/0229037 A1 | 12/2003 | Massing et al. | |
| 2004/0018176 A1 | 1/2004 | Tolentino et al. | |
| 2004/0115201 A1 | 6/2004 | Einat et al. | |
| 2004/0180847 A1 | 9/2004 | Dobie et al. | |
| 2004/0209832 A1 | 10/2004 | McSwiggen et al. | |
| 2004/0259247 A1 | 12/2004 | Tuschl et al. | |
| 2005/0064595 A1 | 3/2005 | MacLachlan et al. | |
| 2005/0112141 A1 | 5/2005 | Terman | |
| 2005/0175682 A1 | 8/2005 | Heyes et al. | |
| 2005/0244858 A1 | 11/2005 | Rossi et al. | |
| 2005/0255487 A1 | 11/2005 | Khvorova et al. | |
| 2005/0282188 A1 | 12/2005 | Haeberli et al. | |
| 2006/0008910 A1 | 1/2006 | MacLachlan et al. | |
| 2006/0063751 A1 | 3/2006 | Aquila et al. | |
| 2006/0083780 A1 | 4/2006 | Heyes et al. | |

(Continued)

FOREIGN PATENT DOCUMENTS

DE 101 00 586 4/2002
EP 0445131 10/1989

(Continued)

OTHER PUBLICATIONS

Elbashir et al. "Analysis of gene function in somatic mammalian cells using small interfering RNAs," Methods, 2002, vol. 26, pp. 199-213.
Elbashir et al. "Functional anatomy of siRNAs for mediating efficient RNAi in *Drosphila melanogaster* embryo lysate," The EMBO Journal, 2001, vol. 20, No. 23, pp. 6877-6888.
Judge et al. "Design of Noninflammatory Synthetic siRNA Mediating Potent Gene Silencing in Vivo," Molecular Therapy, 2006, vol. 13, No. 3, pp. 494-505.
Reynolds et al. "Rational siRNA design for RNA interference," Nature Biotechnology, 2004, vol. 22, No. 3, pp. 326-330.
Weil et al. "Targeting the Kinesin Eg5 to Monitor siRNA Transfection in Mammalian Cells," Biotechniques, 2002, vol. 33, No. 6, pp. 1244-1248.
Akhtar et al. "Cellular uptake and intracellular fate of antisense oligonucleotides" Trends Cell Bio. 2:139-144 (1992).
Aldrian-Herrada et al., "A peptide nucleic acid (PNA) is more rapidly internalized in cultured neurons when coupled to a retro-inverse delivery peptide. The antisense activity depresses the target mRNA and protein in magnocellular oxytocin neurons" Nucleic Acids Res. 26:4910-4916 (1998).

(Continued)

*Primary Examiner* — Brian Whiteman
(74) *Attorney, Agent, or Firm* — Fenwick & West LLP

(57) ABSTRACT

The present invention provides nucleic acid-lipid particles comprising siRNA molecules that silence genes expressed in cancer (e.g., Eg5, EGFR or XIAP) and methods of using such nucleic acid-lipid particles to silence Eg5, EGFR or XIAP gene expression.

8 Claims, 378 Drawing Sheets

(56) References Cited

U.S. PATENT DOCUMENTS

| | | | |
|---|---|---|---|
| 2006/0094032 A1 | 5/2006 | De Fougerolles |
| 2006/0223770 A1 | 10/2006 | De Fougerolles |
| 2006/0240093 A1 | 10/2006 | MacLachlan et al. |
| 2006/0263435 A1 | 11/2006 | Davis et al. |
| 2007/0004664 A1 | 1/2007 | McSwiggen et al. |
| 2007/0031844 A1 | 2/2007 | Khvorova et al. |
| 2007/0135372 A1 | 6/2007 | MacLachlan et al. |
| 2007/0281899 A1 | 12/2007 | Bumcrot et al. |
| 2008/0188675 A1 | 8/2008 | Chen et al. |
| 2008/0213350 A1 | 9/2008 | Ko et al. |
| 2009/0023215 A1 | 1/2009 | Jessee et al. |
| 2009/0023673 A1 | 1/2009 | Manoharan |
| 2009/0099109 A1 | 4/2009 | Shames et al. |
| 2009/0149403 A1 | 6/2009 | MacLachlan et al. |
| 2009/0291131 A1 | 11/2009 | MacLachlan et al. |
| 2010/0087508 A1 | 4/2010 | Bumcrot et al. |
| 2010/0130588 A1 | 5/2010 | Yaworski |
| 2010/0267806 A1 | 10/2010 | Bumcrot et al. |
| 2010/0324120 A1 | 12/2010 | Chen et al. |
| 2011/0015250 A1 | 1/2011 | Bumcrot et al. |
| 2011/0224282 A1 | 9/2011 | De Fougerolles et al. |
| 2012/0136145 A1 | 5/2012 | Bumcrot et al. |

FOREIGN PATENT DOCUMENTS

| | | |
|---|---|---|
| EP | 0496813 | 10/1990 |
| WO | WO 88/04924 | 7/1988 |
| WO | WO 89/02468 | 3/1989 |
| WO | WO 89/05345 | 6/1989 |
| WO | WO 89/07136 | 8/1989 |
| WO | WO 90/04384 | 5/1990 |
| WO | WO 91/05545 | 5/1991 |
| WO | WO 92/07065 | 4/1992 |
| WO | WO 92/07573 | 5/1992 |
| WO | WO 93/15187 | 5/1993 |
| WO | WO 93/23569 | 11/1993 |
| WO | WO 93/24641 | 12/1993 |
| WO | WO 94/02595 | 2/1994 |
| WO | WO 94/13788 | 6/1994 |
| WO | WO 94/20073 | 9/1994 |
| WO | WO 96/10390 | 4/1996 |
| WO | WO 96/10391 | 4/1996 |
| WO | WO 96/10392 | 4/1996 |
| WO | WO 96/23065 | 8/1996 |
| WO | WO 96/40062 | 12/1996 |
| WO | WO 96/40964 | 12/1996 |
| WO | WO 97/04787 | 2/1997 |
| WO | WO 97/13499 | 4/1997 |
| WO | WO 97/26270 | 7/1997 |
| WO | WO 97/30731 | 8/1997 |
| WO | WO 98/13526 | 4/1998 |
| WO | WO 98/35978 | 8/1998 |
| WO | WO 99/32619 | 7/1999 |
| WO | WO 99/53050 | 10/1999 |
| WO | WO 99/61631 | 12/1999 |
| WO | WO 00/03683 | 1/2000 |
| WO | WO 00/22113 | 4/2000 |
| WO | WO 00/22114 | 4/2000 |
| WO | WO 00/44895 | 8/2000 |
| WO | WO 00/53722 | 9/2000 |
| WO | WO 03/070910 | 8/2003 |
| WO | WO 03/070917 | 8/2003 |
| WO | WO/03/070918 | 8/2003 |
| WO | WO 03/074654 | 9/2003 |
| WO | WO 2004/001193 | 12/2003 |
| WO | WO 2004/007070 | 1/2004 |
| WO | WO 2004/009769 | 1/2004 |
| WO | WO 2004/011822 | 2/2004 |
| WO | WO 2004/011829 | 2/2004 |
| WO | WO 2004/013310 | 2/2004 |
| WO | WO 2004/064737 | 8/2004 |
| WO | WO 2004/065601 | 8/2004 |
| WO | WO 2004/080406 | 9/2004 |
| WO | WO 2004/090108 | 10/2004 |
| WO | WO 2004/094345 | 11/2004 |
| WO | WO 2004/094595 | 11/2004 |
| WO | WO 2004/099410 A2 | 11/2004 |
| WO | WO 2005/007196 A2 | 1/2005 |
| WO | WO 2005/014782 | 2/2005 |
| WO | WO 2005/026372 A1 | 3/2005 |
| WO | WO 2005/031002 A2 | 4/2005 |
| WO | WO 2005/089224 | 9/2005 |
| WO | WO 2005/120152 | 12/2005 |
| WO | WO 2007/002191 | 1/2007 |
| WO | WO 2007/012191 | 2/2007 |
| WO | WO 2007/051303 A1 | 5/2007 |
| WO | WO 2007/115168 | 10/2007 |
| WO | WO 2008/042973 | 4/2008 |
| WO | WO 2009/111658 | 9/2009 |
| WO | WO 2009/127060 | 10/2009 |
| WO | WO 2009/134487 | 11/2009 |
| WO | WO 2010/054406 | 5/2010 |
| WO | WO 2010/088537 | 8/2010 |
| WO | WO 2010/105209 | 9/2010 |
| WO | WO 2010/129709 | 11/2010 |
| WO | WO 2010/144740 | 12/2010 |
| WO | WO 2011/017548 | 2/2011 |
| WO | WO 2011/034798 | 3/2011 |

OTHER PUBLICATIONS

Allen et al., "Large Unilamellar Liposomes with Low Uptake into the Reticuloendothelial System," Feb. 23:42-46 (1987).

Anderson et al., "Human Gene Therapy," Nature, 392 (Suppl): 25-30 (1998).

Armentano et al., "Expression of Human Facot IX in Rabbit Hepatocytes by Retrovirus-Mediated Gene Transfer: Potential for Gene Therapy of hemophilia B" Proc. Natl. Acad. Sci. USA 87: 6141-6145 (1990).

Bass, B., "The short answer," Nature, May 24, 2001, pp. 428-429, vol. 411.

Berkner, K., "Development of Adenovirus Vectors for the Expression of Heterologous Genes," Biotechniques, 6(7): 616-629 (1988).

Beigelman et al., "Chemical Modification of Hammerhead Ribozymes" Journal of Biological Chemistry, Oct. 27, 1995, p. 25702-25708, vol. 270, No. 43.

Bernstein et al., "Role for a bidentate ribonuclease in the initiation step of RNA interference" Nature, Jan. 18, 2000, p. 363-366, vol. 409.

Blume et al., "Liposomes for the Sustained Drug Release in Vivo," Biochimica et Biophysica Acta, 1029:91-97 (1990).

Boado, "Antisense drug delivery through the blood-brain barrier" Adv. Drug. Delivery Reviews, 1995, 15:73-107.

Boado et al., "Drug Delivery of Antisense Molecules to the Brain for Treatment of Alzheimer's Disease and Cerebral AIDS" J. Pharm. Sciences, Nov. 1998, p. 1308-1315, vol. 87, No. 11.

Boese et al., "Mechanical Insights Aid Computational Short Interfering RNA Design," Methods in Enzymology 392:73-96, 2005.

Bucchini et al., "Pancreatic Expression in Human Insulin Gene in Transgenic Mice" Proc. Natl. Acad. Sci. USA, 83: 2511-2515 (1986).

Burgin, Jr. et al., "Chemically Modified Hammerhead Ribozymes with Improved Catalytic Rates" Biochemistry, 1996, p. 14090-14097, vol. 35.

Burlina et al, "Chemical Engineering of RNase Resistant and Catalytically Active Hammerhead Ribozymes" Bioorg. Med. Chem. 5(11):1999-2010 (1997).

Chen et al., "Gene Therapy for Brain Tumors: Regression of Experimental Gliomas by Adenovirus-Mediated Gene Transfer in vivo", Proc. Natl. Acad. Sci. USA, 91: 3054-3057 (1994).

Chen et al., "Multitarget-ribozyme directed to cleave at up to nine highly conserved HIV-1 env RNA regions inhibits HIV-1 replication—potential effectiveness against most presently sequenced HIV-1 isolates" Nucleic Acids Research, Sep. 11, 1992, p. 4581-4589, vol. 20, No. 17.

Chowrira et al., "In Vitro and in Vivo Comparison of Hammerhead, Hairpin, and Hepatitis Delta Virus Self-processing Ribozyme Cassettes" J. Biol. Chem., Oct. 1994, p. 25856-25864, vol. 269, No. 41.

(56) References Cited

OTHER PUBLICATIONS

Chowdhury et al., "Long-Term Improvements of Hypercholesterolemia After ex Vivo Gene Therapy in LDLR-Deficient Rabbits," Science, 254(5039): 1802-1805 (1991).
Cone, R. and Mulligan, R., "High-Efficiency Gene Transfer into Mammalian Cells: Generation of Helper-Free Recombinant Retrovirus with Broad Mammalian Host Range," Proceedings of the National Academy of Sciences of the United States of America, 81(20): 6349-6353 (1984).
Cornetta et al., "Safety Issues Related to Retroviral-Mediated Gene Transfer in Humans," Human Gene Therapy 2:5-14 (1991).
Couture et al., "Anti-Gene Therapy: The Use of Ribozymes to Inhibit Gene Function" TGI 12(12): 510-515 (1996).
Crooke et al., "Pharmacokinetic Properties of Several Novel Oligonucleotide Analogs in Mice" The Journal of Pharmacology and Experimental Therapeutics, 277(2): 923-937 (1996).
Dai et al., "Gene Therapy Via Primary Myoblasts: Long-Term Expression of Factor IX Protein Following Transplantation in vivo" Proc. Natl. Acad. Sci. USA, 89: 10892-10895 (1992).
Danos, O. and Mulligan, R., "Safe and Efficient Generation of Recombinant Retroviruses with Amphotropic and Ecotropic Host Ranges" Proc. Natl. Acad. Sci. USA, 85: 6460-6464 (1988).
Docherty, K. and Clark, A., "Nutrient Regulation of Insulin Gene Expression," The FASEB Journal 8: 20-27 (1994).
Dornburg, R., "Reticuloendotheliosis Viruses and Derived Vectors," Gene Therapy, 2:301-310 (1995).
du Plessis et al., "Topical Delivery of Liposomally Encapsulated Gamma-Interferon," Antiviral Research, 18:259-265 (1992).
Dunn, K.C., et al., "A Human Retinal Pigment Epithelial Cell Line with Differentiated Properties," Exp. Eye Res., 1996, pp. 155-169, vol. 62.
Dropulic et al., "Functional Characterization of a U5 Ribozyme: Intracellular Suppression of Human Immunodeficiency Virus Type I Expression" Journal of Virology, Mar. 1992, p. 1432-1441, vol. 66, No. 3.
Earnshaw et al., "Modified Oligoribonucleotides as Site-Specific Probes of RNA Structure and Function" Biopolymers (Nucleic Acid Sciences), 1998, p. 39-55, vol. 48.
Eglitis et al., "Gene Expression in Mice After High Efficiency Retroviral-Mediated Gene Transfer," Science 230(4732): 1395-1398 (1995).
Eglitis et al., "Retroviral Vectors for Introductions of Genes into Mammalian Cells," Biotechniques 6:608-614 (1988).
Elbashir, S., et al., "Duplexes of 21-nucleotide RNAs mediate RNA interference in mammalian cell culture," Nature, May 24, 2001, p. 494-498, vol. 411.
Elbashir, S., et al., "RNA Interference is Mediated by 21-and 22 Nucleotide RNAs," Genes & Development, 2001, pp. 188-200, vol. 15.
El-Hariri et al., "The Mitigating Effects of Phosphatidylcholines on Bile Salt- and Lysophosphatidylcholine-Induced Membrane Damage," J. Pharm. Pharmacol., 44:651-654 (1992).
Fattal et al., "Ocular delivery of nucleic acids: antisense oligonucleotides aptamers and siRNA," (2006) Advanced Drug Delivery Reviews 58:1203-1223.
Filleur et al., "SiRNA-mediated Inhibition of Vascular-Endothelial Growth Factor Severely Limits Tumor Resistance to Antiangiogenic Thrombospondin-1 and Slows Tumor Vascularization and Growth" Cancer Res. 63:3919-3922 (2003).
Fire, A., et al., "Potent and Specific Genetic Interference by Double Stranded RNA in *Caenorhabditis elegans*," Nature, Feb. 19, 1998, pp. 806-811, vol. 391.
Ferry et al., "Retroviral-Mediated Gene Transfer into Hepatocytes in vivo" Proc. Natl. Acad. Sci. USA, 88: 8377-8381 (1991).
Fisher et al., "Transduction with Recombinant Adeno-Associated Virus for Gene Therapy is Limited by Leading-Strand Synthesis," Journal of Virology, 70:520-532 (1996).
Gabizon et al., "Liposome Formulations with Prolonged Circulation Time in Blood and Enhanced Uptake by Tumors," Proc. Natl. Acad. Sci. USA 85:3949-3953 (1988).

Gassmann et al., "Maintenance of an Extrachromosomal Plasmid Vecot in Mouse Embryonic Stem Cells" Proc. Natl. Acad. Sci. USA, 92: 1292-1296 (1995).
Genbank Accession No. AF214570, "*Homo sapiens* vascular endothelial growth factor isoform 121 precursor, mRNA, complete cds," Dec. 23, 1999.
Good et al., "Expression of small, therapeutic RNAs in human cell nuclei" Gene Therapy 4:45-54, 1997.
Gonzalez, H., et al., "New Class of Polymers for the Delivery of Macromolecular Therapeutics," Bioconjugate Chem., 1999, p. 1068-1074, vol. 10.
Harborth, J., et al., "Sequence, chemical, and structural variation of small interfering RNAs and short hairpin RNAs and the effect on mammalian gene silencing," Antisense & Nucleic Acid Drug Development, Apr. 1, 2003, pp. 83-105, vol. 13, No. 2.
Hofland, H.E.J. et al., "Formulation and Delivery of Nucleic Acids," Novel Therapeutics from Modern Biotechnology, 1999, p. 166-192.
Nolen et al. "Positional effects of short interfering RNAs targeting the human coagulation trigger Tissue Factor," Nucleic Acid Res. 2002, 30:1757-1766.
Hsu et al., "Immunogenicity of Recombinant Adenovirus-Respiratory Syncytial Virus Vaccines with Adenovirus Types 4, 5, and 7 Vecotrs in Dogs and Chimpanzee," The Journal of Infectious Diseases 166:769-775 (1992).
Hu et al., "Topical Delivery of Cyclosporin a from Non-Ionic Liposomal Systems: An In Vovo/In Vitro Correlation Study Using Hairless Mouse Skin," S.T.P. Pharma Sciences, 4: 377-379 (1994).
Huber et al., "Retroviral-Mediated Gene Therapy for the Treatment of Hepatocellular Carcinoma: An Innovative Approach for Cancer Therapy" Proc. Natl. Acad. Sci. USA, 88: 8039-8043 (1991).
Hwu et al., "Functional and Molecular Characterization of Tumor-Infiltrating Lymphocytes Transduced with Tumor Necrosis Factor-.alpha. cDNA for the Gene Therapy of Cancer in Humans," The Journal of Immunology 150: 4104-4115 (1993).
Ilium et al., "The Organ Uptake of Intravenously Administered Collodial Particles can be Altered Using a Non-Ionic Surfactant (Poloxamer 338)," FEBS 167:79-82 (1984).
Ishiwata, H., et al., "Physical-Chemistry Characteristics and Biodistribution of Poly(ethylene glycol)-Coated Liposomes Using Poly(oxyethylene) Cholesteryl Ether," Pharmaceutical Society of Japan, Jun. 1995, p. 1005-1011, vol. 43.
Izant J., et al., "Constitutive and Conditional Suppression of Exogenous and Endogenous Genes by Anti-Sense RNA" Science 229:345-352 (1985).
Jolliet-Riant, P., et al., "Drug transfer across the blood-brain barrier and improvement of brain delivery," Fundam. Clin, Pharmacol., 1996, p. 16-26, vol. 13.
Kabanov et al., "A New Class of Antivirals: Antisense Oligonucleotides Combined with a Hydrophobic Substituent Effitively Inhibit Influenza Virus Reproduction and Synthesis of Virus-Specific Proteins in MDCK Cells" FEB 259(2): 327-330 (1990).
Kapoor et al., "Probing Spindle Assembly Mechanisms with Monastrol, A Small Molecule Inhibitor of the Mototic Kinesin, Eg5," The Journal of Cell Biology, 150:975-988 (2000).
Karpeisky et al., "Highly Efficient Synthesis of 2'-O-Amino Nucleosides and Their Incorporation in Hammerhead Ribozymes" Tetrahedron Lett. 39:1131-1134 (1998).
Kashani-Sabet et al., "Reversal of the Malignant Phenotype by an Anti-ras Ribozyme" Antisense Res. Dev. 2:3-15 (1992).
Kay et al., "Hepatic Gene Therapy: Persistent Expression of Human .alpha.I-Antitypsin in Mice after Direct Gene Delivery in Vivo," Human Gene Therapy 3: 641-647 (1992).
Kawaski et al., "Uniformly Modified 2'-Deoxy-2'-fluoro Phosphorothioate Oligonucleotides as Nuclease-Resistant Antisense Compounds with High Affinity and Specificity for RNA Targets" J. Med. Chem. 36:831-841 (1993).
Klibanov et al., "Amphipathic Polyethyleneglycols Effectively Prolong the Circulation Time of Liposomes," FEBS 268:235-237 (1990).
Kumar et al., "Express Protocol for Functionalization of Polymer Supports for Oligonucleotide Synthesis" Nucleosides & Nucleotides 15(4):879-888 (1996).

(56) References Cited

OTHER PUBLICATIONS

Lasic, D., et al., "Liposomes Revisited," Science, Mar. 3, 1995, 1275-1276, vol. 267.
Lasic, D., et al., "The "Stealth" Liposome: A Prototypical Biomaterial," Chemical Reviews, Dec. 1995, p. 2601-2628, vol. 95, No. 8.
Lee et al., "Mucosal Penetration Enhancers for Facilitation of Peptide and Protein Drug Absorption," Critical Reviews in Therapeutic Drug Carrier Systems, 8:91-192 (1991).
Lee, K., et al., "Modified Liposome Formulations for Cytosolic Delivery for Macromolecules," Controlled Drug Delivery, Designing Technologies for the Future, 2000, p. 184-192.
Letsinger et al., "Cholesteryl-Conjugated Oligonucleotides: Synthesis, Properties, and Activity as Inhibitors of replication of Human Immunodeficiency Virus in Cell Culture" Proc. Natl. Acad. Sci. USA 86: 6533-6556 (1989).
Liu, Y., et al., "Cationic Liposome-mediated Intravenous Gene Delivery," The Journal of Biological Chemistry, Jun. 30, 1995, p. 24864-24870, vol. 270, No. 42.
Manoharan et al., "Chemical Modifications to Improve Uptake and Bioavailability of Anisense Oligonucleotides", Annals of the New York Academy of Sciences, 660: 306-308 (1992).
Manoharan et al., "Cholic Acid-Oligonucleotide Conjugates for Antisense Applications" Bioorganic & Medicinal Chemistry Letters 4(8): 1053-1060 (1994).
Manoharan et al., "Introduction of a Lipophilic Thioehter Tether in the Minor Groove of Nucleic Acids for Antisense Applications" Bioorganic & Medicinal Chemistry Letters 13(12):2765-2770 (1993).
Manoharan et al., "Lipidic Nucleic Acids" Tetrahedron Letters 36(21): 3651-3654 (1995).
Manoharan et al., "Oligonucleotide Conjugates: Alteration of the Pharmacokinetic Properties of Antisense Agents" Nucleosides & Nucleotides 14(3-5): 969-973 (1995).
Martin, Pierre, "Streoselektive Sytheses von 2'-o-(2-Methoxyethyl)ribonucleosiden: Nachbargruppenbeteiligung der Methoxyethoxy-Gruppe bei der Ribosylierung von Heterocyclen," Helvetica Chimica Acta 79: 1930-1938 (1996).
Maurer et al., "Lipid-based systems for the intracellular delivery of genetics Drugs," Molecular Membrane Biology, 16:129-140, 1999.
Mayer, T. U. et. al. "Small Molecule Inhibitor of Mitotic Spindle Bipolarity Identified in a Phenotype-Based Screen," Science, Oct. 1999, pp. 971-974, vol. 286, No. 5441.
McGarry T., et al., "Inhibition of heat shock protein synthesis by heat-inducible antisense RNA" Proc. Nat. Acad. Sci. USA 83:399-403, Jan. 1986.
Miller, Dusty A., "Retrovirus Packaging Cells," Human Gene Therapy, 1:5-14 (1990).
Mishra et al., "Improved Leislunanicidal Effect of Phosphorotioate Antisense Oligonucleotides by LDL-Mediated Delivery" Biochimica et Biophysica Acta 1264: 229-237 (1995).
Miyao et al., "Stability and Pharmacokinetic Characteristics of Oligonucleotides Modified at Terminal Linkages in Mice," Antisense Research and Development, 5:115-121 (1995).
Muranishi, S., "Absorption Enhancers," Critical Reviews in Therapeutic Drug Carrier Systems, 7(1): 1-33 (1990).
Muzyczka, N., "Use of Adeno-Associated Virus as a General Transduction Vector for Mammalian Cells," Current Topics in Microbiology and Immunology, 158: 97-129 (1992).
Nykanen et al., "ATP Requirements and Small Interfering RNA Structure in the RNA Interference Pathway" Cell, Nov. 2, 2001, p. 309-321, vol. 107.
Oberhauser et al., "Effectve Incorporation of 2'-O-Methly-Oligoribonucleotides Into Liposomes and Enhanced Cell Association Through Modification with Thiocholesterol" Nucleic Acids Research, 20(3): 533-538 (1992).
Ohkawa et al., "Activities of HIV-RNA targeted ribozymes transcribed from a 'shot-gun' type ribozyme-trimming plasmid" Nucleic Acids Symp. Ser. No. 27, 1992, p. 15-16.

Ojwang at al., "Inhibition of human immunodeficiency virus type I expression by a hairpin ribozyme," Proc. Natl. Acad. Sci. USA, Nov. 1992, p. 10802-10806, vol. 89.
Oku et al., "Real-time analysis of liposomal trafficking in tumor-bearing mice by use of positron emission tomography" Biochimica et Biophysics Acta 1238, 1995, p. 86-90.
Papahadjopoulos et al., "Targeting Liposomes to Tumor Cells in Vivo," Annals of the New York Academy of Sciences, 507: 64-74 (1987).
Pardridge et al., "Vector-mediated delivery of a polyamide ('peptide') nucleic acid analogue through the blood-brain barrier in vivo" Proc. Natl. Acad. Sci. USA, Jun. 1995, p. 5592-5596, vol. 92.
Perreault et al., "Mixed deoxyribo- and ribo-oligonucleotides with catalytic activity" Nature, Apr. 5, 1990, p. 565-567, col. 344.
Pieken et al., "Kinetic Characterization of Ribonuclease-Resistant 2'-Modified Hammerhead Ribozymes," Science, Jul. 19, 1991, p. 314-317, vol. 253.
Prakash et al., "Synthesis of 2'-O[2-[(N,M'Dimethylamino)oxy]ethyl] Modified Nucleosides and Olionucleotides" J. Org. Chem., 2002, p. 357-369, vol. 67.
Rabinowitz et al., "Cross-Packaging of a Single Adeno-Associated Virus (AAV) Type 2 Vector Genome into Muliple AAV Serotypes Enables Transduction with Broad Specificity," Journal of Virology, 76:791-701 (2002).
Reich et al., "Small interfering RNA (siRNA) targeting VEGF effectively inhibits ocular neovascularization in a mouse model" Molecular Vision, May 30, 2003, p. 210-216, vol. 9.
Rosenfeld et al., "In Vivo Transfer of the Human Cystic Fibrosis Transmembrane Conductance Regulator Gene to the Airway Epithelium," Cell 68:143-155 (1992).
Rubinson et al., "A Lentivirus-Based System to Functionally Silence Genes in Primary Mammalian Cells,. Stem Cells and Transgenic Mice by RNA Interference," Nature Genetics, 33: 401-406 (2003).
Saison-Behmoaras et al., "Short Modified Antisense Oligonucleotides Directed Against Ha-ras Point Mutation Induce Selective Cleavage of the mRNA and Inhibit T24 Cells Proliferation" EMBO J., 10: 1111-1118 (1991).
Samulski et al., "A Recombinant Plasmid from Which an Infectious Adeno-Associated Virus Genome Can be Excised in Vitro and Its Use to Study Viral Replication," Journal of Virology, 61:3096-3101 (1987).
Samulski et al., "Helper-Free Stocks of Recombinant Adeno-Associated Viruses: Normal Integration Does Not Require Viral Gene Expression," Journal of Virology 63:3822-3828 (1989).
Sarver et al., "Ribozymes as Potential Anti-HIV-1 Therapeutic Agents" Science, Mar. 9, 1990, p. 1222-1225, vol. 247.
Scanlon et al., "Ribozyme-mediated cleavage of c-fos mRNA reduces gene expression of DNA synthesis enzymes and metallothionein" Proc. Natl. Acad. Sci. USA, Dec. 1991, p. 10591-10595, vol. 88.
Shea et al., "Synthesis, Hybridization Properties and Antiviral Activity of Lipid-Oligodeoxynucleotide Conjugates" Nucleic Acids Research 18(13): 3777-3783 (1990).
Sunamoto et al., "Liposomeal Membranes. V. Interaction of Zinc (II) Ion with Egg Phosphatidylcholine Liposomes," Bull. Chem. Soc. Jpn., 53: 2778-2781 (1980).
Svinarchuk et al., "Inhibition of HIV Proloferation in MT-4 Cells by Antisense Oligonucleotide Conjugated to Lipophilic Groups" Biochimie 75: 49-54 (1993).
Taira et al., "Construction of a novel RNA-transcript-trimming plasmid which can be used both in vitro in place of run-off and (G)-free transcriptions and in vivo as multi-sequences transcription vectors" Nucleic Acids Research, 1991, p. 5125-5130, vol. 19, No. 19.
Takahashi et al., "The Use of a Perfluorochemical Emulsion as a Vascular Perfusate in Drug Absorption," J. Pharm. Phramacol. 40:252-257 (1988).
Takakura et al., "Uptake Characteristics of Oligonucleotides in the Isolated Rat Liver Perfusion System," Antisense & Nucleic Acid Drug Development 6:177-183 (1996).

(56) References Cited

OTHER PUBLICATIONS

Takimoto, C., et al., "Safety and anti-tumor activity of sorafenib (Nexavar .RTM.) in combination with other anti-cancer agents: a review of clinical trials," Cancer Chemotherapy and Pharmacology, Apr. 2008, pp. 535-548, vol. 61, No. 4.
Thompson et al., "Improved accumulation and activity of ribozymes expressed from a tRNA-based RNA of erase III promoter" Nucleic Acids Research, 1995, p. 2259-2268, vol. 23, No. 12.
Tyler et al., "Peptide nucleic acids targeted to the neurotensin receptor and administered i.p. cross the blood-brain barrier and specifically reduce gene expression" Proc. Natl. Acad. Sci. USA, Jun. 1999, vol. 96, p. 7053-7058.
Tyler et al., "Specific gene blockade shows that peptide nucleic acids readily enter neuronal cells in vivo," FEBS Letters, 1998, p. 280-284, vol. 421.
Usman et al., "Chemical modification of hammerhead ribozymes: activity and nuclease resistance," Nucleic Acids Symposium Series, 1994, No. 31, p. 163-164.
Usman et al., "Exploiting the chemical synthesis of RNA" Trends Biochem. Sci. 17:334-339 (1992).
Van Beusechem et al., "Long-Term Expression of Human Adenosine Deaminase in Rhesus Monkeys Transplanted With Retrovirus-Infected Bone-Marrow Cells" Proc. Natl. Acad. Sci. USA, 89: 7640-7644 (1992).
Ventura et al., "Activation of HIV-specific ribozyme activity by self-cleavage" Nucleic Acids Research, 1993, p. 3249-3255, vol. 21, No. 14.
Verma et al., "Modified Oligonucleotides: Synthesis and Strategy for Users" Annu. Rev. Biochem. 1998, p. 99-134, vol. 67, No. 99.
Vickers, T., et al., "Efficient Reduction of Target RNAs by Small Interfering RNA and RNase H-dependent Antisense Agents," The Journal of Biological Chemistry, Feb. 28, 2003, pp. 7108-7118, vol. 278, No. 9.
Wang et al., "Plasmid DNA Absorbed to pH-Sensitive Liposomes Efficiently Transforms the Target Cells," Biochemical and Biophysical Research Communications, 147:980-985 (1987).
Weiner et al., "Liposomes: A Novel Topical Delivery System for Pharmaceutical and Cosmetic Applications," Journal of Drug Targeting 2:405-410 (1994).
Weerasinghe et al., "Resistance to Human Immunodeficiency Virus Type I (HIV-1) Infection in Human CD4+ Lymphocyte-Derived Cell Lines Conferred by Using Retroviral Vectors Expressing an HIV-1 RNA-Specific Ribozyme" Journal of Virology, 1991, p. 5531-5534, vol. 65, No. 10.
Wincott et al., "Synthesis, deprotection, analysis and purification of RNA and ribozymes" Nucleic Acids Research, 1995, p. 2677-2684, vol. 23, No. 14.
Wilson et al., "Retrovirus-Mediated Transduction of Adult Hepatocytes" Proc. Natl. Acad. Sci. USA, 85: 3014-3018 (1988).
Xia et al., "siRNA-Mediated Gene Silencing in Vitro and in Vivo," Nature Biotechnology, 20:1006-1010 (2002).
Yang et al., "Evidence That Processed Small dsRNAs May Mediate Sequence-Specific mRNA Degradation during RNAi in *Drosophila* embryos" Current Biology 10: 1191-1200 (2000).
Zhou et al., "Targeted Delivery of DNA by Liposomes and Polymers, "Journal of Controlled Release 19:269-274 (1992).
Zimmerman, et al., "RNAi-mediated gene silencing in non-human primates," Nature, May 4, 2006, pp. 111-114, With supplementary information, vol. 441.
Agrawal, S., et al., "Antisense oligonucleotides: towards clinical trials." Trends in Biotechnology. Oct. 1996, vol. 14, pp. 376-387.
Byrom, M., et al., "Inducing RNAi with siRNA Cocktails Generated by RNase III," Ambiom, TechNotes 10(1), 2004, 8 Pages [online] [Archived on web.archive.org on Jan. 1, 2004] [Retrieved on Jun. 13, 2013] Retrieved from the internet <URL:http://web.archive.org/web/20040101035700/http://www.ambion.com/techlib/tn/101/4.html>.
Cui, W., et al., "OptiRNAi, an RNAi design tool," Computer Methods and Programs Biomedicine, 2004, vol. 75, p. 67-73.
De Fougerolles, A.R., et al., Discovery and development of RNAi Therapeutics, in "Antisense Drug Technologies: Principles, Strategies and Applications, second edition", edited by Crooke, S., Taylor and Francis, 2007, pp. 465-484.
Fire, A., "RNA-triggered Gene Silencing," Trends in Genetics, Sep. 1999, pp. 358-363, vol. 15, No. 9.
Harborth, J., et al., "Identification of essiential genes in cultured mammalian cells using small interfering RNAs," Journal of Cell Science, Oct. 2001, pp. 4557-4565, vol. 114.
Haque, S., et al., "Monastrol, a Prototype Anti-Cancer Drug That Inhibits Mitotic Kinesin, Induces Rapid Bursts of Axonal Outgrowth From Cultured Postmitotic Neurons," Cell Motility and the Cytoskeleton, 2004, vol. 58, p. 10-16.
Hornung, V., et al., "Sequence-specific potent induction of IFN-α by short interfering RNA in plasmacytoid dendritic cells through TLR7," Nature Medicine, Mar. 2005, pp. 263-270, vol. 11, No. 3.
Kim, D.H., et al., "Synthetic dsRNA Dicer substrates enhance RNAi potency and efficacy," Nature Biotechnology, Feb. 2005, pp. 222-226, vol. 23, No. 2.
Li, L., et al., "Overcoming obstacles to develop effective and safe siRNA therapeutics," Expert Opinion on Biological Therapym <ay 2009, pp. 609-619, vol. 9, No. 5.
Love, K., et al., "Lipid-like materials for low-dose, in vivo gene silencing," PNAS, Feb. 2, 2010, pp. 1864-69, vol. 107, No. 5.
Luo, L., et al., "Mechanism of Inhibition of Human KSP by Monastrol: Insights from Kinetic Analysis and the Effect of Ionic Strength on KSP Inhibition," Biochemistry, 2004, vol. 43, p. 15258-15266.
Robbins, M., et al., "Stable expression of shRNAs in human CD34+progenitor cells can avoid induction of interferon responses to siRNAs in vitro," Nature Biotechnology, May 2006, pp. 566-571, vol. 24, No. 5.
Rose, S., et al., "Functional polarity is introduced by Dicer processing of short substrate RNAs," Nucleic Acids Research, 2005, pp. 4140-4156, vol. 33, No. 13.
Sunder-Plassmann, N., et al., "Systhesis and biological evaluation of new tetrahydro-β-cardonlines as inhibitors of the mitotic kinesin Eg5," Bioorganic & Medicinal Chemistry, 2005, vol. 13, p. 6094-6111.
Tolentino, M., et al., "Intravitreal Injection of Vascular Endothelial Growth Factor Small Interfering RNA Inhibits Growth and Leakage in a Nonhuman Primate, Laser-Induced Model of Choroidal Neovascularization," The Journal of Retinal and Vitreous Diseases, 2004, pp. 132-138, vol. 24, No. 1.
Tuschl, T., "Functional genomics: RNA sets the standard," Nature, Jan. 16, 2003, vol. 421, No. 6920, pp. 220-221.
Tuschl T., "RNA Interference and Small Interfering RNAs" Chembiochem, 2001, pp. 239-245, vol. 2.
Tuschl, T., et al., "Small Interfering RNAs: A Revolutionary Tool for the Analysis of Gene Function and Gene Therapy," Molecular Interventions, 2002, pgs. 158-167, vol. 2, No. 3.
Tuschl, T., "Mammalian RNA Interference," RNAi, A Guide to Gene Silencing, Chapter 13, G.J. Hannon (ed,), 2003, pp. 265-295.
Tuschl, T., et al., "Targeted mRNA Degradation by Double-Stranded RNA In Vitro," Genes & Development, 1999, pp. 3191-3197, vol. 13.
Tuschl, T., "Expanding small RNA interference," Nature Biotechnology, May 2002, pp. 446-448, vol. 20.
Zhu, A., et al., "Development of sofafenib and other molecularly targeted agents in hepatocellular carcinoma," Cancer, Jan. 2008, pp. 250-259, vol. 112, No. 2.
Patent Interference No. 105,792: Bumcrot v. Maclachlan v. Bumcrot, U.S. Appl. No. 11/694,215 v. U.S. Appl. No. 11/807,872 v. U.S. Appl. No. 13/165,568; Declaration date Feb. 28, 2011; Judgment Date Nov. 30, 2012; Distribution Date Nov. 30, 2013.

\* cited by examiner

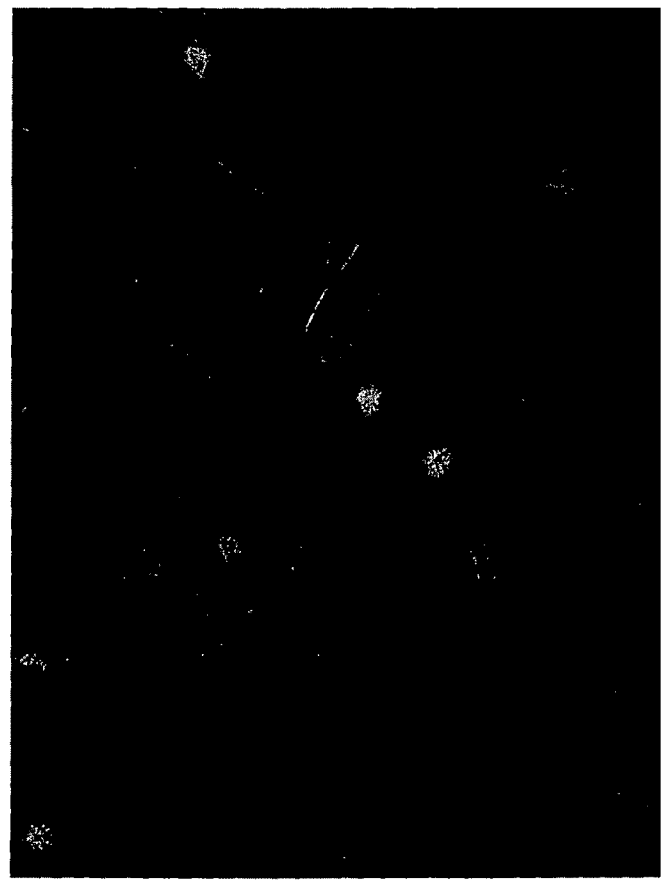
Figure 5

| | Sense/AS |
|---|---|
| 1 | 0/0 |
| 2 | U/0 |
| 3 | G/0 |
| 4 | 0/U |
| 5 | 0/G |
| 6 | U/U |
| 7 | U/G |
| 8 | G/G |
| 9 | G/U |

5' C U G A A G A C C U G A A G A C A A U dT dT sense
3' dT dT G A C U U C U G G A C U U C U G U U A   antisense 5' C [U] G A A G A C C U G A A G A C A A [U] dT dT sense
3' dT dT G A C U U C U G G A C U U C U G U U A   antisense 5' C U [G] A A G A C C U G A A G A C A A U dT dT sense
3' dT dT G A C U U C U G G A C U U C U G U U A   antisense 5' C U G A A G A C C U G A A G A C A A U dT dT sense
3' dT dT G A C [U] [U] C [U] G G A C [U] [U] C [U] G [U] [U] A   antisense 5' C U G A A G A C C U G A A G A C A A U dT dT sense
3' dT dT [G] A C U U C U [G] [G] A C U U C U [G] U U A   antisense 5' C [U] G A A G A C C U G A A G A C A A [U] dT dT sense
3' dT dT G A C [U] [U] C [U] G G A C [U] [U] C [U] G [U] [U] A   antisense 5' C [U] G A A G A C C U G A A G A C A A [U] dT dT sense
3' dT dT [G] A C U U C U [G] [G] A C U U C U [G] U U A   antisense 5' C U [G] A A [G] A C C U [G] A A [G] A C A A U dT dT sense
3' dT dT [G] A C U U C U [G] [G] A C U U C U [G] U U A   antisense 5' C U [G] A A [G] A C C U [G] A A [G] A C A A U dT dT sense
3' dT dT G A C [U] [U] C [U] G G A C [U] [U] C [U] G [U] [U] A   antisense

Figure 6

TABLE 1: Eg5 (Kif11) siRNA Sequences

| Start site | Sense strand 5p-3p – 19bp core | Sense leader-trailer | Reynolds score | %GC | Thermo (AS-S) | mRNA secondary structure |
|---|---|---|---|---|---|---|
| 196 | UCCAGGUGGUGGUGAGAUG | CA-CA | 5 | 57.9% | 1.7 | Y |
| 200 | GGUGGUGGUGAGAUGCAGA | CA-CC | 3 | 57.9% | 2.0 | M |
| 347 | UAUGGUGUUUGGAGCAUCU | GA-AC | 2 | 42.1% | 0.6 | Y |
| 349 | UGGUGUUUGGAGCAUCUAC | UA-UA | 3 | 47.4% | 0.6 | Y |
| 380 | UGUUUACCGAAGUGUUGUU | GA-UG | 6 | 36.8% | 0.5 | M |
| 390 | AGUGUUGUUUGUCCAAUUC | GA-UG | 5 | 36.8% | 1.7 | M |
| 391 | GUGUUGUUUGUCCAAUUCU | AA-GG | 5 | 36.8% | 2.5 | M |
| 413 | TGAAGUUAUUAUGGGCUAU | GA-AA | 5 | 31.6% | 0.1 | M |
| 416 | AGUUAUUAUGGGCUAUAAU | GA-UG | 3 | 26.3% | 2.1 | N |
| 417 | GUUAUUAUGGGCUAUAAUU | AA-GC | 3 | 26.3% | 2.9 | N |
| 488 | AGGUGAAAGGUCACCUAAU | GA-GA | 2 | 42.1% | 4.3 | M |
| 489 | GGUGAAAGGUCACCUAAUG | AA-AA | 3 | 47.4% | 5.2 | Y |
| 893 | UGGAGAAGAGCUUGUGUAA | GA-AT | 5 | 36.8% | 5.9 | Y |
| 1073 | UCGAGAAUCUAAACUAACU | UA-AG | 3 | 31.6% | 3.3 | M |
| 1077 | GAAUCUAAACUAACUAGAA | GA-TC | 3 | 26.3% | 1.2 | Y |
| 1172 | GGAAACUCUGAGUACAUUG | GA-GA | 2 | 42.1% | 1.9 | M |
| 1176 | ACUCUGAGUACAUUGGAAU | AA-AU | 2 | 36.8% | 1.1 | M |
| 1177 | CUCUGAGUACAUUGGAAUA | AA-UG | 3 | 36.8% | 3.5 | N |
| 1256 | AGCUCUUAUUAAGGAGUAU | AA-AC | 0 | 31.6% | 3.3 | Y |
| 1257 | GCUCUUAUUAAGGAGUAUA | AA-CG | 1 | 31.6% | 5.2 | M |
| 1478 | ACUUGACCAGUGUAAAUCU | GA-GA | 6 | 36.8% | 0.8 | Y |
| 1487 | GUGUAAAUCUGACCUGCAA | CA-AA | 5 | 42.1% | 0.4 | Y |
| 2262 | ACUGAAGACCUGAAGACAA | UA-UA | 8 | 42.1% | 0.7 | M |
| 2263 | CUGAAGACCUGAAGACAAU | AA-AA | 8 | 42.1% | 2.2 | M |
| 2267 | AGACCUGAAGACAAUAAAG | GA-CA | 8 | 36.8% | 3.8 | M |
| 2331 | GAGAGAUUCUGUGCUUUGG | CA-AG | 5 | 47.4% | 2.4 | M |

Figure 21

TABLE 2: Eg5 (Kif11) siRNA Sequences

| HEg5 21bp Start Pos | 19bp core hEg5 start bp | Sense | Antisense |
|---|---|---|---|
| 389 | 391 | GUGUUGUUUGUCCAAUUCUdTdT | AGAAUUGGACAAACAACACdTdT |
| 415 | 417 | GUUAUUAUGGGCUAUAAUUdTdT | AAUUAUAGCCCAUAAUAACdTdT |
| 486 | 488 | AGGUGAAAGGUCACCUAAUdTdT | AUUAGGUGACCUUUCACCUdTdT |
| 487 | 489 | GGUGAAAGGUCACCUAAUGdTdT | CAUUAGGUGACCUUUCACCdTdT |
| 891 | 893 | UGGAGAAGAGCUUGUUAAAdTdT | UUUAACAAGCUCUUCUCCAdTdT |
| 1071 | 1073 | UCGAGAAUCUAAACUAACUdTdT | AGUUAGUUUAGAUUCUCGAdTdT |
| 1170 | 1172 | GGAAACUCUGAGUACAUUGdTdT | CAAUGUACUCAGAGUUUCCdTdT |
| 1175 | 1177 | CUCUGAGUACAUUGGAAUAdTdT | UAUUCCAAUGUACUCAGAGdTdT |
| 1254 | 1256 | AGCUCUUAUUAAGGAGUAUdTdT | AUACUCCUUAAUAAGAGCUdTdT |
| 1255 | 1257 | GCUCUUAUUAAGGAGUAUAdTdT | UAUACUCCUUAAUAAGAGCdTdT |
| 1476 | 1478 | ACUUGACCAGUGUAAAUCUdTdT | AGAUUUACACUGGUCAAGUdTdT |
| 2260 | 2262 | ACUGAAGACCUGAAGACAAdTdT | UUGUCUUCAGGUCUUCAGUdTdT |
| 2261 | 2263 | CUGAAGACCUGAAGACAAUdTdT | AUUGUCUUCAGGUCUUCAGdTdT |
| 2265 | 2267 | AGACCUGAAGACAAUAAAGdTdT | CUUUAUUGUCUUCAGGUCUdTdT |
| 2329 | 2331 | GAGAGAUUCUGUGCUUUGGdTdT | CCAAAGCACAGAAUCUCUCdTdT |

Figure 22

TABLE 3: EGFR siRNA Sequences

| bp start (human) | Sense strand target 5p-3p – 19bp + TT |
|---|---|
| 510 | UGUCCUCAUUGCCCUCAACUTT |
| 511 | GUCCUCAUUGCCCUCAACAUU |
| 512 | UCCUCAUUGCCCUCAACACUU |
| 816 | UGAUCCAAGCUGUCCCAAUUU |
| 817 | GAUCCAAGCUGUCCCAAUGUU |
| 854 | GAGAGGAGAACUGCCAGAAUU |
| 855 | AGAGGAGAACUGCCAGAAAUU |
| 928 | CCCAGUGACUGCUGCCACAUU |
| 929 | CCAGUGACUGCUGCCACAAUU |
| 1252 | GUGUGUAACGGAAUAGGUAUU |
| 1986 | CCAGUGCCACUACACAUUUU |
| 1987 | CAGUGCCACUACACAUUGUU |
| 1988 | AGUGCCCACUACACAUUGAUU |
| 2438 | GGAUCCCAGAAGGUGAGAAUU |
| 2439 | GAUCCCAGAAGGUGAGAAAUU |
| 2440 | AUCCCAGAAGGUGAGAAAGUU |
| 2441 | UCCCAGAAGGUGAGAAAGUUU |
| 2793 | GCAUGUCAAGAUCACAGAUUU |
| 2794 | CAUGUCAAGAUCACAGAUUUU |
| 2795 | AUGUCAAGAUCACAGAUUUUU |
| 2872 | GUGCCUAUCAAGUGGAUGGUU |
| 3068 | UCGAUGUCUACAUGGAUCAUU |
| 3086 | UGGUCAAGUGCUGGAUGAUUU |
| 3087 | GGUCAAGUGCUGGAUGAUAUU |
| 3088 | GUCAAGUGCUGGAUGAUAGUU |
| 3194 | GGGAUGAAAGAAUGCAUUUUU |
| 3195 | GGAUGAAAGAAUGCAUUUGUU |
| 3755 | CUGACUACCAGGACUUUUU |
| 3757 | GACUACCAGGACUUUUUU |
| 3758 | ACUACCAGGACUUUUUUU |

Figure 23

TABLE 4: EGFR siRNA Sequences

| bp start (human) | Sense 5p-3p – 19bp + TT | AntiSense 5p-3p – 19bp + TT |
|---|---|---|
| 511 | GUCCUCAUUGCCCUCAACAUTT | UGUUGAGGGCAAUGAGGACTT |
| 512 | UCCUCAUUGCCCUCAACACTT | GUGUUGAGGGCAAUGAGGATT |
| 816 | UGAUCCAAGCUGUCCCAAUTT | AUUGGGACAGCUUGGAUCATT |
| 817 | GAUCCAAGCUGUCCCAAUGTT | CAUUGGGACAGCUUGGAUCTT |
| 1252 | GUGUGUAACGGAAUAGGUATT | UACCUAUUCCGUUACACACTT |
| 1986 | CCAGUGUGCCACUACAUUTT | AAUGUAGUGGGCACACUGGTT |
| 2440 | AUCCCAGAAGGUGAGAAAGTT | CUUUCUCACCUUCUGGGAUTT |
| 2795 | AUGUCAAGAUCACAGAUUUTT | AAAUCUGUGAUCUUGACAUTT |
| 3068 | UCGAUGUCUACAUGAUCAUTT | AUGAUCAUGUAGACAUCGATT |
| 3088 | GUCAAGUGCUGGAUGAUAGTT | CUAUCAUCCAGCACUUGACTT |
| 3755 | CUGACUACCAGCAGGACUUTT | AAGUCCUGCUGGUAGUCAGTT |
| 3757 | GACUACCAGCAGGACUUCUTT | AGAAGUCCUGCUGGUAGUCTT |
| 3758 | ACUACCAGCAGGACUUCUUTT | AAGAAGUCCUGCUGGUAGUTT |

Figure 24

TABLE 5: XIAP siRNA Sequences

| bp start (human) | Sense strand target (5p-3p – 19bp + TT) |
|---|---|
| 5'UTR1 | AAGGUGGACAAGUCCUAUUTT |
| 5'UTR2 | AGGUGGACAAGUCCUAUUUTT |
| 64 | GAAUUGUAGAAGAGAGUUUAUTT |
| 67 | UUUGUAGAAGAGUUUAAAUATT |
| 70 | GUAGAAGAGUUUAAUAGAUTT |
| 72 | AGAAGAGUUUAAUAGAUUATT |
| 73 | GAAGAGUUUAAUAGAUUAATT |
| 74 | AAGAGUUUAAUAGAUUAAUTT |
| 113 | GUGGUAGUCCUGUUUCAGCTT |
| 118 | AGUCCUGUUUCAGCAUCAATT |
| 119 | GUCCUGUUUCAGCAUCAACTT |
| 120 | UCCUGUUUCAGCAUCAACATT |
| 261 | CCCAAAUUGCAGAUUUAUCTT |
| 300 | UAGUGCCAGCAGUCUACATT |
| 732 | GAGUUCAGUAGGAAUUUCTT |
| 738 | UGAUAGGAAUUUCCCAAAUTT |
| 739 | GAUAGGAAUUUCCCAAAUUTT |
| 741 | UAGGAAUUUCCCAAAUUCATT |
| 742 | AGGAAUUUCCCAAAUUCAATT |
| 849 | GCUUGCAAGAGCUGGAUUUTT |
| 1307 | GUACUGAAGAGCAGCUAAGTT |
| 1353 | AAUCUGUAUGGAUAGAAAUTT |
| 1354 | AUCUGUAUGGAUAGAAAUATT |
| 1355 | UCUGUAUGGAUAGAAAUAUTT |
| 1356 | CUGUAUGGAUAGAAAUAUUTT |
| 1361 | UGGAUAGAAAUAUUGCUAUTT |
| 1362 | GGAUAGAAAUAUUGCUAUCTT |

Figure 25

TABLE 6: XIAP siRNA Sequences

| bp start (human) | Sense 5p-3p – 19bp + TT | AntiSense 5p-3p – 19bp + TT |
| --- | --- | --- |
| 64 | GAAUUGUAGAAGAGAGUUUATT | UAAACUCUCUCUACAAAUUCTT |
| 73 | GAAGAGUUUAAUAGAUUAATT | UUAAUCUAUUAAACUCUUCTT |
| 74 | AAGAGUUUAAUAGAUUAAAATT | UUUAAUCUAUUAAACUCUUTT |
| 113 | GUGGUAGUCCUGUUUCAGCTT | GCUGAAACAGGACUACCACTT |
| 120 | UCCUGUUUCAGCAUCAACATT | UGUUGAUGCUGAAACAGGATT |
| 261 | CCCAAAUUGCAGAUUUAUCTT | GAUAAAUCUGCAAUUUGGGTT |
| 300 | UAGUGCCACGCAGUCUACATT | UGUAGACUGCGUGGCACUATT |
| 732 | GAGUUCUGAUAGGAAUUUCTT | GAAAUUCCUAUCAGAACUCTT |
| 741 | UAGGAAUUUCCCAAAUUCATT | UGAAUUUGGGAAAUUCCUATT |
| 742 | AGGAAUUUCCCAAAUUCAATT | UUGAAUUUGGGAAAUUCCUTT |
| 849 | GCUUGCAAGAGCUGGAUUUTT | AAAUCCAGCUCUUGCAAGCTT |
| 1307 | GUACUGAGAGCAGCUAAGTT | CUUAGCUGCUCUCUCAGUACTT |
| 1361 | UGGAUAGAAAUAUUGCUAUTT | AUAGCAAUAUUUCUAUCCATT |
| 1362 | GGAUAGAAAUAUUGCUAUCTT | GAUAGCAAUAUUUCUAUCCTT |

Figure 26

TABLE 7

| ID | SEQUENCE |
|---|---|
| 1 | ACCTGCGTGCAGTCGGTCCTCCA |
| 2 | CCTGCGTGCAGTCGGTCCTCCAG |
| 3 | CTGCGTGCAGTCGGTCCTCCAGG |
| 4 | TGCGTGCAGTCGGTCCTCCAGGC |
| 5 | GCGTGCAGTCGGTCCTCCAGGCC |
| 6 | CGTGCAGTCGGTCCTCCAGGCCA |
| 7 | GTGCAGTCGGTCCTCCAGGCCAC |
| 8 | TGCAGTCGGTCCTCCAGGCCACG |
| 9 | GCAGTCGGTCCTCCAGGCCACGC |
| 10 | CAGTCGGTCCTCCAGGCCACGCA |
| 11 | AGTCGGTCCTCCAGGCCACGCAG |
| 12 | GTCGGTCCTCCAGGCCACGCAGC |
| 13 | TCGGTCCTCCAGGCCACGCAGCG |
| 14 | CGGTCCTCCAGGCCACGCAGCGC |
| 15 | GGTCCTCCAGGCCACGCAGCGCC |
| 16 | GTCCTCCAGGCCACGCAGCGCCC |
| 17 | TCCTCCAGGCCACGCAGCGCCCG |
| 18 | CCTCCAGGCCACGCAGCGCCCGA |
| 19 | CTCCAGGCCACGCAGCGCCCGAG |
| 20 | TCCAGGCCACGCAGCGCCCGAGA |
| 21 | CCAGGCCACGCAGCGCCCGAGAG |
| 22 | CAGGCCACGCAGCGCCCGAGAGT |
| 23 | AGGCCACGCAGCGCCCGAGAGTA |
| 24 | GGCCACGCAGCGCCCGAGAGTAC |
| 25 | GCCACGCAGCGCCCGAGAGTACC |
| 26 | CCACGCAGCGCCCGAGAGTACCA |
| 27 | CACGCAGCGCCCGAGAGTACCAG |
| 28 | ACGCAGCGCCCGAGAGTACCAGG |
| 29 | CGCAGCGCCCGAGAGTACCAGGG |
| 30 | GCAGCGCCCGAGAGTACCAGGGA |
| 31 | CAGCGCCCGAGAGTACCAGGGAG |
| 32 | AGCGCCCGAGAGTACCAGGGAGA |
| 33 | GCGCCCGAGAGTACCAGGGAGAC |
| 34 | CGCCCGAGAGTACCAGGGAGACT |
| 35 | GCCCGAGAGTACCAGGGAGACTC |
| 36 | CCCGAGAGTACCAGGGAGACTCC |
| 37 | CCGAGAGTACCAGGGAGACTCCG |
| 38 | CGAGAGTACCAGGGAGACTCCGG |
| 39 | GAGAGTACCAGGGAGACTCCGGC |
| 40 | AGAGTACCAGGGAGACTCCGGCC |
| 41 | GAGTACCAGGGAGACTCCGGCCC |
| 42 | AGTACCAGGGAGACTCCGGCCCC |
| 43 | GTACCAGGGAGACTCCGGCCCCT |
| 44 | TACCAGGGAGACTCCGGCCCCTG |
| 45 | ACCAGGGAGACTCCGGCCCCTGT |
| 46 | CCAGGGAGACTCCGGCCCCTGTC |
| 47 | CAGGGAGACTCCGGCCCCTGTCG |
| 48 | AGGGAGACTCCGGCCCCTGTCGG |
| 49 | GGGAGACTCCGGCCCCTGTCGGC |
| 50 | GGAGACTCCGGCCCCTGTCGGCG |
| 51 | GAGACTCCGGCCCCTGTCGGCGC |
| 52 | AGACTCCGGCCCCTGTCGGCGCC |
| 53 | GACTCCGGCCCCTGTCGGCGCCA |
| 54 | ACTCCGGCCCCTGTCGGCGCCAA |
| 55 | CTCCGGCCCCTGTCGGCGCCAAG |

| ID | SEQUENCE |
|---|---|
| 56 | TCCGGCCCCTGTCGGCGCCAAGC |
| 57 | CCGGCCCCTGTCGGCGCCAAGCC |
| 58 | CGGCCCCTGTCGGCGCCAAGCCC |
| 59 | GGCCCCTGTCGGCGCCAAGCCCC |
| 60 | GCCCCTGTCGGCGCCAAGCCCCT |
| 61 | CCCCTGTCGGCGCCAAGCCCCTC |
| 62 | CCCTGTCGGCGCCAAGCCCCTCC |
| 63 | CCTGTCGGCGCCAAGCCCCTCCG |
| 64 | CTGTCGGCGCCAAGCCCCTCCGC |
| 65 | TGTCGGCGCCAAGCCCCTCCGCC |
| 66 | GTCGGCGCCAAGCCCCTCCGCCC |
| 67 | TCGGCGCCAAGCCCCTCCGCCCC |
| 68 | CGGCGCCAAGCCCCTCCGCCCCT |
| 69 | GGCGCCAAGCCCCTCCGCCCCTC |
| 70 | GCGCCAAGCCCCTCCGCCCCTCA |
| 71 | CGCCAAGCCCCTCCGCCCCTCAC |
| 72 | GCCAAGCCCCTCCGCCCCTCACA |
| 73 | CCAAGCCCCTCCGCCCCTCACAG |
| 74 | CAAGCCCCTCCGCCCCTCACAGC |
| 75 | AAGCCCCTCCGCCCCTCACAGCG |
| 76 | AGCCCCTCCGCCCCTCACAGCGC |
| 77 | GCCCCTCCGCCCCTCACAGCGCC |
| 78 | CCCCTCCGCCCCTCACAGCGCCC |
| 79 | CCCTCCGCCCCTCACAGCGCCCA |
| 80 | CCTCCGCCCCTCACAGCGCCCAG |
| 81 | CTCCGCCCCTCACAGCGCCCAGG |
| 82 | TCCGCCCCTCACAGCGCCCAGGT |
| 83 | CCGCCCCTCACAGCGCCCAGGTC |
| 84 | CGCCCCTCACAGCGCCCAGGTCC |
| 85 | GCCCCTCACAGCGCCCAGGTCCG |
| 86 | CCCCTCACAGCGCCCAGGTCCGC |
| 87 | CCCTCACAGCGCCCAGGTCCGCG |
| 88 | CCTCACAGCGCCCAGGTCCGCGG |
| 89 | CTCACAGCGCCCAGGTCCGCGGC |
| 90 | TCACAGCGCCCAGGTCCGCGGCC |
| 91 | GCCGGGCCTTGATTTTTTGGCGG |
| 92 | CCGGGCCTTGATTTTTTGGCGGG |
| 93 | CGGGCCTTGATTTTTTGGCGGGG |
| 94 | GGGCCTTGATTTTTTGGCGGGGA |
| 95 | GGCCTTGATTTTTTGGCGGGGAC |
| 96 | GCCTTGATTTTTTGGCGGGGACC |
| 97 | CCTTGATTTTTTGGCGGGGACCG |
| 98 | CTTGATTTTTTGGCGGGGACCGT |
| 99 | ATGGCGTCGCAGCCAAATTCGTC |
| 100 | TGGCGTCGCAGCCAAATTCGTCT |
| 101 | GGCGTCGCAGCCAAATTCGTCTG |
| 102 | GCGTCGCAGCCAAATTCGTCTGC |
| 103 | CGTCGCAGCCAAATTCGTCTGCG |
| 104 | GTCGCAGCCAAATTCGTCTGCGA |
| 105 | TCGCAGCCAAATTCGTCTGCGAA |
| 106 | CGCAGCCAAATTCGTCTGCGAAG |
| 107 | GCAGCCAAATTCGTCTGCGAAGA |
| 108 | CAGCCAAATTCGTCTGCGAAGAA |
| 109 | AGCCAAATTCGTCTGCGAAGAAG |
| 110 | GCCAAATTCGTCTGCGAAGAAGA |
| 111 | CCAAATTCGTCTGCGAAGAAGAA |
| 112 | CAAATTCGTCTGCGAAGAAGAAA |
| 113 | AAATTCGTCTGCGAAGAAGAAAG |

| ID | SEQUENCE |
|---|---|
| 114 | AATTCGTCTGCGAAGAAGAAAGA |
| 115 | ATTCGTCTGCGAAGAAGAAAGAG |
| 116 | TTCGTCTGCGAAGAAGAAAGAGG |
| 117 | TCGTCTGCGAAGAAGAAAGAGGA |
| 118 | CGTCTGCGAAGAAGAAAGAGGAG |
| 119 | GTCTGCGAAGAAGAAAGAGGAGA |
| 120 | TCTGCGAAGAAGAAAGAGGAGAA |
| 121 | CTGCGAAGAAGAAAGAGGAGAAG |
| 122 | TGCGAAGAAGAAAGAGGAGAAGG |
| 123 | GCGAAGAAGAAAGAGGAGAAGGG |
| 124 | CGAAGAAGAAAGAGGAGAAGGGG |
| 125 | GAAGAAGAAAGAGGAGAAGGGGA |
| 126 | AAGAAGAAAGAGGAGAAGGGGAA |
| 127 | AGAAGAAAGAGGAGAAGGGGAAG |
| 128 | GAAGAAAGAGGAGAAGGGGAAGA |
| 129 | AAGAAAGAGGAGAAGGGGAAGAA |
| 130 | AGAAAGAGGAGAAGGGGAAGAAC |
| 131 | GAAAGAGGAGAAGGGGAAGAACA |
| 132 | AAAGAGGAGAAGGGGAAGAACAT |
| 133 | AAGAGGAGAAGGGGAAGAACATC |
| 134 | AGAGGAGAAGGGGAAGAACATCC |
| 135 | GAGGAGAAGGGGAAGAACATCCA |
| 136 | AGGAGAAGGGGAAGAACATCCAG |
| 137 | GGAGAAGGGGAAGAACATCCAGG |
| 138 | GAGAAGGGGAAGAACATCCAGGT |
| 139 | AGAAGGGGAAGAACATCCAGGTG |
| 140 | GAAGGGGAAGAACATCCAGGTGG |
| 141 | AAGGGGAAGAACATCCAGGTGGT |
| 142 | AGGGGAAGAACATCCAGGTGGTG |
| 143 | GGGGAAGAACATCCAGGTGGTGG |
| 144 | GGGAAGAACATCCAGGTGGTGGT |
| 145 | GGAAGAACATCCAGGTGGTGGTG |
| 146 | GAAGAACATCCAGGTGGTGGTGA |
| 147 | AAGAACATCCAGGTGGTGGTGAG |
| 148 | AGAACATCCAGGTGGTGGTGAGA |
| 149 | GAACATCCAGGTGGTGGTGAGAT |
| 150 | AACATCCAGGTGGTGGTGAGATG |
| 151 | ACATCCAGGTGGTGGTGAGATGC |
| 152 | CATCCAGGTGGTGGTGAGATGCA |
| 153 | ATCCAGGTGGTGGTGAGATGCAG |
| 154 | TCCAGGTGGTGGTGAGATGCAGA |
| 155 | CCAGGTGGTGGTGAGATGCAGAC |
| 156 | CAGGTGGTGGTGAGATGCAGACC |
| 157 | AGGTGGTGGTGAGATGCAGACCA |
| 158 | GGTGGTGGTGAGATGCAGACCAT |
| 159 | GTGGTGGTGAGATGCAGACCATT |
| 160 | TGGTGGTGAGATGCAGACCATTT |
| 161 | GGTGGTGAGATGCAGACCATTTA |
| 162 | GTGGTGAGATGCAGACCATTTAA |
| 163 | TGGTGAGATGCAGACCATTTAAT |
| 164 | GGTGAGATGCAGACCATTTAATT |
| 165 | GTGAGATGCAGACCATTTAATTT |
| 166 | TGAGATGCAGACCATTTAATTTG |
| 167 | GAGATGCAGACCATTTAATTTGG |
| 168 | AGATGCAGACCATTTAATTTGGC |
| 169 | GATGCAGACCATTTAATTTGGCA |
| 170 | ATGCAGACCATTTAATTTGGCAG |
| 171 | TGCAGACCATTTAATTTGGCAGA |

| ID | SEQUENCE |
|---|---|
| 172 | GCAGACCATTTAATTTGGCAGAG |
| 173 | CAGACCATTTAATTTGGCAGAGC |
| 174 | AGACCATTTAATTTGGCAGAGCG |
| 175 | GACCATTTAATTTGGCAGAGCGG |
| 176 | ACCATTTAATTTGGCAGAGCGGA |
| 177 | CCATTTAATTTGGCAGAGCGGAA |
| 178 | CATTTAATTTGGCAGAGCGGAAA |
| 179 | ATTTAATTTGGCAGAGCGGAAAG |
| 180 | TTTAATTTGGCAGAGCGGAAAGC |
| 181 | TTAATTTGGCAGAGCGGAAAGCT |
| 182 | TAATTTGGCAGAGCGGAAAGCTA |
| 183 | AATTTGGCAGAGCGGAAAGCTAG |
| 184 | ATTTGGCAGAGCGGAAAGCTAGC |
| 185 | TTTGGCAGAGCGGAAAGCTAGCG |
| 186 | TTGGCAGAGCGGAAAGCTAGCGC |
| 187 | TGGCAGAGCGGAAAGCTAGCGCC |
| 188 | GGCAGAGCGGAAAGCTAGCGCCC |
| 189 | GCAGAGCGGAAAGCTAGCGCCCA |
| 190 | CAGAGCGGAAAGCTAGCGCCCAT |
| 191 | AGAGCGGAAAGCTAGCGCCCATT |
| 192 | GAGCGGAAAGCTAGCGCCCATTC |
| 193 | AGCGGAAAGCTAGCGCCCATTCA |
| 194 | GCGGAAAGCTAGCGCCCATTCAA |
| 195 | CGGAAAGCTAGCGCCCATTCAAT |
| 196 | GGAAAGCTAGCGCCCATTCAATA |
| 197 | GAAAGCTAGCGCCCATTCAATAG |
| 198 | AAAGCTAGCGCCCATTCAATAGT |
| 199 | AAGCTAGCGCCCATTCAATAGTA |
| 200 | AGCTAGCGCCCATTCAATAGTAG |
| 201 | GCTAGCGCCCATTCAATAGTAGA |
| 202 | CTAGCGCCCATTCAATAGTAGAA |
| 203 | TAGCGCCCATTCAATAGTAGAAT |
| 204 | AGCGCCCATTCAATAGTAGAATG |
| 205 | GCGCCCATTCAATAGTAGAATGT |
| 206 | CGCCCATTCAATAGTAGAATGTG |
| 207 | GCCCATTCAATAGTAGAATGTGA |
| 208 | CCCATTCAATAGTAGAATGTGAT |
| 209 | CCATTCAATAGTAGAATGTGATC |
| 210 | CATTCAATAGTAGAATGTGATCC |
| 211 | ATTCAATAGTAGAATGTGATCCT |
| 212 | TTCAATAGTAGAATGTGATCCTG |
| 213 | TCAATAGTAGAATGTGATCCTGT |
| 214 | CAATAGTAGAATGTGATCCTGTA |
| 215 | AATAGTAGAATGTGATCCTGTAC |
| 216 | ATAGTAGAATGTGATCCTGTACG |
| 217 | TAGTAGAATGTGATCCTGTACGA |
| 218 | AGTAGAATGTGATCCTGTACGAA |
| 219 | GTAGAATGTGATCCTGTACGAAA |
| 220 | TAGAATGTGATCCTGTACGAAAA |
| 221 | AGAATGTGATCCTGTACGAAAAG |
| 222 | GAATGTGATCCTGTACGAAAAGA |
| 223 | AATGTGATCCTGTACGAAAAGAA |
| 224 | ATGTGATCCTGTACGAAAAGAAG |
| 225 | TGTGATCCTGTACGAAAAGAAGT |
| 226 | GTGATCCTGTACGAAAAGAAGTT |
| 227 | TGATCCTGTACGAAAAGAAGTTA |
| 228 | GATCCTGTACGAAAAGAAGTTAG |
| 229 | ATCCTGTACGAAAAGAAGTTAGT |

| ID | SEQUENCE |
|---|---|
| 230 | TCCTGTACGAAAAGAAGTTAGTG |
| 231 | CCTGTACGAAAAGAAGTTAGTGT |
| 232 | CTGTACGAAAAGAAGTTAGTGTA |
| 233 | TGTACGAAAAGAAGTTAGTGTAC |
| 234 | GTACGAAAAGAAGTTAGTGTACG |
| 235 | TACGAAAAGAAGTTAGTGTACGA |
| 236 | ACGAAAAGAAGTTAGTGTACGAA |
| 237 | CGAAAAGAAGTTAGTGTACGAAC |
| 238 | GAAAAGAAGTTAGTGTACGAACT |
| 239 | AAAAGAAGTTAGTGTACGAACTG |
| 240 | AAAGAAGTTAGTGTACGAACTGG |
| 241 | AAGAAGTTAGTGTACGAACTGGA |
| 242 | AGAAGTTAGTGTACGAACTGGAG |
| 243 | GAAGTTAGTGTACGAACTGGAGG |
| 244 | AAGTTAGTGTACGAACTGGAGGA |
| 245 | AGTTAGTGTACGAACTGGAGGAT |
| 246 | GTTAGTGTACGAACTGGAGGATT |
| 247 | TTAGTGTACGAACTGGAGGATTG |
| 248 | TAGTGTACGAACTGGAGGATTGG |
| 249 | AGTGTACGAACTGGAGGATTGGC |
| 250 | GTGTACGAACTGGAGGATTGGCT |
| 251 | TGTACGAACTGGAGGATTGGCTG |
| 252 | GTACGAACTGGAGGATTGGCTGA |
| 253 | TACGAACTGGAGGATTGGCTGAC |
| 254 | ACGAACTGGAGGATTGGCTGACA |
| 255 | CGAACTGGAGGATTGGCTGACAA |
| 256 | GAACTGGAGGATTGGCTGACAAG |
| 257 | AACTGGAGGATTGGCTGACAAGA |
| 258 | ACTGGAGGATTGGCTGACAAGAG |
| 259 | CTGGAGGATTGGCTGACAAGAGC |
| 260 | TGGAGGATTGGCTGACAAGAGCT |
| 261 | GGAGGATTGGCTGACAAGAGCTC |
| 262 | GAGGATTGGCTGACAAGAGCTCA |
| 263 | AGGATTGGCTGACAAGAGCTCAA |
| 264 | GGATTGGCTGACAAGAGCTCAAG |
| 265 | GATTGGCTGACAAGAGCTCAAGG |
| 266 | ATTGGCTGACAAGAGCTCAAGGA |
| 267 | TTGGCTGACAAGAGCTCAAGGAA |
| 268 | TGGCTGACAAGAGCTCAAGGAAA |
| 269 | GGCTGACAAGAGCTCAAGGAAAA |
| 270 | GCTGACAAGAGCTCAAGGAAAAC |
| 271 | CTGACAAGAGCTCAAGGAAAACA |
| 272 | TGACAAGAGCTCAAGGAAAACAT |
| 273 | GACAAGAGCTCAAGGAAAACATA |
| 274 | ACAAGAGCTCAAGGAAAACATAC |
| 275 | CAAGAGCTCAAGGAAAACATACA |
| 276 | AAGAGCTCAAGGAAAACATACAC |
| 277 | AGAGCTCAAGGAAAACATACACT |
| 278 | GAGCTCAAGGAAAACATACACTT |
| 279 | AGCTCAAGGAAAACATACACTTT |
| 280 | GCTCAAGGAAAACATACACTTTT |
| 281 | CTCAAGGAAAACATACACTTTTG |
| 282 | TCAAGGAAAACATACACTTTTGA |
| 283 | CAAGGAAAACATACACTTTTGAT |
| 284 | AAGGAAAACATACACTTTTGATA |
| 285 | AGGAAAACATACACTTTTGATAT |
| 286 | GGAAAACATACACTTTTGATATG |
| 287 | GAAAACATACACTTTTGATATGG |

| ID | SEQUENCE |
|---|---|
| 288 | AAAACATACACTTTTGATATGGT |
| 289 | AAACATACACTTTTGATATGGTG |
| 290 | AACATACACTTTTGATATGGTGT |
| 291 | ACATACACTTTTGATATGGTGTT |
| 292 | CATACACTTTTGATATGGTGTTT |
| 293 | ATACACTTTTGATATGGTGTTTG |
| 294 | TACACTTTTGATATGGTGTTTGG |
| 295 | ACACTTTTGATATGGTGTTTGGA |
| 296 | CACTTTTGATATGGTGTTTGGAG |
| 297 | ACTTTTGATATGGTGTTTGGAGC |
| 298 | CTTTTGATATGGTGTTTGGAGCA |
| 299 | TTTTGATATGGTGTTTGGAGCAT |
| 300 | TTTGATATGGTGTTTGGAGCATC |
| 301 | TTGATATGGTGTTTGGAGCATCT |
| 302 | TGATATGGTGTTTGGAGCATCTA |
| 303 | GATATGGTGTTTGGAGCATCTAC |
| 304 | ATATGGTGTTTGGAGCATCTACT |
| 305 | TATGGTGTTTGGAGCATCTACTA |
| 306 | ATGGTGTTTGGAGCATCTACTAA |
| 307 | TGGTGTTTGGAGCATCTACTAAA |
| 308 | GGTGTTTGGAGCATCTACTAAAC |
| 309 | GTGTTTGGAGCATCTACTAAACA |
| 310 | TGTTTGGAGCATCTACTAAACAG |
| 311 | GTTTGGAGCATCTACTAAACAGA |
| 312 | TTTGGAGCATCTACTAAACAGAT |
| 313 | TTGGAGCATCTACTAAACAGATT |
| 314 | TGGAGCATCTACTAAACAGATTG |
| 315 | GGAGCATCTACTAAACAGATTGA |
| 316 | GAGCATCTACTAAACAGATTGAT |
| 317 | AGCATCTACTAAACAGATTGATG |
| 318 | GCATCTACTAAACAGATTGATGT |
| 319 | CATCTACTAAACAGATTGATGTT |
| 320 | ATCTACTAAACAGATTGATGTTT |
| 321 | TCTACTAAACAGATTGATGTTTA |
| 322 | CTACTAAACAGATTGATGTTTAC |
| 323 | TACTAAACAGATTGATGTTTACC |
| 324 | ACTAAACAGATTGATGTTTACCG |
| 325 | CTAAACAGATTGATGTTTACCGA |
| 326 | TAAACAGATTGATGTTTACCGAA |
| 327 | AAACAGATTGATGTTTACCGAAG |
| 328 | AACAGATTGATGTTTACCGAAGT |
| 329 | ACAGATTGATGTTTACCGAAGTG |
| 330 | CAGATTGATGTTTACCGAAGTGT |
| 331 | AGATTGATGTTTACCGAAGTGTT |
| 332 | GATTGATGTTTACCGAAGTGTTG |
| 333 | ATTGATGTTTACCGAAGTGTTGT |
| 334 | TTGATGTTTACCGAAGTGTTGTT |
| 335 | TGATGTTTACCGAAGTGTTGTTT |
| 336 | GATGTTTACCGAAGTGTTGTTTG |
| 337 | ATGTTTACCGAAGTGTTGTTTGT |
| 338 | TGTTTACCGAAGTGTTGTTTGTC |
| 339 | GTTTACCGAAGTGTTGTTTGTCC |
| 340 | TTTACCGAAGTGTTGTTTGTCCA |
| 341 | TTACCGAAGTGTTGTTTGTCCAA |
| 342 | TACCGAAGTGTTGTTTGTCCAAT |
| 343 | ACCGAAGTGTTGTTTGTCCAATT |
| 344 | CCGAAGTGTTGTTTGTCCAATTC |
| 345 | CGAAGTGTTGTTTGTCCAATTCT |

| ID | SEQUENCE |
|---|---|
| 346 | GAAGTGTTGTTTGTCCAATTCTG |
| 347 | AAGTGTTGTTTGTCCAATTCTGG |
| 348 | AGTGTTGTTTGTCCAATTCTGGA |
| 349 | GTGTTGTTTGTCCAATTCTGGAT |
| 350 | TGTTGTTTGTCCAATTCTGGATG |
| 351 | GTTGTTTGTCCAATTCTGGATGA |
| 352 | TTGTTTGTCCAATTCTGGATGAA |
| 353 | TGTTTGTCCAATTCTGGATGAAG |
| 354 | GTTTGTCCAATTCTGGATGAAGT |
| 355 | TTTGTCCAATTCTGGATGAAGTT |
| 356 | TTGTCCAATTCTGGATGAAGTTA |
| 357 | TGTCCAATTCTGGATGAAGTTAT |
| 358 | GTCCAATTCTGGATGAAGTTATT |
| 359 | TCCAATTCTGGATGAAGTTATTA |
| 360 | CCAATTCTGGATGAAGTTATTAT |
| 361 | CAATTCTGGATGAAGTTATTATG |
| 362 | AATTCTGGATGAAGTTATTATGG |
| 363 | ATTCTGGATGAAGTTATTATGGG |
| 364 | TTCTGGATGAAGTTATTATGGGC |
| 365 | TCTGGATGAAGTTATTATGGGCT |
| 366 | CTGGATGAAGTTATTATGGGCTA |
| 367 | TGGATGAAGTTATTATGGGCTAT |
| 368 | GGATGAAGTTATTATGGGCTATA |
| 369 | GATGAAGTTATTATGGGCTATAA |
| 370 | ATGAAGTTATTATGGGCTATAAT |
| 371 | TGAAGTTATTATGGGCTATAATT |
| 372 | GAAGTTATTATGGGCTATAATTG |
| 373 | AAGTTATTATGGGCTATAATTGC |
| 374 | AGTTATTATGGGCTATAATTGCA |
| 375 | GTTATTATGGGCTATAATTGCAC |
| 376 | TTATTATGGGCTATAATTGCACT |
| 377 | TATTATGGGCTATAATTGCACTA |
| 378 | ATTATGGGCTATAATTGCACTAT |
| 379 | TTATGGGCTATAATTGCACTATC |
| 380 | TATGGGCTATAATTGCACTATCT |
| 381 | ATGGGCTATAATTGCACTATCTT |
| 382 | TGGGCTATAATTGCACTATCTTT |
| 383 | GGGCTATAATTGCACTATCTTTG |
| 384 | GGCTATAATTGCACTATCTTTGC |
| 385 | GCTATAATTGCACTATCTTTGCG |
| 386 | CTATAATTGCACTATCTTTGCGT |
| 387 | TATAATTGCACTATCTTTGCGTA |
| 388 | ATAATTGCACTATCTTTGCGTAT |
| 389 | TAATTGCACTATCTTTGCGTATG |
| 390 | AATTGCACTATCTTTGCGTATGG |
| 391 | ATTGCACTATCTTTGCGTATGGC |
| 392 | TTGCACTATCTTTGCGTATGGCC |
| 393 | TGCACTATCTTTGCGTATGGCCA |
| 394 | GCACTATCTTTGCGTATGGCCAA |
| 395 | CACTATCTTTGCGTATGGCCAAA |
| 396 | ACTATCTTTGCGTATGGCCAAAC |
| 397 | CTATCTTTGCGTATGGCCAAACT |
| 398 | TATCTTTGCGTATGGCCAAACTG |
| 399 | ATCTTTGCGTATGGCCAAACTGG |
| 400 | TCTTTGCGTATGGCCAAACTGGC |
| 401 | CTTTGCGTATGGCCAAACTGGCA |
| 402 | TTTGCGTATGGCCAAACTGGCAC |
| 403 | TTGCGTATGGCCAAACTGGCACT |

| ID | SEQUENCE |
|---|---|
| 404 | TGCGTATGGCCAAACTGGCACTG |
| 405 | GCGTATGGCCAAACTGGCACTGG |
| 406 | CGTATGGCCAAACTGGCACTGGA |
| 407 | GTATGGCCAAACTGGCACTGGAA |
| 408 | TATGGCCAAACTGGCACTGGAAA |
| 409 | ATGGCCAAACTGGCACTGGAAAA |
| 410 | TGGCCAAACTGGCACTGGAAAAA |
| 411 | GGCCAAACTGGCACTGGAAAAAC |
| 412 | GCCAAACTGGCACTGGAAAAACT |
| 413 | CCAAACTGGCACTGGAAAAACTT |
| 414 | CAAACTGGCACTGGAAAAACTTT |
| 415 | AAACTGGCACTGGAAAAACTTTT |
| 416 | AACTGGCACTGGAAAAACTTTTA |
| 417 | ACTGGCACTGGAAAAACTTTTAC |
| 418 | CTGGCACTGGAAAAACTTTTACA |
| 419 | TGGCACTGGAAAAACTTTTACAA |
| 420 | GGCACTGGAAAAACTTTTACAAT |
| 421 | GCACTGGAAAAACTTTTACAATG |
| 422 | CACTGGAAAAACTTTTACAATGG |
| 423 | ACTGGAAAAACTTTTACAATGGA |
| 424 | CTGGAAAAACTTTTACAATGGAA |
| 425 | TGGAAAAACTTTTACAATGGAAG |
| 426 | GGAAAAACTTTTACAATGGAAGG |
| 427 | GAAAAACTTTTACAATGGAAGGT |
| 428 | AAAAACTTTTACAATGGAAGGTG |
| 429 | AAAACTTTTACAATGGAAGGTGA |
| 430 | AAACTTTTACAATGGAAGGTGAA |
| 431 | AACTTTTACAATGGAAGGTGAAA |
| 432 | ACTTTTACAATGGAAGGTGAAAG |
| 433 | CTTTTACAATGGAAGGTGAAAGG |
| 434 | TTTTACAATGGAAGGTGAAAGGT |
| 435 | TTTACAATGGAAGGTGAAAGGTC |
| 436 | TTACAATGGAAGGTGAAAGGTCA |
| 437 | TACAATGGAAGGTGAAAGGTCAC |
| 438 | ACAATGGAAGGTGAAAGGTCACC |
| 439 | CAATGGAAGGTGAAAGGTCACCT |
| 440 | AATGGAAGGTGAAAGGTCACCTA |
| 441 | ATGGAAGGTGAAAGGTCACCTAA |
| 442 | TGGAAGGTGAAAGGTCACCTAAT |
| 443 | GGAAGGTGAAAGGTCACCTAATG |
| 444 | GAAGGTGAAAGGTCACCTAATGA |
| 445 | AAGGTGAAAGGTCACCTAATGAA |
| 446 | AGGTGAAAGGTCACCTAATGAAG |
| 447 | GGTGAAAGGTCACCTAATGAAGA |
| 448 | GTGAAAGGTCACCTAATGAAGAG |
| 449 | TGAAAGGTCACCTAATGAAGAGT |
| 450 | GAAAGGTCACCTAATGAAGAGTA |
| 451 | AAAGGTCACCTAATGAAGAGTAT |
| 452 | AAGGTCACCTAATGAAGAGTATA |
| 453 | AGGTCACCTAATGAAGAGTATAC |
| 454 | GGTCACCTAATGAAGAGTATACC |
| 455 | GTCACCTAATGAAGAGTATACCT |
| 456 | TCACCTAATGAAGAGTATACCTG |
| 457 | CACCTAATGAAGAGTATACCTGG |
| 458 | ACCTAATGAAGAGTATACCTGGG |
| 459 | CCTAATGAAGAGTATACCTGGGA |
| 460 | CTAATGAAGAGTATACCTGGGAA |
| 461 | TAATGAAGAGTATACCTGGGAAG |

| ID | SEQUENCE |
|---|---|
| 462 | AATGAAGAGTATACCTGGGAAGA |
| 463 | ATGAAGAGTATACCTGGGAAGAG |
| 464 | TGAAGAGTATACCTGGGAAGAGG |
| 465 | TTCAAATCTTAACCCTTAGGACT |
| 466 | TCAAATCTTAACCCTTAGGACTC |
| 467 | AGAGTATACCTGGGAAGAGGATC |
| 468 | GAGTATACCTGGGAAGAGGATCC |
| 469 | AGTATACCTGGGAAGAGGATCCC |
| 470 | GTATACCTGGGAAGAGGATCCCT |
| 471 | TATACCTGGGAAGAGGATCCCTT |
| 472 | ATACCTGGGAAGAGGATCCCTTG |
| 473 | TACCTGGGAAGAGGATCCCTTGG |
| 474 | ACCTGGGAAGAGGATCCCTTGGC |
| 475 | CCTGGGAAGAGGATCCCTTGGCT |
| 476 | CTGGGAAGAGGATCCCTTGGCTG |
| 477 | TGGGAAGAGGATCCCTTGGCTGG |
| 478 | GGGAAGAGGATCCCTTGGCTGGT |
| 479 | GGAAGAGGATCCCTTGGCTGGTA |
| 480 | GAAGAGGATCCCTTGGCTGGTAT |
| 481 | AAGAGGATCCCTTGGCTGGTATA |
| 482 | AGAGGATCCCTTGGCTGGTATAA |
| 483 | GAGGATCCCTTGGCTGGTATAAT |
| 484 | AGGATCCCTTGGCTGGTATAATT |
| 485 | GGATCCCTTGGCTGGTATAATTC |
| 486 | GATCCCTTGGCTGGTATAATTCC |
| 487 | ATCCCTTGGCTGGTATAATTCCA |
| 488 | TCCCTTGGCTGGTATAATTCCAC |
| 489 | CCCTTGGCTGGTATAATTCCACG |
| 490 | CCTTGGCTGGTATAATTCCACGT |
| 491 | CTTGGCTGGTATAATTCCACGTA |
| 492 | TTGGCTGGTATAATTCCACGTAC |
| 493 | TGGCTGGTATAATTCCACGTACC |
| 494 | GGCTGGTATAATTCCACGTACCC |
| 495 | GCTGGTATAATTCCACGTACCCT |
| 496 | CTGGTATAATTCCACGTACCCTT |
| 497 | TGGTATAATTCCACGTACCCTTC |
| 498 | GGTATAATTCCACGTACCCTTCA |
| 499 | GTATAATTCCACGTACCCTTCAT |
| 500 | TATAATTCCACGTACCCTTCATC |
| 501 | ATAATTCCACGTACCCTTCATCA |
| 502 | TAATTCCACGTACCCTTCATCAA |
| 503 | AATTCCACGTACCCTTCATCAAA |
| 504 | ATTCCACGTACCCTTCATCAAAT |
| 505 | TTCCACGTACCCTTCATCAAATT |
| 506 | TCCACGTACCCTTCATCAAATTT |
| 507 | CCACGTACCCTTCATCAAATTTT |
| 508 | CACGTACCCTTCATCAAATTTTT |
| 509 | ACGTACCCTTCATCAAATTTTTG |
| 510 | CGTACCCTTCATCAAATTTTTGA |
| 511 | GTACCCTTCATCAAATTTTTGAG |
| 512 | TACCCTTCATCAAATTTTTGAGA |
| 513 | ACCCTTCATCAAATTTTTGAGAA |
| 514 | CCCTTCATCAAATTTTTGAGAAA |
| 515 | CCTTCATCAAATTTTTGAGAAAC |
| 516 | CTTCATCAAATTTTTGAGAAACT |
| 517 | TTCATCAAATTTTTGAGAAACTT |
| 518 | TCATCAAATTTTTGAGAAACTTA |
| 519 | CATCAAATTTTTGAGAAACTTAC |

| ID | SEQUENCE |
|---|---|
| 520 | ATCAAATTTTTGAGAAACTTACT |
| 521 | TCAAATTTTTGAGAAACTTACTG |
| 522 | CAAATTTTTGAGAAACTTACTGA |
| 523 | AAATTTTTGAGAAACTTACTGAT |
| 524 | AATTTTTGAGAAACTTACTGATA |
| 525 | ATTTTTGAGAAACTTACTGATAA |
| 526 | TTTTTGAGAAACTTACTGATAAT |
| 527 | TTTTGAGAAACTTACTGATAATG |
| 528 | TTTGAGAAACTTACTGATAATGG |
| 529 | TTGAGAAACTTACTGATAATGGT |
| 530 | TGAGAAACTTACTGATAATGGTA |
| 531 | GAGAAACTTACTGATAATGGTAC |
| 532 | AGAAACTTACTGATAATGGTACT |
| 533 | GAAACTTACTGATAATGGTACTG |
| 534 | AAACTTACTGATAATGGTACTGA |
| 535 | AACTTACTGATAATGGTACTGAA |
| 536 | ACTTACTGATAATGGTACTGAAT |
| 537 | CTTACTGATAATGGTACTGAATT |
| 538 | TTACTGATAATGGTACTGAATTT |
| 539 | TACTGATAATGGTACTGAATTTT |
| 540 | ACTGATAATGGTACTGAATTTTC |
| 541 | CTGATAATGGTACTGAATTTTCA |
| 542 | TGATAATGGTACTGAATTTTCAG |
| 543 | GATAATGGTACTGAATTTTCAGT |
| 544 | ATAATGGTACTGAATTTTCAGTC |
| 545 | TAATGGTACTGAATTTTCAGTCA |
| 546 | AATGGTACTGAATTTTCAGTCAA |
| 547 | ATGGTACTGAATTTTCAGTCAAA |
| 548 | TGGTACTGAATTTTCAGTCAAAG |
| 549 | GGTACTGAATTTTCAGTCAAAGT |
| 550 | GTACTGAATTTTCAGTCAAAGTG |
| 551 | TACTGAATTTTCAGTCAAAGTGT |
| 552 | ACTGAATTTTCAGTCAAAGTGTC |
| 553 | CTGAATTTTCAGTCAAAGTGTCT |
| 554 | TGAATTTTCAGTCAAAGTGTCTC |
| 555 | GAATTTTCAGTCAAAGTGTCTCT |
| 556 | AATTTTCAGTCAAAGTGTCTCTG |
| 557 | ATTTTCAGTCAAAGTGTCTCTGT |
| 558 | TTTTCAGTCAAAGTGTCTCTGTT |
| 559 | TTTCAGTCAAAGTGTCTCTGTTG |
| 560 | TTCAGTCAAAGTGTCTCTGTTGG |
| 561 | TCAGTCAAAGTGTCTCTGTTGGA |
| 562 | CAGTCAAAGTGTCTCTGTTGGAG |
| 563 | AGTCAAAGTGTCTCTGTTGGAGA |
| 564 | GTCAAAGTGTCTCTGTTGGAGAT |
| 565 | TCAAAGTGTCTCTGTTGGAGATC |
| 566 | CAAAGTGTCTCTGTTGGAGATCT |
| 567 | AAAGTGTCTCTGTTGGAGATCTA |
| 568 | AAGTGTCTCTGTTGGAGATCTAT |
| 569 | AGTGTCTCTGTTGGAGATCTATA |
| 570 | GTGTCTCTGTTGGAGATCTATAA |
| 571 | TGTCTCTGTTGGAGATCTATAAT |
| 572 | GTCTCTGTTGGAGATCTATAATG |
| 573 | TCTCTGTTGGAGATCTATAATGA |
| 574 | CTCTGTTGGAGATCTATAATGAA |
| 575 | TCTGTTGGAGATCTATAATGAAG |
| 576 | CTGTTGGAGATCTATAATGAAGA |
| 577 | TGTTGGAGATCTATAATGAAGAG |

| ID | SEQUENCE |
|---|---|
| 578 | GTTGGAGATCTATAATGAAGAGC |
| 579 | TTGGAGATCTATAATGAAGAGCT |
| 580 | TGGAGATCTATAATGAAGAGCTT |
| 581 | GGAGATCTATAATGAAGAGCTTT |
| 582 | GAGATCTATAATGAAGAGCTTTT |
| 583 | AGATCTATAATGAAGAGCTTTTT |
| 584 | GATCTATAATGAAGAGCTTTTTG |
| 585 | ATCTATAATGAAGAGCTTTTTGA |
| 586 | TCTATAATGAAGAGCTTTTTGAT |
| 587 | CTATAATGAAGAGCTTTTTGATC |
| 588 | TATAATGAAGAGCTTTTTGATCT |
| 589 | ATAATGAAGAGCTTTTTGATCTT |
| 590 | TAATGAAGAGCTTTTTGATCTTC |
| 591 | AATGAAGAGCTTTTTGATCTTCT |
| 592 | ATGAAGAGCTTTTTGATCTTCTT |
| 593 | TGAAGAGCTTTTTGATCTTCTTA |
| 594 | GAAGAGCTTTTTGATCTTCTTAA |
| 595 | AAGAGCTTTTTGATCTTCTTAAT |
| 596 | AGAGCTTTTTGATCTTCTTAATC |
| 597 | GAGCTTTTTGATCTTCTTAATCC |
| 598 | AGCTTTTTGATCTTCTTAATCCA |
| 599 | GCTTTTTGATCTTCTTAATCCAT |
| 600 | CTTTTTGATCTTCTTAATCCATC |
| 601 | TTTTTGATCTTCTTAATCCATCA |
| 602 | TTTTGATCTTCTTAATCCATCAT |
| 603 | TTTGATCTTCTTAATCCATCATC |
| 604 | TTGATCTTCTTAATCCATCATCT |
| 605 | TGATCTTCTTAATCCATCATCTG |
| 606 | GATCTTCTTAATCCATCATCTGA |
| 607 | ATCTTCTTAATCCATCATCTGAT |
| 608 | TCTTCTTAATCCATCATCTGATG |
| 609 | CTTCTTAATCCATCATCTGATGT |
| 610 | TTCTTAATCCATCATCTGATGTT |
| 611 | TCTTAATCCATCATCTGATGTTT |
| 612 | CTTAATCCATCATCTGATGTTTC |
| 613 | TTAATCCATCATCTGATGTTTCT |
| 614 | TAATCCATCATCTGATGTTTCTG |
| 615 | AATCCATCATCTGATGTTTCTGA |
| 616 | ATCCATCATCTGATGTTTCTGAG |
| 617 | TCCATCATCTGATGTTTCTGAGA |
| 618 | CCATCATCTGATGTTTCTGAGAG |
| 619 | CATCATCTGATGTTTCTGAGAGA |
| 620 | ATCATCTGATGTTTCTGAGAGAC |
| 621 | TCATCTGATGTTTCTGAGAGACT |
| 622 | CATCTGATGTTTCTGAGAGACTA |
| 623 | ATCTGATGTTTCTGAGAGACTAC |
| 624 | TCTGATGTTTCTGAGAGACTACA |
| 625 | CTGATGTTTCTGAGAGACTACAG |
| 626 | TGATGTTTCTGAGAGACTACAGA |
| 627 | GATGTTTCTGAGAGACTACAGAT |
| 628 | ATGTTTCTGAGAGACTACAGATG |
| 629 | TGTTTCTGAGAGACTACAGATGT |
| 630 | GTTTCTGAGAGACTACAGATGTT |
| 631 | TTTCTGAGAGACTACAGATGTTT |
| 632 | TTCTGAGAGACTACAGATGTTTG |
| 633 | TCTGAGAGACTACAGATGTTTGA |
| 634 | CTGAGAGACTACAGATGTTTGAT |
| 635 | TGAGAGACTACAGATGTTTGATG |

| ID | SEQUENCE |
|---|---|
| 636 | GAGAGACTACAGATGTTTGATGA |
| 637 | AGAGACTACAGATGTTTGATGAT |
| 638 | GAGACTACAGATGTTTGATGATC |
| 639 | AGACTACAGATGTTTGATGATCC |
| 640 | GACTACAGATGTTTGATGATCCC |
| 641 | ACTACAGATGTTTGATGATCCCC |
| 642 | CTACAGATGTTTGATGATCCCCG |
| 643 | TACAGATGTTTGATGATCCCCGT |
| 644 | ACAGATGTTTGATGATCCCCGTA |
| 645 | CAGATGTTTGATGATCCCCGTAA |
| 646 | AGATGTTTGATGATCCCCGTAAC |
| 647 | GATGTTTGATGATCCCCGTAACA |
| 648 | ATGTTTGATGATCCCCGTAACAA |
| 649 | TGTTTGATGATCCCCGTAACAAG |
| 650 | GTTTGATGATCCCCGTAACAAGA |
| 651 | TTTGATGATCCCCGTAACAAGAG |
| 652 | TTGATGATCCCCGTAACAAGAGA |
| 653 | TGATGATCCCCGTAACAAGAGAG |
| 654 | GATGATCCCCGTAACAAGAGAGG |
| 655 | ATGATCCCCGTAACAAGAGAGGA |
| 656 | TGATCCCCGTAACAAGAGAGGAG |
| 657 | GATCCCCGTAACAAGAGAGGAGT |
| 658 | ATCCCCGTAACAAGAGAGGAGTG |
| 659 | TCCCCGTAACAAGAGAGGAGTGA |
| 660 | CCCCGTAACAAGAGAGGAGTGAT |
| 661 | CCCGTAACAAGAGAGGAGTGATA |
| 662 | CCGTAACAAGAGAGGAGTGATAA |
| 663 | CGTAACAAGAGAGGAGTGATAAT |
| 664 | GTAACAAGAGAGGAGTGATAATT |
| 665 | TAACAAGAGAGGAGTGATAATTA |
| 666 | AACAAGAGAGGAGTGATAATTAA |
| 667 | ACAAGAGAGGAGTGATAATTAAA |
| 668 | CAAGAGAGGAGTGATAATTAAAG |
| 669 | AAGAGAGGAGTGATAATTAAAGG |
| 670 | AGAGAGGAGTGATAATTAAAGGT |
| 671 | GAGAGGAGTGATAATTAAAGGTT |
| 672 | AGAGGAGTGATAATTAAAGGTTT |
| 673 | GAGGAGTGATAATTAAAGGTTTA |
| 674 | AGGAGTGATAATTAAAGGTTTAG |
| 675 | GGAGTGATAATTAAAGGTTTAGA |
| 676 | GAGTGATAATTAAAGGTTTAGAA |
| 677 | AGTGATAATTAAAGGTTTAGAAG |
| 678 | GTGATAATTAAAGGTTTAGAAGA |
| 679 | TGATAATTAAAGGTTTAGAAGAA |
| 680 | GATAATTAAAGGTTTAGAAGAAA |
| 681 | ATAATTAAAGGTTTAGAAGAAAT |
| 682 | TAATTAAAGGTTTAGAAGAAATT |
| 683 | AATTAAAGGTTTAGAAGAAATTA |
| 684 | ATTAAAGGTTTAGAAGAAATTAC |
| 685 | TTAAAGGTTTAGAAGAAATTACA |
| 686 | TAAAGGTTTAGAAGAAATTACAG |
| 687 | AAAGGTTTAGAAGAAATTACAGT |
| 688 | AAGGTTTAGAAGAAATTACAGTA |
| 689 | AGGTTTAGAAGAAATTACAGTAC |
| 690 | GGTTTAGAAGAAATTACAGTACA |
| 691 | GTTTAGAAGAAATTACAGTACAC |
| 692 | TTTAGAAGAAATTACAGTACACA |
| 693 | TTAGAAGAAATTACAGTACACAA |

| ID | SEQUENCE |
|---|---|
| 694 | TAGAAGAAATTACAGTACACAAC |
| 695 | AGAAGAAATTACAGTACACAACA |
| 696 | GAAGAAATTACAGTACACAACAA |
| 697 | AAGAAATTACAGTACACAACAAG |
| 698 | AGAAATTACAGTACACAACAAGG |
| 699 | GAAATTACAGTACACAACAAGGA |
| 700 | AAATTACAGTACACAACAAGGAT |
| 701 | AATTACAGTACACAACAAGGATG |
| 702 | ATTACAGTACACAACAAGGATGA |
| 703 | TTACAGTACACAACAAGGATGAA |
| 704 | TACAGTACACAACAAGGATGAAG |
| 705 | ACAGTACACAACAAGGATGAAGT |
| 706 | CAGTACACAACAAGGATGAAGTC |
| 707 | AGTACACAACAAGGATGAAGTCT |
| 708 | GTACACAACAAGGATGAAGTCTA |
| 709 | TACACAACAAGGATGAAGTCTAT |
| 710 | ACACAACAAGGATGAAGTCTATC |
| 711 | CACAACAAGGATGAAGTCTATCA |
| 712 | ACAACAAGGATGAAGTCTATCAA |
| 713 | CAACAAGGATGAAGTCTATCAAA |
| 714 | AACAAGGATGAAGTCTATCAAAT |
| 715 | ACAAGGATGAAGTCTATCAAATT |
| 716 | CAAGGATGAAGTCTATCAAATTT |
| 717 | AAGGATGAAGTCTATCAAATTTT |
| 718 | AGGATGAAGTCTATCAAATTTTA |
| 719 | GGATGAAGTCTATCAAATTTTAG |
| 720 | GATGAAGTCTATCAAATTTTAGA |
| 721 | ATGAAGTCTATCAAATTTTAGAA |
| 722 | TGAAGTCTATCAAATTTTAGAAA |
| 723 | GAAGTCTATCAAATTTTAGAAAA |
| 724 | AAGTCTATCAAATTTTAGAAAAG |
| 725 | AGTCTATCAAATTTTAGAAAAGG |
| 726 | GTCTATCAAATTTTAGAAAAGGG |
| 727 | TCTATCAAATTTTAGAAAAGGGG |
| 728 | CTATCAAATTTTAGAAAAGGGGG |
| 729 | TATCAAATTTTAGAAAAGGGGGC |
| 730 | ATCAAATTTTAGAAAAGGGGGCA |
| 731 | TCAAATTTTAGAAAAGGGGGCAG |
| 732 | CAAATTTTAGAAAAGGGGGCAGC |
| 733 | AAATTTTAGAAAAGGGGGCAGCA |
| 734 | AATTTTAGAAAAGGGGGCAGCAA |
| 735 | ATTTTAGAAAAGGGGGCAGCAAA |
| 736 | TTTTAGAAAAGGGGGCAGCAAAA |
| 737 | TTTAGAAAAGGGGGCAGCAAAAA |
| 738 | TTAGAAAAGGGGGCAGCAAAAAG |
| 739 | TAGAAAAGGGGGCAGCAAAAAGG |
| 740 | AGAAAAGGGGGCAGCAAAAAGGA |
| 741 | GAAAAGGGGGCAGCAAAAAGGAC |
| 742 | AAAAGGGGGCAGCAAAAAGGACA |
| 743 | AAAGGGGGCAGCAAAAAGGACAA |
| 744 | AAGGGGGCAGCAAAAAGGACAAC |
| 745 | AGGGGGCAGCAAAAAGGACAACT |
| 746 | GGGGGCAGCAAAAAGGACAACTG |
| 747 | GGGGCAGCAAAAAGGACAACTGC |
| 748 | GGGCAGCAAAAAGGACAACTGCA |
| 749 | GGCAGCAAAAAGGACAACTGCAG |
| 750 | GCAGCAAAAAGGACAACTGCAGC |
| 751 | CAGCAAAAAGGACAACTGCAGCT |

| ID | SEQUENCE |
|---|---|
| 752 | AGCAAAAAGGACAACTGCAGCTA |
| 753 | GCAAAAAGGACAACTGCAGCTAC |
| 754 | CAAAAAGGACAACTGCAGCTACT |
| 755 | AAAAAGGACAACTGCAGCTACTC |
| 756 | AAAAGGACAACTGCAGCTACTCT |
| 757 | AAAGGACAACTGCAGCTACTCTG |
| 758 | AAGGACAACTGCAGCTACTCTGA |
| 759 | AGGACAACTGCAGCTACTCTGAT |
| 760 | GGACAACTGCAGCTACTCTGATG |
| 761 | GACAACTGCAGCTACTCTGATGA |
| 762 | ACAACTGCAGCTACTCTGATGAA |
| 763 | CAACTGCAGCTACTCTGATGAAT |
| 764 | AACTGCAGCTACTCTGATGAATG |
| 765 | ACTGCAGCTACTCTGATGAATGC |
| 766 | CTGCAGCTACTCTGATGAATGCA |
| 767 | TGCAGCTACTCTGATGAATGCAT |
| 768 | GCAGCTACTCTGATGAATGCATA |
| 769 | CAGCTACTCTGATGAATGCATAC |
| 770 | AGCTACTCTGATGAATGCATACT |
| 771 | GCTACTCTGATGAATGCATACTC |
| 772 | CTACTCTGATGAATGCATACTCT |
| 773 | TACTCTGATGAATGCATACTCTA |
| 774 | ACTCTGATGAATGCATACTCTAG |
| 775 | CTCTGATGAATGCATACTCTAGT |
| 776 | TCTGATGAATGCATACTCTAGTC |
| 777 | CTGATGAATGCATACTCTAGTCG |
| 778 | TGATGAATGCATACTCTAGTCGT |
| 779 | GATGAATGCATACTCTAGTCGTT |
| 780 | ATGAATGCATACTCTAGTCGTTC |
| 781 | TGAATGCATACTCTAGTCGTTCC |
| 782 | GAATGCATACTCTAGTCGTTCCC |
| 783 | AATGCATACTCTAGTCGTTCCCA |
| 784 | ATGCATACTCTAGTCGTTCCCAC |
| 785 | TGCATACTCTAGTCGTTCCCACT |
| 786 | GCATACTCTAGTCGTTCCCACTC |
| 787 | CATACTCTAGTCGTTCCCACTCA |
| 788 | ATACTCTAGTCGTTCCCACTCAG |
| 789 | TACTCTAGTCGTTCCCACTCAGT |
| 790 | ACTCTAGTCGTTCCCACTCAGTT |
| 791 | CTCTAGTCGTTCCCACTCAGTTT |
| 792 | TCTAGTCGTTCCCACTCAGTTTT |
| 793 | CTAGTCGTTCCCACTCAGTTTTC |
| 794 | TAGTCGTTCCCACTCAGTTTTCT |
| 795 | AGTCGTTCCCACTCAGTTTTCTC |
| 796 | GTCGTTCCCACTCAGTTTTCTCT |
| 797 | TCGTTCCCACTCAGTTTTCTCTG |
| 798 | CGTTCCCACTCAGTTTTCTCTGT |
| 799 | GTTCCCACTCAGTTTTCTCTGTT |
| 800 | TTCCCACTCAGTTTTCTCTGTTA |
| 801 | TCCCACTCAGTTTTCTCTGTTAC |
| 802 | CCCACTCAGTTTTCTCTGTTACA |
| 803 | CCACTCAGTTTTCTCTGTTACAA |
| 804 | CACTCAGTTTTCTCTGTTACAAT |
| 805 | ACTCAGTTTTCTCTGTTACAATA |
| 806 | CTCAGTTTTCTCTGTTACAATAC |
| 807 | TCAGTTTTCTCTGTTACAATACA |
| 808 | CAGTTTTCTCTGTTACAATACAT |
| 809 | AGTTTTCTCTGTTACAATACATA |

| ID | SEQUENCE |
|---|---|
| 810 | GTTTTCTCTGTTACAATACATAT |
| 811 | TTTTCTCTGTTACAATACATATG |
| 812 | TTTCTCTGTTACAATACATATGA |
| 813 | TTCTCTGTTACAATACATATGAA |
| 814 | TCTCTGTTACAATACATATGAAA |
| 815 | CTCTGTTACAATACATATGAAAG |
| 816 | TCTGTTACAATACATATGAAAGA |
| 817 | CTGTTACAATACATATGAAAGAA |
| 818 | TGTTACAATACATATGAAAGAAA |
| 819 | GTTACAATACATATGAAAGAAAC |
| 820 | TTACAATACATATGAAAGAAACT |
| 821 | TACAATACATATGAAAGAAACTA |
| 822 | ACAATACATATGAAAGAAACTAC |
| 823 | CAATACATATGAAAGAAACTACG |
| 824 | AATACATATGAAAGAAACTACGA |
| 825 | ATACATATGAAAGAAACTACGAT |
| 826 | TACATATGAAAGAAACTACGATT |
| 827 | ACATATGAAAGAAACTACGATTG |
| 828 | CATATGAAAGAAACTACGATTGA |
| 829 | ATATGAAAGAAACTACGATTGAT |
| 830 | TATGAAAGAAACTACGATTGATG |
| 831 | ATGAAAGAAACTACGATTGATGG |
| 832 | TGAAAGAAACTACGATTGATGGA |
| 833 | GAAAGAAACTACGATTGATGGAG |
| 834 | AAAGAAACTACGATTGATGGAGA |
| 835 | AAGAAACTACGATTGATGGAGAA |
| 836 | AGAAACTACGATTGATGGAGAAG |
| 837 | GAAACTACGATTGATGGAGAAGA |
| 838 | AAACTACGATTGATGGAGAAGAG |
| 839 | AACTACGATTGATGGAGAAGAGC |
| 840 | ACTACGATTGATGGAGAAGAGCT |
| 841 | CTACGATTGATGGAGAAGAGCTT |
| 842 | TACGATTGATGGAGAAGAGCTTG |
| 843 | ACGATTGATGGAGAAGAGCTTGT |
| 844 | CGATTGATGGAGAAGAGCTTGTT |
| 845 | GATTGATGGAGAAGAGCTTGTTA |
| 846 | ATTGATGGAGAAGAGCTTGTTAA |
| 847 | TTGATGGAGAAGAGCTTGTTAAA |
| 848 | TGATGGAGAAGAGCTTGTTAAAA |
| 849 | GATGGAGAAGAGCTTGTTAAAAT |
| 850 | ATGGAGAAGAGCTTGTTAAAATC |
| 851 | TGGAGAAGAGCTTGTTAAAATCG |
| 852 | GGAGAAGAGCTTGTTAAAATCGG |
| 853 | GAGAAGAGCTTGTTAAAATCGGA |
| 854 | AGAAGAGCTTGTTAAAATCGGAA |
| 855 | GAAGAGCTTGTTAAAATCGGAAA |
| 856 | AAGAGCTTGTTAAAATCGGAAAG |
| 857 | AGAGCTTGTTAAAATCGGAAAGT |
| 858 | GAGCTTGTTAAAATCGGAAAGTT |
| 859 | AGCTTGTTAAAATCGGAAAGTTG |
| 860 | GCTTGTTAAAATCGGAAAGTTGA |
| 861 | CTTGTTAAAATCGGAAAGTTGAA |
| 862 | TTGTTAAAATCGGAAAGTTGAAC |
| 863 | TGTTAAAATCGGAAAGTTGAACT |
| 864 | GTTAAAATCGGAAAGTTGAACTT |
| 865 | TTAAAATCGGAAAGTTGAACTTG |
| 866 | TAAAATCGGAAAGTTGAACTTGG |
| 867 | AAAATCGGAAAGTTGAACTTGGT |

| ID | SEQUENCE |
|---|---|
| 868 | AAATCGGAAAGTTGAACTTGGTT |
| 869 | AATCGGAAAGTTGAACTTGGTTG |
| 870 | ATCGGAAAGTTGAACTTGGTTGA |
| 871 | TCGGAAAGTTGAACTTGGTTGAT |
| 872 | CGGAAAGTTGAACTTGGTTGATC |
| 873 | GGAAAGTTGAACTTGGTTGATCT |
| 874 | GAAAGTTGAACTTGGTTGATCTT |
| 875 | AAAGTTGAACTTGGTTGATCTTG |
| 876 | AAGTTGAACTTGGTTGATCTTGC |
| 877 | AGTTGAACTTGGTTGATCTTGCA |
| 878 | GTTGAACTTGGTTGATCTTGCAG |
| 879 | TTGAACTTGGTTGATCTTGCAGG |
| 880 | TGAACTTGGTTGATCTTGCAGGA |
| 881 | GAACTTGGTTGATCTTGCAGGAA |
| 882 | AACTTGGTTGATCTTGCAGGAAG |
| 883 | ACTTGGTTGATCTTGCAGGAAGT |
| 884 | CTTGGTTGATCTTGCAGGAAGTG |
| 885 | TTGGTTGATCTTGCAGGAAGTGA |
| 886 | TGGTTGATCTTGCAGGAAGTGAA |
| 887 | GGTTGATCTTGCAGGAAGTGAAA |
| 888 | GTTGATCTTGCAGGAAGTGAAAA |
| 889 | TTGATCTTGCAGGAAGTGAAAAC |
| 890 | TGATCTTGCAGGAAGTGAAAACA |
| 891 | GATCTTGCAGGAAGTGAAAACAT |
| 892 | ATCTTGCAGGAAGTGAAAACATT |
| 893 | TCTTGCAGGAAGTGAAAACATTG |
| 894 | CTTGCAGGAAGTGAAAACATTGG |
| 895 | TTGCAGGAAGTGAAAACATTGGC |
| 896 | TGCAGGAAGTGAAAACATTGGCC |
| 897 | GCAGGAAGTGAAAACATTGGCCG |
| 898 | CAGGAAGTGAAAACATTGGCCGT |
| 899 | AGGAAGTGAAAACATTGGCCGTT |
| 900 | GGAAGTGAAAACATTGGCCGTTC |
| 901 | GAAGTGAAAACATTGGCCGTTCT |
| 902 | AAGTGAAAACATTGGCCGTTCTG |
| 903 | AGTGAAAACATTGGCCGTTCTGG |
| 904 | GTGAAAACATTGGCCGTTCTGGA |
| 905 | TGAAAACATTGGCCGTTCTGGAG |
| 906 | GAAAACATTGGCCGTTCTGGAGC |
| 907 | AAAACATTGGCCGTTCTGGAGCT |
| 908 | AAACATTGGCCGTTCTGGAGCTG |
| 909 | AACATTGGCCGTTCTGGAGCTGT |
| 910 | ACATTGGCCGTTCTGGAGCTGTT |
| 911 | CATTGGCCGTTCTGGAGCTGTTG |
| 912 | ATTGGCCGTTCTGGAGCTGTTGA |
| 913 | TTGGCCGTTCTGGAGCTGTTGAT |
| 914 | TGGCCGTTCTGGAGCTGTTGATA |
| 915 | GGCCGTTCTGGAGCTGTTGATAA |
| 916 | GCCGTTCTGGAGCTGTTGATAAG |
| 917 | CCGTTCTGGAGCTGTTGATAAGA |
| 918 | CGTTCTGGAGCTGTTGATAAGAG |
| 919 | GTTCTGGAGCTGTTGATAAGAGA |
| 920 | TTCTGGAGCTGTTGATAAGAGAG |
| 921 | TCTGGAGCTGTTGATAAGAGAGC |
| 922 | CTGGAGCTGTTGATAAGAGAGCT |
| 923 | TGGAGCTGTTGATAAGAGAGCTC |
| 924 | GGAGCTGTTGATAAGAGAGCTCG |
| 925 | GAGCTGTTGATAAGAGAGCTCGG |

| ID | SEQUENCE |
|---|---|
| 926 | AGCTGTTGATAAGAGAGCTCGGG |
| 927 | GCTGTTGATAAGAGAGCTCGGGA |
| 928 | CTGTTGATAAGAGAGCTCGGGAA |
| 929 | TGTTGATAAGAGAGCTCGGGAAG |
| 930 | GTTGATAAGAGAGCTCGGGAAGC |
| 931 | TTGATAAGAGAGCTCGGGAAGCT |
| 932 | TGATAAGAGAGCTCGGGAAGCTG |
| 933 | GATAAGAGAGCTCGGGAAGCTGG |
| 934 | ATAAGAGAGCTCGGGAAGCTGGA |
| 935 | TAAGAGAGCTCGGGAAGCTGGAA |
| 936 | AAGAGAGCTCGGGAAGCTGGAAA |
| 937 | AGAGAGCTCGGGAAGCTGGAAAT |
| 938 | GAGAGCTCGGGAAGCTGGAAATA |
| 939 | AGAGCTCGGGAAGCTGGAAATAT |
| 940 | GAGCTCGGGAAGCTGGAAATATA |
| 941 | AGCTCGGGAAGCTGGAAATATAA |
| 942 | GCTCGGGAAGCTGGAAATATAAA |
| 943 | CTCGGGAAGCTGGAAATATAAAT |
| 944 | TCGGGAAGCTGGAAATATAAATC |
| 945 | CGGGAAGCTGGAAATATAAATCA |
| 946 | GGGAAGCTGGAAATATAAATCAA |
| 947 | GGAAGCTGGAAATATAAATCAAT |
| 948 | GAAGCTGGAAATATAAATCAATC |
| 949 | AAGCTGGAAATATAAATCAATCC |
| 950 | AGCTGGAAATATAAATCAATCCC |
| 951 | GCTGGAAATATAAATCAATCCCT |
| 952 | CTGGAAATATAAATCAATCCCTG |
| 953 | TGGAAATATAAATCAATCCCTGT |
| 954 | GGAAATATAAATCAATCCCTGTT |
| 955 | GAAATATAAATCAATCCCTGTTG |
| 956 | AAATATAAATCAATCCCTGTTGA |
| 957 | AATATAAATCAATCCCTGTTGAC |
| 958 | ATATAAATCAATCCCTGTTGACT |
| 959 | TATAAATCAATCCCTGTTGACTT |
| 960 | ATAAATCAATCCCTGTTGACTTT |
| 961 | TAAATCAATCCCTGTTGACTTTG |
| 962 | AAATCAATCCCTGTTGACTTTGG |
| 963 | AATCAATCCCTGTTGACTTTGGG |
| 964 | ATCAATCCCTGTTGACTTTGGGA |
| 965 | TCAATCCCTGTTGACTTTGGGAA |
| 966 | CAATCCCTGTTGACTTTGGGAAG |
| 967 | AATCCCTGTTGACTTTGGGAAGG |
| 968 | ATCCCTGTTGACTTTGGGAAGGG |
| 969 | TCCCTGTTGACTTTGGGAAGGGT |
| 970 | CCCTGTTGACTTTGGGAAGGGTC |
| 971 | CCTGTTGACTTTGGGAAGGGTCA |
| 972 | CTGTTGACTTTGGGAAGGGTCAT |
| 973 | TGTTGACTTTGGGAAGGGTCATT |
| 974 | GTTGACTTTGGGAAGGGTCATTA |
| 975 | TTGACTTTGGGAAGGGTCATTAC |
| 976 | TGACTTTGGGAAGGGTCATTACT |
| 977 | GACTTTGGGAAGGGTCATTACTG |
| 978 | ACTTTGGGAAGGGTCATTACTGC |
| 979 | CTTTGGGAAGGGTCATTACTGCC |
| 980 | TTTGGGAAGGGTCATTACTGCCC |
| 981 | TTGGGAAGGGTCATTACTGCCCT |
| 982 | TGGGAAGGGTCATTACTGCCCTT |
| 983 | GGGAAGGGTCATTACTGCCCTTG |

| ID | SEQUENCE |
|---|---|
| 984 | GGAAGGGTCATTACTGCCCTTGT |
| 985 | GAAGGGTCATTACTGCCCTTGTA |
| 986 | AAGGGTCATTACTGCCCTTGTAG |
| 987 | AGGGTCATTACTGCCCTTGTAGA |
| 988 | GGGTCATTACTGCCCTTGTAGAA |
| 989 | GGTCATTACTGCCCTTGTAGAAA |
| 990 | GTCATTACTGCCCTTGTAGAAAG |
| 991 | TCATTACTGCCCTTGTAGAAAGA |
| 992 | CATTACTGCCCTTGTAGAAAGAA |
| 993 | ATTACTGCCCTTGTAGAAAGAAC |
| 994 | TTACTGCCCTTGTAGAAAGAACA |
| 995 | TACTGCCCTTGTAGAAAGAACAC |
| 996 | ACTGCCCTTGTAGAAAGAACACC |
| 997 | CTGCCCTTGTAGAAAGAACACCT |
| 998 | TGCCCTTGTAGAAAGAACACCTC |
| 999 | GCCCTTGTAGAAAGAACACCTCA |
| 1000 | CCCTTGTAGAAAGAACACCTCAT |
| 1001 | CCTTGTAGAAAGAACACCTCATG |
| 1002 | CTTGTAGAAAGAACACCTCATGT |
| 1003 | TTGTAGAAAGAACACCTCATGTT |
| 1004 | TGTAGAAAGAACACCTCATGTTC |
| 1005 | GTAGAAAGAACACCTCATGTTCC |
| 1006 | TAGAAAGAACACCTCATGTTCCT |
| 1007 | AGAAAGAACACCTCATGTTCCTT |
| 1008 | GAAAGAACACCTCATGTTCCTTA |
| 1009 | AAAGAACACCTCATGTTCCTTAT |
| 1010 | AAGAACACCTCATGTTCCTTATC |
| 1011 | AGAACACCTCATGTTCCTTATCG |
| 1012 | GAACACCTCATGTTCCTTATCGA |
| 1013 | AACACCTCATGTTCCTTATCGAG |
| 1014 | ACACCTCATGTTCCTTATCGAGA |
| 1015 | CACCTCATGTTCCTTATCGAGAA |
| 1016 | ACCTCATGTTCCTTATCGAGAAT |
| 1017 | CCTCATGTTCCTTATCGAGAATC |
| 1018 | CTCATGTTCCTTATCGAGAATCT |
| 1019 | TCATGTTCCTTATCGAGAATCTA |
| 1020 | CATGTTCCTTATCGAGAATCTAA |
| 1021 | ATGTTCCTTATCGAGAATCTAAA |
| 1022 | TGTTCCTTATCGAGAATCTAAAC |
| 1023 | GTTCCTTATCGAGAATCTAAACT |
| 1024 | TTCCTTATCGAGAATCTAAACTA |
| 1025 | TCCTTATCGAGAATCTAAACTAA |
| 1026 | CCTTATCGAGAATCTAAACTAAC |
| 1027 | CTTATCGAGAATCTAAACTAACT |
| 1028 | TTATCGAGAATCTAAACTAACTA |
| 1029 | TATCGAGAATCTAAACTAACTAG |
| 1030 | ATCGAGAATCTAAACTAACTAGA |
| 1031 | TCGAGAATCTAAACTAACTAGAA |
| 1032 | CGAGAATCTAAACTAACTAGAAT |
| 1033 | GAGAATCTAAACTAACTAGAATC |
| 1034 | AGAATCTAAACTAACTAGAATCC |
| 1035 | GAATCTAAACTAACTAGAATCCT |
| 1036 | AATCTAAACTAACTAGAATCCTC |
| 1037 | ATCTAAACTAACTAGAATCCTCC |
| 1038 | TCTAAACTAACTAGAATCCTCCA |
| 1039 | CTAAACTAACTAGAATCCTCCAG |
| 1040 | TAAACTAACTAGAATCCTCCAGG |
| 1041 | AAACTAACTAGAATCCTCCAGGA |

| ID | SEQUENCE |
|---|---|
| 1042 | AACTAACTAGAATCCTCCAGGAT |
| 1043 | ACTAACTAGAATCCTCCAGGATT |
| 1044 | CTAACTAGAATCCTCCAGGATTC |
| 1045 | TAACTAGAATCCTCCAGGATTCT |
| 1046 | AACTAGAATCCTCCAGGATTCTC |
| 1047 | ACTAGAATCCTCCAGGATTCTCT |
| 1048 | CTAGAATCCTCCAGGATTCTCTT |
| 1049 | TAGAATCCTCCAGGATTCTCTTG |
| 1050 | AGAATCCTCCAGGATTCTCTTGG |
| 1051 | GAATCCTCCAGGATTCTCTTGGA |
| 1052 | AATCCTCCAGGATTCTCTTGGAG |
| 1053 | ATCCTCCAGGATTCTCTTGGAGG |
| 1054 | TCCTCCAGGATTCTCTTGGAGGG |
| 1055 | CCTCCAGGATTCTCTTGGAGGGC |
| 1056 | CTCCAGGATTCTCTTGGAGGGCG |
| 1057 | TCCAGGATTCTCTTGGAGGGCGT |
| 1058 | CCAGGATTCTCTTGGAGGGCGTA |
| 1059 | CAGGATTCTCTTGGAGGGCGTAC |
| 1060 | AGGATTCTCTTGGAGGGCGTACA |
| 1061 | GGATTCTCTTGGAGGGCGTACAA |
| 1062 | GATTCTCTTGGAGGGCGTACAAG |
| 1063 | ATTCTCTTGGAGGGCGTACAAGA |
| 1064 | TTCTCTTGGAGGGCGTACAAGAA |
| 1065 | TCTCTTGGAGGGCGTACAAGAAC |
| 1066 | CTCTTGGAGGGCGTACAAGAACA |
| 1067 | TCTTGGAGGGCGTACAAGAACAT |
| 1068 | CTTGGAGGGCGTACAAGAACATC |
| 1069 | TTGGAGGGCGTACAAGAACATCT |
| 1070 | TGGAGGGCGTACAAGAACATCTA |
| 1071 | GGAGGGCGTACAAGAACATCTAT |
| 1072 | GAGGGCGTACAAGAACATCTATA |
| 1073 | AGGGCGTACAAGAACATCTATAA |
| 1074 | GGGCGTACAAGAACATCTATAAT |
| 1075 | GGCGTACAAGAACATCTATAATT |
| 1076 | GCGTACAAGAACATCTATAATTG |
| 1077 | CGTACAAGAACATCTATAATTGC |
| 1078 | GTACAAGAACATCTATAATTGCA |
| 1079 | TACAAGAACATCTATAATTGCAA |
| 1080 | ACAAGAACATCTATAATTGCAAC |
| 1081 | CAAGAACATCTATAATTGCAACA |
| 1082 | AAGAACATCTATAATTGCAACAA |
| 1083 | AGAACATCTATAATTGCAACAAT |
| 1084 | GAACATCTATAATTGCAACAATT |
| 1085 | AACATCTATAATTGCAACAATTT |
| 1086 | ACATCTATAATTGCAACAATTTC |
| 1087 | CATCTATAATTGCAACAATTTCT |
| 1088 | ATCTATAATTGCAACAATTTCTC |
| 1089 | TCTATAATTGCAACAATTTCTCC |
| 1090 | CTATAATTGCAACAATTTCTCCT |
| 1091 | TATAATTGCAACAATTTCTCCTG |
| 1092 | ATAATTGCAACAATTTCTCCTGC |
| 1093 | TAATTGCAACAATTTCTCCTGCA |
| 1094 | AATTGCAACAATTTCTCCTGCAT |
| 1095 | ATTGCAACAATTTCTCCTGCATC |
| 1096 | TTGCAACAATTTCTCCTGCATCT |
| 1097 | TGCAACAATTTCTCCTGCATCTC |
| 1098 | GCAACAATTTCTCCTGCATCTCT |
| 1099 | CAACAATTTCTCCTGCATCTCTC |

| ID | SEQUENCE |
|---|---|
| 1100 | AACAATTTCTCCTGCATCTCTCA |
| 1101 | ACAATTTCTCCTGCATCTCTCAA |
| 1102 | CAATTTCTCCTGCATCTCTCAAT |
| 1103 | AATTTCTCCTGCATCTCTCAATC |
| 1104 | ATTTCTCCTGCATCTCTCAATCT |
| 1105 | TTTCTCCTGCATCTCTCAATCTT |
| 1106 | TTCTCCTGCATCTCTCAATCTTG |
| 1107 | TCTCCTGCATCTCTCAATCTTGA |
| 1108 | CTCCTGCATCTCTCAATCTTGAG |
| 1109 | TCCTGCATCTCTCAATCTTGAGG |
| 1110 | CCTGCATCTCTCAATCTTGAGGA |
| 1111 | CTGCATCTCTCAATCTTGAGGAA |
| 1112 | TGCATCTCTCAATCTTGAGGAAA |
| 1113 | GCATCTCTCAATCTTGAGGAAAC |
| 1114 | CATCTCTCAATCTTGAGGAAACT |
| 1115 | ATCTCTCAATCTTGAGGAAACTC |
| 1116 | TCTCTCAATCTTGAGGAAACTCT |
| 1117 | CTCTCAATCTTGAGGAAACTCTG |
| 1118 | TCTCAATCTTGAGGAAACTCTGA |
| 1119 | CTCAATCTTGAGGAAACTCTGAG |
| 1120 | TCAATCTTGAGGAAACTCTGAGT |
| 1121 | CAATCTTGAGGAAACTCTGAGTA |
| 1122 | AATCTTGAGGAAACTCTGAGTAC |
| 1123 | ATCTTGAGGAAACTCTGAGTACA |
| 1124 | TCTTGAGGAAACTCTGAGTACAT |
| 1125 | CTTGAGGAAACTCTGAGTACATT |
| 1126 | TTGAGGAAACTCTGAGTACATTG |
| 1127 | TGAGGAAACTCTGAGTACATTGG |
| 1128 | GAGGAAACTCTGAGTACATTGGA |
| 1129 | AGGAAACTCTGAGTACATTGGAA |
| 1130 | GGAAACTCTGAGTACATTGGAAT |
| 1131 | GAAACTCTGAGTACATTGGAATA |
| 1132 | AAACTCTGAGTACATTGGAATAT |
| 1133 | AACTCTGAGTACATTGGAATATG |
| 1134 | ACTCTGAGTACATTGGAATATGC |
| 1135 | CTCTGAGTACATTGGAATATGCT |
| 1136 | TCTGAGTACATTGGAATATGCTC |
| 1137 | CTGAGTACATTGGAATATGCTCA |
| 1138 | TGAGTACATTGGAATATGCTCAT |
| 1139 | GAGTACATTGGAATATGCTCATA |
| 1140 | AGTACATTGGAATATGCTCATAG |
| 1141 | GTACATTGGAATATGCTCATAGA |
| 1142 | TACATTGGAATATGCTCATAGAG |
| 1143 | ACATTGGAATATGCTCATAGAGC |
| 1144 | CATTGGAATATGCTCATAGAGCA |
| 1145 | ATTGGAATATGCTCATAGAGCAA |
| 1146 | TTGGAATATGCTCATAGAGCAAA |
| 1147 | TGGAATATGCTCATAGAGCAAAG |
| 1148 | GGAATATGCTCATAGAGCAAAGA |
| 1149 | GAATATGCTCATAGAGCAAAGAA |
| 1150 | AATATGCTCATAGAGCAAAGAAC |
| 1151 | ATATGCTCATAGAGCAAAGAACA |
| 1152 | TATGCTCATAGAGCAAAGAACAT |
| 1153 | ATGCTCATAGAGCAAAGAACATA |
| 1154 | TGCTCATAGAGCAAAGAACATAT |
| 1155 | GCTCATAGAGCAAAGAACATATT |
| 1156 | CTCATAGAGCAAAGAACATATTG |
| 1157 | TCATAGAGCAAAGAACATATTGA |

| ID | SEQUENCE |
|---|---|
| 1158 | CATAGAGCAAAGAACATATTGAA |
| 1159 | ATAGAGCAAAGAACATATTGAAT |
| 1160 | TAGAGCAAAGAACATATTGAATA |
| 1161 | AGAGCAAAGAACATATTGAATAA |
| 1162 | GAGCAAAGAACATATTGAATAAG |
| 1163 | AGCAAAGAACATATTGAATAAGC |
| 1164 | GCAAAGAACATATTGAATAAGCC |
| 1165 | CAAAGAACATATTGAATAAGCCT |
| 1166 | AAAGAACATATTGAATAAGCCTG |
| 1167 | AAGAACATATTGAATAAGCCTGA |
| 1168 | AGAACATATTGAATAAGCCTGAA |
| 1169 | GAACATATTGAATAAGCCTGAAG |
| 1170 | AACATATTGAATAAGCCTGAAGT |
| 1171 | ACATATTGAATAAGCCTGAAGTG |
| 1172 | CATATTGAATAAGCCTGAAGTGA |
| 1173 | ATATTGAATAAGCCTGAAGTGAA |
| 1174 | TATTGAATAAGCCTGAAGTGAAT |
| 1175 | ATTGAATAAGCCTGAAGTGAATC |
| 1176 | TTGAATAAGCCTGAAGTGAATCA |
| 1177 | TGAATAAGCCTGAAGTGAATCAG |
| 1178 | GAATAAGCCTGAAGTGAATCAGA |
| 1179 | AATAAGCCTGAAGTGAATCAGAA |
| 1180 | ATAAGCCTGAAGTGAATCAGAAA |
| 1181 | TAAGCCTGAAGTGAATCAGAAAC |
| 1182 | AAGCCTGAAGTGAATCAGAAACT |
| 1183 | AGCCTGAAGTGAATCAGAAACTC |
| 1184 | GCCTGAAGTGAATCAGAAACTCA |
| 1185 | CCTGAAGTGAATCAGAAACTCAC |
| 1186 | CTGAAGTGAATCAGAAACTCACC |
| 1187 | TGAAGTGAATCAGAAACTCACCA |
| 1188 | GAAGTGAATCAGAAACTCACCAA |
| 1189 | AAGTGAATCAGAAACTCACCAAA |
| 1190 | AGTGAATCAGAAACTCACCAAAA |
| 1191 | GTGAATCAGAAACTCACCAAAAA |
| 1192 | TGAATCAGAAACTCACCAAAAAA |
| 1193 | GAATCAGAAACTCACCAAAAAAG |
| 1194 | AATCAGAAACTCACCAAAAAAGC |
| 1195 | ATCAGAAACTCACCAAAAAAGCT |
| 1196 | TCAGAAACTCACCAAAAAAGCTC |
| 1197 | CAGAAACTCACCAAAAAAGCTCT |
| 1198 | AGAAACTCACCAAAAAAGCTCTT |
| 1199 | GAAACTCACCAAAAAAGCTCTTA |
| 1200 | AAACTCACCAAAAAAGCTCTTAT |
| 1201 | AACTCACCAAAAAAGCTCTTATT |
| 1202 | ACTCACCAAAAAAGCTCTTATTA |
| 1203 | CTCACCAAAAAAGCTCTTATTAA |
| 1204 | TCACCAAAAAAGCTCTTATTAAG |
| 1205 | CACCAAAAAAGCTCTTATTAAGG |
| 1206 | ACCAAAAAAGCTCTTATTAAGGA |
| 1207 | CCAAAAAAGCTCTTATTAAGGAG |
| 1208 | CAAAAAAGCTCTTATTAAGGAGT |
| 1209 | AAAAAAGCTCTTATTAAGGAGTA |
| 1210 | AAAAAGCTCTTATTAAGGAGTAT |
| 1211 | AAAAGCTCTTATTAAGGAGTATA |
| 1212 | AAAGCTCTTATTAAGGAGTATAC |
| 1213 | AAGCTCTTATTAAGGAGTATACG |
| 1214 | AGCTCTTATTAAGGAGTATACGG |
| 1215 | GCTCTTATTAAGGAGTATACGGA |

| ID | SEQUENCE |
|---|---|
| 1216 | CTCTTATTAAGGAGTATACGGAG |
| 1217 | TCTTATTAAGGAGTATACGGAGG |
| 1218 | CTTATTAAGGAGTATACGGAGGA |
| 1219 | TTATTAAGGAGTATACGGAGGAG |
| 1220 | TATTAAGGAGTATACGGAGGAGA |
| 1221 | ATTAAGGAGTATACGGAGGAGAT |
| 1222 | TTAAGGAGTATACGGAGGAGATA |
| 1223 | TAAGGAGTATACGGAGGAGATAG |
| 1224 | AAGGAGTATACGGAGGAGATAGA |
| 1225 | AGGAGTATACGGAGGAGATAGAA |
| 1226 | GGAGTATACGGAGGAGATAGAAC |
| 1227 | GAGTATACGGAGGAGATAGAACG |
| 1228 | AGTATACGGAGGAGATAGAACGT |
| 1229 | GTATACGGAGGAGATAGAACGTT |
| 1230 | TATACGGAGGAGATAGAACGTTT |
| 1231 | ATACGGAGGAGATAGAACGTTTA |
| 1232 | TACGGAGGAGATAGAACGTTTAA |
| 1233 | ACGGAGGAGATAGAACGTTTAAA |
| 1234 | CGGAGGAGATAGAACGTTTAAAA |
| 1235 | GGAGGAGATAGAACGTTTAAAAC |
| 1236 | GAGGAGATAGAACGTTTAAAACG |
| 1237 | AGGAGATAGAACGTTTAAAACGA |
| 1238 | GGAGATAGAACGTTTAAAACGAG |
| 1239 | GAGATAGAACGTTTAAAACGAGA |
| 1240 | AGATAGAACGTTTAAAACGAGAT |
| 1241 | GATAGAACGTTTAAAACGAGATC |
| 1242 | ATAGAACGTTTAAAACGAGATCT |
| 1243 | TAGAACGTTTAAAACGAGATCTT |
| 1244 | AGAACGTTTAAAACGAGATCTTG |
| 1245 | GAACGTTTAAAACGAGATCTTGC |
| 1246 | AACGTTTAAAACGAGATCTTGCT |
| 1247 | ACGTTTAAAACGAGATCTTGCTG |
| 1248 | CGTTTAAAACGAGATCTTGCTGC |
| 1249 | GTTTAAAACGAGATCTTGCTGCA |
| 1250 | TTTAAAACGAGATCTTGCTGCAG |
| 1251 | TTAAAACGAGATCTTGCTGCAGC |
| 1252 | TAAAACGAGATCTTGCTGCAGCC |
| 1253 | AAAACGAGATCTTGCTGCAGCCC |
| 1254 | AAACGAGATCTTGCTGCAGCCCG |
| 1255 | AACGAGATCTTGCTGCAGCCCGT |
| 1256 | ACGAGATCTTGCTGCAGCCCGTG |
| 1257 | CGAGATCTTGCTGCAGCCCGTGA |
| 1258 | GAGATCTTGCTGCAGCCCGTGAG |
| 1259 | AGATCTTGCTGCAGCCCGTGAGA |
| 1260 | GATCTTGCTGCAGCCCGTGAGAA |
| 1261 | ATCTTGCTGCAGCCCGTGAGAAA |
| 1262 | TCTTGCTGCAGCCCGTGAGAAAA |
| 1263 | CTTGCTGCAGCCCGTGAGAAAAA |
| 1264 | TTGCTGCAGCCCGTGAGAAAAAT |
| 1265 | TGCTGCAGCCCGTGAGAAAAATG |
| 1266 | GCTGCAGCCCGTGAGAAAAATGG |
| 1267 | CTGCAGCCCGTGAGAAAAATGGA |
| 1268 | TGCAGCCCGTGAGAAAAATGGAG |
| 1269 | GCAGCCCGTGAGAAAAATGGAGT |
| 1270 | CAGCCCGTGAGAAAAATGGAGTG |
| 1271 | AGCCCGTGAGAAAAATGGAGTGT |
| 1272 | GCCCGTGAGAAAAATGGAGTGTA |
| 1273 | CCCGTGAGAAAAATGGAGTGTAT |

| ID | SEQUENCE |
|---|---|
| 1274 | CCGTGAGAAAAATGGAGTGTATA |
| 1275 | CGTGAGAAAAATGGAGTGTATAT |
| 1276 | GTGAGAAAAATGGAGTGTATATT |
| 1277 | TGAGAAAAATGGAGTGTATATTT |
| 1278 | GAGAAAAATGGAGTGTATATTTC |
| 1279 | AGAAAAATGGAGTGTATATTTCT |
| 1280 | GAAAAATGGAGTGTATATTTCTG |
| 1281 | AAAAATGGAGTGTATATTTCTGA |
| 1282 | AAAATGGAGTGTATATTTCTGAA |
| 1283 | AAATGGAGTGTATATTTCTGAAG |
| 1284 | AATGGAGTGTATATTTCTGAAGA |
| 1285 | ATGGAGTGTATATTTCTGAAGAA |
| 1286 | TGGAGTGTATATTTCTGAAGAAA |
| 1287 | GGAGTGTATATTTCTGAAGAAAA |
| 1288 | GAGTGTATATTTCTGAAGAAAAT |
| 1289 | AGTGTATATTTCTGAAGAAAATT |
| 1290 | GTGTATATTTCTGAAGAAAATTT |
| 1291 | TGTATATTTCTGAAGAAAATTTT |
| 1292 | GTATATTTCTGAAGAAAATTTTA |
| 1293 | TATATTTCTGAAGAAAATTTTAG |
| 1294 | ATATTTCTGAAGAAAATTTTAGA |
| 1295 | TATTTCTGAAGAAAATTTTAGAG |
| 1296 | ATTTCTGAAGAAAATTTTAGAGT |
| 1297 | TTTCTGAAGAAAATTTTAGAGTC |
| 1298 | TTCTGAAGAAAATTTTAGAGTCA |
| 1299 | TCTGAAGAAAATTTTAGAGTCAT |
| 1300 | CTGAAGAAAATTTTAGAGTCATG |
| 1301 | TGAAGAAAATTTTAGAGTCATGA |
| 1302 | GAAGAAAATTTTAGAGTCATGAG |
| 1303 | AAGAAAATTTTAGAGTCATGAGT |
| 1304 | AGAAAATTTTAGAGTCATGAGTG |
| 1305 | GAAAATTTTAGAGTCATGAGTGG |
| 1306 | AAAATTTTAGAGTCATGAGTGGA |
| 1307 | AAATTTTAGAGTCATGAGTGGAA |
| 1308 | AATTTTAGAGTCATGAGTGGAAA |
| 1309 | ATTTTAGAGTCATGAGTGGAAAA |
| 1310 | TTTTAGAGTCATGAGTGGAAAAT |
| 1311 | TTTAGAGTCATGAGTGGAAAATT |
| 1312 | TTAGAGTCATGAGTGGAAAATTA |
| 1313 | TAGAGTCATGAGTGGAAAATTAA |
| 1314 | AGAGTCATGAGTGGAAAATTAAC |
| 1315 | GAGTCATGAGTGGAAAATTAACT |
| 1316 | AGTCATGAGTGGAAAATTAACTG |
| 1317 | GTCATGAGTGGAAAATTAACTGT |
| 1318 | TCATGAGTGGAAAATTAACTGTT |
| 1319 | CATGAGTGGAAAATTAACTGTTC |
| 1320 | ATGAGTGGAAAATTAACTGTTCA |
| 1321 | TGAGTGGAAAATTAACTGTTCAA |
| 1322 | GAGTGGAAAATTAACTGTTCAAG |
| 1323 | AGTGGAAAATTAACTGTTCAAGA |
| 1324 | GTGGAAAATTAACTGTTCAAGAA |
| 1325 | TGGAAAATTAACTGTTCAAGAAG |
| 1326 | GGAAAATTAACTGTTCAAGAAGA |
| 1327 | GAAAATTAACTGTTCAAGAAGAG |
| 1328 | AAAATTAACTGTTCAAGAAGAGC |
| 1329 | AAATTAACTGTTCAAGAAGAGCA |
| 1330 | AATTAACTGTTCAAGAAGAGCAG |
| 1331 | ATTAACTGTTCAAGAAGAGCAGA |

| ID | SEQUENCE |
|---|---|
| 1332 | TTAACTGTTCAAGAAGAGCAGAT |
| 1333 | TAACTGTTCAAGAAGAGCAGATT |
| 1334 | AACTGTTCAAGAAGAGCAGATTG |
| 1335 | ACTGTTCAAGAAGAGCAGATTGT |
| 1336 | CTGTTCAAGAAGAGCAGATTGTA |
| 1337 | TGTTCAAGAAGAGCAGATTGTAG |
| 1338 | GTTCAAGAAGAGCAGATTGTAGA |
| 1339 | TTCAAGAAGAGCAGATTGTAGAA |
| 1340 | TCAAGAAGAGCAGATTGTAGAAT |
| 1341 | CAAGAAGAGCAGATTGTAGAATT |
| 1342 | AAGAAGAGCAGATTGTAGAATTG |
| 1343 | AGAAGAGCAGATTGTAGAATTGA |
| 1344 | GAAGAGCAGATTGTAGAATTGAT |
| 1345 | AAGAGCAGATTGTAGAATTGATT |
| 1346 | AGAGCAGATTGTAGAATTGATTG |
| 1347 | GAGCAGATTGTAGAATTGATTGA |
| 1348 | AGCAGATTGTAGAATTGATTGAA |
| 1349 | GCAGATTGTAGAATTGATTGAAA |
| 1350 | CAGATTGTAGAATTGATTGAAAA |
| 1351 | AGATTGTAGAATTGATTGAAAAA |
| 1352 | GATTGTAGAATTGATTGAAAAAA |
| 1353 | ATTGTAGAATTGATTGAAAAAAT |
| 1354 | TTGTAGAATTGATTGAAAAAATT |
| 1355 | TGTAGAATTGATTGAAAAAATTG |
| 1356 | GTAGAATTGATTGAAAAAATTGG |
| 1357 | TAGAATTGATTGAAAAAATTGGT |
| 1358 | AGAATTGATTGAAAAAATTGGTG |
| 1359 | GAATTGATTGAAAAAATTGGTGC |
| 1360 | AATTGATTGAAAAAATTGGTGCT |
| 1361 | ATTGATTGAAAAAATTGGTGCTG |
| 1362 | TTGATTGAAAAAATTGGTGCTGT |
| 1363 | TGATTGAAAAAATTGGTGCTGTT |
| 1364 | GATTGAAAAAATTGGTGCTGTTG |
| 1365 | ATTGAAAAAATTGGTGCTGTTGA |
| 1366 | TTGAAAAAATTGGTGCTGTTGAG |
| 1367 | TGAAAAAATTGGTGCTGTTGAGG |
| 1368 | GAAAAAATTGGTGCTGTTGAGGA |
| 1369 | AAAAAATTGGTGCTGTTGAGGAG |
| 1370 | AAAAATTGGTGCTGTTGAGGAGG |
| 1371 | AAAATTGGTGCTGTTGAGGAGGA |
| 1372 | AAATTGGTGCTGTTGAGGAGGAG |
| 1373 | AATTGGTGCTGTTGAGGAGGAGC |
| 1374 | ATTGGTGCTGTTGAGGAGGAGCT |
| 1375 | TTGGTGCTGTTGAGGAGGAGCTG |
| 1376 | TGGTGCTGTTGAGGAGGAGCTGA |
| 1377 | GGTGCTGTTGAGGAGGAGCTGAA |
| 1378 | GTGCTGTTGAGGAGGAGCTGAAT |
| 1379 | TGCTGTTGAGGAGGAGCTGAATA |
| 1380 | GCTGTTGAGGAGGAGCTGAATAG |
| 1381 | CTGTTGAGGAGGAGCTGAATAGG |
| 1382 | TGTTGAGGAGGAGCTGAATAGGG |
| 1383 | GTTGAGGAGGAGCTGAATAGGGT |
| 1384 | TTGAGGAGGAGCTGAATAGGGTT |
| 1385 | TGAGGAGGAGCTGAATAGGGTTA |
| 1386 | GAGGAGGAGCTGAATAGGGTTAC |
| 1387 | AGGAGGAGCTGAATAGGGTTACA |
| 1388 | GGAGGAGCTGAATAGGGTTACAG |
| 1389 | GAGGAGCTGAATAGGGTTACAGA |

| ID | SEQUENCE |
|---|---|
| 1390 | AGGAGCTGAATAGGGTTACAGAG |
| 1391 | GGAGCTGAATAGGGTTACAGAGT |
| 1392 | GAGCTGAATAGGGTTACAGAGTT |
| 1393 | AGCTGAATAGGGTTACAGAGTTG |
| 1394 | GCTGAATAGGGTTACAGAGTTGT |
| 1395 | CTGAATAGGGTTACAGAGTTGTT |
| 1396 | TGAATAGGGTTACAGAGTTGTTT |
| 1397 | GAATAGGGTTACAGAGTTGTTTA |
| 1398 | AATAGGGTTACAGAGTTGTTTAT |
| 1399 | ATAGGGTTACAGAGTTGTTTATG |
| 1400 | TAGGGTTACAGAGTTGTTTATGG |
| 1401 | AGGGTTACAGAGTTGTTTATGGA |
| 1402 | GGGTTACAGAGTTGTTTATGGAT |
| 1403 | GGTTACAGAGTTGTTTATGGATA |
| 1404 | GTTACAGAGTTGTTTATGGATAA |
| 1405 | TTACAGAGTTGTTTATGGATAAT |
| 1406 | TACAGAGTTGTTTATGGATAATA |
| 1407 | ACAGAGTTGTTTATGGATAATAA |
| 1408 | CAGAGTTGTTTATGGATAATAAA |
| 1409 | AGAGTTGTTTATGGATAATAAAA |
| 1410 | GAGTTGTTTATGGATAATAAAAA |
| 1411 | AGTTGTTTATGGATAATAAAAAT |
| 1412 | GTTGTTTATGGATAATAAAAATG |
| 1413 | TTGTTTATGGATAATAAAAATGA |
| 1414 | TGTTTATGGATAATAAAAATGAA |
| 1415 | GTTTATGGATAATAAAAATGAAC |
| 1416 | TTTATGGATAATAAAAATGAACT |
| 1417 | TTATGGATAATAAAAATGAACTT |
| 1418 | TATGGATAATAAAAATGAACTTG |
| 1419 | ATGGATAATAAAAATGAACTTGA |
| 1420 | TGGATAATAAAAATGAACTTGAC |
| 1421 | GGATAATAAAAATGAACTTGACC |
| 1422 | GATAATAAAAATGAACTTGACCA |
| 1423 | ATAATAAAAATGAACTTGACCAG |
| 1424 | TAATAAAAATGAACTTGACCAGT |
| 1425 | AATAAAAATGAACTTGACCAGTG |
| 1426 | ATAAAAATGAACTTGACCAGTGT |
| 1427 | TAAAAATGAACTTGACCAGTGTA |
| 1428 | AAAAATGAACTTGACCAGTGTAA |
| 1429 | AAAATGAACTTGACCAGTGTAAA |
| 1430 | AAATGAACTTGACCAGTGTAAAT |
| 1431 | AATGAACTTGACCAGTGTAAATC |
| 1432 | ATGAACTTGACCAGTGTAAATCT |
| 1433 | TGAACTTGACCAGTGTAAATCTG |
| 1434 | GAACTTGACCAGTGTAAATCTGA |
| 1435 | AACTTGACCAGTGTAAATCTGAC |
| 1436 | ACTTGACCAGTGTAAATCTGACC |
| 1437 | CTTGACCAGTGTAAATCTGACCT |
| 1438 | TTGACCAGTGTAAATCTGACCTG |
| 1439 | TGACCAGTGTAAATCTGACCTGC |
| 1440 | GACCAGTGTAAATCTGACCTGCA |
| 1441 | ACCAGTGTAAATCTGACCTGCAA |
| 1442 | CCAGTGTAAATCTGACCTGCAAA |
| 1443 | CAGTGTAAATCTGACCTGCAAAA |
| 1444 | AGTGTAAATCTGACCTGCAAAAT |
| 1445 | GTGTAAATCTGACCTGCAAAATA |
| 1446 | TGTAAATCTGACCTGCAAAATAA |
| 1447 | GTAAATCTGACCTGCAAAATAAA |

| ID | SEQUENCE |
|---|---|
| 1448 | TAAATCTGACCTGCAAAATAAAA |
| 1449 | AAATCTGACCTGCAAAATAAAAC |
| 1450 | AATCTGACCTGCAAAATAAAACA |
| 1451 | ATCTGACCTGCAAAATAAAACAC |
| 1452 | TCTGACCTGCAAAATAAAACACA |
| 1453 | CTGACCTGCAAAATAAAACACAA |
| 1454 | TGACCTGCAAAATAAAACACAAG |
| 1455 | GACCTGCAAAATAAAACACAAGA |
| 1456 | ACCTGCAAAATAAAACACAAGAA |
| 1457 | CCTGCAAAATAAAACACAAGAAC |
| 1458 | CTGCAAAATAAAACACAAGAACT |
| 1459 | TGCAAAATAAAACACAAGAACTT |
| 1460 | GCAAAATAAAACACAAGAACTTG |
| 1461 | CAAAATAAAACACAAGAACTTGA |
| 1462 | AAAATAAAACACAAGAACTTGAA |
| 1463 | AAATAAAACACAAGAACTTGAAA |
| 1464 | AATAAAACACAAGAACTTGAAAC |
| 1465 | ATAAAACACAAGAACTTGAAACC |
| 1466 | TAAAACACAAGAACTTGAAACCA |
| 1467 | AAAACACAAGAACTTGAAACCAC |
| 1468 | AAACACAAGAACTTGAAACCACT |
| 1469 | AACACAAGAACTTGAAACCACTC |
| 1470 | ACACAAGAACTTGAAACCACTCA |
| 1471 | CACAAGAACTTGAAACCACTCAA |
| 1472 | ACAAGAACTTGAAACCACTCAAA |
| 1473 | CAAGAACTTGAAACCACTCAAAA |
| 1474 | AAGAACTTGAAACCACTCAAAAA |
| 1475 | AGAACTTGAAACCACTCAAAAAC |
| 1476 | GAACTTGAAACCACTCAAAAACA |
| 1477 | AACTTGAAACCACTCAAAAACAT |
| 1478 | ACTTGAAACCACTCAAAAACATT |
| 1479 | CTTGAAACCACTCAAAAACATTT |
| 1480 | TTGAAACCACTCAAAAACATTTG |
| 1481 | TGAAACCACTCAAAAACATTTGC |
| 1482 | GAAACCACTCAAAAACATTTGCA |
| 1483 | AAACCACTCAAAAACATTTGCAA |
| 1484 | AACCACTCAAAAACATTTGCAAG |
| 1485 | ACCACTCAAAAACATTTGCAAGA |
| 1486 | CCACTCAAAAACATTTGCAAGAA |
| 1487 | CACTCAAAAACATTTGCAAGAAA |
| 1488 | ACTCAAAAACATTTGCAAGAAAC |
| 1489 | CTCAAAAACATTTGCAAGAAACT |
| 1490 | TCAAAAACATTTGCAAGAAACTA |
| 1491 | CAAAAACATTTGCAAGAAACTAA |
| 1492 | AAAAACATTTGCAAGAAACTAAA |
| 1493 | AAAACATTTGCAAGAAACTAAAT |
| 1494 | AAACATTTGCAAGAAACTAAATT |
| 1495 | AACATTTGCAAGAAACTAAATTA |
| 1496 | ACATTTGCAAGAAACTAAATTAC |
| 1497 | CATTTGCAAGAAACTAAATTACA |
| 1498 | ATTTGCAAGAAACTAAATTACAA |
| 1499 | TTTGCAAGAAACTAAATTACAAC |
| 1500 | TTGCAAGAAACTAAATTACAACT |
| 1501 | TGCAAGAAACTAAATTACAACTT |
| 1502 | GCAAGAAACTAAATTACAACTTG |
| 1503 | CAAGAAACTAAATTACAACTTGT |
| 1504 | AAGAAACTAAATTACAACTTGTT |
| 1505 | AGAAACTAAATTACAACTTGTTA |

| ID | SEQUENCE |
|---|---|
| 1506 | GAAACTAAATTACAACTTGTTAA |
| 1507 | AAACTAAATTACAACTTGTTAAA |
| 1508 | AACTAAATTACAACTTGTTAAAG |
| 1509 | ACTAAATTACAACTTGTTAAAGA |
| 1510 | CTAAATTACAACTTGTTAAAGAA |
| 1511 | TAAATTACAACTTGTTAAAGAAG |
| 1512 | AAATTACAACTTGTTAAAGAAGA |
| 1513 | AATTACAACTTGTTAAAGAAGAA |
| 1514 | ATTACAACTTGTTAAAGAAGAAT |
| 1515 | TTACAACTTGTTAAAGAAGAATA |
| 1516 | TACAACTTGTTAAAGAAGAATAT |
| 1517 | ACAACTTGTTAAAGAAGAATATA |
| 1518 | CAACTTGTTAAAGAAGAATATAT |
| 1519 | AACTTGTTAAAGAAGAATATATC |
| 1520 | ACTTGTTAAAGAAGAATATATCA |
| 1521 | CTTGTTAAAGAAGAATATATCAC |
| 1522 | TTGTTAAAGAAGAATATATCACA |
| 1523 | TGTTAAAGAAGAATATATCACAT |
| 1524 | GTTAAAGAAGAATATATCACATC |
| 1525 | TTAAAGAAGAATATATCACATCA |
| 1526 | TAAAGAAGAATATATCACATCAG |
| 1527 | AAAGAAGAATATATCACATCAGC |
| 1528 | AAGAAGAATATATCACATCAGCT |
| 1529 | AGAAGAATATATCACATCAGCTT |
| 1530 | GAAGAATATATCACATCAGCTTT |
| 1531 | AAGAATATATCACATCAGCTTTG |
| 1532 | AGAATATATCACATCAGCTTTGG |
| 1533 | GAATATATCACATCAGCTTTGGA |
| 1534 | AATATATCACATCAGCTTTGGAA |
| 1535 | ATATATCACATCAGCTTTGGAAA |
| 1536 | TATATCACATCAGCTTTGGAAAG |
| 1537 | ATATCACATCAGCTTTGGAAAGT |
| 1538 | TATCACATCAGCTTTGGAAAGTA |
| 1539 | ATCACATCAGCTTTGGAAAGTAC |
| 1540 | TCACATCAGCTTTGGAAAGTACT |
| 1541 | CACATCAGCTTTGGAAAGTACTG |
| 1542 | ACATCAGCTTTGGAAAGTACTGA |
| 1543 | CATCAGCTTTGGAAAGTACTGAG |
| 1544 | ATCAGCTTTGGAAAGTACTGAGG |
| 1545 | TCAGCTTTGGAAAGTACTGAGGA |
| 1546 | CAGCTTTGGAAAGTACTGAGGAG |
| 1547 | AGCTTTGGAAAGTACTGAGGAGA |
| 1548 | GCTTTGGAAAGTACTGAGGAGAA |
| 1549 | CTTTGGAAAGTACTGAGGAGAAA |
| 1550 | TTTGGAAAGTACTGAGGAGAAAC |
| 1551 | TTGGAAAGTACTGAGGAGAAACT |
| 1552 | TGGAAAGTACTGAGGAGAAACTT |
| 1553 | GGAAAGTACTGAGGAGAAACTTC |
| 1554 | GAAAGTACTGAGGAGAAACTTCA |
| 1555 | AAAGTACTGAGGAGAAACTTCAT |
| 1556 | AAGTACTGAGGAGAAACTTCATG |
| 1557 | AGTACTGAGGAGAAACTTCATGA |
| 1558 | GTACTGAGGAGAAACTTCATGAT |
| 1559 | TACTGAGGAGAAACTTCATGATG |
| 1560 | ACTGAGGAGAAACTTCATGATGC |
| 1561 | CTGAGGAGAAACTTCATGATGCT |
| 1562 | TGAGGAGAAACTTCATGATGCTG |
| 1563 | GAGGAGAAACTTCATGATGCTGC |

| ID | SEQUENCE |
|---|---|
| 1564 | AGGAGAAACTTCATGATGCTGCC |
| 1565 | GGAGAAACTTCATGATGCTGCCA |
| 1566 | GAGAAACTTCATGATGCTGCCAG |
| 1567 | AGAAACTTCATGATGCTGCCAGC |
| 1568 | GAAACTTCATGATGCTGCCAGCA |
| 1569 | AAACTTCATGATGCTGCCAGCAA |
| 1570 | AACTTCATGATGCTGCCAGCAAG |
| 1571 | ACTTCATGATGCTGCCAGCAAGC |
| 1572 | CTTCATGATGCTGCCAGCAAGCT |
| 1573 | TTCATGATGCTGCCAGCAAGCTG |
| 1574 | TCATGATGCTGCCAGCAAGCTGC |
| 1575 | CATGATGCTGCCAGCAAGCTGCT |
| 1576 | ATGATGCTGCCAGCAAGCTGCTT |
| 1577 | TGATGCTGCCAGCAAGCTGCTTA |
| 1578 | GATGCTGCCAGCAAGCTGCTTAA |
| 1579 | ATGCTGCCAGCAAGCTGCTTAAC |
| 1580 | TGCTGCCAGCAAGCTGCTTAACA |
| 1581 | GCTGCCAGCAAGCTGCTTAACAC |
| 1582 | CTGCCAGCAAGCTGCTTAACACA |
| 1583 | TGCCAGCAAGCTGCTTAACACAG |
| 1584 | GCCAGCAAGCTGCTTAACACAGT |
| 1585 | CCAGCAAGCTGCTTAACACAGTT |
| 1586 | CAGCAAGCTGCTTAACACAGTTG |
| 1587 | AGCAAGCTGCTTAACACAGTTGA |
| 1588 | GCAAGCTGCTTAACACAGTTGAA |
| 1589 | CAAGCTGCTTAACACAGTTGAAG |
| 1590 | AAGCTGCTTAACACAGTTGAAGA |
| 1591 | AGCTGCTTAACACAGTTGAAGAA |
| 1592 | GCTGCTTAACACAGTTGAAGAAA |
| 1593 | CTGCTTAACACAGTTGAAGAAAC |
| 1594 | TGCTTAACACAGTTGAAGAAACT |
| 1595 | GCTTAACACAGTTGAAGAAACTA |
| 1596 | CTTAACACAGTTGAAGAAACTAC |
| 1597 | TTAACACAGTTGAAGAAACTACA |
| 1598 | TAACACAGTTGAAGAAACTACAA |
| 1599 | AACACAGTTGAAGAAACTACAAA |
| 1600 | ACACAGTTGAAGAAACTACAAAA |
| 1601 | CACAGTTGAAGAAACTACAAAAG |
| 1602 | ACAGTTGAAGAAACTACAAAAGA |
| 1603 | CAGTTGAAGAAACTACAAAAGAT |
| 1604 | AGTTGAAGAAACTACAAAAGATG |
| 1605 | GTTGAAGAAACTACAAAAGATGT |
| 1606 | TTGAAGAAACTACAAAAGATGTA |
| 1607 | TGAAGAAACTACAAAAGATGTAT |
| 1608 | GAAGAAACTACAAAAGATGTATC |
| 1609 | AAGAAACTACAAAAGATGTATCT |
| 1610 | AGAAACTACAAAAGATGTATCTG |
| 1611 | GAAACTACAAAAGATGTATCTGG |
| 1612 | AAACTACAAAAGATGTATCTGGT |
| 1613 | AACTACAAAAGATGTATCTGGTC |
| 1614 | ACTACAAAAGATGTATCTGGTCT |
| 1615 | CTACAAAAGATGTATCTGGTCTC |
| 1616 | TACAAAAGATGTATCTGGTCTCC |
| 1617 | ACAAAAGATGTATCTGGTCTCCA |
| 1618 | CAAAAGATGTATCTGGTCTCCAT |
| 1619 | AAAAGATGTATCTGGTCTCCATT |
| 1620 | AAAGATGTATCTGGTCTCCATTC |
| 1621 | AAGATGTATCTGGTCTCCATTCC |

| ID | SEQUENCE |
|---|---|
| 1622 | AGATGTATCTGGTCTCCATTCCA |
| 1623 | GATGTATCTGGTCTCCATTCCAA |
| 1624 | ATGTATCTGGTCTCCATTCCAAA |
| 1625 | TGTATCTGGTCTCCATTCCAAAC |
| 1626 | GTATCTGGTCTCCATTCCAAACT |
| 1627 | TATCTGGTCTCCATTCCAAACTG |
| 1628 | ATCTGGTCTCCATTCCAAACTGG |
| 1629 | TCTGGTCTCCATTCCAAACTGGA |
| 1630 | CTGGTCTCCATTCCAAACTGGAT |
| 1631 | TGGTCTCCATTCCAAACTGGATC |
| 1632 | GGTCTCCATTCCAAACTGGATCG |
| 1633 | GTCTCCATTCCAAACTGGATCGT |
| 1634 | TCTCCATTCCAAACTGGATCGTA |
| 1635 | CTCCATTCCAAACTGGATCGTAA |
| 1636 | TCCATTCCAAACTGGATCGTAAG |
| 1637 | CCATTCCAAACTGGATCGTAAGA |
| 1638 | CATTCCAAACTGGATCGTAAGAA |
| 1639 | ATTCCAAACTGGATCGTAAGAAG |
| 1640 | TTCCAAACTGGATCGTAAGAAGG |
| 1641 | TCCAAACTGGATCGTAAGAAGGC |
| 1642 | CCAAACTGGATCGTAAGAAGGCA |
| 1643 | CAAACTGGATCGTAAGAAGGCAG |
| 1644 | AAACTGGATCGTAAGAAGGCAGT |
| 1645 | AACTGGATCGTAAGAAGGCAGTT |
| 1646 | ACTGGATCGTAAGAAGGCAGTTG |
| 1647 | CTGGATCGTAAGAAGGCAGTTGA |
| 1648 | TGGATCGTAAGAAGGCAGTTGAC |
| 1649 | GGATCGTAAGAAGGCAGTTGACC |
| 1650 | GATCGTAAGAAGGCAGTTGACCA |
| 1651 | ATCGTAAGAAGGCAGTTGACCAA |
| 1652 | TCGTAAGAAGGCAGTTGACCAAC |
| 1653 | CGTAAGAAGGCAGTTGACCAACA |
| 1654 | GTAAGAAGGCAGTTGACCAACAC |
| 1655 | TAAGAAGGCAGTTGACCAACACA |
| 1656 | AAGAAGGCAGTTGACCAACACAA |
| 1657 | AGAAGGCAGTTGACCAACACAAT |
| 1658 | GAAGGCAGTTGACCAACACAATG |
| 1659 | AAGGCAGTTGACCAACACAATGC |
| 1660 | AGGCAGTTGACCAACACAATGCA |
| 1661 | GGCAGTTGACCAACACAATGCAG |
| 1662 | GCAGTTGACCAACACAATGCAGA |
| 1663 | CAGTTGACCAACACAATGCAGAA |
| 1664 | AGTTGACCAACACAATGCAGAAG |
| 1665 | GTTGACCAACACAATGCAGAAGC |
| 1666 | TTGACCAACACAATGCAGAAGCT |
| 1667 | TGACCAACACAATGCAGAAGCTC |
| 1668 | GACCAACACAATGCAGAAGCTCA |
| 1669 | ACCAACACAATGCAGAAGCTCAG |
| 1670 | CCAACACAATGCAGAAGCTCAGG |
| 1671 | CAACACAATGCAGAAGCTCAGGA |
| 1672 | AACACAATGCAGAAGCTCAGGAT |
| 1673 | ACACAATGCAGAAGCTCAGGATA |
| 1674 | CACAATGCAGAAGCTCAGGATAT |
| 1675 | ACAATGCAGAAGCTCAGGATATT |
| 1676 | CAATGCAGAAGCTCAGGATATTT |
| 1677 | AATGCAGAAGCTCAGGATATTTT |
| 1678 | ATGCAGAAGCTCAGGATATTTTT |
| 1679 | TGCAGAAGCTCAGGATATTTTTG |

| ID | SEQUENCE |
|---|---|
| 1680 | GCAGAAGCTCAGGATATTTTTGG |
| 1681 | CAGAAGCTCAGGATATTTTTGGC |
| 1682 | AGAAGCTCAGGATATTTTTGGCA |
| 1683 | GAAGCTCAGGATATTTTTGGCAA |
| 1684 | AAGCTCAGGATATTTTTGGCAAA |
| 1685 | AGCTCAGGATATTTTTGGCAAAA |
| 1686 | GCTCAGGATATTTTTGGCAAAAA |
| 1687 | CTCAGGATATTTTTGGCAAAAAC |
| 1688 | TCAGGATATTTTTGGCAAAAACC |
| 1689 | CAGGATATTTTTGGCAAAAACCT |
| 1690 | AGGATATTTTTGGCAAAAACCTG |
| 1691 | GGATATTTTTGGCAAAAACCTGA |
| 1692 | GATATTTTTGGCAAAAACCTGAA |
| 1693 | ATATTTTTGGCAAAAACCTGAAT |
| 1694 | TATTTTTGGCAAAAACCTGAATA |
| 1695 | ATTTTTGGCAAAAACCTGAATAG |
| 1696 | TTTTTGGCAAAAACCTGAATAGT |
| 1697 | TTTTGGCAAAAACCTGAATAGTC |
| 1698 | TTTGGCAAAAACCTGAATAGTCT |
| 1699 | TTGGCAAAAACCTGAATAGTCTG |
| 1700 | TGGCAAAAACCTGAATAGTCTGT |
| 1701 | GGCAAAAACCTGAATAGTCTGTT |
| 1702 | GCAAAAACCTGAATAGTCTGTTT |
| 1703 | CAAAAACCTGAATAGTCTGTTTA |
| 1704 | AAAAACCTGAATAGTCTGTTTAA |
| 1705 | AAAACCTGAATAGTCTGTTTAAT |
| 1706 | AAACCTGAATAGTCTGTTTAATA |
| 1707 | AACCTGAATAGTCTGTTTAATAA |
| 1708 | ACCTGAATAGTCTGTTTAATAAT |
| 1709 | CCTGAATAGTCTGTTTAATAATA |
| 1710 | CTGAATAGTCTGTTTAATAATAT |
| 1711 | TGAATAGTCTGTTTAATAATATG |
| 1712 | GAATAGTCTGTTTAATAATATGG |
| 1713 | AATAGTCTGTTTAATAATATGGA |
| 1714 | ATAGTCTGTTTAATAATATGGAA |
| 1715 | TAGTCTGTTTAATAATATGGAAG |
| 1716 | AGTCTGTTTAATAATATGGAAGA |
| 1717 | GTCTGTTTAATAATATGGAAGAA |
| 1718 | TCTGTTTAATAATATGGAAGAAT |
| 1719 | CTGTTTAATAATATGGAAGAATT |
| 1720 | TGTTTAATAATATGGAAGAATTA |
| 1721 | GTTTAATAATATGGAAGAATTAA |
| 1722 | TTTAATAATATGGAAGAATTAAT |
| 1723 | TTAATAATATGGAAGAATTAATT |
| 1724 | TAATAATATGGAAGAATTAATTA |
| 1725 | AATAATATGGAAGAATTAATTAA |
| 1726 | ATAATATGGAAGAATTAATTAAG |
| 1727 | TAATATGGAAGAATTAATTAAGG |
| 1728 | AATATGGAAGAATTAATTAAGGA |
| 1729 | ATATGGAAGAATTAATTAAGGAT |
| 1730 | TATGGAAGAATTAATTAAGGATG |
| 1731 | ATGGAAGAATTAATTAAGGATGG |
| 1732 | TGGAAGAATTAATTAAGGATGGC |
| 1733 | GGAAGAATTAATTAAGGATGGCA |
| 1734 | GAAGAATTAATTAAGGATGGCAG |
| 1735 | AAGAATTAATTAAGGATGGCAGC |
| 1736 | AGAATTAATTAAGGATGGCAGCT |
| 1737 | GAATTAATTAAGGATGGCAGCTC |

| ID | SEQUENCE |
|---|---|
| 1738 | AATTAATTAAGGATGGCAGCTCA |
| 1739 | ATTAATTAAGGATGGCAGCTCAA |
| 1740 | TTAATTAAGGATGGCAGCTCAAA |
| 1741 | TAATTAAGGATGGCAGCTCAAAG |
| 1742 | AATTAAGGATGGCAGCTCAAAGC |
| 1743 | ATTAAGGATGGCAGCTCAAAGCA |
| 1744 | TTAAGGATGGCAGCTCAAAGCAA |
| 1745 | TAAGGATGGCAGCTCAAAGCAAA |
| 1746 | AAGGATGGCAGCTCAAAGCAAAA |
| 1747 | AGGATGGCAGCTCAAAGCAAAAG |
| 1748 | GGATGGCAGCTCAAAGCAAAAGG |
| 1749 | GATGGCAGCTCAAAGCAAAAGGC |
| 1750 | ATGGCAGCTCAAAGCAAAAGGCC |
| 1751 | TGGCAGCTCAAAGCAAAAGGCCA |
| 1752 | GGCAGCTCAAAGCAAAAGGCCAT |
| 1753 | GCAGCTCAAAGCAAAAGGCCATG |
| 1754 | CAGCTCAAAGCAAAAGGCCATGC |
| 1755 | AGCTCAAAGCAAAAGGCCATGCT |
| 1756 | GCTCAAAGCAAAAGGCCATGCTA |
| 1757 | CTCAAAGCAAAAGGCCATGCTAG |
| 1758 | TCAAAGCAAAAGGCCATGCTAGA |
| 1759 | CAAAGCAAAAGGCCATGCTAGAA |
| 1760 | AAAGCAAAAGGCCATGCTAGAAG |
| 1761 | AAGCAAAAGGCCATGCTAGAAGT |
| 1762 | AGCAAAAGGCCATGCTAGAAGTA |
| 1763 | GCAAAAGGCCATGCTAGAAGTAC |
| 1764 | CAAAAGGCCATGCTAGAAGTACA |
| 1765 | AAAAGGCCATGCTAGAAGTACAT |
| 1766 | AAAGGCCATGCTAGAAGTACATA |
| 1767 | AAGGCCATGCTAGAAGTACATAA |
| 1768 | AGGCCATGCTAGAAGTACATAAG |
| 1769 | GGCCATGCTAGAAGTACATAAGA |
| 1770 | GCCATGCTAGAAGTACATAAGAC |
| 1771 | CCATGCTAGAAGTACATAAGACC |
| 1772 | CATGCTAGAAGTACATAAGACCT |
| 1773 | ATGCTAGAAGTACATAAGACCTT |
| 1774 | TGCTAGAAGTACATAAGACCTTA |
| 1775 | GCTAGAAGTACATAAGACCTTAT |
| 1776 | CTAGAAGTACATAAGACCTTATT |
| 1777 | TAGAAGTACATAAGACCTTATTT |
| 1778 | AGAAGTACATAAGACCTTATTTG |
| 1779 | GAAGTACATAAGACCTTATTTGG |
| 1780 | AAGTACATAAGACCTTATTTGGT |
| 1781 | AGTACATAAGACCTTATTTGGTA |
| 1782 | GTACATAAGACCTTATTTGGTAA |
| 1783 | TACATAAGACCTTATTTGGTAAT |
| 1784 | ACATAAGACCTTATTTGGTAATC |
| 1785 | CATAAGACCTTATTTGGTAATCT |
| 1786 | ATAAGACCTTATTTGGTAATCTG |
| 1787 | TAAGACCTTATTTGGTAATCTGC |
| 1788 | AAGACCTTATTTGGTAATCTGCT |
| 1789 | AGACCTTATTTGGTAATCTGCTG |
| 1790 | GACCTTATTTGGTAATCTGCTGT |
| 1791 | ACCTTATTTGGTAATCTGCTGTC |
| 1792 | CCTTATTTGGTAATCTGCTGTCT |
| 1793 | CTTATTTGGTAATCTGCTGTCTT |
| 1794 | TTATTTGGTAATCTGCTGTCTTC |
| 1795 | TATTTGGTAATCTGCTGTCTTCC |

| ID | SEQUENCE |
|---|---|
| 1796 | ATTTGGTAATCTGCTGTCTTCCA |
| 1797 | TTTGGTAATCTGCTGTCTTCCAG |
| 1798 | TTGGTAATCTGCTGTCTTCCAGT |
| 1799 | TGGTAATCTGCTGTCTTCCAGTG |
| 1800 | GGTAATCTGCTGTCTTCCAGTGT |
| 1801 | GTAATCTGCTGTCTTCCAGTGTC |
| 1802 | TAATCTGCTGTCTTCCAGTGTCT |
| 1803 | AATCTGCTGTCTTCCAGTGTCTC |
| 1804 | ATCTGCTGTCTTCCAGTGTCTCT |
| 1805 | TCTGCTGTCTTCCAGTGTCTCTG |
| 1806 | CTGCTGTCTTCCAGTGTCTCTGC |
| 1807 | TGCTGTCTTCCAGTGTCTCTGCA |
| 1808 | GCTGTCTTCCAGTGTCTCTGCAT |
| 1809 | CTGTCTTCCAGTGTCTCTGCATT |
| 1810 | TGTCTTCCAGTGTCTCTGCATTA |
| 1811 | GTCTTCCAGTGTCTCTGCATTAG |
| 1812 | TCTTCCAGTGTCTCTGCATTAGA |
| 1813 | CTTCCAGTGTCTCTGCATTAGAT |
| 1814 | TTCCAGTGTCTCTGCATTAGATA |
| 1815 | TCCAGTGTCTCTGCATTAGATAC |
| 1816 | CCAGTGTCTCTGCATTAGATACC |
| 1817 | CAGTGTCTCTGCATTAGATACCA |
| 1818 | AGTGTCTCTGCATTAGATACCAT |
| 1819 | GTGTCTCTGCATTAGATACCATT |
| 1820 | TGTCTCTGCATTAGATACCATTA |
| 1821 | GTCTCTGCATTAGATACCATTAC |
| 1822 | TCTCTGCATTAGATACCATTACT |
| 1823 | CTCTGCATTAGATACCATTACTA |
| 1824 | TCTGCATTAGATACCATTACTAC |
| 1825 | CTGCATTAGATACCATTACTACA |
| 1826 | TGCATTAGATACCATTACTACAG |
| 1827 | GCATTAGATACCATTACTACAGT |
| 1828 | CATTAGATACCATTACTACAGTA |
| 1829 | ATTAGATACCATTACTACAGTAG |
| 1830 | TTAGATACCATTACTACAGTAGC |
| 1831 | TAGATACCATTACTACAGTAGCA |
| 1832 | AGATACCATTACTACAGTAGCAC |
| 1833 | GATACCATTACTACAGTAGCACT |
| 1834 | ATACCATTACTACAGTAGCACTT |
| 1835 | TACCATTACTACAGTAGCACTTG |
| 1836 | ACCATTACTACAGTAGCACTTGG |
| 1837 | CCATTACTACAGTAGCACTTGGA |
| 1838 | CATTACTACAGTAGCACTTGGAT |
| 1839 | ATTACTACAGTAGCACTTGGATC |
| 1840 | TTACTACAGTAGCACTTGGATCT |
| 1841 | TACTACAGTAGCACTTGGATCTC |
| 1842 | ACTACAGTAGCACTTGGATCTCT |
| 1843 | CTACAGTAGCACTTGGATCTCTC |
| 1844 | TACAGTAGCACTTGGATCTCTCA |
| 1845 | ACAGTAGCACTTGGATCTCTCAC |
| 1846 | CAGTAGCACTTGGATCTCTCACA |
| 1847 | AGTAGCACTTGGATCTCTCACAT |
| 1848 | GTAGCACTTGGATCTCTCACATC |
| 1849 | TAGCACTTGGATCTCTCACATCT |
| 1850 | AGCACTTGGATCTCTCACATCTA |
| 1851 | GCACTTGGATCTCTCACATCTAT |
| 1852 | CACTTGGATCTCTCACATCTATT |
| 1853 | ACTTGGATCTCTCACATCTATTC |

| ID | SEQUENCE |
|---|---|
| 1854 | CTTGGATCTCTCACATCTATTCC |
| 1855 | TTGGATCTCTCACATCTATTCCA |
| 1856 | TGGATCTCTCACATCTATTCCAG |
| 1857 | GGATCTCTCACATCTATTCCAGA |
| 1858 | GATCTCTCACATCTATTCCAGAA |
| 1859 | ATCTCTCACATCTATTCCAGAAA |
| 1860 | TCTCTCACATCTATTCCAGAAAA |
| 1861 | CTCTCACATCTATTCCAGAAAAT |
| 1862 | TCTCACATCTATTCCAGAAAATG |
| 1863 | CTCACATCTATTCCAGAAAATGT |
| 1864 | TCACATCTATTCCAGAAAATGTG |
| 1865 | CACATCTATTCCAGAAAATGTGT |
| 1866 | ACATCTATTCCAGAAAATGTGTC |
| 1867 | CATCTATTCCAGAAAATGTGTCT |
| 1868 | ATCTATTCCAGAAAATGTGTCTA |
| 1869 | TCTATTCCAGAAAATGTGTCTAC |
| 1870 | CTATTCCAGAAAATGTGTCTACT |
| 1871 | TATTCCAGAAAATGTGTCTACTC |
| 1872 | ATTCCAGAAAATGTGTCTACTCA |
| 1873 | TTCCAGAAAATGTGTCTACTCAT |
| 1874 | TCCAGAAAATGTGTCTACTCATG |
| 1875 | CCAGAAAATGTGTCTACTCATGT |
| 1876 | CAGAAAATGTGTCTACTCATGTT |
| 1877 | AGAAAATGTGTCTACTCATGTTT |
| 1878 | GAAAATGTGTCTACTCATGTTTC |
| 1879 | AAAATGTGTCTACTCATGTTTCT |
| 1880 | AAATGTGTCTACTCATGTTTCTC |
| 1881 | AATGTGTCTACTCATGTTTCTCA |
| 1882 | ATGTGTCTACTCATGTTTCTCAG |
| 1883 | TGTGTCTACTCATGTTTCTCAGA |
| 1884 | GTGTCTACTCATGTTTCTCAGAT |
| 1885 | TGTCTACTCATGTTTCTCAGATT |
| 1886 | GTCTACTCATGTTTCTCAGATTT |
| 1887 | TCTACTCATGTTTCTCAGATTTT |
| 1888 | CTACTCATGTTTCTCAGATTTTT |
| 1889 | TACTCATGTTTCTCAGATTTTTA |
| 1890 | ACTCATGTTTCTCAGATTTTTAA |
| 1891 | CTCATGTTTCTCAGATTTTTAAT |
| 1892 | TCATGTTTCTCAGATTTTTAATA |
| 1893 | CATGTTTCTCAGATTTTTAATAT |
| 1894 | ATGTTTCTCAGATTTTTAATATG |
| 1895 | TGTTTCTCAGATTTTTAATATGA |
| 1896 | GTTTCTCAGATTTTTAATATGAT |
| 1897 | TTTCTCAGATTTTTAATATGATA |
| 1898 | TTCTCAGATTTTTAATATGATAC |
| 1899 | TCTCAGATTTTTAATATGATACT |
| 1900 | CTCAGATTTTTAATATGATACTA |
| 1901 | TCAGATTTTTAATATGATACTAA |
| 1902 | CAGATTTTTAATATGATACTAAA |
| 1903 | AGATTTTTAATATGATACTAAAA |
| 1904 | GATTTTTAATATGATACTAAAAG |
| 1905 | ATTTTTAATATGATACTAAAAGA |
| 1906 | TTTTTAATATGATACTAAAAGAA |
| 1907 | TTTTAATATGATACTAAAAGAAC |
| 1908 | TTTAATATGATACTAAAAGAACA |
| 1909 | TTAATATGATACTAAAAGAACAA |
| 1910 | TAATATGATACTAAAAGAACAAT |
| 1911 | AATATGATACTAAAAGAACAATC |

| ID | SEQUENCE |
|---|---|
| 1912 | ATATGATACTAAAAGAACAATCA |
| 1913 | TATGATACTAAAAGAACAATCAT |
| 1914 | ATGATACTAAAAGAACAATCATT |
| 1915 | TGATACTAAAAGAACAATCATTA |
| 1916 | GATACTAAAAGAACAATCATTAG |
| 1917 | ATACTAAAAGAACAATCATTAGC |
| 1918 | TACTAAAAGAACAATCATTAGCA |
| 1919 | ACTAAAAGAACAATCATTAGCAG |
| 1920 | CTAAAAGAACAATCATTAGCAGC |
| 1921 | TAAAAGAACAATCATTAGCAGCA |
| 1922 | AAAAGAACAATCATTAGCAGCAG |
| 1923 | AAAGAACAATCATTAGCAGCAGA |
| 1924 | AAGAACAATCATTAGCAGCAGAA |
| 1925 | AGAACAATCATTAGCAGCAGAAA |
| 1926 | GAACAATCATTAGCAGCAGAAAG |
| 1927 | AACAATCATTAGCAGCAGAAAGT |
| 1928 | ACAATCATTAGCAGCAGAAAGTA |
| 1929 | CAATCATTAGCAGCAGAAAGTAA |
| 1930 | AATCATTAGCAGCAGAAAGTAAA |
| 1931 | ATCATTAGCAGCAGAAAGTAAAA |
| 1932 | TCATTAGCAGCAGAAAGTAAAAC |
| 1933 | CATTAGCAGCAGAAAGTAAAACT |
| 1934 | ATTAGCAGCAGAAAGTAAAACTG |
| 1935 | TTAGCAGCAGAAAGTAAAACTGT |
| 1936 | TAGCAGCAGAAAGTAAAACTGTA |
| 1937 | AGCAGCAGAAAGTAAAACTGTAC |
| 1938 | GCAGCAGAAAGTAAAACTGTACT |
| 1939 | CAGCAGAAAGTAAAACTGTACTA |
| 1940 | AGCAGAAAGTAAAACTGTACTAC |
| 1941 | GCAGAAAGTAAAACTGTACTACA |
| 1942 | CAGAAAGTAAAACTGTACTACAG |
| 1943 | AGAAAGTAAAACTGTACTACAGG |
| 1944 | GAAAGTAAAACTGTACTACAGGA |
| 1945 | AAAGTAAAACTGTACTACAGGAA |
| 1946 | AAGTAAAACTGTACTACAGGAAT |
| 1947 | AGTAAAACTGTACTACAGGAATT |
| 1948 | GTAAAACTGTACTACAGGAATTG |
| 1949 | TAAAACTGTACTACAGGAATTGA |
| 1950 | AAAACTGTACTACAGGAATTGAT |
| 1951 | AAACTGTACTACAGGAATTGATT |
| 1952 | AACTGTACTACAGGAATTGATTA |
| 1953 | ACTGTACTACAGGAATTGATTAA |
| 1954 | CTGTACTACAGGAATTGATTAAT |
| 1955 | TGTACTACAGGAATTGATTAATG |
| 1956 | GTACTACAGGAATTGATTAATGT |
| 1957 | TACTACAGGAATTGATTAATGTA |
| 1958 | ACTACAGGAATTGATTAATGTAC |
| 1959 | CTACAGGAATTGATTAATGTACT |
| 1960 | TACAGGAATTGATTAATGTACTC |
| 1961 | ACAGGAATTGATTAATGTACTCA |
| 1962 | CAGGAATTGATTAATGTACTCAA |
| 1963 | AGGAATTGATTAATGTACTCAAG |
| 1964 | GGAATTGATTAATGTACTCAAGA |
| 1965 | GAATTGATTAATGTACTCAAGAC |
| 1966 | AATTGATTAATGTACTCAAGACT |
| 1967 | ATTGATTAATGTACTCAAGACTG |
| 1968 | TTGATTAATGTACTCAAGACTGA |
| 1969 | TGATTAATGTACTCAAGACTGAT |

| ID | SEQUENCE |
|---|---|
| 1970 | GATTAATGTACTCAAGACTGATC |
| 1971 | ATTAATGTACTCAAGACTGATCT |
| 1972 | TTAATGTACTCAAGACTGATCTT |
| 1973 | TAATGTACTCAAGACTGATCTTC |
| 1974 | AATGTACTCAAGACTGATCTTCT |
| 1975 | ATGTACTCAAGACTGATCTTCTA |
| 1976 | TGTACTCAAGACTGATCTTCTAA |
| 1977 | GTACTCAAGACTGATCTTCTAAG |
| 1978 | TACTCAAGACTGATCTTCTAAGT |
| 1979 | ACTCAAGACTGATCTTCTAAGTT |
| 1980 | CTCAAGACTGATCTTCTAAGTTC |
| 1981 | TCAAGACTGATCTTCTAAGTTCA |
| 1982 | CAAGACTGATCTTCTAAGTTCAC |
| 1983 | AAGACTGATCTTCTAAGTTCACT |
| 1984 | AGACTGATCTTCTAAGTTCACTG |
| 1985 | GACTGATCTTCTAAGTTCACTGG |
| 1986 | ACTGATCTTCTAAGTTCACTGGA |
| 1987 | CTGATCTTCTAAGTTCACTGGAA |
| 1988 | TGATCTTCTAAGTTCACTGGAAA |
| 1989 | GATCTTCTAAGTTCACTGGAAAT |
| 1990 | ATCTTCTAAGTTCACTGGAAATG |
| 1991 | TCTTCTAAGTTCACTGGAAATGA |
| 1992 | CTTCTAAGTTCACTGGAAATGAT |
| 1993 | TTCTAAGTTCACTGGAAATGATT |
| 1994 | TCTAAGTTCACTGGAAATGATTT |
| 1995 | CTAAGTTCACTGGAAATGATTTT |
| 1996 | TAAGTTCACTGGAAATGATTTTA |
| 1997 | AAGTTCACTGGAAATGATTTTAT |
| 1998 | AGTTCACTGGAAATGATTTTATC |
| 1999 | GTTCACTGGAAATGATTTTATCC |
| 2000 | TTCACTGGAAATGATTTTATCCC |
| 2001 | TCACTGGAAATGATTTTATCCCC |
| 2002 | CACTGGAAATGATTTTATCCCCA |
| 2003 | ACTGGAAATGATTTTATCCCCAA |
| 2004 | CTGGAAATGATTTTATCCCCAAC |
| 2005 | TGGAAATGATTTTATCCCCAACT |
| 2006 | GGAAATGATTTTATCCCCAACTG |
| 2007 | GAAATGATTTTATCCCCAACTGT |
| 2008 | AAATGATTTTATCCCCAACTGTG |
| 2009 | AATGATTTTATCCCCAACTGTGG |
| 2010 | ATGATTTTATCCCCAACTGTGGT |
| 2011 | TGATTTTATCCCCAACTGTGGTG |
| 2012 | GATTTTATCCCCAACTGTGGTGT |
| 2013 | ATTTTATCCCCAACTGTGGTGTC |
| 2014 | TTTTATCCCCAACTGTGGTGTCT |
| 2015 | TTTATCCCCAACTGTGGTGTCTA |
| 2016 | TTATCCCCAACTGTGGTGTCTAT |
| 2017 | TATCCCCAACTGTGGTGTCTATA |
| 2018 | ATCCCCAACTGTGGTGTCTATAC |
| 2019 | TCCCCAACTGTGGTGTCTATACT |
| 2020 | CCCCAACTGTGGTGTCTATACTG |
| 2021 | CCCAACTGTGGTGTCTATACTGA |
| 2022 | CCAACTGTGGTGTCTATACTGAA |
| 2023 | CAACTGTGGTGTCTATACTGAAA |
| 2024 | AACTGTGGTGTCTATACTGAAAA |
| 2025 | ACTGTGGTGTCTATACTGAAAAT |
| 2026 | CTGTGGTGTCTATACTGAAAATC |
| 2027 | TGTGGTGTCTATACTGAAAATCA |

| ID | SEQUENCE |
|---|---|
| 2028 | GTGGTGTCTATACTGAAAATCAA |
| 2029 | TGGTGTCTATACTGAAAATCAAT |
| 2030 | GGTGTCTATACTGAAAATCAATA |
| 2031 | GTGTCTATACTGAAAATCAATAG |
| 2032 | TGTCTATACTGAAAATCAATAGT |
| 2033 | GTCTATACTGAAAATCAATAGTC |
| 2034 | TCTATACTGAAAATCAATAGTCA |
| 2035 | CTATACTGAAAATCAATAGTCAA |
| 2036 | TATACTGAAAATCAATAGTCAAC |
| 2037 | ATACTGAAAATCAATAGTCAACT |
| 2038 | TACTGAAAATCAATAGTCAACTA |
| 2039 | ACTGAAAATCAATAGTCAACTAA |
| 2040 | CTGAAAATCAATAGTCAACTAAA |
| 2041 | TGAAAATCAATAGTCAACTAAAG |
| 2042 | GAAAATCAATAGTCAACTAAAGC |
| 2043 | AAAATCAATAGTCAACTAAAGCA |
| 2044 | AAATCAATAGTCAACTAAAGCAT |
| 2045 | AATCAATAGTCAACTAAAGCATA |
| 2046 | ATCAATAGTCAACTAAAGCATAT |
| 2047 | TCAATAGTCAACTAAAGCATATT |
| 2048 | CAATAGTCAACTAAAGCATATTT |
| 2049 | AATAGTCAACTAAAGCATATTTT |
| 2050 | ATAGTCAACTAAAGCATATTTTC |
| 2051 | TAGTCAACTAAAGCATATTTTCA |
| 2052 | AGTCAACTAAAGCATATTTTCAA |
| 2053 | GTCAACTAAAGCATATTTTCAAG |
| 2054 | TCAACTAAAGCATATTTTCAAGA |
| 2055 | CAACTAAAGCATATTTTCAAGAC |
| 2056 | AACTAAAGCATATTTTCAAGACT |
| 2057 | ACTAAAGCATATTTTCAAGACTT |
| 2058 | CTAAAGCATATTTTCAAGACTTC |
| 2059 | TAAAGCATATTTTCAAGACTTCA |
| 2060 | AAAGCATATTTTCAAGACTTCAT |
| 2061 | AAGCATATTTTCAAGACTTCATT |
| 2062 | AGCATATTTTCAAGACTTCATTG |
| 2063 | GCATATTTTCAAGACTTCATTGA |
| 2064 | CATATTTTCAAGACTTCATTGAC |
| 2065 | ATATTTTCAAGACTTCATTGACA |
| 2066 | TATTTTCAAGACTTCATTGACAG |
| 2067 | ATTTTCAAGACTTCATTGACAGT |
| 2068 | TTTTCAAGACTTCATTGACAGTG |
| 2069 | TTTCAAGACTTCATTGACAGTGG |
| 2070 | TTCAAGACTTCATTGACAGTGGC |
| 2071 | TCAAGACTTCATTGACAGTGGCC |
| 2072 | CAAGACTTCATTGACAGTGGCCG |
| 2073 | AAGACTTCATTGACAGTGGCCGA |
| 2074 | AGACTTCATTGACAGTGGCCGAT |
| 2075 | GACTTCATTGACAGTGGCCGATA |
| 2076 | ACTTCATTGACAGTGGCCGATAA |
| 2077 | CTTCATTGACAGTGGCCGATAAG |
| 2078 | TTCATTGACAGTGGCCGATAAGA |
| 2079 | TCATTGACAGTGGCCGATAAGAT |
| 2080 | CATTGACAGTGGCCGATAAGATA |
| 2081 | ATTGACAGTGGCCGATAAGATAG |
| 2082 | TTGACAGTGGCCGATAAGATAGA |
| 2083 | TGACAGTGGCCGATAAGATAGAA |
| 2084 | GACAGTGGCCGATAAGATAGAAG |
| 2085 | ACAGTGGCCGATAAGATAGAAGA |

| ID | SEQUENCE |
|---|---|
| 2086 | CAGTGGCCGATAAGATAGAAGAT |
| 2087 | AGTGGCCGATAAGATAGAAGATC |
| 2088 | GTGGCCGATAAGATAGAAGATCA |
| 2089 | TGGCCGATAAGATAGAAGATCAA |
| 2090 | GGCCGATAAGATAGAAGATCAAA |
| 2091 | GCCGATAAGATAGAAGATCAAAA |
| 2092 | CCGATAAGATAGAAGATCAAAAA |
| 2093 | CGATAAGATAGAAGATCAAAAAA |
| 2094 | GATAAGATAGAAGATCAAAAAAA |
| 2095 | ATAAGATAGAAGATCAAAAAAAG |
| 2096 | TAAGATAGAAGATCAAAAAAAGG |
| 2097 | AAGATAGAAGATCAAAAAAAGGA |
| 2098 | AGATAGAAGATCAAAAAAAGGAA |
| 2099 | GATAGAAGATCAAAAAAAGGAAC |
| 2100 | ATAGAAGATCAAAAAAAGGAACT |
| 2101 | TAGAAGATCAAAAAAAGGAACTA |
| 2102 | AGAAGATCAAAAAAAGGAACTAG |
| 2103 | GAAGATCAAAAAAAGGAACTAGA |
| 2104 | AAGATCAAAAAAAGGAACTAGAT |
| 2105 | AGATCAAAAAAAGGAACTAGATG |
| 2106 | GATCAAAAAAAGGAACTAGATGG |
| 2107 | ATCAAAAAAAGGAACTAGATGGC |
| 2108 | TCAAAAAAAGGAACTAGATGGCT |
| 2109 | CAAAAAAAGGAACTAGATGGCTT |
| 2110 | AAAAAAAGGAACTAGATGGCTTT |
| 2111 | AAAAAAGGAACTAGATGGCTTTC |
| 2112 | AAAAAGGAACTAGATGGCTTTCT |
| 2113 | AAAAGGAACTAGATGGCTTTCTC |
| 2114 | AAAGGAACTAGATGGCTTTCTCA |
| 2115 | AAGGAACTAGATGGCTTTCTCAG |
| 2116 | AGGAACTAGATGGCTTTCTCAGT |
| 2117 | GGAACTAGATGGCTTTCTCAGTA |
| 2118 | GAACTAGATGGCTTTCTCAGTAT |
| 2119 | AACTAGATGGCTTTCTCAGTATA |
| 2120 | ACTAGATGGCTTTCTCAGTATAC |
| 2121 | CTAGATGGCTTTCTCAGTATACT |
| 2122 | TAGATGGCTTTCTCAGTATACTG |
| 2123 | AGATGGCTTTCTCAGTATACTGT |
| 2124 | GATGGCTTTCTCAGTATACTGTG |
| 2125 | ATGGCTTTCTCAGTATACTGTGT |
| 2126 | TGGCTTTCTCAGTATACTGTGTA |
| 2127 | GGCTTTCTCAGTATACTGTGTAA |
| 2128 | GCTTTCTCAGTATACTGTGTAAC |
| 2129 | CTTTCTCAGTATACTGTGTAACA |
| 2130 | TTTCTCAGTATACTGTGTAACAA |
| 2131 | TTCTCAGTATACTGTGTAACAAT |
| 2132 | TCTCAGTATACTGTGTAACAATC |
| 2133 | CTCAGTATACTGTGTAACAATCT |
| 2134 | TCAGTATACTGTGTAACAATCTA |
| 2135 | CAGTATACTGTGTAACAATCTAC |
| 2136 | AGTATACTGTGTAACAATCTACA |
| 2137 | GTATACTGTGTAACAATCTACAT |
| 2138 | TATACTGTGTAACAATCTACATG |
| 2139 | ATACTGTGTAACAATCTACATGA |
| 2140 | TACTGTGTAACAATCTACATGAA |
| 2141 | ACTGTGTAACAATCTACATGAAC |
| 2142 | CTGTGTAACAATCTACATGAACT |
| 2143 | TGTGTAACAATCTACATGAACTA |

| ID | SEQUENCE |
|---|---|
| 2144 | GTGTAACAATCTACATGAACTAC |
| 2145 | TGTAACAATCTACATGAACTACA |
| 2146 | GTAACAATCTACATGAACTACAA |
| 2147 | TAACAATCTACATGAACTACAAG |
| 2148 | AACAATCTACATGAACTACAAGA |
| 2149 | ACAATCTACATGAACTACAAGAA |
| 2150 | CAATCTACATGAACTACAAGAAA |
| 2151 | AATCTACATGAACTACAAGAAAA |
| 2152 | ATCTACATGAACTACAAGAAAAT |
| 2153 | TCTACATGAACTACAAGAAAATA |
| 2154 | CTACATGAACTACAAGAAAATAC |
| 2155 | TACATGAACTACAAGAAAATACC |
| 2156 | ACATGAACTACAAGAAAATACCA |
| 2157 | CATGAACTACAAGAAAATACCAT |
| 2158 | ATGAACTACAAGAAAATACCATT |
| 2159 | TGAACTACAAGAAAATACCATTT |
| 2160 | GAACTACAAGAAAATACCATTTG |
| 2161 | AACTACAAGAAAATACCATTTGT |
| 2162 | ACTACAAGAAAATACCATTTGTT |
| 2163 | CTACAAGAAAATACCATTTGTTC |
| 2164 | TACAAGAAAATACCATTTGTTCC |
| 2165 | ACAAGAAAATACCATTTGTTCCT |
| 2166 | CAAGAAAATACCATTTGTTCCTT |
| 2167 | AAGAAAATACCATTTGTTCCTTG |
| 2168 | AGAAAATACCATTTGTTCCTTGG |
| 2169 | GAAAATACCATTTGTTCCTTGGT |
| 2170 | AAAATACCATTTGTTCCTTGGTT |
| 2171 | AAATACCATTTGTTCCTTGGTTG |
| 2172 | AATACCATTTGTTCCTTGGTTGA |
| 2173 | ATACCATTTGTTCCTTGGTTGAG |
| 2174 | TACCATTTGTTCCTTGGTTGAGT |
| 2175 | ACCATTTGTTCCTTGGTTGAGTC |
| 2176 | CCATTTGTTCCTTGGTTGAGTCA |
| 2177 | CATTTGTTCCTTGGTTGAGTCAC |
| 2178 | ATTTGTTCCTTGGTTGAGTCACA |
| 2179 | TTTGTTCCTTGGTTGAGTCACAA |
| 2180 | TTGTTCCTTGGTTGAGTCACAAA |
| 2181 | TGTTCCTTGGTTGAGTCACAAAA |
| 2182 | GTTCCTTGGTTGAGTCACAAAAG |
| 2183 | TTCCTTGGTTGAGTCACAAAAGC |
| 2184 | TCCTTGGTTGAGTCACAAAAGCA |
| 2185 | CCTTGGTTGAGTCACAAAAGCAA |
| 2186 | CTTGGTTGAGTCACAAAAGCAAT |
| 2187 | TTGGTTGAGTCACAAAAGCAATG |
| 2188 | TGGTTGAGTCACAAAAGCAATGT |
| 2189 | GGTTGAGTCACAAAAGCAATGTG |
| 2190 | GTTGAGTCACAAAAGCAATGTGG |
| 2191 | TTGAGTCACAAAAGCAATGTGGA |
| 2192 | TGAGTCACAAAAGCAATGTGGAA |
| 2193 | GAGTCACAAAAGCAATGTGGAAA |
| 2194 | AGTCACAAAAGCAATGTGGAAAC |
| 2195 | GTCACAAAAGCAATGTGGAAACC |
| 2196 | TCACAAAAGCAATGTGGAAACCT |
| 2197 | CACAAAAGCAATGTGGAAACCTA |
| 2198 | ACAAAAGCAATGTGGAAACCTAA |
| 2199 | CAAAAGCAATGTGGAAACCTAAC |
| 2200 | AAAAGCAATGTGGAAACCTAACT |
| 2201 | AAAGCAATGTGGAAACCTAACTG |

| ID | SEQUENCE |
|---|---|
| 2202 | AAGCAATGTGGAAACCTAACTGA |
| 2203 | AGCAATGTGGAAACCTAACTGAA |
| 2204 | GCAATGTGGAAACCTAACTGAAG |
| 2205 | CAATGTGGAAACCTAACTGAAGA |
| 2206 | AATGTGGAAACCTAACTGAAGAC |
| 2207 | ATGTGGAAACCTAACTGAAGACC |
| 2208 | TGTGGAAACCTAACTGAAGACCT |
| 2209 | GTGGAAACCTAACTGAAGACCTG |
| 2210 | TGGAAACCTAACTGAAGACCTGA |
| 2211 | GGAAACCTAACTGAAGACCTGAA |
| 2212 | GAAACCTAACTGAAGACCTGAAG |
| 2213 | AAACCTAACTGAAGACCTGAAGA |
| 2214 | AACCTAACTGAAGACCTGAAGAC |
| 2215 | ACCTAACTGAAGACCTGAAGACA |
| 2216 | CCTAACTGAAGACCTGAAGACAA |
| 2217 | CTAACTGAAGACCTGAAGACAAT |
| 2218 | TAACTGAAGACCTGAAGACAATA |
| 2219 | AACTGAAGACCTGAAGACAATAA |
| 2220 | ACTGAAGACCTGAAGACAATAAA |
| 2221 | CTGAAGACCTGAAGACAATAAAG |
| 2222 | TGAAGACCTGAAGACAATAAAGC |
| 2223 | GAAGACCTGAAGACAATAAAGCA |
| 2224 | AAGACCTGAAGACAATAAAGCAG |
| 2225 | AGACCTGAAGACAATAAAGCAGA |
| 2226 | GACCTGAAGACAATAAAGCAGAC |
| 2227 | ACCTGAAGACAATAAAGCAGACC |
| 2228 | CCTGAAGACAATAAAGCAGACCC |
| 2229 | CTGAAGACAATAAAGCAGACCCA |
| 2230 | TGAAGACAATAAAGCAGACCCAT |
| 2231 | GAAGACAATAAAGCAGACCCATT |
| 2232 | AAGACAATAAAGCAGACCCATTC |
| 2233 | AGACAATAAAGCAGACCCATTCC |
| 2234 | GACAATAAAGCAGACCCATTCCC |
| 2235 | ACAATAAAGCAGACCCATTCCCA |
| 2236 | CAATAAAGCAGACCCATTCCCAG |
| 2237 | AATAAAGCAGACCCATTCCCAGG |
| 2238 | ATAAAGCAGACCCATTCCCAGGA |
| 2239 | TAAAGCAGACCCATTCCCAGGAA |
| 2240 | AAAGCAGACCCATTCCCAGGAAC |
| 2241 | AAGCAGACCCATTCCCAGGAACT |
| 2242 | AGCAGACCCATTCCCAGGAACTT |
| 2243 | GCAGACCCATTCCCAGGAACTTT |
| 2244 | CAGACCCATTCCCAGGAACTTTG |
| 2245 | AGACCCATTCCCAGGAACTTTGC |
| 2246 | GACCCATTCCCAGGAACTTTGCA |
| 2247 | ACCCATTCCCAGGAACTTTGCAA |
| 2248 | CCCATTCCCAGGAACTTTGCAAG |
| 2249 | CCATTCCCAGGAACTTTGCAAGT |
| 2250 | CATTCCCAGGAACTTTGCAAGTT |
| 2251 | ATTCCCAGGAACTTTGCAAGTTA |
| 2252 | TTCCCAGGAACTTTGCAAGTTAA |
| 2253 | TCCCAGGAACTTTGCAAGTTAAT |
| 2254 | CCCAGGAACTTTGCAAGTTAATG |
| 2255 | CCAGGAACTTTGCAAGTTAATGA |
| 2256 | CAGGAACTTTGCAAGTTAATGAA |
| 2257 | AGGAACTTTGCAAGTTAATGAAT |
| 2258 | GGAACTTTGCAAGTTAATGAATC |
| 2259 | GAACTTTGCAAGTTAATGAATCT |

| ID | SEQUENCE |
|---|---|
| 2260 | AACTTTGCAAGTTAATGAATCTT |
| 2261 | ACTTTGCAAGTTAATGAATCTTT |
| 2262 | CTTTGCAAGTTAATGAATCTTTG |
| 2263 | TTTGCAAGTTAATGAATCTTTGG |
| 2264 | TTGCAAGTTAATGAATCTTTGGA |
| 2265 | TGCAAGTTAATGAATCTTTGGAC |
| 2266 | GCAAGTTAATGAATCTTTGGACA |
| 2267 | CAAGTTAATGAATCTTTGGACAG |
| 2268 | AAGTTAATGAATCTTTGGACAGA |
| 2269 | AGTTAATGAATCTTTGGACAGAG |
| 2270 | GTTAATGAATCTTTGGACAGAGA |
| 2271 | TTAATGAATCTTTGGACAGAGAG |
| 2272 | TAATGAATCTTTGGACAGAGAGA |
| 2273 | AATGAATCTTTGGACAGAGAGAT |
| 2274 | ATGAATCTTTGGACAGAGAGATT |
| 2275 | TGAATCTTTGGACAGAGAGATTC |
| 2276 | GAATCTTTGGACAGAGAGATTCT |
| 2277 | AATCTTTGGACAGAGAGATTCTG |
| 2278 | ATCTTTGGACAGAGAGATTCTGT |
| 2279 | TCTTTGGACAGAGAGATTCTGTG |
| 2280 | CTTTGGACAGAGAGATTCTGTGC |
| 2281 | TTTGGACAGAGAGATTCTGTGCT |
| 2282 | TTGGACAGAGAGATTCTGTGCTT |
| 2283 | TGGACAGAGAGATTCTGTGCTTT |
| 2284 | GGACAGAGAGATTCTGTGCTTTG |
| 2285 | GACAGAGAGATTCTGTGCTTTGG |
| 2286 | ACAGAGAGATTCTGTGCTTTGGA |
| 2287 | CAGAGAGATTCTGTGCTTTGGAG |
| 2288 | AGAGAGATTCTGTGCTTTGGAGG |
| 2289 | GAGAGATTCTGTGCTTTGGAGGA |
| 2290 | AGAGATTCTGTGCTTTGGAGGAA |
| 2291 | GAGATTCTGTGCTTTGGAGGAAA |
| 2292 | AGATTCTGTGCTTTGGAGGAAAA |
| 2293 | GATTCTGTGCTTTGGAGGAAAAG |
| 2294 | ATTCTGTGCTTTGGAGGAAAAGT |
| 2295 | TTCTGTGCTTTGGAGGAAAAGTG |
| 2296 | TCTGTGCTTTGGAGGAAAAGTGT |
| 2297 | CTGTGCTTTGGAGGAAAAGTGTG |
| 2298 | TGTGCTTTGGAGGAAAAGTGTGA |
| 2299 | GTGCTTTGGAGGAAAAGTGTGAA |
| 2300 | TGCTTTGGAGGAAAAGTGTGAAA |
| 2301 | GCTTTGGAGGAAAAGTGTGAAAA |
| 2302 | CTTTGGAGGAAAAGTGTGAAAAT |
| 2303 | TTTGGAGGAAAAGTGTGAAAATA |
| 2304 | TTGGAGGAAAAGTGTGAAAATAT |
| 2305 | TGGAGGAAAAGTGTGAAAATATA |
| 2306 | GGAGGAAAAGTGTGAAAATATAC |
| 2307 | GAGGAAAAGTGTGAAAATATACA |
| 2308 | AGGAAAAGTGTGAAAATATACAG |
| 2309 | GGAAAAGTGTGAAAATATACAGA |
| 2310 | GAAAAGTGTGAAAATATACAGAA |
| 2311 | AAAAGTGTGAAAATATACAGAAA |
| 2312 | AAAGTGTGAAAATATACAGAAAC |
| 2313 | AAGTGTGAAAATATACAGAAACC |
| 2314 | AGTGTGAAAATATACAGAAACCA |
| 2315 | GTGTGAAAATATACAGAAACCAC |
| 2316 | TGTGAAAATATACAGAAACCACT |
| 2317 | GTGAAAATATACAGAAACCACTT |

| ID | SEQUENCE |
|---|---|
| 2318 | TGAAAATATACAGAAACCACTTA |
| 2319 | GAAAATATACAGAAACCACTTAG |
| 2320 | AAAATATACAGAAACCACTTAGT |
| 2321 | AAATATACAGAAACCACTTAGTA |
| 2322 | AATATACAGAAACCACTTAGTAG |
| 2323 | ATATACAGAAACCACTTAGTAGT |
| 2324 | TATACAGAAACCACTTAGTAGTG |
| 2325 | ATACAGAAACCACTTAGTAGTGT |
| 2326 | TACAGAAACCACTTAGTAGTGTC |
| 2327 | ACAGAAACCACTTAGTAGTGTCC |
| 2328 | CAGAAACCACTTAGTAGTGTCCA |
| 2329 | AGAAACCACTTAGTAGTGTCCAG |
| 2330 | GAAACCACTTAGTAGTGTCCAGG |
| 2331 | AAACCACTTAGTAGTGTCCAGGA |
| 2332 | AACCACTTAGTAGTGTCCAGGAA |
| 2333 | ACCACTTAGTAGTGTCCAGGAAA |
| 2334 | CCACTTAGTAGTGTCCAGGAAAA |
| 2335 | CACTTAGTAGTGTCCAGGAAAAT |
| 2336 | ACTTAGTAGTGTCCAGGAAAATA |
| 2337 | CTTAGTAGTGTCCAGGAAAATAT |
| 2338 | TTAGTAGTGTCCAGGAAAATATA |
| 2339 | TAGTAGTGTCCAGGAAAATATAC |
| 2340 | AGTAGTGTCCAGGAAAATATACA |
| 2341 | GTAGTGTCCAGGAAAATATACAG |
| 2342 | TAGTGTCCAGGAAAATATACAGC |
| 2343 | AGTGTCCAGGAAAATATACAGCA |
| 2344 | GTGTCCAGGAAAATATACAGCAG |
| 2345 | TGTCCAGGAAAATATACAGCAGA |
| 2346 | GTCCAGGAAAATATACAGCAGAA |
| 2347 | TCCAGGAAAATATACAGCAGAAA |
| 2348 | CCAGGAAAATATACAGCAGAAAT |
| 2349 | CAGGAAAATATACAGCAGAAATC |
| 2350 | AGGAAAATATACAGCAGAAATCT |
| 2351 | GGAAAATATACAGCAGAAATCTA |
| 2352 | GAAAATATACAGCAGAAATCTAA |
| 2353 | AAAATATACAGCAGAAATCTAAG |
| 2354 | AAATATACAGCAGAAATCTAAGG |
| 2355 | AATATACAGCAGAAATCTAAGGA |
| 2356 | ATATACAGCAGAAATCTAAGGAT |
| 2357 | TATACAGCAGAAATCTAAGGATA |
| 2358 | ATACAGCAGAAATCTAAGGATAT |
| 2359 | TACAGCAGAAATCTAAGGATATA |
| 2360 | ACAGCAGAAATCTAAGGATATAG |
| 2361 | CAGCAGAAATCTAAGGATATAGT |
| 2362 | AGCAGAAATCTAAGGATATAGTC |
| 2363 | GCAGAAATCTAAGGATATAGTCA |
| 2364 | CAGAAATCTAAGGATATAGTCAA |
| 2365 | AGAAATCTAAGGATATAGTCAAC |
| 2366 | GAAATCTAAGGATATAGTCAACA |
| 2367 | AAATCTAAGGATATAGTCAACAA |
| 2368 | AATCTAAGGATATAGTCAACAAA |
| 2369 | ATCTAAGGATATAGTCAACAAAA |
| 2370 | TCTAAGGATATAGTCAACAAAAT |
| 2371 | CTAAGGATATAGTCAACAAAATG |
| 2372 | TAAGGATATAGTCAACAAAATGA |
| 2373 | AAGGATATAGTCAACAAAATGAC |
| 2374 | AGGATATAGTCAACAAAATGACT |
| 2375 | GGATATAGTCAACAAAATGACTT |

| ID | SEQUENCE |
|---|---|
| 2376 | GATATAGTCAACAAAATGACTTT |
| 2377 | ATATAGTCAACAAAATGACTTTT |
| 2378 | TATAGTCAACAAAATGACTTTTC |
| 2379 | ATAGTCAACAAAATGACTTTTCA |
| 2380 | TAGTCAACAAAATGACTTTTCAC |
| 2381 | AGTCAACAAAATGACTTTTCACA |
| 2382 | GTCAACAAAATGACTTTTCACAG |
| 2383 | TCAACAAAATGACTTTTCACAGT |
| 2384 | CAACAAAATGACTTTTCACAGTC |
| 2385 | AACAAAATGACTTTTCACAGTCA |
| 2386 | ACAAAATGACTTTTCACAGTCAA |
| 2387 | CAAAATGACTTTTCACAGTCAAA |
| 2388 | AAAATGACTTTTCACAGTCAAAA |
| 2389 | AAATGACTTTTCACAGTCAAAAA |
| 2390 | AATGACTTTTCACAGTCAAAAAT |
| 2391 | ATGACTTTTCACAGTCAAAAATT |
| 2392 | TGACTTTTCACAGTCAAAAATTT |
| 2393 | GACTTTTCACAGTCAAAAATTTT |
| 2394 | ACTTTTCACAGTCAAAAATTTTG |
| 2395 | CTTTTCACAGTCAAAAATTTTGT |
| 2396 | TTTTCACAGTCAAAAATTTTGTG |
| 2397 | TTTCACAGTCAAAAATTTTGTGC |
| 2398 | TTCACAGTCAAAAATTTTGTGCT |
| 2399 | TCACAGTCAAAAATTTTGTGCTG |
| 2400 | CACAGTCAAAAATTTTGTGCTGA |
| 2401 | ACAGTCAAAAATTTTGTGCTGAT |
| 2402 | CAGTCAAAAATTTTGTGCTGATT |
| 2403 | AGTCAAAAATTTTGTGCTGATTC |
| 2404 | GTCAAAAATTTTGTGCTGATTCT |
| 2405 | TCAAAAATTTTGTGCTGATTCTG |
| 2406 | CAAAAATTTTGTGCTGATTCTGA |
| 2407 | AAAAATTTTGTGCTGATTCTGAT |
| 2408 | AAAATTTTGTGCTGATTCTGATG |
| 2409 | AAATTTTGTGCTGATTCTGATGG |
| 2410 | AATTTTGTGCTGATTCTGATGGC |
| 2411 | ATTTTGTGCTGATTCTGATGGCT |
| 2412 | TTTTGTGCTGATTCTGATGGCTT |
| 2413 | TTTGTGCTGATTCTGATGGCTTC |
| 2414 | TTGTGCTGATTCTGATGGCTTCT |
| 2415 | TGTGCTGATTCTGATGGCTTCTC |
| 2416 | GTGCTGATTCTGATGGCTTCTCA |
| 2417 | TGCTGATTCTGATGGCTTCTCAC |
| 2418 | GCTGATTCTGATGGCTTCTCACA |
| 2419 | CTGATTCTGATGGCTTCTCACAG |
| 2420 | TGATTCTGATGGCTTCTCACAGG |
| 2421 | GATTCTGATGGCTTCTCACAGGA |
| 2422 | ATTCTGATGGCTTCTCACAGGAA |
| 2423 | TTCTGATGGCTTCTCACAGGAAC |
| 2424 | TCTGATGGCTTCTCACAGGAACT |
| 2425 | CTGATGGCTTCTCACAGGAACTC |
| 2426 | TGATGGCTTCTCACAGGAACTCA |
| 2427 | GATGGCTTCTCACAGGAACTCAG |
| 2428 | ATGGCTTCTCACAGGAACTCAGA |
| 2429 | TGGCTTCTCACAGGAACTCAGAA |
| 2430 | GGCTTCTCACAGGAACTCAGAAA |
| 2431 | GCTTCTCACAGGAACTCAGAAAT |
| 2432 | CTTCTCACAGGAACTCAGAAATT |
| 2433 | TTCTCACAGGAACTCAGAAATTT |

| ID | SEQUENCE |
|---|---|
| 2434 | TCTCACAGGAACTCAGAAATTTT |
| 2435 | CTCACAGGAACTCAGAAATTTTA |
| 2436 | TCACAGGAACTCAGAAATTTTAA |
| 2437 | CACAGGAACTCAGAAATTTTAAC |
| 2438 | ACAGGAACTCAGAAATTTTAACC |
| 2439 | CAGGAACTCAGAAATTTTAACCA |
| 2440 | AGGAACTCAGAAATTTTAACCAA |
| 2441 | GGAACTCAGAAATTTTAACCAAG |
| 2442 | GAACTCAGAAATTTTAACCAAGA |
| 2443 | AACTCAGAAATTTTAACCAAGAA |
| 2444 | ACTCAGAAATTTTAACCAAGAAG |
| 2445 | CTCAGAAATTTTAACCAAGAAGG |
| 2446 | TCAGAAATTTTAACCAAGAAGGT |
| 2447 | CAGAAATTTTAACCAAGAAGGTA |
| 2448 | AGAAATTTTAACCAAGAAGGTAC |
| 2449 | GAAATTTTAACCAAGAAGGTACA |
| 2450 | AAATTTTAACCAAGAAGGTACAA |
| 2451 | AATTTTAACCAAGAAGGTACAAA |
| 2452 | ATTTTAACCAAGAAGGTACAAAA |
| 2453 | TTTTAACCAAGAAGGTACAAAAT |
| 2454 | TTTAACCAAGAAGGTACAAAATT |
| 2455 | TTAACCAAGAAGGTACAAAATTG |
| 2456 | TAACCAAGAAGGTACAAAATTGG |
| 2457 | AACCAAGAAGGTACAAAATTGGT |
| 2458 | ACCAAGAAGGTACAAAATTGGTT |
| 2459 | CCAAGAAGGTACAAAATTGGTTG |
| 2460 | CAAGAAGGTACAAAATTGGTTGA |
| 2461 | AAGAAGGTACAAAATTGGTTGAA |
| 2462 | AGAAGGTACAAAATTGGTTGAAG |
| 2463 | GAAGGTACAAAATTGGTTGAAGA |
| 2464 | AAGGTACAAAATTGGTTGAAGAA |
| 2465 | AGGTACAAAATTGGTTGAAGAAT |
| 2466 | GGTACAAAATTGGTTGAAGAATC |
| 2467 | GTACAAAATTGGTTGAAGAATCT |
| 2468 | TACAAAATTGGTTGAAGAATCTG |
| 2469 | ACAAAATTGGTTGAAGAATCTGT |
| 2470 | CAAAATTGGTTGAAGAATCTGTG |
| 2471 | AAAATTGGTTGAAGAATCTGTGA |
| 2472 | AAATTGGTTGAAGAATCTGTGAA |
| 2473 | AATTGGTTGAAGAATCTGTGAAA |
| 2474 | ATTGGTTGAAGAATCTGTGAAAC |
| 2475 | TTGGTTGAAGAATCTGTGAAACA |
| 2476 | TGGTTGAAGAATCTGTGAAACAC |
| 2477 | GGTTGAAGAATCTGTGAAACACT |
| 2478 | GTTGAAGAATCTGTGAAACACTC |
| 2479 | TTGAAGAATCTGTGAAACACTCT |
| 2480 | TGAAGAATCTGTGAAACACTCTG |
| 2481 | GAAGAATCTGTGAAACACTCTGA |
| 2482 | AAGAATCTGTGAAACACTCTGAT |
| 2483 | AGAATCTGTGAAACACTCTGATA |
| 2484 | GAATCTGTGAAACACTCTGATAA |
| 2485 | AATCTGTGAAACACTCTGATAAA |
| 2486 | ATCTGTGAAACACTCTGATAAAC |
| 2487 | TCTGTGAAACACTCTGATAAACT |
| 2488 | CTGTGAAACACTCTGATAAACTC |
| 2489 | TGTGAAACACTCTGATAAACTCA |
| 2490 | GTGAAACACTCTGATAAACTCAA |
| 2491 | TGAAACACTCTGATAAACTCAAT |

| ID | SEQUENCE |
|---|---|
| 2492 | GAAACACTCTGATAAACTCAATG |
| 2493 | AAACACTCTGATAAACTCAATGG |
| 2494 | AACACTCTGATAAACTCAATGGC |
| 2495 | ACACTCTGATAAACTCAATGGCA |
| 2496 | CACTCTGATAAACTCAATGGCAA |
| 2497 | ACTCTGATAAACTCAATGGCAAC |
| 2498 | CTCTGATAAACTCAATGGCAACC |
| 2499 | TCTGATAAACTCAATGGCAACCT |
| 2500 | CTGATAAACTCAATGGCAACCTG |
| 2501 | TGATAAACTCAATGGCAACCTGG |
| 2502 | GATAAACTCAATGGCAACCTGGA |
| 2503 | ATAAACTCAATGGCAACCTGGAA |
| 2504 | TAAACTCAATGGCAACCTGGAAA |
| 2505 | AAACTCAATGGCAACCTGGAAAA |
| 2506 | AACTCAATGGCAACCTGGAAAAA |
| 2507 | ACTCAATGGCAACCTGGAAAAAA |
| 2508 | CTCAATGGCAACCTGGAAAAAAT |
| 2509 | TCAATGGCAACCTGGAAAAAATA |
| 2510 | CAATGGCAACCTGGAAAAAATAT |
| 2511 | AATGGCAACCTGGAAAAAATATC |
| 2512 | ATGGCAACCTGGAAAAAATATCT |
| 2513 | TGGCAACCTGGAAAAAATATCTC |
| 2514 | GGCAACCTGGAAAAAATATCTCA |
| 2515 | GCAACCTGGAAAAAATATCTCAA |
| 2516 | CAACCTGGAAAAAATATCTCAAG |
| 2517 | AACCTGGAAAAAATATCTCAAGA |
| 2518 | ACCTGGAAAAAATATCTCAAGAG |
| 2519 | CCTGGAAAAAATATCTCAAGAGA |
| 2520 | CTGGAAAAAATATCTCAAGAGAC |
| 2521 | TGGAAAAAATATCTCAAGAGACT |
| 2522 | GGAAAAAATATCTCAAGAGACTG |
| 2523 | GAAAAAATATCTCAAGAGACTGA |
| 2524 | AAAAAATATCTCAAGAGACTGAA |
| 2525 | AAAAATATCTCAAGAGACTGAAC |
| 2526 | AAAATATCTCAAGAGACTGAACA |
| 2527 | AAATATCTCAAGAGACTGAACAG |
| 2528 | AATATCTCAAGAGACTGAACAGA |
| 2529 | ATATCTCAAGAGACTGAACAGAG |
| 2530 | TATCTCAAGAGACTGAACAGAGA |
| 2531 | ATCTCAAGAGACTGAACAGAGAT |
| 2532 | TCTCAAGAGACTGAACAGAGATG |
| 2533 | CTCAAGAGACTGAACAGAGATGT |
| 2534 | TCAAGAGACTGAACAGAGATGTG |
| 2535 | CAAGAGACTGAACAGAGATGTGA |
| 2536 | AAGAGACTGAACAGAGATGTGAA |
| 2537 | AGAGACTGAACAGAGATGTGAAT |
| 2538 | GAGACTGAACAGAGATGTGAATC |
| 2539 | AGACTGAACAGAGATGTGAATCT |
| 2540 | GACTGAACAGAGATGTGAATCTC |
| 2541 | ACTGAACAGAGATGTGAATCTCT |
| 2542 | CTGAACAGAGATGTGAATCTCTG |
| 2543 | TGAACAGAGATGTGAATCTCTGA |
| 2544 | GAACAGAGATGTGAATCTCTGAA |
| 2545 | AACAGAGATGTGAATCTCTGAAC |
| 2546 | ACAGAGATGTGAATCTCTGAACA |
| 2547 | CAGAGATGTGAATCTCTGAACAC |
| 2548 | AGAGATGTGAATCTCTGAACACA |
| 2549 | GAGATGTGAATCTCTGAACACAA |

| ID | SEQUENCE |
|---|---|
| 2550 | AGATGTGAATCTCTGAACACAAG |
| 2551 | GATGTGAATCTCTGAACACAAGA |
| 2552 | ATGTGAATCTCTGAACACAAGAA |
| 2553 | TGTGAATCTCTGAACACAAGAAC |
| 2554 | GTGAATCTCTGAACACAAGAACA |
| 2555 | TGAATCTCTGAACACAAGAACAG |
| 2556 | GAATCTCTGAACACAAGAACAGT |
| 2557 | AATCTCTGAACACAAGAACAGTT |
| 2558 | ATCTCTGAACACAAGAACAGTTT |
| 2559 | TCTCTGAACACAAGAACAGTTTA |
| 2560 | CTCTGAACACAAGAACAGTTTAT |
| 2561 | TCTGAACACAAGAACAGTTTATT |
| 2562 | CTGAACACAAGAACAGTTTATTT |
| 2563 | TGAACACAAGAACAGTTTATTTT |
| 2564 | GAACACAAGAACAGTTTATTTTT |
| 2565 | AACACAAGAACAGTTTATTTTTC |
| 2566 | ACACAAGAACAGTTTATTTTTCT |
| 2567 | CACAAGAACAGTTTATTTTTCTG |
| 2568 | ACAAGAACAGTTTATTTTTCTGA |
| 2569 | CAAGAACAGTTTATTTTTCTGAA |
| 2570 | AAGAACAGTTTATTTTTCTGAAC |
| 2571 | AGAACAGTTTATTTTTCTGAACA |
| 2572 | GAACAGTTTATTTTTCTGAACAG |
| 2573 | AACAGTTTATTTTTCTGAACAGT |
| 2574 | ACAGTTTATTTTTCTGAACAGTG |
| 2575 | CAGTTTATTTTTCTGAACAGTGG |
| 2576 | AGTTTATTTTTCTGAACAGTGGG |
| 2577 | GTTTATTTTTCTGAACAGTGGGT |
| 2578 | TTTATTTTTCTGAACAGTGGGTA |
| 2579 | TTATTTTTCTGAACAGTGGGTAT |
| 2580 | TATTTTTCTGAACAGTGGGTATC |
| 2581 | ATTTTTCTGAACAGTGGGTATCT |
| 2582 | TTTTTCTGAACAGTGGGTATCTT |
| 2583 | TTTTCTGAACAGTGGGTATCTTC |
| 2584 | TTTCTGAACAGTGGGTATCTTCC |
| 2585 | TTCTGAACAGTGGGTATCTTCCT |
| 2586 | TCTGAACAGTGGGTATCTTCCTT |
| 2587 | CTGAACAGTGGGTATCTTCCTTA |
| 2588 | TGAACAGTGGGTATCTTCCTTAA |
| 2589 | GAACAGTGGGTATCTTCCTTAAA |
| 2590 | AACAGTGGGTATCTTCCTTAAAT |
| 2591 | ACAGTGGGTATCTTCCTTAAATG |
| 2592 | CAGTGGGTATCTTCCTTAAATGA |
| 2593 | AGTGGGTATCTTCCTTAAATGAA |
| 2594 | GTGGGTATCTTCCTTAAATGAAA |
| 2595 | TGGGTATCTTCCTTAAATGAAAG |
| 2596 | GGGTATCTTCCTTAAATGAAAGG |
| 2597 | GGTATCTTCCTTAAATGAAAGGG |
| 2598 | GTATCTTCCTTAAATGAAAGGGA |
| 2599 | TATCTTCCTTAAATGAAAGGGAA |
| 2600 | ATCTTCCTTAAATGAAAGGGAAC |
| 2601 | TCTTCCTTAAATGAAAGGGAACA |
| 2602 | CTTCCTTAAATGAAAGGGAACAG |
| 2603 | TTCCTTAAATGAAAGGGAACAGG |
| 2604 | TCCTTAAATGAAAGGGAACAGGA |
| 2605 | CCTTAAATGAAAGGGAACAGGAA |
| 2606 | CTTAAATGAAAGGGAACAGGAAC |
| 2607 | TTAAATGAAAGGGAACAGGAACT |

| ID | SEQUENCE |
|---|---|
| 2608 | TAAATGAAAGGGAACAGGAACTT |
| 2609 | AAATGAAAGGGAACAGGAACTTC |
| 2610 | AATGAAAGGGAACAGGAACTTCA |
| 2611 | ATGAAAGGGAACAGGAACTTCAC |
| 2612 | TGAAAGGGAACAGGAACTTCACA |
| 2613 | GAAAGGGAACAGGAACTTCACAA |
| 2614 | AAAGGGAACAGGAACTTCACAAC |
| 2615 | AAGGGAACAGGAACTTCACAACT |
| 2616 | AGGGAACAGGAACTTCACAACTT |
| 2617 | GGGAACAGGAACTTCACAACTTA |
| 2618 | GGAACAGGAACTTCACAACTTAT |
| 2619 | GAACAGGAACTTCACAACTTATT |
| 2620 | AACAGGAACTTCACAACTTATTG |
| 2621 | ACAGGAACTTCACAACTTATTGG |
| 2622 | CAGGAACTTCACAACTTATTGGA |
| 2623 | AGGAACTTCACAACTTATTGGAG |
| 2624 | GGAACTTCACAACTTATTGGAGG |
| 2625 | GAACTTCACAACTTATTGGAGGT |
| 2626 | AACTTCACAACTTATTGGAGGTT |
| 2627 | ACTTCACAACTTATTGGAGGTTG |
| 2628 | CTTCACAACTTATTGGAGGTTGT |
| 2629 | TTCACAACTTATTGGAGGTTGTA |
| 2630 | TCACAACTTATTGGAGGTTGTAA |
| 2631 | CACAACTTATTGGAGGTTGTAAG |
| 2632 | ACAACTTATTGGAGGTTGTAAGC |
| 2633 | CAACTTATTGGAGGTTGTAAGCC |
| 2634 | AACTTATTGGAGGTTGTAAGCCA |
| 2635 | ACTTATTGGAGGTTGTAAGCCAA |
| 2636 | CTTATTGGAGGTTGTAAGCCAAT |
| 2637 | TTATTGGAGGTTGTAAGCCAATG |
| 2638 | TATTGGAGGTTGTAAGCCAATGT |
| 2639 | ATTGGAGGTTGTAAGCCAATGTT |
| 2640 | TTGGAGGTTGTAAGCCAATGTTG |
| 2641 | TGGAGGTTGTAAGCCAATGTTGT |
| 2642 | GGAGGTTGTAAGCCAATGTTGTG |
| 2643 | GAGGTTGTAAGCCAATGTTGTGA |
| 2644 | AGGTTGTAAGCCAATGTTGTGAG |
| 2645 | GGTTGTAAGCCAATGTTGTGAGG |
| 2646 | GTTGTAAGCCAATGTTGTGAGGC |
| 2647 | TTGTAAGCCAATGTTGTGAGGCT |
| 2648 | TGTAAGCCAATGTTGTGAGGCTT |
| 2649 | GTAAGCCAATGTTGTGAGGCTTC |
| 2650 | TAAGCCAATGTTGTGAGGCTTCA |
| 2651 | AAGCCAATGTTGTGAGGCTTCAA |
| 2652 | AGCCAATGTTGTGAGGCTTCAAG |
| 2653 | GCCAATGTTGTGAGGCTTCAAGT |
| 2654 | CCAATGTTGTGAGGCTTCAAGTT |
| 2655 | CAATGTTGTGAGGCTTCAAGTTC |
| 2656 | AATGTTGTGAGGCTTCAAGTTCA |
| 2657 | ATGTTGTGAGGCTTCAAGTTCAG |
| 2658 | TGTTGTGAGGCTTCAAGTTCAGA |
| 2659 | GTTGTGAGGCTTCAAGTTCAGAC |
| 2660 | TTGTGAGGCTTCAAGTTCAGACA |
| 2661 | TGTGAGGCTTCAAGTTCAGACAT |
| 2662 | GTGAGGCTTCAAGTTCAGACATC |
| 2663 | TGAGGCTTCAAGTTCAGACATCA |
| 2664 | GAGGCTTCAAGTTCAGACATCAC |
| 2665 | AGGCTTCAAGTTCAGACATCACT |

| ID | SEQUENCE |
|---|---|
| 2666 | GGCTTCAAGTTCAGACATCACTG |
| 2667 | GCTTCAAGTTCAGACATCACTGA |
| 2668 | CTTCAAGTTCAGACATCACTGAG |
| 2669 | TTCAAGTTCAGACATCACTGAGA |
| 2670 | TCAAGTTCAGACATCACTGAGAA |
| 2671 | CAAGTTCAGACATCACTGAGAAA |
| 2672 | AAGTTCAGACATCACTGAGAAAT |
| 2673 | AGTTCAGACATCACTGAGAAATC |
| 2674 | GTTCAGACATCACTGAGAAATCA |
| 2675 | TTCAGACATCACTGAGAAATCAG |
| 2676 | TCAGACATCACTGAGAAATCAGA |
| 2677 | CAGACATCACTGAGAAATCAGAT |
| 2678 | AGACATCACTGAGAAATCAGATG |
| 2679 | GACATCACTGAGAAATCAGATGG |
| 2680 | ACATCACTGAGAAATCAGATGGA |
| 2681 | CATCACTGAGAAATCAGATGGAC |
| 2682 | ATCACTGAGAAATCAGATGGACG |
| 2683 | TCACTGAGAAATCAGATGGACGT |
| 2684 | CACTGAGAAATCAGATGGACGTA |
| 2685 | ACTGAGAAATCAGATGGACGTAA |
| 2686 | CTGAGAAATCAGATGGACGTAAG |
| 2687 | TGAGAAATCAGATGGACGTAAGG |
| 2688 | GAGAAATCAGATGGACGTAAGGC |
| 2689 | AGAAATCAGATGGACGTAAGGCA |
| 2690 | GAAATCAGATGGACGTAAGGCAG |
| 2691 | AAATCAGATGGACGTAAGGCAGC |
| 2692 | AATCAGATGGACGTAAGGCAGCT |
| 2693 | ATCAGATGGACGTAAGGCAGCTC |
| 2694 | TCAGATGGACGTAAGGCAGCTCA |
| 2695 | CAGATGGACGTAAGGCAGCTCAT |
| 2696 | AGATGGACGTAAGGCAGCTCATG |
| 2697 | GATGGACGTAAGGCAGCTCATGA |
| 2698 | ATGGACGTAAGGCAGCTCATGAG |
| 2699 | TGGACGTAAGGCAGCTCATGAGA |
| 2700 | GGACGTAAGGCAGCTCATGAGAA |
| 2701 | GACGTAAGGCAGCTCATGAGAAA |
| 2702 | ACGTAAGGCAGCTCATGAGAAAC |
| 2703 | CGTAAGGCAGCTCATGAGAAACA |
| 2704 | GTAAGGCAGCTCATGAGAAACAG |
| 2705 | TAAGGCAGCTCATGAGAAACAGC |
| 2706 | AAGGCAGCTCATGAGAAACAGCA |
| 2707 | AGGCAGCTCATGAGAAACAGCAT |
| 2708 | GGCAGCTCATGAGAAACAGCATA |
| 2709 | GCAGCTCATGAGAAACAGCATAA |
| 2710 | CAGCTCATGAGAAACAGCATAAC |
| 2711 | AGCTCATGAGAAACAGCATAACA |
| 2712 | GCTCATGAGAAACAGCATAACAT |
| 2713 | CTCATGAGAAACAGCATAACATT |
| 2714 | TCATGAGAAACAGCATAACATTT |
| 2715 | CATGAGAAACAGCATAACATTTT |
| 2716 | ATGAGAAACAGCATAACATTTTT |
| 2717 | TGAGAAACAGCATAACATTTTTC |
| 2718 | GAGAAACAGCATAACATTTTTCT |
| 2719 | AGAAACAGCATAACATTTTTCTT |
| 2720 | GAAACAGCATAACATTTTTCTTG |
| 2721 | AAACAGCATAACATTTTTCTTGA |
| 2722 | AACAGCATAACATTTTTCTTGAT |
| 2723 | ACAGCATAACATTTTTCTTGATC |

| ID | SEQUENCE |
|---|---|
| 2724 | CAGCATAACATTTTTCTTGATCA |
| 2725 | AGCATAACATTTTTCTTGATCAG |
| 2726 | GCATAACATTTTTCTTGATCAGA |
| 2727 | CATAACATTTTTCTTGATCAGAT |
| 2728 | ATAACATTTTTCTTGATCAGATG |
| 2729 | TAACATTTTTCTTGATCAGATGA |
| 2730 | AACATTTTTCTTGATCAGATGAC |
| 2731 | ACATTTTTCTTGATCAGATGACT |
| 2732 | CATTTTTCTTGATCAGATGACTA |
| 2733 | ATTTTTCTTGATCAGATGACTAT |
| 2734 | TTTTTCTTGATCAGATGACTATT |
| 2735 | TTTTCTTGATCAGATGACTATTG |
| 2736 | TTTCTTGATCAGATGACTATTGA |
| 2737 | TTCTTGATCAGATGACTATTGAT |
| 2738 | TCTTGATCAGATGACTATTGATG |
| 2739 | CTTGATCAGATGACTATTGATGA |
| 2740 | TTGATCAGATGACTATTGATGAA |
| 2741 | TGATCAGATGACTATTGATGAAG |
| 2742 | GATCAGATGACTATTGATGAAGA |
| 2743 | ATCAGATGACTATTGATGAAGAT |
| 2744 | TCAGATGACTATTGATGAAGATA |
| 2745 | CAGATGACTATTGATGAAGATAA |
| 2746 | AGATGACTATTGATGAAGATAAA |
| 2747 | GATGACTATTGATGAAGATAAAT |
| 2748 | ATGACTATTGATGAAGATAAATT |
| 2749 | TGACTATTGATGAAGATAAATTG |
| 2750 | GACTATTGATGAAGATAAATTGA |
| 2751 | ACTATTGATGAAGATAAATTGAT |
| 2752 | CTATTGATGAAGATAAATTGATA |
| 2753 | TATTGATGAAGATAAATTGATAG |
| 2754 | ATTGATGAAGATAAATTGATAGC |
| 2755 | TTGATGAAGATAAATTGATAGCA |
| 2756 | TGATGAAGATAAATTGATAGCAC |
| 2757 | GATGAAGATAAATTGATAGCACA |
| 2758 | ATGAAGATAAATTGATAGCACAA |
| 2759 | TGAAGATAAATTGATAGCACAAA |
| 2760 | GAAGATAAATTGATAGCACAAAA |
| 2761 | AAGATAAATTGATAGCACAAAAT |
| 2762 | AGATAAATTGATAGCACAAAATC |
| 2763 | GATAAATTGATAGCACAAAATCT |
| 2764 | ATAAATTGATAGCACAAAATCTA |
| 2765 | TAAATTGATAGCACAAAATCTAG |
| 2766 | AAATTGATAGCACAAAATCTAGA |
| 2767 | AATTGATAGCACAAAATCTAGAA |
| 2768 | ATTGATAGCACAAAATCTAGAAC |
| 2769 | TTGATAGCACAAAATCTAGAACT |
| 2770 | TGATAGCACAAAATCTAGAACTT |
| 2771 | GATAGCACAAAATCTAGAACTTA |
| 2772 | ATAGCACAAAATCTAGAACTTAA |
| 2773 | TAGCACAAAATCTAGAACTTAAT |
| 2774 | AGCACAAAATCTAGAACTTAATG |
| 2775 | GCACAAAATCTAGAACTTAATGA |
| 2776 | CACAAAATCTAGAACTTAATGAA |
| 2777 | ACAAAATCTAGAACTTAATGAAA |
| 2778 | CAAAATCTAGAACTTAATGAAAC |
| 2779 | AAAATCTAGAACTTAATGAAACC |
| 2780 | AAATCTAGAACTTAATGAAACCA |
| 2781 | AATCTAGAACTTAATGAAACCAT |

| ID | SEQUENCE |
|---|---|
| 2782 | ATCTAGAACTTAATGAAACCATA |
| 2783 | TCTAGAACTTAATGAAACCATAA |
| 2784 | CTAGAACTTAATGAAACCATAAA |
| 2785 | TAGAACTTAATGAAACCATAAAA |
| 2786 | AGAACTTAATGAAACCATAAAAA |
| 2787 | GAACTTAATGAAACCATAAAAAT |
| 2788 | AACTTAATGAAACCATAAAAATT |
| 2789 | ACTTAATGAAACCATAAAAATTG |
| 2790 | CTTAATGAAACCATAAAAATTGG |
| 2791 | TTAATGAAACCATAAAAATTGGT |
| 2792 | TAATGAAACCATAAAAATTGGTT |
| 2793 | AATGAAACCATAAAAATTGGTTT |
| 2794 | ATGAAACCATAAAAATTGGTTTG |
| 2795 | TGAAACCATAAAAATTGGTTTGA |
| 2796 | GAAACCATAAAAATTGGTTTGAC |
| 2797 | AAACCATAAAAATTGGTTTGACT |
| 2798 | AACCATAAAAATTGGTTTGACTA |
| 2799 | ACCATAAAAATTGGTTTGACTAA |
| 2800 | CCATAAAAATTGGTTTGACTAAG |
| 2801 | CATAAAAATTGGTTTGACTAAGC |
| 2802 | ATAAAAATTGGTTTGACTAAGCT |
| 2803 | TAAAAATTGGTTTGACTAAGCTT |
| 2804 | AAAAATTGGTTTGACTAAGCTTA |
| 2805 | AAAATTGGTTTGACTAAGCTTAA |
| 2806 | AAATTGGTTTGACTAAGCTTAAT |
| 2807 | AATTGGTTTGACTAAGCTTAATT |
| 2808 | ATTGGTTTGACTAAGCTTAATTG |
| 2809 | TTGGTTTGACTAAGCTTAATTGC |
| 2810 | TGGTTTGACTAAGCTTAATTGCT |
| 2811 | GGTTTGACTAAGCTTAATTGCTT |
| 2812 | GTTTGACTAAGCTTAATTGCTTT |
| 2813 | TTTGACTAAGCTTAATTGCTTTC |
| 2814 | TTGACTAAGCTTAATTGCTTTCT |
| 2815 | TGACTAAGCTTAATTGCTTTCTG |
| 2816 | GACTAAGCTTAATTGCTTTCTGG |
| 2817 | ACTAAGCTTAATTGCTTTCTGGA |
| 2818 | CTAAGCTTAATTGCTTTCTGGAA |
| 2819 | TAAGCTTAATTGCTTTCTGGAAC |
| 2820 | AAGCTTAATTGCTTTCTGGAACA |
| 2821 | AGCTTAATTGCTTTCTGGAACAG |
| 2822 | GCTTAATTGCTTTCTGGAACAGG |
| 2823 | CTTAATTGCTTTCTGGAACAGGA |
| 2824 | TTAATTGCTTTCTGGAACAGGAT |
| 2825 | TAATTGCTTTCTGGAACAGGATC |
| 2826 | AATTGCTTTCTGGAACAGGATCT |
| 2827 | ATTGCTTTCTGGAACAGGATCTG |
| 2828 | TTGCTTTCTGGAACAGGATCTGA |
| 2829 | TGCTTTCTGGAACAGGATCTGAA |
| 2830 | GCTTTCTGGAACAGGATCTGAAA |
| 2831 | CTTTCTGGAACAGGATCTGAAAC |
| 2832 | TTTCTGGAACAGGATCTGAAACT |
| 2833 | TTCTGGAACAGGATCTGAAACTG |
| 2834 | TCTGGAACAGGATCTGAAACTGG |
| 2835 | CTGGAACAGGATCTGAAACTGGA |
| 2836 | TGGAACAGGATCTGAAACTGGAT |
| 2837 | GGAACAGGATCTGAAACTGGATA |
| 2838 | GAACAGGATCTGAAACTGGATAT |
| 2839 | AACAGGATCTGAAACTGGATATC |

| ID | SEQUENCE |
|---|---|
| 2840 | ACAGGATCTGAAACTGGATATCC |
| 2841 | CAGGATCTGAAACTGGATATCCC |
| 2842 | AGGATCTGAAACTGGATATCCCA |
| 2843 | GGATCTGAAACTGGATATCCCAA |
| 2844 | GATCTGAAACTGGATATCCCAAC |
| 2845 | ATCTGAAACTGGATATCCCAACA |
| 2846 | TCTGAAACTGGATATCCCAACAG |
| 2847 | CTGAAACTGGATATCCCAACAGG |
| 2848 | TGAAACTGGATATCCCAACAGGT |
| 2849 | GAAACTGGATATCCCAACAGGTA |
| 2850 | AAACTGGATATCCCAACAGGTAC |
| 2851 | AACTGGATATCCCAACAGGTACG |
| 2852 | ACTGGATATCCCAACAGGTACGA |
| 2853 | CTGGATATCCCAACAGGTACGAC |
| 2854 | TGGATATCCCAACAGGTACGACA |
| 2855 | GGATATCCCAACAGGTACGACAC |
| 2856 | GATATCCCAACAGGTACGACACC |
| 2857 | ATATCCCAACAGGTACGACACCA |
| 2858 | TATCCCAACAGGTACGACACCAC |
| 2859 | ATCCCAACAGGTACGACACCACA |
| 2860 | TCCCAACAGGTACGACACCACAG |
| 2861 | CCCAACAGGTACGACACCACAGA |
| 2862 | CCAACAGGTACGACACCACAGAG |
| 2863 | CAACAGGTACGACACCACAGAGG |
| 2864 | AACAGGTACGACACCACAGAGGA |
| 2865 | ACAGGTACGACACCACAGAGGAA |
| 2866 | CAGGTACGACACCACAGAGGAAA |
| 2867 | AGGTACGACACCACAGAGGAAAA |
| 2868 | GGTACGACACCACAGAGGAAAAG |
| 2869 | GTACGACACCACAGAGGAAAAGT |
| 2870 | TACGACACCACAGAGGAAAAGTT |
| 2871 | ACGACACCACAGAGGAAAAGTTA |
| 2872 | CGACACCACAGAGGAAAAGTTAT |
| 2873 | GACACCACAGAGGAAAAGTTATT |
| 2874 | ACACCACAGAGGAAAAGTTATTT |
| 2875 | CACCACAGAGGAAAAGTTATTTA |
| 2876 | ACCACAGAGGAAAAGTTATTTAT |
| 2877 | CCACAGAGGAAAAGTTATTTATA |
| 2878 | CACAGAGGAAAAGTTATTTATAC |
| 2879 | ACAGAGGAAAAGTTATTTATACC |
| 2880 | CAGAGGAAAAGTTATTTATACCC |
| 2881 | AGAGGAAAAGTTATTTATACCCA |
| 2882 | GAGGAAAAGTTATTTATACCCAT |
| 2883 | AGGAAAAGTTATTTATACCCATC |
| 2884 | GGAAAAGTTATTTATACCCATCA |
| 2885 | GAAAAGTTATTTATACCCATCAA |
| 2886 | AAAAGTTATTTATACCCATCAAC |
| 2887 | AAAGTTATTTATACCCATCAACA |
| 2888 | AAGTTATTTATACCCATCAACAC |
| 2889 | AGTTATTTATACCCATCAACACT |
| 2890 | GTTATTTATACCCATCAACACTG |
| 2891 | TTATTTATACCCATCAACACTGG |
| 2892 | TATTTATACCCATCAACACTGGT |
| 2893 | ATTTATACCCATCAACACTGGTA |
| 2894 | TTTATACCCATCAACACTGGTAA |
| 2895 | TTATACCCATCAACACTGGTAAG |
| 2896 | TATACCCATCAACACTGGTAAGA |
| 2897 | ATACCCATCAACACTGGTAAGAA |

| ID | SEQUENCE |
|---|---|
| 2898 | TACCCATCAACACTGGTAAGAAC |
| 2899 | ACCCATCAACACTGGTAAGAACT |
| 2900 | CCCATCAACACTGGTAAGAACTG |
| 2901 | CCATCAACACTGGTAAGAACTGA |
| 2902 | CATCAACACTGGTAAGAACTGAA |
| 2903 | ATCAACACTGGTAAGAACTGAAC |
| 2904 | TCAACACTGGTAAGAACTGAACC |
| 2905 | CAACACTGGTAAGAACTGAACCA |
| 2906 | AACACTGGTAAGAACTGAACCAC |
| 2907 | ACACTGGTAAGAACTGAACCACG |
| 2908 | CACTGGTAAGAACTGAACCACGT |
| 2909 | ACTGGTAAGAACTGAACCACGTG |
| 2910 | CTGGTAAGAACTGAACCACGTGA |
| 2911 | TGGTAAGAACTGAACCACGTGAA |
| 2912 | GGTAAGAACTGAACCACGTGAAC |
| 2913 | GTAAGAACTGAACCACGTGAACA |
| 2914 | TAAGAACTGAACCACGTGAACAT |
| 2915 | AAGAACTGAACCACGTGAACATC |
| 2916 | AGAACTGAACCACGTGAACATCT |
| 2917 | GAACTGAACCACGTGAACATCTC |
| 2918 | AACTGAACCACGTGAACATCTCC |
| 2919 | ACTGAACCACGTGAACATCTCCT |
| 2920 | CTGAACCACGTGAACATCTCCTT |
| 2921 | TGAACCACGTGAACATCTCCTTG |
| 2922 | GAACCACGTGAACATCTCCTTGA |
| 2923 | AACCACGTGAACATCTCCTTGAT |
| 2924 | ACCACGTGAACATCTCCTTGATC |
| 2925 | CCACGTGAACATCTCCTTGATCA |
| 2926 | CACGTGAACATCTCCTTGATCAG |
| 2927 | ACGTGAACATCTCCTTGATCAGC |
| 2928 | CGTGAACATCTCCTTGATCAGCT |
| 2929 | GTGAACATCTCCTTGATCAGCTG |
| 2930 | TGAACATCTCCTTGATCAGCTGA |
| 2931 | GAACATCTCCTTGATCAGCTGAA |
| 2932 | AACATCTCCTTGATCAGCTGAAA |
| 2933 | ACATCTCCTTGATCAGCTGAAAA |
| 2934 | CATCTCCTTGATCAGCTGAAAAG |
| 2935 | ATCTCCTTGATCAGCTGAAAAGG |
| 2936 | TCTCCTTGATCAGCTGAAAAGGA |
| 2937 | CTCCTTGATCAGCTGAAAAGGAA |
| 2938 | TCCTTGATCAGCTGAAAAGGAAA |
| 2939 | CCTTGATCAGCTGAAAAGGAAAC |
| 2940 | CTTGATCAGCTGAAAAGGAAACA |
| 2941 | TTGATCAGCTGAAAAGGAAACAG |
| 2942 | TGATCAGCTGAAAAGGAAACAGC |
| 2943 | GATCAGCTGAAAAGGAAACAGCC |
| 2944 | ATCAGCTGAAAAGGAAACAGCCT |
| 2945 | TCAGCTGAAAAGGAAACAGCCTG |
| 2946 | CAGCTGAAAAGGAAACAGCCTGA |
| 2947 | AGCTGAAAAGGAAACAGCCTGAG |
| 2948 | GCTGAAAAGGAAACAGCCTGAGC |
| 2949 | CTGAAAAGGAAACAGCCTGAGCT |
| 2950 | TGAAAAGGAAACAGCCTGAGCTG |
| 2951 | GAAAAGGAAACAGCCTGAGCTGT |
| 2952 | AAAAGGAAACAGCCTGAGCTGTT |
| 2953 | AAAGGAAACAGCCTGAGCTGTTA |
| 2954 | AAGGAAACAGCCTGAGCTGTTAA |
| 2955 | AGGAAACAGCCTGAGCTGTTAAT |

| ID | SEQUENCE |
|---|---|
| 2956 | GGAAACAGCCTGAGCTGTTAATG |
| 2957 | GAAACAGCCTGAGCTGTTAATGA |
| 2958 | AAACAGCCTGAGCTGTTAATGAT |
| 2959 | AACAGCCTGAGCTGTTAATGATG |
| 2960 | ACAGCCTGAGCTGTTAATGATGC |
| 2961 | CAGCCTGAGCTGTTAATGATGCT |
| 2962 | AGCCTGAGCTGTTAATGATGCTA |
| 2963 | GCCTGAGCTGTTAATGATGCTAA |
| 2964 | CCTGAGCTGTTAATGATGCTAAA |
| 2965 | CTGAGCTGTTAATGATGCTAAAC |
| 2966 | TGAGCTGTTAATGATGCTAAACT |
| 2967 | GAGCTGTTAATGATGCTAAACTG |
| 2968 | AGCTGTTAATGATGCTAAACTGT |
| 2969 | GCTGTTAATGATGCTAAACTGTT |
| 2970 | CTGTTAATGATGCTAAACTGTTC |
| 2971 | TGTTAATGATGCTAAACTGTTCA |
| 2972 | GTTAATGATGCTAAACTGTTCAG |
| 2973 | TTAATGATGCTAAACTGTTCAGA |
| 2974 | TAATGATGCTAAACTGTTCAGAA |
| 2975 | AATGATGCTAAACTGTTCAGAAA |
| 2976 | ATGATGCTAAACTGTTCAGAAAA |
| 2977 | TGATGCTAAACTGTTCAGAAAAC |
| 2978 | GATGCTAAACTGTTCAGAAAACA |
| 2979 | ATGCTAAACTGTTCAGAAAACAA |
| 2980 | TGCTAAACTGTTCAGAAAACAAC |
| 2981 | GCTAAACTGTTCAGAAAACAACA |
| 2982 | CTAAACTGTTCAGAAAACAACAA |
| 2983 | TAAACTGTTCAGAAAACAACAAA |
| 2984 | AAACTGTTCAGAAAACAACAAAG |
| 2985 | AACTGTTCAGAAAACAACAAAGA |
| 2986 | ACTGTTCAGAAAACAACAAAGAA |
| 2987 | CTGTTCAGAAAACAACAAAGAAG |
| 2988 | TGTTCAGAAAACAACAAAGAAGA |
| 2989 | GTTCAGAAAACAACAAAGAAGAG |
| 2990 | TTCAGAAAACAACAAAGAAGAGA |
| 2991 | TCAGAAAACAACAAAGAAGAGAC |
| 2992 | CAGAAAACAACAAAGAAGAGACA |
| 2993 | AGAAAACAACAAAGAAGAGACAA |
| 2994 | GAAAACAACAAAGAAGAGACAAT |
| 2995 | AAAACAACAAAGAAGAGACAATT |
| 2996 | AAACAACAAAGAAGAGACAATTC |
| 2997 | AACAACAAAGAAGAGACAATTCC |
| 2998 | ACAACAAAGAAGAGACAATTCCG |
| 2999 | CAACAAAGAAGAGACAATTCCGG |
| 3000 | AACAAAGAAGAGACAATTCCGGA |
| 3001 | ACAAAGAAGAGACAATTCCGGAT |
| 3002 | CAAAGAAGAGACAATTCCGGATG |
| 3003 | AAAGAAGAGACAATTCCGGATGT |
| 3004 | AAGAAGAGACAATTCCGGATGTG |
| 3005 | AGAAGAGACAATTCCGGATGTGG |
| 3006 | GAAGAGACAATTCCGGATGTGGA |
| 3007 | AAGAGACAATTCCGGATGTGGAT |
| 3008 | AGAGACAATTCCGGATGTGGATG |
| 3009 | GAGACAATTCCGGATGTGGATGT |
| 3010 | AGACAATTCCGGATGTGGATGTA |
| 3011 | GACAATTCCGGATGTGGATGTAG |
| 3012 | ACAATTCCGGATGTGGATGTAGA |
| 3013 | CAATTCCGGATGTGGATGTAGAA |

| ID | SEQUENCE |
|---|---|
| 3014 | AATTCCGGATGTGGATGTAGAAG |
| 3015 | ATTCCGGATGTGGATGTAGAAGA |
| 3016 | TTCCGGATGTGGATGTAGAAGAG |
| 3017 | TCCGGATGTGGATGTAGAAGAGG |
| 3018 | CCGGATGTGGATGTAGAAGAGGC |
| 3019 | CGGATGTGGATGTAGAAGAGGCA |
| 3020 | GGATGTGGATGTAGAAGAGGCAG |
| 3021 | GATGTGGATGTAGAAGAGGCAGT |
| 3022 | ATGTGGATGTAGAAGAGGCAGTT |
| 3023 | TGTGGATGTAGAAGAGGCAGTTC |
| 3024 | GTGGATGTAGAAGAGGCAGTTCT |
| 3025 | TGGATGTAGAAGAGGCAGTTCTG |
| 3026 | GGATGTAGAAGAGGCAGTTCTGG |
| 3027 | GATGTAGAAGAGGCAGTTCTGGG |
| 3028 | ATGTAGAAGAGGCAGTTCTGGGG |
| 3029 | TGTAGAAGAGGCAGTTCTGGGGC |
| 3030 | GTAGAAGAGGCAGTTCTGGGGCA |
| 3031 | TAGAAGAGGCAGTTCTGGGGCAG |
| 3032 | AGAAGAGGCAGTTCTGGGGCAGT |
| 3033 | GAAGAGGCAGTTCTGGGGCAGTA |
| 3034 | AAGAGGCAGTTCTGGGGCAGTAT |
| 3035 | AGAGGCAGTTCTGGGGCAGTATA |
| 3036 | GAGGCAGTTCTGGGGCAGTATAC |
| 3037 | AGGCAGTTCTGGGGCAGTATACT |
| 3038 | GGCAGTTCTGGGGCAGTATACTG |
| 3039 | GCAGTTCTGGGGCAGTATACTGA |
| 3040 | CAGTTCTGGGGCAGTATACTGAA |
| 3041 | AGTTCTGGGGCAGTATACTGAAG |
| 3042 | GTTCTGGGGCAGTATACTGAAGA |
| 3043 | TTCTGGGGCAGTATACTGAAGAA |
| 3044 | TCTGGGGCAGTATACTGAAGAAC |
| 3045 | CTGGGGCAGTATACTGAAGAACC |
| 3046 | TGGGGCAGTATACTGAAGAACCT |
| 3047 | GGGGCAGTATACTGAAGAACCTC |
| 3048 | GGGCAGTATACTGAAGAACCTCT |
| 3049 | GGCAGTATACTGAAGAACCTCTA |
| 3050 | GCAGTATACTGAAGAACCTCTAA |
| 3051 | CAGTATACTGAAGAACCTCTAAG |
| 3052 | AGTATACTGAAGAACCTCTAAGT |
| 3053 | GTATACTGAAGAACCTCTAAGTC |
| 3054 | TATACTGAAGAACCTCTAAGTCA |
| 3055 | ATACTGAAGAACCTCTAAGTCAA |
| 3056 | TACTGAAGAACCTCTAAGTCAAG |
| 3057 | ACTGAAGAACCTCTAAGTCAAGA |
| 3058 | CTGAAGAACCTCTAAGTCAAGAG |
| 3059 | TGAAGAACCTCTAAGTCAAGAGC |
| 3060 | GAAGAACCTCTAAGTCAAGAGCC |
| 3061 | AAGAACCTCTAAGTCAAGAGCCA |
| 3062 | AGAACCTCTAAGTCAAGAGCCAT |
| 3063 | GAACCTCTAAGTCAAGAGCCATC |
| 3064 | AACCTCTAAGTCAAGAGCCATCT |
| 3065 | ACCTCTAAGTCAAGAGCCATCTG |
| 3066 | CCTCTAAGTCAAGAGCCATCTGT |
| 3067 | CTCTAAGTCAAGAGCCATCTGTA |
| 3068 | TCTAAGTCAAGAGCCATCTGTAG |
| 3069 | CTAAGTCAAGAGCCATCTGTAGA |
| 3070 | TAAGTCAAGAGCCATCTGTAGAT |
| 3071 | AAGTCAAGAGCCATCTGTAGATG |

| ID | SEQUENCE |
|---|---|
| 3072 | AGTCAAGAGCCATCTGTAGATGC |
| 3073 | GTCAAGAGCCATCTGTAGATGCT |
| 3074 | TCAAGAGCCATCTGTAGATGCTG |
| 3075 | CAAGAGCCATCTGTAGATGCTGG |
| 3076 | AAGAGCCATCTGTAGATGCTGGT |
| 3077 | AGAGCCATCTGTAGATGCTGGTG |
| 3078 | GAGCCATCTGTAGATGCTGGTGT |
| 3079 | AGCCATCTGTAGATGCTGGTGTG |
| 3080 | GCCATCTGTAGATGCTGGTGTGG |
| 3081 | CCATCTGTAGATGCTGGTGTGGA |
| 3082 | CATCTGTAGATGCTGGTGTGGAT |
| 3083 | ATCTGTAGATGCTGGTGTGGATT |
| 3084 | TCTGTAGATGCTGGTGTGGATTG |
| 3085 | CTGTAGATGCTGGTGTGGATTGT |
| 3086 | TGTAGATGCTGGTGTGGATTGTT |
| 3087 | GTAGATGCTGGTGTGGATTGTTC |
| 3088 | TAGATGCTGGTGTGGATTGTTCA |
| 3089 | AGATGCTGGTGTGGATTGTTCAT |
| 3090 | GATGCTGGTGTGGATTGTTCATC |
| 3091 | ATGCTGGTGTGGATTGTTCATCA |
| 3092 | TGCTGGTGTGGATTGTTCATCAA |
| 3093 | GCTGGTGTGGATTGTTCATCAAT |
| 3094 | CTGGTGTGGATTGTTCATCAATT |
| 3095 | TGGTGTGGATTGTTCATCAATTG |
| 3096 | GGTGTGGATTGTTCATCAATTGG |
| 3097 | GTGTGGATTGTTCATCAATTGGC |
| 3098 | TGTGGATTGTTCATCAATTGGCG |
| 3099 | GTGGATTGTTCATCAATTGGCGG |
| 3100 | TGGATTGTTCATCAATTGGCGGG |
| 3101 | GGATTGTTCATCAATTGGCGGGG |
| 3102 | GATTGTTCATCAATTGGCGGGGT |
| 3103 | ATTGTTCATCAATTGGCGGGGTT |
| 3104 | TTGTTCATCAATTGGCGGGGTTC |
| 3105 | TGTTCATCAATTGGCGGGGTTCC |
| 3106 | GTTCATCAATTGGCGGGGTTCCA |
| 3107 | TTCATCAATTGGCGGGGTTCCAT |
| 3108 | TCATCAATTGGCGGGGTTCCATT |
| 3109 | CATCAATTGGCGGGGTTCCATTT |
| 3110 | ATCAATTGGCGGGGTTCCATTTT |
| 3111 | TCAATTGGCGGGGTTCCATTTTT |
| 3112 | CAATTGGCGGGGTTCCATTTTTC |
| 3113 | AATTGGCGGGGTTCCATTTTTCC |
| 3114 | ATTGGCGGGGTTCCATTTTTCCA |
| 3115 | TTGGCGGGGTTCCATTTTTCCAG |
| 3116 | TGGCGGGGTTCCATTTTTCCAGC |
| 3117 | GGCGGGGTTCCATTTTTCCAGCA |
| 3118 | GCGGGGTTCCATTTTTCCAGCAT |
| 3119 | CGGGGTTCCATTTTTCCAGCATA |
| 3120 | GGGGTTCCATTTTTCCAGCATAA |
| 3121 | GGGTTCCATTTTTCCAGCATAAA |
| 3122 | GGTTCCATTTTTCCAGCATAAAA |
| 3123 | GTTCCATTTTTCCAGCATAAAAA |
| 3124 | TTCCATTTTTCCAGCATAAAAAA |
| 3125 | TCCATTTTTCCAGCATAAAAAAT |
| 3126 | CCATTTTTCCAGCATAAAAAATC |
| 3127 | CATTTTTCCAGCATAAAAAATCA |
| 3128 | ATTTTTCCAGCATAAAAAATCAC |
| 3129 | TTTTTCCAGCATAAAAAATCACA |

| ID | SEQUENCE |
|---|---|
| 3130 | TTTTCCAGCATAAAAAATCACAT |
| 3131 | TTTCCAGCATAAAAAATCACATG |
| 3132 | TTCCAGCATAAAAAATCACATGG |
| 3133 | TCCAGCATAAAAAATCACATGGA |
| 3134 | CCAGCATAAAAAATCACATGGAA |
| 3135 | CAGCATAAAAAATCACATGGAAA |
| 3136 | AGCATAAAAAATCACATGGAAAA |
| 3137 | GCATAAAAAATCACATGGAAAAG |
| 3138 | CATAAAAAATCACATGGAAAAGA |
| 3139 | ATAAAAAATCACATGGAAAAGAC |
| 3140 | TAAAAAATCACATGGAAAAGACA |
| 3141 | AAAAAATCACATGGAAAAGACAA |
| 3142 | AAAAATCACATGGAAAAGACAAA |
| 3143 | AAAATCACATGGAAAAGACAAAG |
| 3144 | AAATCACATGGAAAAGACAAAGA |
| 3145 | AATCACATGGAAAAGACAAAGAA |
| 3146 | ATCACATGGAAAAGACAAAGAAA |
| 3147 | TCACATGGAAAAGACAAAGAAAA |
| 3148 | CACATGGAAAAGACAAAGAAAAC |
| 3149 | ACATGGAAAAGACAAAGAAAACA |
| 3150 | CATGGAAAAGACAAAGAAAACAG |
| 3151 | ATGGAAAAGACAAAGAAAACAGA |
| 3152 | TGGAAAAGACAAAGAAAACAGAG |
| 3153 | GGAAAAGACAAAGAAAACAGAGG |
| 3154 | GAAAAGACAAAGAAAACAGAGGC |
| 3155 | AAAAGACAAAGAAAACAGAGGCA |
| 3156 | AAAGACAAAGAAAACAGAGGCAT |
| 3157 | AAGACAAAGAAAACAGAGGCATT |
| 3158 | AGACAAAGAAAACAGAGGCATTA |
| 3159 | GACAAAGAAAACAGAGGCATTAA |
| 3160 | ACAAAGAAAACAGAGGCATTAAC |
| 3161 | CAAAGAAAACAGAGGCATTAACA |
| 3162 | AAAGAAAACAGAGGCATTAACAC |
| 3163 | AAGAAAACAGAGGCATTAACACA |
| 3164 | AGAAAACAGAGGCATTAACACAC |
| 3165 | GAAAACAGAGGCATTAACACACT |
| 3166 | AAAACAGAGGCATTAACACACTG |
| 3167 | AAACAGAGGCATTAACACACTGG |
| 3168 | AACAGAGGCATTAACACACTGGA |
| 3169 | ACAGAGGCATTAACACACTGGAG |
| 3170 | CAGAGGCATTAACACACTGGAGA |
| 3171 | AGAGGCATTAACACACTGGAGAG |
| 3172 | GAGGCATTAACACACTGGAGAGG |
| 3173 | AGGCATTAACACACTGGAGAGGT |
| 3174 | GGCATTAACACACTGGAGAGGTC |
| 3175 | GCATTAACACACTGGAGAGGTCT |
| 3176 | CATTAACACACTGGAGAGGTCTA |
| 3177 | ATTAACACACTGGAGAGGTCTAA |
| 3178 | TTAACACACTGGAGAGGTCTAAA |
| 3179 | TAACACACTGGAGAGGTCTAAAG |
| 3180 | AACACACTGGAGAGGTCTAAAGT |
| 3181 | ACACACTGGAGAGGTCTAAAGTG |
| 3182 | CACACTGGAGAGGTCTAAAGTGG |
| 3183 | ACACTGGAGAGGTCTAAAGTGGA |
| 3184 | CACTGGAGAGGTCTAAAGTGGAA |
| 3185 | ACTGGAGAGGTCTAAAGTGGAAG |
| 3186 | CTGGAGAGGTCTAAAGTGGAAGA |
| 3187 | TGGAGAGGTCTAAAGTGGAAGAA |

| ID | SEQUENCE |
|---|---|
| 3188 | GGAGAGGTCTAAAGTGGAAGAAA |
| 3189 | GAGAGGTCTAAAGTGGAAGAAAC |
| 3190 | AGAGGTCTAAAGTGGAAGAAACT |
| 3191 | GAGGTCTAAAGTGGAAGAAACTA |
| 3192 | AGGTCTAAAGTGGAAGAAACTAC |
| 3193 | GGTCTAAAGTGGAAGAAACTACA |
| 3194 | GTCTAAAGTGGAAGAAACTACAG |
| 3195 | TCTAAAGTGGAAGAAACTACAGA |
| 3196 | CTAAAGTGGAAGAAACTACAGAG |
| 3197 | TAAAGTGGAAGAAACTACAGAGC |
| 3198 | AAAGTGGAAGAAACTACAGAGCA |
| 3199 | AAGTGGAAGAAACTACAGAGCAC |
| 3200 | AGTGGAAGAAACTACAGAGCACT |
| 3201 | GTGGAAGAAACTACAGAGCACTT |
| 3202 | TGGAAGAAACTACAGAGCACTTG |
| 3203 | GGAAGAAACTACAGAGCACTTGG |
| 3204 | GAAGAAACTACAGAGCACTTGGT |
| 3205 | AAGAAACTACAGAGCACTTGGTT |
| 3206 | AGAAACTACAGAGCACTTGGTTA |
| 3207 | GAAACTACAGAGCACTTGGTTAC |
| 3208 | AAACTACAGAGCACTTGGTTACA |
| 3209 | AACTACAGAGCACTTGGTTACAA |
| 3210 | ACTACAGAGCACTTGGTTACAAA |
| 3211 | CTACAGAGCACTTGGTTACAAAG |
| 3212 | TACAGAGCACTTGGTTACAAAGA |
| 3213 | ACAGAGCACTTGGTTACAAAGAG |
| 3214 | CAGAGCACTTGGTTACAAAGAGC |
| 3215 | AGAGCACTTGGTTACAAAGAGCA |
| 3216 | GAGCACTTGGTTACAAAGAGCAG |
| 3217 | AGCACTTGGTTACAAAGAGCAGA |
| 3218 | GCACTTGGTTACAAAGAGCAGAT |
| 3219 | CACTTGGTTACAAAGAGCAGATT |
| 3220 | ACTTGGTTACAAAGAGCAGATTA |
| 3221 | CTTGGTTACAAAGAGCAGATTAC |
| 3222 | TTGGTTACAAAGAGCAGATTACC |
| 3223 | TGGTTACAAAGAGCAGATTACCT |
| 3224 | GGTTACAAAGAGCAGATTACCTC |
| 3225 | GTTACAAAGAGCAGATTACCTCT |
| 3226 | TTACAAAGAGCAGATTACCTCTG |
| 3227 | TACAAAGAGCAGATTACCTCTGC |
| 3228 | ACAAAGAGCAGATTACCTCTGCG |
| 3229 | CAAAGAGCAGATTACCTCTGCGA |
| 3230 | AAAGAGCAGATTACCTCTGCGAG |
| 3231 | AAGAGCAGATTACCTCTGCGAGC |
| 3232 | AGAGCAGATTACCTCTGCGAGCC |
| 3233 | GAGCAGATTACCTCTGCGAGCCC |
| 3234 | AGCAGATTACCTCTGCGAGCCCA |
| 3235 | GCAGATTACCTCTGCGAGCCCAG |
| 3236 | CAGATTACCTCTGCGAGCCCAGA |
| 3237 | AGATTACCTCTGCGAGCCCAGAT |
| 3238 | GATTACCTCTGCGAGCCCAGATC |
| 3239 | ATTACCTCTGCGAGCCCAGATCA |
| 3240 | TTACCTCTGCGAGCCCAGATCAA |
| 3241 | TACCTCTGCGAGCCCAGATCAAC |
| 3242 | ACCTCTGCGAGCCCAGATCAACC |
| 3243 | CCTCTGCGAGCCCAGATCAACCT |
| 3244 | CTCTGCGAGCCCAGATCAACCTT |
| 3245 | TCTGCGAGCCCAGATCAACCTTT |

| ID | SEQUENCE |
|---|---|
| 3246 | CTGCGAGCCCAGATCAACCTTTA |
| 3247 | TTCACTTGGGGGTTGGCAATTTT |
| 3248 | TCACTTGGGGGTTGGCAATTTTA |
| 3249 | CACTTGGGGGTTGGCAATTTTAT |
| 3250 | ACTTGGGGGTTGGCAATTTTATT |
| 3251 | CTTGGGGGTTGGCAATTTTATTT |
| 3252 | TTGGGGGTTGGCAATTTTATTTT |
| 3253 | TGGGGGTTGGCAATTTTATTTTT |
| 3254 | GGGGGTTGGCAATTTTATTTTTA |
| 3255 | GGGGTTGGCAATTTTATTTTTAA |
| 3256 | GGGTTGGCAATTTTATTTTTAAA |
| 3257 | GGTTGGCAATTTTATTTTTAAAG |
| 3258 | GTTGGCAATTTTATTTTTAAAGA |
| 3259 | TTGGCAATTTTATTTTTAAAGAA |
| 3260 | TGGCAATTTTATTTTTAAAGAAA |
| 3261 | GGCAATTTTATTTTTAAAGAAAA |
| 3262 | GCAATTTTATTTTTAAAGAAAAC |
| 3263 | CAATTTTATTTTTAAAGAAAACT |
| 3264 | AATTTTATTTTTAAAGAAAACTT |
| 3265 | ATTTTATTTTTAAAGAAAACTTA |
| 3266 | TTTTATTTTTAAAGAAAACTTAA |
| 3267 | TTTATTTTTAAAGAAAACTTAAA |
| 3268 | TTATTTTTAAAGAAAACTTAAAA |
| 3269 | TATTTTTAAAGAAAACTTAAAAA |
| 3270 | ATTTTTAAAGAAAACTTAAAAAT |
| 3271 | TTTTTAAAGAAAACTTAAAAATA |
| 3272 | TTTTAAAGAAAACTTAAAAATAA |
| 3273 | TTTAAAGAAAACTTAAAAATAAA |
| 3274 | TTAAAGAAAACTTAAAAATAAAA |
| 3275 | TAAAGAAAACTTAAAAATAAAAC |
| 3276 | AAAGAAAACTTAAAAATAAAACC |
| 3277 | AAGAAAACTTAAAAATAAAACCT |
| 3278 | AGAAAACTTAAAAATAAAACCTG |
| 3279 | GAAAACTTAAAAATAAAACCTGA |
| 3280 | AAAACTTAAAAATAAAACCTGAA |
| 3281 | AAACTTAAAAATAAAACCTGAAA |
| 3282 | AACTTAAAAATAAAACCTGAAAC |
| 3283 | ACTTAAAAATAAAACCTGAAACC |
| 3284 | CTTAAAAATAAAACCTGAAACCC |
| 3285 | TTAAAAATAAAACCTGAAACCCC |
| 3286 | TAAAAATAAAACCTGAAACCCCA |
| 3287 | AAAAATAAAACCTGAAACCCCAG |
| 3288 | AAAATAAAACCTGAAACCCCAGA |
| 3289 | AAATAAAACCTGAAACCCCAGAA |
| 3290 | AATAAAACCTGAAACCCCAGAAC |
| 3291 | ATAAAACCTGAAACCCCAGAACT |
| 3292 | TAAAACCTGAAACCCCAGAACTT |
| 3293 | AAAACCTGAAACCCCAGAACTTG |
| 3294 | AAACCTGAAACCCCAGAACTTGA |
| 3295 | AACCTGAAACCCCAGAACTTGAG |
| 3296 | ACCTGAAACCCCAGAACTTGAGC |
| 3297 | CCTGAAACCCCAGAACTTGAGCC |
| 3298 | CTGAAACCCCAGAACTTGAGCCT |
| 3299 | TGAAACCCCAGAACTTGAGCCTT |
| 3300 | GAAACCCCAGAACTTGAGCCTTG |
| 3301 | AAACCCCAGAACTTGAGCCTTGT |
| 3302 | AACCCCAGAACTTGAGCCTTGTG |
| 3303 | ACCCCAGAACTTGAGCCTTGTGT |

| ID | SEQUENCE |
|---|---|
| 3304 | CCCCAGAACTTGAGCCTTGTGTA |
| 3305 | CCCAGAACTTGAGCCTTGTGTAT |
| 3306 | CCAGAACTTGAGCCTTGTGTATA |
| 3307 | CAGAACTTGAGCCTTGTGTATAG |
| 3308 | AGAACTTGAGCCTTGTGTATAGA |
| 3309 | GAACTTGAGCCTTGTGTATAGAT |
| 3310 | AACTTGAGCCTTGTGTATAGATT |
| 3311 | ACTTGAGCCTTGTGTATAGATTT |
| 3312 | CTTGAGCCTTGTGTATAGATTTT |
| 3313 | TTGAGCCTTGTGTATAGATTTTA |
| 3314 | TGAGCCTTGTGTATAGATTTTAA |
| 3315 | GAGCCTTGTGTATAGATTTTAAA |
| 3316 | AGCCTTGTGTATAGATTTTAAAA |
| 3317 | GCCTTGTGTATAGATTTTAAAAG |
| 3318 | CCTTGTGTATAGATTTTAAAAGA |
| 3319 | CTTGTGTATAGATTTTAAAAGAA |
| 3320 | TTGTGTATAGATTTTAAAAGAAT |
| 3321 | TGTGTATAGATTTTAAAAGAATA |
| 3322 | GTGTATAGATTTTAAAAGAATAT |
| 3323 | TGTATAGATTTTAAAAGAATATA |
| 3324 | GTATAGATTTTAAAAGAATATAT |
| 3325 | TATAGATTTTAAAAGAATATATA |
| 3326 | ATAGATTTTAAAAGAATATATAT |
| 3327 | TAGATTTTAAAAGAATATATATA |
| 3328 | AGATTTTAAAAGAATATATATAT |
| 3329 | GATTTTAAAAGAATATATATATC |
| 3330 | ATTTTAAAAGAATATATATATCA |
| 3331 | TTTTAAAAGAATATATATATCAG |
| 3332 | TTTAAAAGAATATATATATCAGC |
| 3333 | TTAAAAGAATATATATATCAGCC |
| 3334 | TAAAAGAATATATATATCAGCCG |
| 3335 | AAAAGAATATATATATCAGCCGG |
| 3336 | AAAGAATATATATATCAGCCGGG |
| 3337 | AAGAATATATATATCAGCCGGGC |
| 3338 | AGAATATATATATCAGCCGGGCG |
| 3339 | GGGCGCGGTGGCTCATGCCTGTA |
| 3340 | GGCGCGGTGGCTCATGCCTGTAA |
| 3341 | GCGCGGTGGCTCATGCCTGTAAT |
| 3342 | CGCGGTGGCTCATGCCTGTAATC |
| 3343 | GCGGTGGCTCATGCCTGTAATCC |
| 3344 | CGGTGGCTCATGCCTGTAATCCC |
| 3345 | GGTGGCTCATGCCTGTAATCCCA |
| 3346 | GTGGCTCATGCCTGTAATCCCAG |
| 3347 | TGGCTCATGCCTGTAATCCCAGC |
| 3348 | GGCTCATGCCTGTAATCCCAGCA |
| 3349 | GCTCATGCCTGTAATCCCAGCAC |
| 3350 | CTCATGCCTGTAATCCCAGCACT |
| 3351 | TCATGCCTGTAATCCCAGCACTT |
| 3352 | CATGCCTGTAATCCCAGCACTTT |
| 3353 | ATGCCTGTAATCCCAGCACTTTG |
| 3354 | TGCCTGTAATCCCAGCACTTTGG |
| 3355 | GCCTGTAATCCCAGCACTTTGGG |
| 3356 | CCTGTAATCCCAGCACTTTGGGA |
| 3357 | CTGTAATCCCAGCACTTTGGGAG |
| 3358 | TGTAATCCCAGCACTTTGGGAGG |
| 3359 | GTAATCCCAGCACTTTGGGAGGC |
| 3360 | TAATCCCAGCACTTTGGGAGGCT |
| 3361 | AATCCCAGCACTTTGGGAGGCTG |

| ID | SEQUENCE |
|---|---|
| 3362 | ATCCCAGCACTTTGGGAGGCTGA |
| 3363 | TCCCAGCACTTTGGGAGGCTGAG |
| 3364 | CCCAGCACTTTGGGAGGCTGAGG |
| 3365 | CCAGCACTTTGGGAGGCTGAGGC |
| 3366 | CAGCACTTTGGGAGGCTGAGGCG |
| 3367 | AGCACTTTGGGAGGCTGAGGCGG |
| 3368 | GCACTTTGGGAGGCTGAGGCGGG |
| 3369 | CACTTTGGGAGGCTGAGGCGGGT |
| 3370 | ACTTTGGGAGGCTGAGGCGGGTG |
| 3371 | CTTTGGGAGGCTGAGGCGGGTGG |
| 3372 | TTTGGGAGGCTGAGGCGGGTGGA |
| 3373 | TTGGGAGGCTGAGGCGGGTGGAT |
| 3374 | TGGGAGGCTGAGGCGGGTGGATT |
| 3375 | GGGAGGCTGAGGCGGGTGGATTG |
| 3376 | GGAGGCTGAGGCGGGTGGATTGC |
| 3377 | GAGGCTGAGGCGGGTGGATTGCT |
| 3378 | AGGCTGAGGCGGGTGGATTGCTT |
| 3379 | GGCTGAGGCGGGTGGATTGCTTG |
| 3380 | GCTGAGGCGGGTGGATTGCTTGA |
| 3381 | CTGAGGCGGGTGGATTGCTTGAG |
| 3382 | TGAGGCGGGTGGATTGCTTGAGC |
| 3383 | GAGGCGGGTGGATTGCTTGAGCC |
| 3384 | AGGCGGGTGGATTGCTTGAGCCC |
| 3385 | GGCGGGTGGATTGCTTGAGCCCA |
| 3386 | GCGGGTGGATTGCTTGAGCCCAG |
| 3387 | CGGGTGGATTGCTTGAGCCCAGG |
| 3388 | GGGTGGATTGCTTGAGCCCAGGA |
| 3389 | GGTGGATTGCTTGAGCCCAGGAG |
| 3390 | GTGGATTGCTTGAGCCCAGGAGT |
| 3391 | TGGATTGCTTGAGCCCAGGAGTT |
| 3392 | GGATTGCTTGAGCCCAGGAGTTT |
| 3393 | GATTGCTTGAGCCCAGGAGTTTG |
| 3394 | ATTGCTTGAGCCCAGGAGTTTGA |
| 3395 | TTGCTTGAGCCCAGGAGTTTGAG |
| 3396 | TGCTTGAGCCCAGGAGTTTGAGA |
| 3397 | GCTTGAGCCCAGGAGTTTGAGAC |
| 3398 | CTTGAGCCCAGGAGTTTGAGACC |
| 3399 | TTGAGCCCAGGAGTTTGAGACCA |
| 3400 | TGAGCCCAGGAGTTTGAGACCAG |
| 3401 | GAGCCCAGGAGTTTGAGACCAGC |
| 3402 | AGCCCAGGAGTTTGAGACCAGCC |
| 3403 | GCCCAGGAGTTTGAGACCAGCCT |
| 3404 | CCCAGGAGTTTGAGACCAGCCTG |
| 3405 | CCAGGAGTTTGAGACCAGCCTGG |
| 3406 | CAGGAGTTTGAGACCAGCCTGGC |
| 3407 | AGGAGTTTGAGACCAGCCTGGCC |
| 3408 | GGAGTTTGAGACCAGCCTGGCCA |
| 3409 | GAGTTTGAGACCAGCCTGGCCAA |
| 3410 | AGTTTGAGACCAGCCTGGCCAAC |
| 3411 | GTTTGAGACCAGCCTGGCCAACG |
| 3412 | TTTGAGACCAGCCTGGCCAACGT |
| 3413 | TTGAGACCAGCCTGGCCAACGTG |
| 3414 | TGAGACCAGCCTGGCCAACGTGG |
| 3415 | GAGACCAGCCTGGCCAACGTGGC |
| 3416 | AGACCAGCCTGGCCAACGTGGCA |
| 3417 | GACCAGCCTGGCCAACGTGGCAA |
| 3418 | ACCAGCCTGGCCAACGTGGCAAA |
| 3419 | CCAGCCTGGCCAACGTGGCAAAA |

| ID | SEQUENCE |
|---|---|
| 3420 | CAGCCTGGCCAACGTGGCAAAAC |
| 3421 | AGCCTGGCCAACGTGGCAAAACC |
| 3422 | GCCTGGCCAACGTGGCAAAACCT |
| 3423 | CCTGGCCAACGTGGCAAAACCTC |
| 3424 | CTGGCCAACGTGGCAAAACCTCG |
| 3425 | TGGCCAACGTGGCAAAACCTCGT |
| 3426 | GGCCAACGTGGCAAAACCTCGTC |
| 3427 | GCCAACGTGGCAAAACCTCGTCT |
| 3428 | CCAACGTGGCAAAACCTCGTCTC |
| 3429 | CAACGTGGCAAAACCTCGTCTCT |
| 3430 | AACGTGGCAAAACCTCGTCTCTG |
| 3431 | ACGTGGCAAAACCTCGTCTCTGT |
| 3432 | CGTGGCAAAACCTCGTCTCTGTT |
| 3433 | GTGGCAAAACCTCGTCTCTGTTA |
| 3434 | TGGCAAAACCTCGTCTCTGTTAA |
| 3435 | GGCAAAACCTCGTCTCTGTTAAA |
| 3436 | GCAAAACCTCGTCTCTGTTAAAA |
| 3437 | CAAAACCTCGTCTCTGTTAAAAA |
| 3438 | AAAACCTCGTCTCTGTTAAAAAT |
| 3439 | AAACCTCGTCTCTGTTAAAAATT |
| 3440 | AACCTCGTCTCTGTTAAAAATTA |
| 3441 | ACCTCGTCTCTGTTAAAAATTAG |
| 3442 | CCTCGTCTCTGTTAAAAATTAGC |
| 3443 | CTCGTCTCTGTTAAAAATTAGCC |
| 3444 | TCGTCTCTGTTAAAAATTAGCCG |
| 3445 | CGTCTCTGTTAAAAATTAGCCGG |
| 3446 | GTCTCTGTTAAAAATTAGCCGGG |
| 3447 | TCTCTGTTAAAAATTAGCCGGGC |
| 3448 | CTCTGTTAAAAATTAGCCGGGCG |
| 3449 | TCTGTTAAAAATTAGCCGGGCGT |
| 3450 | CTGTTAAAAATTAGCCGGGCGTG |
| 3451 | TGTTAAAAATTAGCCGGGCGTGG |
| 3452 | GTTAAAAATTAGCCGGGCGTGGT |
| 3453 | TTAAAAATTAGCCGGGCGTGGTG |
| 3454 | TAAAAATTAGCCGGGCGTGGTGG |
| 3455 | AAAAATTAGCCGGGCGTGGTGGC |
| 3456 | AAAATTAGCCGGGCGTGGTGGCA |
| 3457 | AAATTAGCCGGGCGTGGTGGCAC |
| 3458 | AATTAGCCGGGCGTGGTGGCACA |
| 3459 | ATTAGCCGGGCGTGGTGGCACAC |
| 3460 | TTAGCCGGGCGTGGTGGCACACT |
| 3461 | TAGCCGGGCGTGGTGGCACACTC |
| 3462 | AGCCGGGCGTGGTGGCACACTCC |
| 3463 | GCCGGGCGTGGTGGCACACTCCT |
| 3464 | CCGGGCGTGGTGGCACACTCCTG |
| 3465 | CGGGCGTGGTGGCACACTCCTGT |
| 3466 | GGGCGTGGTGGCACACTCCTGTA |
| 3467 | GGCGTGGTGGCACACTCCTGTAA |
| 3468 | GCGTGGTGGCACACTCCTGTAAT |
| 3469 | CGTGGTGGCACACTCCTGTAATC |
| 3470 | GTGGTGGCACACTCCTGTAATCC |
| 3471 | TGGTGGCACACTCCTGTAATCCC |
| 3472 | GGTGGCACACTCCTGTAATCCCA |
| 3473 | GTGGCACACTCCTGTAATCCCAG |
| 3474 | TGGCACACTCCTGTAATCCCAGC |
| 3475 | GGCACACTCCTGTAATCCCAGCT |
| 3476 | GCACACTCCTGTAATCCCAGCTA |
| 3477 | CACACTCCTGTAATCCCAGCTAC |

| ID | SEQUENCE |
|---|---|
| 3478 | ACACTCCTGTAATCCCAGCTACT |
| 3479 | CACTCCTGTAATCCCAGCTACTG |
| 3480 | ACTCCTGTAATCCCAGCTACTGG |
| 3481 | CTCCTGTAATCCCAGCTACTGGG |
| 3482 | TCCTGTAATCCCAGCTACTGGGG |
| 3483 | CCTGTAATCCCAGCTACTGGGGA |
| 3484 | CTGTAATCCCAGCTACTGGGGAG |
| 3485 | TGTAATCCCAGCTACTGGGGAGG |
| 3486 | GTAATCCCAGCTACTGGGGAGGC |
| 3487 | TAATCCCAGCTACTGGGGAGGCT |
| 3488 | AATCCCAGCTACTGGGGAGGCTG |
| 3489 | ATCCCAGCTACTGGGGAGGCTGA |
| 3490 | TCCCAGCTACTGGGGAGGCTGAG |
| 3491 | CCCAGCTACTGGGGAGGCTGAGG |
| 3492 | CCAGCTACTGGGGAGGCTGAGGC |
| 3493 | CAGCTACTGGGGAGGCTGAGGCA |
| 3494 | AGCTACTGGGGAGGCTGAGGCAC |
| 3495 | GCTACTGGGGAGGCTGAGGCACG |
| 3496 | CTACTGGGGAGGCTGAGGCACGA |
| 3497 | TACTGGGGAGGCTGAGGCACGAG |
| 3498 | ACTGGGGAGGCTGAGGCACGAGA |
| 3499 | CTGGGGAGGCTGAGGCACGAGAA |
| 3500 | TGGGGAGGCTGAGGCACGAGAAT |
| 3501 | GGGGAGGCTGAGGCACGAGAATC |
| 3502 | GGGAGGCTGAGGCACGAGAATCA |
| 3503 | GGAGGCTGAGGCACGAGAATCAC |
| 3504 | GAGGCTGAGGCACGAGAATCACT |
| 3505 | AGGCTGAGGCACGAGAATCACTT |
| 3506 | GGCTGAGGCACGAGAATCACTTG |
| 3507 | GCTGAGGCACGAGAATCACTTGA |
| 3508 | CTGAGGCACGAGAATCACTTGAA |
| 3509 | TGAGGCACGAGAATCACTTGAAC |
| 3510 | GAGGCACGAGAATCACTTGAACC |
| 3511 | AGGCACGAGAATCACTTGAACCC |
| 3512 | GGCACGAGAATCACTTGAACCCA |
| 3513 | GCACGAGAATCACTTGAACCCAG |
| 3514 | CACGAGAATCACTTGAACCCAGG |
| 3515 | ACGAGAATCACTTGAACCCAGGA |
| 3516 | CGAGAATCACTTGAACCCAGGAA |
| 3517 | GAGAATCACTTGAACCCAGGAAG |
| 3518 | AGAATCACTTGAACCCAGGAAGC |
| 3519 | GAATCACTTGAACCCAGGAAGCG |
| 3520 | AATCACTTGAACCCAGGAAGCGG |
| 3521 | ATCACTTGAACCCAGGAAGCGGG |
| 3522 | TCACTTGAACCCAGGAAGCGGGG |
| 3523 | CACTTGAACCCAGGAAGCGGGGT |
| 3524 | ACTTGAACCCAGGAAGCGGGGTT |
| 3525 | CTTGAACCCAGGAAGCGGGGTTG |
| 3526 | TTGAACCCAGGAAGCGGGGTTGC |
| 3527 | TGAACCCAGGAAGCGGGGTTGCA |
| 3528 | GAACCCAGGAAGCGGGGTTGCAG |
| 3529 | AACCCAGGAAGCGGGGTTGCAGT |
| 3530 | ACCCAGGAAGCGGGGTTGCAGTG |
| 3531 | CCCAGGAAGCGGGGTTGCAGTGA |
| 3532 | CCAGGAAGCGGGGTTGCAGTGAG |
| 3533 | CAGGAAGCGGGGTTGCAGTGAGC |
| 3534 | AGGAAGCGGGGTTGCAGTGAGCC |
| 3535 | GGAAGCGGGGTTGCAGTGAGCCA |

| ID | SEQUENCE |
|---|---|
| 3536 | GAAGCGGGGTTGCAGTGAGCCAA |
| 3537 | AAGCGGGGTTGCAGTGAGCCAAA |
| 3538 | AGCGGGGTTGCAGTGAGCCAAAG |
| 3539 | GCGGGGTTGCAGTGAGCCAAAGG |
| 3540 | CGGGGTTGCAGTGAGCCAAAGGT |
| 3541 | GGGGTTGCAGTGAGCCAAAGGTA |
| 3542 | GGGTTGCAGTGAGCCAAAGGTAC |
| 3543 | GGTTGCAGTGAGCCAAAGGTACA |
| 3544 | GTTGCAGTGAGCCAAAGGTACAC |
| 3545 | TTGCAGTGAGCCAAAGGTACACC |
| 3546 | TGCAGTGAGCCAAAGGTACACCA |
| 3547 | GCAGTGAGCCAAAGGTACACCAC |
| 3548 | CAGTGAGCCAAAGGTACACCACT |
| 3549 | AGTGAGCCAAAGGTACACCACTA |
| 3550 | GTGAGCCAAAGGTACACCACTAC |
| 3551 | TGAGCCAAAGGTACACCACTACA |
| 3552 | GAGCCAAAGGTACACCACTACAC |
| 3553 | AGCCAAAGGTACACCACTACACT |
| 3554 | GCCAAAGGTACACCACTACACTC |
| 3555 | CCAAAGGTACACCACTACACTCC |
| 3556 | CAAAGGTACACCACTACACTCCA |
| 3557 | AAAGGTACACCACTACACTCCAG |
| 3558 | AAGGTACACCACTACACTCCAGC |
| 3559 | AGGTACACCACTACACTCCAGCC |
| 3560 | GGTACACCACTACACTCCAGCCT |
| 3561 | GTACACCACTACACTCCAGCCTG |
| 3562 | TACACCACTACACTCCAGCCTGG |
| 3563 | ACACCACTACACTCCAGCCTGGG |
| 3564 | CACCACTACACTCCAGCCTGGGC |
| 3565 | ACCACTACACTCCAGCCTGGGCA |
| 3566 | CCACTACACTCCAGCCTGGGCAA |
| 3567 | CACTACACTCCAGCCTGGGCAAC |
| 3568 | ACTACACTCCAGCCTGGGCAACA |
| 3569 | CTACACTCCAGCCTGGGCAACAG |
| 3570 | TACACTCCAGCCTGGGCAACAGA |
| 3571 | ACACTCCAGCCTGGGCAACAGAG |
| 3572 | CACTCCAGCCTGGGCAACAGAGC |
| 3573 | ACTCCAGCCTGGGCAACAGAGCA |
| 3574 | CTCCAGCCTGGGCAACAGAGCAA |
| 3575 | TCCAGCCTGGGCAACAGAGCAAG |
| 3576 | CCAGCCTGGGCAACAGAGCAAGA |
| 3577 | CAGCCTGGGCAACAGAGCAAGAC |
| 3578 | AGCCTGGGCAACAGAGCAAGACT |
| 3579 | GCCTGGGCAACAGAGCAAGACTC |
| 3580 | CCTGGGCAACAGAGCAAGACTCG |
| 3581 | CTGGGCAACAGAGCAAGACTCGG |
| 3582 | TGGGCAACAGAGCAAGACTCGGT |
| 3583 | GGGCAACAGAGCAAGACTCGGTC |
| 3584 | GGCAACAGAGCAAGACTCGGTCT |
| 3585 | GCAACAGAGCAAGACTCGGTCTC |
| 3586 | CAACAGAGCAAGACTCGGTCTCA |
| 3587 | AACAGAGCAAGACTCGGTCTCAA |
| 3588 | ACAGAGCAAGACTCGGTCTCAAA |
| 3589 | CAGAGCAAGACTCGGTCTCAAAA |
| 3590 | AGAGCAAGACTCGGTCTCAAAAA |
| 3591 | GAGCAAGACTCGGTCTCAAAAAC |
| 3592 | AGCAAGACTCGGTCTCAAAAACA |
| 3593 | GCAAGACTCGGTCTCAAAAACAA |

| ID | SEQUENCE |
|---|---|
| 3594 | CAAGACTCGGTCTCAAAAACAAA |
| 3595 | AAGACTCGGTCTCAAAAACAAAA |
| 3596 | AGACTCGGTCTCAAAAACAAAAT |
| 3597 | GACTCGGTCTCAAAAACAAAATT |
| 3598 | ACTCGGTCTCAAAAACAAAATTT |
| 3599 | CTCGGTCTCAAAAACAAAATTTA |
| 3600 | TCGGTCTCAAAAACAAAATTTAA |
| 3601 | CGGTCTCAAAAACAAAATTTAAA |
| 3602 | GGTCTCAAAAACAAAATTTAAAA |
| 3603 | GTCTCAAAAACAAAATTTAAAAA |
| 3604 | TCTCAAAAACAAAATTTAAAAAA |
| 3605 | CTCAAAAACAAAATTTAAAAAAG |
| 3606 | TCAAAAACAAAATTTAAAAAAGA |
| 3607 | CAAAAACAAAATTTAAAAAAGAT |
| 3608 | AAAAACAAAATTTAAAAAAGATA |
| 3609 | AAAACAAAATTTAAAAAAGATAT |
| 3610 | AAACAAAATTTAAAAAAGATATA |
| 3611 | AACAAAATTTAAAAAAGATATAA |
| 3612 | ACAAAATTTAAAAAAGATATAAG |
| 3613 | CAAAATTTAAAAAAGATATAAGG |
| 3614 | AAAATTTAAAAAAGATATAAGGC |
| 3615 | AAATTTAAAAAAGATATAAGGCA |
| 3616 | AATTTAAAAAAGATATAAGGCAG |
| 3617 | ATTTAAAAAAGATATAAGGCAGT |
| 3618 | TTTAAAAAAGATATAAGGCAGTA |
| 3619 | TTAAAAAAGATATAAGGCAGTAC |
| 3620 | TAAAAAAGATATAAGGCAGTACT |
| 3621 | AAAAAAGATATAAGGCAGTACTG |
| 3622 | AAAAAGATATAAGGCAGTACTGT |
| 3623 | AAAAGATATAAGGCAGTACTGTA |
| 3624 | AAAGATATAAGGCAGTACTGTAA |
| 3625 | AAGATATAAGGCAGTACTGTAAA |
| 3626 | AGATATAAGGCAGTACTGTAAAT |
| 3627 | GATATAAGGCAGTACTGTAAATT |
| 3628 | ATATAAGGCAGTACTGTAAATTC |
| 3629 | TATAAGGCAGTACTGTAAATTCA |
| 3630 | ATAAGGCAGTACTGTAAATTCAG |
| 3631 | TAAGGCAGTACTGTAAATTCAGT |
| 3632 | AAGGCAGTACTGTAAATTCAGTT |
| 3633 | AGGCAGTACTGTAAATTCAGTTG |
| 3634 | GGCAGTACTGTAAATTCAGTTGA |
| 3635 | GCAGTACTGTAAATTCAGTTGAA |
| 3636 | CAGTACTGTAAATTCAGTTGAAT |
| 3637 | AGTACTGTAAATTCAGTTGAATT |
| 3638 | GTACTGTAAATTCAGTTGAATTT |
| 3639 | TACTGTAAATTCAGTTGAATTTT |
| 3640 | ACTGTAAATTCAGTTGAATTTTG |
| 3641 | CTGTAAATTCAGTTGAATTTTGA |
| 3642 | TGTAAATTCAGTTGAATTTTGAT |
| 3643 | GTAAATTCAGTTGAATTTTGATA |
| 3644 | TAAATTCAGTTGAATTTTGATAT |
| 3645 | AAATTCAGTTGAATTTTGATATC |
| 3646 | AATTCAGTTGAATTTTGATATCT |
| 3647 | ATTCAGTTGAATTTTGATATCTA |
| 3648 | TTCAGTTGAATTTTGATATCTAC |
| 3649 | TCAGTTGAATTTTGATATCTACC |
| 3650 | CAGTTGAATTTTGATATCTACCC |
| 3651 | AGTTGAATTTTGATATCTACCCA |

| ID | SEQUENCE |
|---|---|
| 3652 | GTTGAATTTTGATATCTACCCAT |
| 3653 | TTGAATTTTGATATCTACCCATT |
| 3654 | TGAATTTTGATATCTACCCATTT |
| 3655 | GAATTTTGATATCTACCCATTTT |
| 3656 | AATTTTGATATCTACCCATTTTT |
| 3657 | ATTTTGATATCTACCCATTTTTC |
| 3658 | TTTTGATATCTACCCATTTTTCT |
| 3659 | TTTGATATCTACCCATTTTTCTG |
| 3660 | TTGATATCTACCCATTTTTCTGT |
| 3661 | TGATATCTACCCATTTTTCTGTC |
| 3662 | GATATCTACCCATTTTTCTGTCA |
| 3663 | ATATCTACCCATTTTTCTGTCAT |
| 3664 | TATCTACCCATTTTTCTGTCATC |
| 3665 | ATCTACCCATTTTTCTGTCATCC |
| 3666 | TCTACCCATTTTTCTGTCATCCC |
| 3667 | CTACCCATTTTTCTGTCATCCCT |
| 3668 | TACCCATTTTTCTGTCATCCCTA |
| 3669 | ACCCATTTTTCTGTCATCCCTAT |
| 3670 | CCCATTTTTCTGTCATCCCTATA |
| 3671 | CCATTTTTCTGTCATCCCTATAG |
| 3672 | CATTTTTCTGTCATCCCTATAGT |
| 3673 | ATTTTTCTGTCATCCCTATAGTT |
| 3674 | TTTTTCTGTCATCCCTATAGTTC |
| 3675 | TTTTCTGTCATCCCTATAGTTCA |
| 3676 | TTTCTGTCATCCCTATAGTTCAC |
| 3677 | TTCTGTCATCCCTATAGTTCACT |
| 3678 | TCTGTCATCCCTATAGTTCACTT |
| 3679 | CTGTCATCCCTATAGTTCACTTT |
| 3680 | TGTCATCCCTATAGTTCACTTTG |
| 3681 | GTCATCCCTATAGTTCACTTTGT |
| 3682 | TCATCCCTATAGTTCACTTTGTA |
| 3683 | CATCCCTATAGTTCACTTTGTAT |
| 3684 | ATCCCTATAGTTCACTTTGTATT |
| 3685 | TCCCTATAGTTCACTTTGTATTA |
| 3686 | CCCTATAGTTCACTTTGTATTAA |
| 3687 | CCTATAGTTCACTTTGTATTAAA |
| 3688 | CTATAGTTCACTTTGTATTAAAT |
| 3689 | TATAGTTCACTTTGTATTAAATT |
| 3690 | ATAGTTCACTTTGTATTAAATTG |
| 3691 | TAGTTCACTTTGTATTAAATTGG |
| 3692 | AGTTCACTTTGTATTAAATTGGG |
| 3693 | GTTCACTTTGTATTAAATTGGGT |
| 3694 | TTCACTTTGTATTAAATTGGGTT |
| 3695 | TCACTTTGTATTAAATTGGGTTT |
| 3696 | CACTTTGTATTAAATTGGGTTTC |
| 3697 | ACTTTGTATTAAATTGGGTTTCA |
| 3698 | CTTTGTATTAAATTGGGTTTCAT |
| 3699 | TTTGTATTAAATTGGGTTTCATT |
| 3700 | TTGTATTAAATTGGGTTTCATTT |
| 3701 | TGTATTAAATTGGGTTTCATTTG |
| 3702 | GTATTAAATTGGGTTTCATTTGG |
| 3703 | TATTAAATTGGGTTTCATTTGGG |
| 3704 | ATTAAATTGGGTTTCATTTGGGA |
| 3705 | TTAAATTGGGTTTCATTTGGGAT |
| 3706 | TAAATTGGGTTTCATTTGGGATT |
| 3707 | AAATTGGGTTTCATTTGGGATTT |
| 3708 | AATTGGGTTTCATTTGGGATTTG |
| 3709 | ATTGGGTTTCATTTGGGATTTGC |

| ID | SEQUENCE |
|---|---|
| 3710 | TTGGGTTTCATTTGGGATTTGCA |
| 3711 | TGGGTTTCATTTGGGATTTGCAA |
| 3712 | GGGTTTCATTTGGGATTTGCAAT |
| 3713 | GGTTTCATTTGGGATTTGCAATG |
| 3714 | GTTTCATTTGGGATTTGCAATGT |
| 3715 | TTTCATTTGGGATTTGCAATGTA |
| 3716 | TTCATTTGGGATTTGCAATGTAA |
| 3717 | TCATTTGGGATTTGCAATGTAAA |
| 3718 | CATTTGGGATTTGCAATGTAAAT |
| 3719 | ATTTGGGATTTGCAATGTAAATA |
| 3720 | TTTGGGATTTGCAATGTAAATAC |
| 3721 | TTGGGATTTGCAATGTAAATACG |
| 3722 | TGGGATTTGCAATGTAAATACGT |
| 3723 | GGGATTTGCAATGTAAATACGTA |
| 3724 | GGATTTGCAATGTAAATACGTAT |
| 3725 | GATTTGCAATGTAAATACGTATT |
| 3726 | ATTTGCAATGTAAATACGTATTT |
| 3727 | TTTGCAATGTAAATACGTATTTC |
| 3728 | TTGCAATGTAAATACGTATTTCT |
| 3729 | TGCAATGTAAATACGTATTTCTA |
| 3730 | GCAATGTAAATACGTATTTCTAG |
| 3731 | CAATGTAAATACGTATTTCTAGT |
| 3732 | AATGTAAATACGTATTTCTAGTT |
| 3733 | ATGTAAATACGTATTTCTAGTTT |
| 3734 | TGTAAATACGTATTTCTAGTTTT |
| 3735 | GTAAATACGTATTTCTAGTTTTC |
| 3736 | TAAATACGTATTTCTAGTTTTCA |
| 3737 | AAATACGTATTTCTAGTTTTCAT |
| 3738 | AATACGTATTTCTAGTTTTCATA |
| 3739 | ATACGTATTTCTAGTTTTCATAT |
| 3740 | TACGTATTTCTAGTTTTCATATA |
| 3741 | ACGTATTTCTAGTTTTCATATAA |
| 3742 | CGTATTTCTAGTTTTCATATAAA |
| 3743 | GTATTTCTAGTTTTCATATAAAG |
| 3744 | TATTTCTAGTTTTCATATAAAGT |
| 3745 | ATTTCTAGTTTTCATATAAAGTA |
| 3746 | TTTCTAGTTTTCATATAAAGTAG |
| 3747 | TTCTAGTTTTCATATAAAGTAGT |
| 3748 | TCTAGTTTTCATATAAAGTAGTT |
| 3749 | CTAGTTTTCATATAAAGTAGTTC |
| 3750 | TAGTTTTCATATAAAGTAGTTCT |
| 3751 | AGTTTTCATATAAAGTAGTTCTT |
| 3752 | GTTTTCATATAAAGTAGTTCTTT |
| 3753 | TTTTCATATAAAGTAGTTCTTTT |
| 3754 | TTTCATATAAAGTAGTTCTTTTA |
| 3755 | TTCATATAAAGTAGTTCTTTTAT |
| 3756 | TCATATAAAGTAGTTCTTTTATA |
| 3757 | CATATAAAGTAGTTCTTTTATAA |
| 3758 | ATATAAAGTAGTTCTTTTATAAC |
| 3759 | TATAAAGTAGTTCTTTTATAACA |
| 3760 | ATAAAGTAGTTCTTTTATAACAA |
| 3761 | TAAAGTAGTTCTTTTATAACAAA |
| 3762 | AAAGTAGTTCTTTTATAACAAAT |
| 3763 | AAGTAGTTCTTTTATAACAAATG |
| 3764 | AGTAGTTCTTTTATAACAAATGA |
| 3765 | GTAGTTCTTTTATAACAAATGAA |
| 3766 | TAGTTCTTTTATAACAAATGAAA |
| 3767 | AGTTCTTTTATAACAAATGAAAA |

| ID | SEQUENCE |
|---|---|
| 3768 | GTTCTTTTATAACAAATGAAAAG |
| 3769 | TTCTTTTATAACAAATGAAAAGT |
| 3770 | TCTTTTATAACAAATGAAAAGTA |
| 3771 | CTTTTATAACAAATGAAAAGTAT |
| 3772 | TTTTATAACAAATGAAAAGTATT |
| 3773 | TTTATAACAAATGAAAAGTATTT |
| 3774 | TTATAACAAATGAAAAGTATTTT |
| 3775 | TATAACAAATGAAAAGTATTTTT |
| 3776 | ATAACAAATGAAAAGTATTTTTC |
| 3777 | TAACAAATGAAAAGTATTTTTCT |
| 3778 | AACAAATGAAAAGTATTTTTCTT |
| 3779 | ACAAATGAAAAGTATTTTTCTTG |
| 3780 | CAAATGAAAAGTATTTTTCTTGT |
| 3781 | AAATGAAAAGTATTTTTCTTGTA |
| 3782 | AATGAAAAGTATTTTTCTTGTAT |
| 3783 | ATGAAAAGTATTTTTCTTGTATA |
| 3784 | TGAAAAGTATTTTTCTTGTATAT |
| 3785 | GAAAAGTATTTTTCTTGTATATT |
| 3786 | AAAAGTATTTTTCTTGTATATTA |
| 3787 | AAAGTATTTTTCTTGTATATTAT |
| 3788 | AAGTATTTTTCTTGTATATTATT |
| 3789 | AGTATTTTTCTTGTATATTATTA |
| 3790 | GTATTTTTCTTGTATATTATTAA |
| 3791 | TATTTTTCTTGTATATTATTAAG |
| 3792 | ATTTTTCTTGTATATTATTAAGT |
| 3793 | TTTTTCTTGTATATTATTAAGTA |
| 3794 | TTTTCTTGTATATTATTAAGTAA |
| 3795 | TTTCTTGTATATTATTAAGTAAT |
| 3796 | TTCTTGTATATTATTAAGTAATG |
| 3797 | TCTTGTATATTATTAAGTAATGA |
| 3798 | CTTGTATATTATTAAGTAATGAA |
| 3799 | TTGTATATTATTAAGTAATGAAT |
| 3800 | TGTATATTATTAAGTAATGAATA |
| 3801 | GTATATTATTAAGTAATGAATAT |
| 3802 | TATATTATTAAGTAATGAATATA |
| 3803 | ATATTATTAAGTAATGAATATAT |
| 3804 | TATTATTAAGTAATGAATATATA |
| 3805 | ATTATTAAGTAATGAATATATAA |
| 3806 | TTATTAAGTAATGAATATATAAG |
| 3807 | TATTAAGTAATGAATATATAAGA |
| 3808 | ATTAAGTAATGAATATATAAGAA |
| 3809 | TTAAGTAATGAATATATAAGAAC |
| 3810 | TAAGTAATGAATATATAAGAACT |
| 3811 | AAGTAATGAATATATAAGAACTG |
| 3812 | AGTAATGAATATATAAGAACTGT |
| 3813 | GTAATGAATATATAAGAACTGTA |
| 3814 | TAATGAATATATAAGAACTGTAC |
| 3815 | AATGAATATATAAGAACTGTACT |
| 3816 | ATGAATATATAAGAACTGTACTC |
| 3817 | TGAATATATAAGAACTGTACTCT |
| 3818 | GAATATATAAGAACTGTACTCTT |
| 3819 | AATATATAAGAACTGTACTCTTC |
| 3820 | ATATATAAGAACTGTACTCTTCT |
| 3821 | TATATAAGAACTGTACTCTTCTC |
| 3822 | ATATAAGAACTGTACTCTTCTCA |
| 3823 | TATAAGAACTGTACTCTTCTCAG |
| 3824 | ATAAGAACTGTACTCTTCTCAGC |
| 3825 | TAAGAACTGTACTCTTCTCAGCT |

| ID | SEQUENCE |
|---|---|
| 3826 | AAGAACTGTACTCTTCTCAGCTT |
| 3827 | AGAACTGTACTCTTCTCAGCTTG |
| 3828 | GAACTGTACTCTTCTCAGCTTGA |
| 3829 | AACTGTACTCTTCTCAGCTTGAG |
| 3830 | ACTGTACTCTTCTCAGCTTGAGC |
| 3831 | CTGTACTCTTCTCAGCTTGAGCT |
| 3832 | TGTACTCTTCTCAGCTTGAGCTT |
| 3833 | GTACTCTTCTCAGCTTGAGCTTA |
| 3834 | TACTCTTCTCAGCTTGAGCTTAA |
| 3835 | ACTCTTCTCAGCTTGAGCTTAAC |
| 3836 | CTCTTCTCAGCTTGAGCTTAACA |
| 3837 | TCTTCTCAGCTTGAGCTTAACAT |
| 3838 | CTTCTCAGCTTGAGCTTAACATA |
| 3839 | TTCTCAGCTTGAGCTTAACATAG |
| 3840 | TCTCAGCTTGAGCTTAACATAGG |
| 3841 | CTCAGCTTGAGCTTAACATAGGT |
| 3842 | TCAGCTTGAGCTTAACATAGGTA |
| 3843 | CAGCTTGAGCTTAACATAGGTAA |
| 3844 | AGCTTGAGCTTAACATAGGTAAA |
| 3845 | GCTTGAGCTTAACATAGGTAAAT |
| 3846 | CTTGAGCTTAACATAGGTAAATA |
| 3847 | TTGAGCTTAACATAGGTAAATAT |
| 3848 | TGAGCTTAACATAGGTAAATATC |
| 3849 | GAGCTTAACATAGGTAAATATCA |
| 3850 | AGCTTAACATAGGTAAATATCAC |
| 3851 | GCTTAACATAGGTAAATATCACC |
| 3852 | CTTAACATAGGTAAATATCACCA |
| 3853 | TTAACATAGGTAAATATCACCAA |
| 3854 | TAACATAGGTAAATATCACCAAC |
| 3855 | AACATAGGTAAATATCACCAACA |
| 3856 | ACATAGGTAAATATCACCAACAT |
| 3857 | CATAGGTAAATATCACCAACATC |
| 3858 | ATAGGTAAATATCACCAACATCT |
| 3859 | TAGGTAAATATCACCAACATCTG |
| 3860 | AGGTAAATATCACCAACATCTGT |
| 3861 | GGTAAATATCACCAACATCTGTC |
| 3862 | GTAAATATCACCAACATCTGTCC |
| 3863 | TAAATATCACCAACATCTGTCCT |
| 3864 | AAATATCACCAACATCTGTCCTT |
| 3865 | AATATCACCAACATCTGTCCTTA |
| 3866 | ATATCACCAACATCTGTCCTTAG |
| 3867 | TATCACCAACATCTGTCCTTAGA |
| 3868 | ATCACCAACATCTGTCCTTAGAA |
| 3869 | TCACCAACATCTGTCCTTAGAAA |
| 3870 | CACCAACATCTGTCCTTAGAAAG |
| 3871 | ACCAACATCTGTCCTTAGAAAGG |
| 3872 | CCAACATCTGTCCTTAGAAAGGA |
| 3873 | CAACATCTGTCCTTAGAAAGGAC |
| 3874 | AACATCTGTCCTTAGAAAGGACC |
| 3875 | ACATCTGTCCTTAGAAAGGACCA |
| 3876 | CATCTGTCCTTAGAAAGGACCAT |
| 3877 | ATCTGTCCTTAGAAAGGACCATC |
| 3878 | TCTGTCCTTAGAAAGGACCATCT |
| 3879 | CTGTCCTTAGAAAGGACCATCTC |
| 3880 | TGTCCTTAGAAAGGACCATCTCA |
| 3881 | GTCCTTAGAAAGGACCATCTCAT |
| 3882 | TCCTTAGAAAGGACCATCTCATG |
| 3883 | CCTTAGAAAGGACCATCTCATGT |

| ID | SEQUENCE |
|---|---|
| 3884 | CTTAGAAAGGACCATCTCATGTT |
| 3885 | TTAGAAAGGACCATCTCATGTTT |
| 3886 | TAGAAAGGACCATCTCATGTTTT |
| 3887 | AGAAAGGACCATCTCATGTTTTT |
| 3888 | GAAAGGACCATCTCATGTTTTTT |
| 3889 | AAAGGACCATCTCATGTTTTTTT |
| 3890 | AAGGACCATCTCATGTTTTTTTT |
| 3891 | AGGACCATCTCATGTTTTTTTC |
| 3892 | GGACCATCTCATGTTTTTTTCT |
| 3893 | GACCATCTCATGTTTTTTTCTT |
| 3894 | ACCATCTCATGTTTTTTTCTTG |
| 3895 | CCATCTCATGTTTTTTTCTTGC |
| 3896 | CATCTCATGTTTTTTTCTTGCT |
| 3897 | ATCTCATGTTTTTTTCTTGCTA |
| 3898 | TCTCATGTTTTTTTCTTGCTAT |
| 3899 | CTCATGTTTTTTTCTTGCTATG |
| 3900 | TCATGTTTTTTTCTTGCTATGA |
| 3901 | CATGTTTTTTTCTTGCTATGAC |
| 3902 | ATGTTTTTTTCTTGCTATGACT |
| 3903 | TGTTTTTTTCTTGCTATGACTT |
| 3904 | GTTTTTTTCTTGCTATGACTTG |
| 3905 | TTTTTTTCTTGCTATGACTTGT |
| 3906 | TTTTTTCTTGCTATGACTTGTG |
| 3907 | TTTTTCTTGCTATGACTTGTGT |
| 3908 | TTTTCTTGCTATGACTTGTGTA |
| 3909 | TTTCTTGCTATGACTTGTGTAT |
| 3910 | TTCTTGCTATGACTTGTGTATT |
| 3911 | TCTTGCTATGACTTGTGTATTT |
| 3912 | CTTGCTATGACTTGTGTATTTT |
| 3913 | TTGCTATGACTTGTGTATTTTC |
| 3914 | TGCTATGACTTGTGTATTTTCT |
| 3915 | GCTATGACTTGTGTATTTTCTT |
| 3916 | CTATGACTTGTGTATTTTCTTG |
| 3917 | TATGACTTGTGTATTTTCTTGC |
| 3918 | ATGACTTGTGTATTTTCTTGCA |
| 3919 | TGACTTGTGTATTTTCTTGCAT |
| 3920 | GACTTGTGTATTTTCTTGCATC |
| 3921 | ACTTGTGTATTTTCTTGCATCC |
| 3922 | CTTGTGTATTTTCTTGCATCCT |
| 3923 | TTGTGTATTTTCTTGCATCCTC |
| 3924 | TGTGTATTTTCTTGCATCCTCC |
| 3925 | GTGTATTTTCTTGCATCCTCCC |
| 3926 | TGTATTTTCTTGCATCCTCCCT |
| 3927 | GTATTTTCTTGCATCCTCCCTA |
| 3928 | TATTTTCTTGCATCCTCCCTAG |
| 3929 | ATTTTCTTGCATCCTCCCTAGA |
| 3930 | TTTTCTTGCATCCTCCCTAGAC |
| 3931 | TTTCTTGCATCCTCCCTAGACT |
| 3932 | TTCTTGCATCCTCCCTAGACTT |
| 3933 | TCTTGCATCCTCCCTAGACTTC |
| 3934 | CTTGCATCCTCCCTAGACTTCC |
| 3935 | TTGCATCCTCCCTAGACTTCCC |
| 3936 | TGCATCCTCCCTAGACTTCCCT |
| 3937 | GCATCCTCCCTAGACTTCCCTA |
| 3938 | CATCCTCCCTAGACTTCCCTAT |
| 3939 | ATCCTCCCTAGACTTCCCTATT |
| 3940 | TCCTCCCTAGACTTCCCTATTT |
| 3941 | CCTCCCTAGACTTCCCTATTTC |

| ID | SEQUENCE |
|---|---|
| 3942 | CCTCCCTAGACTTCCCTATTTCG |
| 3943 | CTCCCTAGACTTCCCTATTTCGC |
| 3944 | TCCCTAGACTTCCCTATTTCGCT |
| 3945 | CCCTAGACTTCCCTATTTCGCTT |
| 3946 | CCTAGACTTCCCTATTTCGCTTT |
| 3947 | CTAGACTTCCCTATTTCGCTTTC |
| 3948 | TAGACTTCCCTATTTCGCTTTCT |
| 3949 | AGACTTCCCTATTTCGCTTTCTC |
| 3950 | GACTTCCCTATTTCGCTTTCTCC |
| 3951 | ACTTCCCTATTTCGCTTTCTCCT |
| 3952 | CTTCCCTATTTCGCTTTCTCCTC |
| 3953 | TTCCCTATTTCGCTTTCTCCTCG |
| 3954 | TCCCTATTTCGCTTTCTCCTCGG |
| 3955 | CCCTATTTCGCTTTCTCCTCGGC |
| 3956 | CCTATTTCGCTTTCTCCTCGGCT |
| 3957 | CTATTTCGCTTTCTCCTCGGCTC |
| 3958 | TATTTCGCTTTCTCCTCGGCTCA |
| 3959 | ATTTCGCTTTCTCCTCGGCTCAC |
| 3960 | TTTCGCTTTCTCCTCGGCTCACT |
| 3961 | TTCGCTTTCTCCTCGGCTCACTT |
| 3962 | TCGCTTTCTCCTCGGCTCACTTT |
| 3963 | CGCTTTCTCCTCGGCTCACTTTC |
| 3964 | GCTTTCTCCTCGGCTCACTTTCT |
| 3965 | CTTTCTCCTCGGCTCACTTTCTC |
| 3966 | TTTCTCCTCGGCTCACTTTCTCC |
| 3967 | TTCTCCTCGGCTCACTTTCTCCC |
| 3968 | TCTCCTCGGCTCACTTTCTCCCT |
| 3969 | CTCCTCGGCTCACTTTCTCCCTT |
| 3970 | TCCTCGGCTCACTTTCTCCCTTT |
| 3971 | CCTCGGCTCACTTTCTCCCTTTT |
| 3972 | CTCGGCTCACTTTCTCCCTTTTT |
| 3973 | TCGGCTCACTTTCTCCCTTTTTA |
| 3974 | CGGCTCACTTTCTCCCTTTTTAT |
| 3975 | GGCTCACTTTCTCCCTTTTTATT |
| 3976 | GCTCACTTTCTCCCTTTTTATTT |
| 3977 | CTCACTTTCTCCCTTTTTATTTT |
| 3978 | TCACTTTCTCCCTTTTTATTTTT |
| 3979 | CACTTTCTCCCTTTTTATTTTTC |
| 3980 | ACTTTCTCCCTTTTTATTTTTCA |
| 3981 | CTTTCTCCCTTTTTATTTTTCAC |
| 3982 | TTTCTCCCTTTTTATTTTTCACC |
| 3983 | TTCTCCCTTTTTATTTTTCACCA |
| 3984 | TCTCCCTTTTTATTTTTCACCAA |
| 3985 | CTCCCTTTTTATTTTTCACCAAA |
| 3986 | TCCCTTTTTATTTTTCACCAAAC |
| 3987 | CCCTTTTTATTTTTCACCAAACC |
| 3988 | CCTTTTTATTTTTCACCAAACCA |
| 3989 | CTTTTTATTTTTCACCAAACCAT |
| 3990 | TTTTTATTTTTCACCAAACCATT |
| 3991 | TTTTATTTTTCACCAAACCATTT |
| 3992 | TTTATTTTTCACCAAACCATTTG |
| 3993 | TTATTTTTCACCAAACCATTTGT |
| 3994 | TATTTTTCACCAAACCATTTGTA |
| 3995 | ATTTTTCACCAAACCATTTGTAG |
| 3996 | TTTTTCACCAAACCATTTGTAGA |
| 3997 | TTTTCACCAAACCATTTGTAGAG |
| 3998 | TTTCACCAAACCATTTGTAGAGC |
| 3999 | TTCACCAAACCATTTGTAGAGCT |

| ID | SEQUENCE |
|---|---|
| 4000 | TCACCAAACCATTTGTAGAGCTA |
| 4001 | CACCAAACCATTTGTAGAGCTAC |
| 4002 | ACCAAACCATTTGTAGAGCTACA |
| 4003 | CCAAACCATTTGTAGAGCTACAA |
| 4004 | CAAACCATTTGTAGAGCTACAAA |
| 4005 | AAACCATTTGTAGAGCTACAAAA |
| 4006 | AACCATTTGTAGAGCTACAAAAC |
| 4007 | ACCATTTGTAGAGCTACAAAACC |
| 4008 | CCATTTGTAGAGCTACAAAACCT |
| 4009 | CATTTGTAGAGCTACAAAACCTA |
| 4010 | ATTTGTAGAGCTACAAAACCTAT |
| 4011 | TTTGTAGAGCTACAAAACCTATC |
| 4012 | TTGTAGAGCTACAAAACCTATCC |
| 4013 | TGTAGAGCTACAAAACCTATCCT |
| 4014 | GTAGAGCTACAAAACCTATCCTT |
| 4015 | TAGAGCTACAAAACCTATCCTTT |
| 4016 | AGAGCTACAAAACCTATCCTTTC |
| 4017 | GAGCTACAAAACCTATCCTTTCT |
| 4018 | AGCTACAAAACCTATCCTTTCTT |
| 4019 | GCTACAAAACCTATCCTTTCTTA |
| 4020 | CTACAAAACCTATCCTTTCTTAT |
| 4021 | TACAAAACCTATCCTTTCTTATT |
| 4022 | ACAAAACCTATCCTTTCTTATTT |
| 4023 | CAAAACCTATCCTTTCTTATTTT |
| 4024 | AAAACCTATCCTTTCTTATTTTC |
| 4025 | AAACCTATCCTTTCTTATTTTCA |
| 4026 | AACCTATCCTTTCTTATTTTCAG |
| 4027 | ACCTATCCTTTCTTATTTTCAGT |
| 4028 | CCTATCCTTTCTTATTTTCAGTA |
| 4029 | CTATCCTTTCTTATTTTCAGTAG |
| 4030 | TATCCTTTCTTATTTTCAGTAGT |
| 4031 | ATCCTTTCTTATTTTCAGTAGTC |
| 4032 | TCCTTTCTTATTTTCAGTAGTCA |
| 4033 | CCTTTCTTATTTTCAGTAGTCAG |
| 4034 | CTTTCTTATTTTCAGTAGTCAGA |
| 4035 | TTTCTTATTTTCAGTAGTCAGAA |
| 4036 | TTCTTATTTTCAGTAGTCAGAAT |
| 4037 | TCTTATTTTCAGTAGTCAGAATT |
| 4038 | CTTATTTTCAGTAGTCAGAATTT |
| 4039 | TTATTTTCAGTAGTCAGAATTTT |
| 4040 | TATTTTCAGTAGTCAGAATTTTA |
| 4041 | ATTTTCAGTAGTCAGAATTTTAT |
| 4042 | TTTTCAGTAGTCAGAATTTTATC |
| 4043 | TTTCAGTAGTCAGAATTTTATCT |
| 4044 | TTCAGTAGTCAGAATTTTATCTA |
| 4045 | TCAGTAGTCAGAATTTTATCTAG |
| 4046 | CAGTAGTCAGAATTTTATCTAGA |
| 4047 | AGTAGTCAGAATTTTATCTAGAA |
| 4048 | GTAGTCAGAATTTTATCTAGAAA |
| 4049 | TAGTCAGAATTTTATCTAGAAAT |
| 4050 | AGTCAGAATTTTATCTAGAAATC |
| 4051 | GTCAGAATTTTATCTAGAAATCT |
| 4052 | TCAGAATTTTATCTAGAAATCTT |
| 4053 | CAGAATTTTATCTAGAAATCTTT |
| 4054 | AGAATTTTATCTAGAAATCTTTT |
| 4055 | GAATTTTATCTAGAAATCTTTTA |
| 4056 | AATTTTATCTAGAAATCTTTTAA |
| 4057 | ATTTTATCTAGAAATCTTTTAAC |

| ID | SEQUENCE |
|---|---|
| 4058 | TTTTATCTAGAAATCTTTTAACA |
| 4059 | TTTATCTAGAAATCTTTTAACAC |
| 4060 | TTATCTAGAAATCTTTTAACACC |
| 4061 | TATCTAGAAATCTTTTAACACCT |
| 4062 | ATCTAGAAATCTTTTAACACCTT |
| 4063 | TCTAGAAATCTTTTAACACCTTT |
| 4064 | CTAGAAATCTTTTAACACCTTTT |
| 4065 | TAGAAATCTTTTAACACCTTTTT |
| 4066 | AGAAATCTTTTAACACCTTTTTA |
| 4067 | GAAATCTTTTAACACCTTTTTAG |
| 4068 | AAATCTTTTAACACCTTTTTAGT |
| 4069 | AATCTTTTAACACCTTTTTAGTG |
| 4070 | ATCTTTTAACACCTTTTTAGTGG |
| 4071 | TCTTTTAACACCTTTTTAGTGGT |
| 4072 | CTTTTAACACCTTTTTAGTGGTT |
| 4073 | TTTTAACACCTTTTTAGTGGTTA |
| 4074 | TTTAACACCTTTTTAGTGGTTAT |
| 4075 | TTAACACCTTTTTAGTGGTTATT |
| 4076 | TAACACCTTTTTAGTGGTTATTT |
| 4077 | AACACCTTTTTAGTGGTTATTTC |
| 4078 | ACACCTTTTTAGTGGTTATTTCT |
| 4079 | CACCTTTTTAGTGGTTATTTCTA |
| 4080 | ACCTTTTTAGTGGTTATTTCTAA |
| 4081 | CCTTTTTAGTGGTTATTTCTAAA |
| 4082 | CTTTTTAGTGGTTATTTCTAAAA |
| 4083 | TTTTTAGTGGTTATTTCTAAAAT |
| 4084 | TTTTAGTGGTTATTTCTAAAATC |
| 4085 | TTTAGTGGTTATTTCTAAAATCA |
| 4086 | TTAGTGGTTATTTCTAAAATCAC |
| 4087 | TAGTGGTTATTTCTAAAATCACT |
| 4088 | AGTGGTTATTTCTAAAATCACTG |
| 4089 | GTGGTTATTTCTAAAATCACTGT |
| 4090 | TGGTTATTTCTAAAATCACTGTC |
| 4091 | GGTTATTTCTAAAATCACTGTCA |
| 4092 | GTTATTTCTAAAATCACTGTCAA |
| 4093 | TTATTTCTAAAATCACTGTCAAC |
| 4094 | TATTTCTAAAATCACTGTCAACA |
| 4095 | ATTTCTAAAATCACTGTCAACAA |
| 4096 | TTTCTAAAATCACTGTCAACAAT |
| 4097 | TTCTAAAATCACTGTCAACAATA |
| 4098 | TCTAAAATCACTGTCAACAATAA |
| 4099 | CTAAAATCACTGTCAACAATAAA |
| 4100 | TAAAATCACTGTCAACAATAAAT |
| 4101 | AAAATCACTGTCAACAATAAATC |
| 4102 | AAATCACTGTCAACAATAAATCT |
| 4103 | AATCACTGTCAACAATAAATCTA |
| 4104 | ATCACTGTCAACAATAAATCTAA |
| 4105 | TCACTGTCAACAATAAATCTAAC |
| 4106 | CACTGTCAACAATAAATCTAACC |
| 4107 | ACTGTCAACAATAAATCTAACCC |
| 4108 | CTGTCAACAATAAATCTAACCCT |
| 4109 | TGTCAACAATAAATCTAACCCTA |
| 4110 | GTCAACAATAAATCTAACCCTAG |
| 4111 | TCAACAATAAATCTAACCCTAGT |
| 4112 | CAACAATAAATCTAACCCTAGTT |
| 4113 | AACAATAAATCTAACCCTAGTTG |
| 4114 | ACAATAAATCTAACCCTAGTTGT |
| 4115 | CAATAAATCTAACCCTAGTTGTA |

| ID | SEQUENCE |
|---|---|
| 4116 | AATAAATCTAACCCTAGTTGTAT |
| 4117 | ATAAATCTAACCCTAGTTGTATC |
| 4118 | TAAATCTAACCCTAGTTGTATCC |
| 4119 | AAATCTAACCCTAGTTGTATCCC |
| 4120 | AATCTAACCCTAGTTGTATCCCT |
| 4121 | ATCTAACCCTAGTTGTATCCCTC |
| 4122 | TCTAACCCTAGTTGTATCCCTCC |
| 4123 | CTAACCCTAGTTGTATCCCTCCT |
| 4124 | TAACCCTAGTTGTATCCCTCCTT |
| 4125 | AACCCTAGTTGTATCCCTCCTTT |
| 4126 | ACCCTAGTTGTATCCCTCCTTTA |
| 4127 | CCCTAGTTGTATCCCTCCTTTAA |
| 4128 | CCTAGTTGTATCCCTCCTTTAAG |
| 4129 | CTAGTTGTATCCCTCCTTTAAGT |
| 4130 | TAGTTGTATCCCTCCTTTAAGTA |
| 4131 | AGTTGTATCCCTCCTTTAAGTAT |
| 4132 | GTTGTATCCCTCCTTTAAGTATT |
| 4133 | TTGTATCCCTCCTTTAAGTATTT |
| 4134 | TGTATCCCTCCTTTAAGTATTTA |
| 4135 | GTATCCCTCCTTTAAGTATTTAA |
| 4136 | TATCCCTCCTTTAAGTATTTAAA |
| 4137 | ATCCCTCCTTTAAGTATTTAAAA |
| 4138 | TCCCTCCTTTAAGTATTTAAAAC |
| 4139 | CCCTCCTTTAAGTATTTAAAACT |
| 4140 | CCTCCTTTAAGTATTTAAAACTT |
| 4141 | CTCCTTTAAGTATTTAAAACTTG |
| 4142 | TCCTTTAAGTATTTAAAACTTGT |
| 4143 | CCTTTAAGTATTTAAAACTTGTT |
| 4144 | CTTTAAGTATTTAAAACTTGTTG |
| 4145 | TTTAAGTATTTAAAACTTGTTGC |
| 4146 | TTAAGTATTTAAAACTTGTTGCC |
| 4147 | TAAGTATTTAAAACTTGTTGCCC |
| 4148 | AAGTATTTAAAACTTGTTGCCCC |
| 4149 | AGTATTTAAAACTTGTTGCCCCA |
| 4150 | GTATTTAAAACTTGTTGCCCCAA |
| 4151 | TATTTAAAACTTGTTGCCCCAAA |
| 4152 | ATTTAAAACTTGTTGCCCCAAAT |
| 4153 | TTTAAAACTTGTTGCCCCAAATG |
| 4154 | TTAAAACTTGTTGCCCCAAATGT |
| 4155 | TAAAACTTGTTGCCCCAAATGTG |
| 4156 | AAAACTTGTTGCCCCAAATGTGA |
| 4157 | AAACTTGTTGCCCCAAATGTGAA |
| 4158 | AACTTGTTGCCCCAAATGTGAAA |
| 4159 | ACTTGTTGCCCCAAATGTGAAAG |
| 4160 | CTTGTTGCCCCAAATGTGAAAGC |
| 4161 | TTGTTGCCCCAAATGTGAAAGCA |
| 4162 | TGTTGCCCCAAATGTGAAAGCAT |
| 4163 | GTTGCCCCAAATGTGAAAGCATT |
| 4164 | TTGCCCCAAATGTGAAAGCATTT |
| 4165 | TGCCCCAAATGTGAAAGCATTTA |
| 4166 | GCCCCAAATGTGAAAGCATTTAA |
| 4167 | CCCCAAATGTGAAAGCATTTAAT |
| 4168 | CCCAAATGTGAAAGCATTTAATT |
| 4169 | CCAAATGTGAAAGCATTTAATTC |
| 4170 | CAAATGTGAAAGCATTTAATTCC |
| 4171 | AAATGTGAAAGCATTTAATTCCT |
| 4172 | AATGTGAAAGCATTTAATTCCTT |
| 4173 | ATGTGAAAGCATTTAATTCCTTT |

| ID | SEQUENCE |
|---|---|
| 4174 | TGTGAAAGCATTTAATTCCTTTA |
| 4175 | GTGAAAGCATTTAATTCCTTTAA |
| 4176 | TGAAAGCATTTAATTCCTTTAAG |
| 4177 | GAAAGCATTTAATTCCTTTAAGA |
| 4178 | AAAGCATTTAATTCCTTTAAGAG |
| 4179 | AAGCATTTAATTCCTTTAAGAGG |
| 4180 | AGCATTTAATTCCTTTAAGAGGC |
| 4181 | GCATTTAATTCCTTTAAGAGGCC |
| 4182 | CATTTAATTCCTTTAAGAGGCCT |
| 4183 | ATTTAATTCCTTTAAGAGGCCTA |
| 4184 | TTTAATTCCTTTAAGAGGCCTAA |
| 4185 | TTAATTCCTTTAAGAGGCCTAAC |
| 4186 | TAATTCCTTTAAGAGGCCTAACT |
| 4187 | AATTCCTTTAAGAGGCCTAACTC |
| 4188 | ATTCCTTTAAGAGGCCTAACTCA |
| 4189 | TTCCTTTAAGAGGCCTAACTCAT |
| 4190 | TCCTTTAAGAGGCCTAACTCATT |
| 4191 | CCTTTAAGAGGCCTAACTCATTC |
| 4192 | CTTTAAGAGGCCTAACTCATTCA |
| 4193 | TTTAAGAGGCCTAACTCATTCAC |
| 4194 | TTAAGAGGCCTAACTCATTCACC |
| 4195 | TAAGAGGCCTAACTCATTCACCC |
| 4196 | AAGAGGCCTAACTCATTCACCCT |
| 4197 | AGAGGCCTAACTCATTCACCCTG |
| 4198 | GAGGCCTAACTCATTCACCCTGA |
| 4199 | AGGCCTAACTCATTCACCCTGAC |
| 4200 | GGCCTAACTCATTCACCCTGACA |
| 4201 | GCCTAACTCATTCACCCTGACAG |
| 4202 | CCTAACTCATTCACCCTGACAGA |
| 4203 | CTAACTCATTCACCCTGACAGAG |
| 4204 | TAACTCATTCACCCTGACAGAGT |
| 4205 | AACTCATTCACCCTGACAGAGTT |
| 4206 | ACTCATTCACCCTGACAGAGTTC |
| 4207 | CTCATTCACCCTGACAGAGTTCA |
| 4208 | TCATTCACCCTGACAGAGTTCAC |
| 4209 | CATTCACCCTGACAGAGTTCACA |
| 4210 | ATTCACCCTGACAGAGTTCACAA |
| 4211 | TTCACCCTGACAGAGTTCACAAA |
| 4212 | TCACCCTGACAGAGTTCACAAAA |
| 4213 | CACCCTGACAGAGTTCACAAAAA |
| 4214 | ACCCTGACAGAGTTCACAAAAAG |
| 4215 | CCCTGACAGAGTTCACAAAAAGC |
| 4216 | CCTGACAGAGTTCACAAAAAGCC |
| 4217 | CTGACAGAGTTCACAAAAAGCCC |
| 4218 | TGACAGAGTTCACAAAAAGCCCA |
| 4219 | GACAGAGTTCACAAAAAGCCCAC |
| 4220 | ACAGAGTTCACAAAAAGCCCACT |
| 4221 | CAGAGTTCACAAAAAGCCCACTT |
| 4222 | AGAGTTCACAAAAAGCCCACTTT |
| 4223 | GAGTTCACAAAAAGCCCACTTTA |
| 4224 | AGTTCACAAAAAGCCCACTTTAG |
| 4225 | GTTCACAAAAAGCCCACTTTAGA |
| 4226 | TTCACAAAAAGCCCACTTTAGAG |
| 4227 | TCACAAAAAGCCCACTTTAGAGT |
| 4228 | CACAAAAAGCCCACTTTAGAGTA |
| 4229 | ACAAAAAGCCCACTTTAGAGTAT |
| 4230 | CAAAAAGCCCACTTTAGAGTATA |
| 4231 | AAAAAGCCCACTTTAGAGTATAC |

| ID | SEQUENCE |
|---|---|
| 4232 | AAAAGCCCACTTTAGAGTATACA |
| 4233 | AAAGCCCACTTTAGAGTATACAT |
| 4234 | AAGCCCACTTTAGAGTATACATT |
| 4235 | AGCCCACTTTAGAGTATACATTG |
| 4236 | GCCCACTTTAGAGTATACATTGC |
| 4237 | CCCACTTTAGAGTATACATTGCT |
| 4238 | CCACTTTAGAGTATACATTGCTA |
| 4239 | CACTTTAGAGTATACATTGCTAT |
| 4240 | ACTTTAGAGTATACATTGCTATT |
| 4241 | CTTTAGAGTATACATTGCTATTA |
| 4242 | TTTAGAGTATACATTGCTATTAT |
| 4243 | TTAGAGTATACATTGCTATTATG |
| 4244 | TAGAGTATACATTGCTATTATGG |
| 4245 | AGAGTATACATTGCTATTATGGG |
| 4246 | GAGTATACATTGCTATTATGGGA |
| 4247 | AGTATACATTGCTATTATGGGAG |
| 4248 | GTATACATTGCTATTATGGGAGA |
| 4249 | TATACATTGCTATTATGGGAGAC |
| 4250 | ATACATTGCTATTATGGGAGACC |
| 4251 | TACATTGCTATTATGGGAGACCA |
| 4252 | ACATTGCTATTATGGGAGACCAC |
| 4253 | CATTGCTATTATGGGAGACCACC |
| 4254 | ATTGCTATTATGGGAGACCACCC |
| 4255 | TTGCTATTATGGGAGACCACCCA |
| 4256 | TGCTATTATGGGAGACCACCCAG |
| 4257 | GCTATTATGGGAGACCACCCAGA |
| 4258 | CTATTATGGGAGACCACCCAGAC |
| 4259 | TATTATGGGAGACCACCCAGACA |
| 4260 | ATTATGGGAGACCACCCAGACAT |
| 4261 | TTATGGGAGACCACCCAGACATC |
| 4262 | TATGGGAGACCACCCAGACATCT |
| 4263 | ATGGGAGACCACCCAGACATCTG |
| 4264 | TGGGAGACCACCCAGACATCTGA |
| 4265 | GGGAGACCACCCAGACATCTGAC |
| 4266 | GGAGACCACCCAGACATCTGACT |
| 4267 | GAGACCACCCAGACATCTGACTA |
| 4268 | AGACCACCCAGACATCTGACTAA |
| 4269 | GACCACCCAGACATCTGACTAAT |
| 4270 | ACCACCCAGACATCTGACTAATG |
| 4271 | CCACCCAGACATCTGACTAATGG |
| 4272 | CACCCAGACATCTGACTAATGGC |
| 4273 | ACCCAGACATCTGACTAATGGCT |
| 4274 | CCCAGACATCTGACTAATGGCTC |
| 4275 | CCAGACATCTGACTAATGGCTCT |
| 4276 | CAGACATCTGACTAATGGCTCTG |
| 4277 | AGACATCTGACTAATGGCTCTGT |
| 4278 | GACATCTGACTAATGGCTCTGTG |
| 4279 | ACATCTGACTAATGGCTCTGTGC |
| 4280 | CATCTGACTAATGGCTCTGTGCC |
| 4281 | ATCTGACTAATGGCTCTGTGCCA |
| 4282 | TCTGACTAATGGCTCTGTGCCAC |
| 4283 | CTGACTAATGGCTCTGTGCCACA |
| 4284 | TGACTAATGGCTCTGTGCCACAC |
| 4285 | GACTAATGGCTCTGTGCCACACT |
| 4286 | ACTAATGGCTCTGTGCCACACTC |
| 4287 | CTAATGGCTCTGTGCCACACTCC |
| 4288 | TAATGGCTCTGTGCCACACTCCA |
| 4289 | AATGGCTCTGTGCCACACTCCAA |

| ID | SEQUENCE |
|---|---|
| 4290 | ATGGCTCTGTGCCACACTCCAAG |
| 4291 | TGGCTCTGTGCCACACTCCAAGA |
| 4292 | GGCTCTGTGCCACACTCCAAGAC |
| 4293 | GCTCTGTGCCACACTCCAAGACC |
| 4294 | CTCTGTGCCACACTCCAAGACCT |
| 4295 | TCTGTGCCACACTCCAAGACCTG |
| 4296 | CTGTGCCACACTCCAAGACCTGT |
| 4297 | TGTGCCACACTCCAAGACCTGTG |
| 4298 | GTGCCACACTCCAAGACCTGTGC |
| 4299 | TGCCACACTCCAAGACCTGTGCC |
| 4300 | GCCACACTCCAAGACCTGTGCCT |
| 4301 | CCACACTCCAAGACCTGTGCCTT |
| 4302 | CACACTCCAAGACCTGTGCCTTT |
| 4303 | ACACTCCAAGACCTGTGCCTTTT |
| 4304 | CACTCCAAGACCTGTGCCTTTTA |
| 4305 | ACTCCAAGACCTGTGCCTTTTAG |
| 4306 | CTCCAAGACCTGTGCCTTTTAGA |
| 4307 | TCCAAGACCTGTGCCTTTTAGAG |
| 4308 | CCAAGACCTGTGCCTTTTAGAGA |
| 4309 | CAAGACCTGTGCCTTTTAGAGAA |
| 4310 | AAGACCTGTGCCTTTTAGAGAAG |
| 4311 | AGACCTGTGCCTTTTAGAGAAGC |
| 4312 | GACCTGTGCCTTTTAGAGAAGCT |
| 4313 | ACCTGTGCCTTTTAGAGAAGCTC |
| 4314 | CCTGTGCCTTTTAGAGAAGCTCA |
| 4315 | CTGTGCCTTTTAGAGAAGCTCAC |
| 4316 | TGTGCCTTTTAGAGAAGCTCACA |
| 4317 | GTGCCTTTTAGAGAAGCTCACAA |
| 4318 | TGCCTTTTAGAGAAGCTCACAAT |
| 4319 | GCCTTTTAGAGAAGCTCACAATG |
| 4320 | CCTTTTAGAGAAGCTCACAATGA |
| 4321 | CTTTTAGAGAAGCTCACAATGAT |
| 4322 | TTTTAGAGAAGCTCACAATGATT |
| 4323 | TTTAGAGAAGCTCACAATGATTT |
| 4324 | TTAGAGAAGCTCACAATGATTTA |
| 4325 | TAGAGAAGCTCACAATGATTTAA |
| 4326 | AGAGAAGCTCACAATGATTTAAG |
| 4327 | GAGAAGCTCACAATGATTTAAGG |
| 4328 | AGAAGCTCACAATGATTTAAGGA |
| 4329 | GAAGCTCACAATGATTTAAGGAC |
| 4330 | AAGCTCACAATGATTTAAGGACT |
| 4331 | AGCTCACAATGATTTAAGGACTG |
| 4332 | GCTCACAATGATTTAAGGACTGT |
| 4333 | CTCACAATGATTTAAGGACTGTT |
| 4334 | TCACAATGATTTAAGGACTGTTT |
| 4335 | CACAATGATTTAAGGACTGTTTG |
| 4336 | ACAATGATTTAAGGACTGTTTGA |
| 4337 | CAATGATTTAAGGACTGTTTGAA |
| 4338 | AATGATTTAAGGACTGTTTGAAA |
| 4339 | ATGATTTAAGGACTGTTTGAAAC |
| 4340 | TGATTTAAGGACTGTTTGAAACT |
| 4341 | GATTTAAGGACTGTTTGAAACTT |
| 4342 | ATTTAAGGACTGTTTGAAACTTC |
| 4343 | TTTAAGGACTGTTTGAAACTTCC |
| 4344 | TTAAGGACTGTTTGAAACTTCCA |
| 4345 | TAAGGACTGTTTGAAACTTCCAA |
| 4346 | AAGGACTGTTTGAAACTTCCAAT |
| 4347 | AGGACTGTTTGAAACTTCCAATT |

| ID | SEQUENCE |
|---|---|
| 4348 | GGACTGTTTGAAACTTCCAATTA |
| 4349 | GACTGTTTGAAACTTCCAATTAT |
| 4350 | ACTGTTTGAAACTTCCAATTATG |
| 4351 | CTGTTTGAAACTTCCAATTATGT |
| 4352 | TGTTTGAAACTTCCAATTATGTC |
| 4353 | GTTTGAAACTTCCAATTATGTCT |
| 4354 | TTTGAAACTTCCAATTATGTCTA |
| 4355 | TTGAAACTTCCAATTATGTCTAT |
| 4356 | TGAAACTTCCAATTATGTCTATA |
| 4357 | GAAACTTCCAATTATGTCTATAA |
| 4358 | AAACTTCCAATTATGTCTATAAT |
| 4359 | AACTTCCAATTATGTCTATAATT |
| 4360 | ACTTCCAATTATGTCTATAATTT |
| 4361 | CTTCCAATTATGTCTATAATTTA |
| 4362 | TTCCAATTATGTCTATAATTTAT |
| 4363 | TCCAATTATGTCTATAATTTATA |
| 4364 | CCAATTATGTCTATAATTTATAT |
| 4365 | CAATTATGTCTATAATTTATATT |
| 4366 | AATTATGTCTATAATTTATATTC |
| 4367 | ATTATGTCTATAATTTATATTCT |
| 4368 | TTATGTCTATAATTTATATTCTT |
| 4369 | TATGTCTATAATTTATATTCTTT |
| 4370 | ATGTCTATAATTTATATTCTTTT |
| 4371 | TGTCTATAATTTATATTCTTTTG |
| 4372 | GTCTATAATTTATATTCTTTTGT |
| 4373 | TCTATAATTTATATTCTTTTGTT |
| 4374 | CTATAATTTATATTCTTTTGTTT |
| 4375 | TATAATTTATATTCTTTTGTTTA |
| 4376 | ATAATTTATATTCTTTTGTTTAC |
| 4377 | TAATTTATATTCTTTTGTTTACA |
| 4378 | AATTTATATTCTTTTGTTTACAT |
| 4379 | ATTTATATTCTTTTGTTTACATG |
| 4380 | TTTATATTCTTTTGTTTACATGA |
| 4381 | TTATATTCTTTTGTTTACATGAT |
| 4382 | TATATTCTTTTGTTTACATGATG |
| 4383 | ATATTCTTTTGTTTACATGATGA |
| 4384 | TATTCTTTTGTTTACATGATGAA |
| 4385 | ATTCTTTTGTTTACATGATGAAA |
| 4386 | TTCTTTTGTTTACATGATGAAAC |
| 4387 | TCTTTTGTTTACATGATGAAACT |
| 4388 | CTTTTGTTTACATGATGAAACTT |
| 4389 | TTTTGTTTACATGATGAAACTTT |
| 4390 | TTTGTTTACATGATGAAACTTTT |
| 4391 | TTGTTTACATGATGAAACTTTTT |
| 4392 | TGTTTACATGATGAAACTTTTTG |
| 4393 | GTTTACATGATGAAACTTTTTGT |
| 4394 | TTTACATGATGAAACTTTTTGTT |
| 4395 | TTACATGATGAAACTTTTTGTTG |
| 4396 | TACATGATGAAACTTTTTGTTGT |
| 4397 | ACATGATGAAACTTTTTGTTGTT |
| 4398 | CATGATGAAACTTTTTGTTGTTG |
| 4399 | ATGATGAAACTTTTTGTTGTTGC |
| 4400 | TGATGAAACTTTTTGTTGTTGCT |
| 4401 | GATGAAACTTTTTGTTGTTGCTT |
| 4402 | ATGAAACTTTTTGTTGTTGCTTG |
| 4403 | TGAAACTTTTTGTTGTTGCTTGT |
| 4404 | GAAACTTTTTGTTGTTGCTTGTT |
| 4405 | AAACTTTTTGTTGTTGCTTGTTT |

| ID | SEQUENCE |
|---|---|
| 4406 | AACTTTTTGTTGTTGCTTGTTTG |
| 4407 | ACTTTTTGTTGTTGCTTGTTTGT |
| 4408 | CTTTTTGTTGTTGCTTGTTTGTA |
| 4409 | TTTTTGTTGTTGCTTGTTTGTAT |
| 4410 | TTTTGTTGTTGCTTGTTTGTATA |
| 4411 | TTTGTTGTTGCTTGTTTGTATAT |
| 4412 | TTGTTGTTGCTTGTTTGTATATA |
| 4413 | TGTTGTTGCTTGTTTGTATATAA |
| 4414 | GTTGTTGCTTGTTTGTATATAAT |
| 4415 | TTGTTGCTTGTTTGTATATAATA |
| 4416 | TGTTGCTTGTTTGTATATAATAC |
| 4417 | GTTGCTTGTTTGTATATAATACA |
| 4418 | TTGCTTGTTTGTATATAATACAA |
| 4419 | TGCTTGTTTGTATATAATACAAT |
| 4420 | GCTTGTTTGTATATAATACAATG |
| 4421 | CTTGTTTGTATATAATACAATGT |
| 4422 | TTGTTTGTATATAATACAATGTG |
| 4423 | TGTTTGTATATAATACAATGTGT |
| 4424 | GTTTGTATATAATACAATGTGTA |
| 4425 | TTTGTATATAATACAATGTGTAC |
| 4426 | TTGTATATAATACAATGTGTACA |
| 4427 | TGTATATAATACAATGTGTACAT |
| 4428 | GTATATAATACAATGTGTACATG |
| 4429 | TATATAATACAATGTGTACATGT |
| 4430 | ATATAATACAATGTGTACATGTA |
| 4431 | TATAATACAATGTGTACATGTAT |
| 4432 | ATAATACAATGTGTACATGTATC |
| 4433 | TAATACAATGTGTACATGTATCT |
| 4434 | AATACAATGTGTACATGTATCTT |
| 4435 | ATACAATGTGTACATGTATCTTT |
| 4436 | TACAATGTGTACATGTATCTTTT |
| 4437 | ACAATGTGTACATGTATCTTTTT |
| 4438 | CAATGTGTACATGTATCTTTTTC |
| 4439 | AATGTGTACATGTATCTTTTTCT |
| 4440 | ATGTGTACATGTATCTTTTTCTC |
| 4441 | TGTGTACATGTATCTTTTTCTCG |
| 4442 | GTGTACATGTATCTTTTTCTCGA |
| 4443 | TGTACATGTATCTTTTTCTCGAT |
| 4444 | GTACATGTATCTTTTTCTCGATT |
| 4445 | TACATGTATCTTTTTCTCGATTC |
| 4446 | ACATGTATCTTTTTCTCGATTCA |
| 4447 | CATGTATCTTTTTCTCGATTCAA |
| 4448 | ATGTATCTTTTTCTCGATTCAAA |
| 4449 | TGTATCTTTTTCTCGATTCAAAT |
| 4450 | GTATCTTTTTCTCGATTCAAATC |
| 4451 | TATCTTTTTCTCGATTCAAATCT |
| 4452 | ATCTTTTTCTCGATTCAAATCTT |
| 4453 | TCTTTTTCTCGATTCAAATCTTA |
| 4454 | CTTTTTCTCGATTCAAATCTTAA |
| 4455 | TTTTTCTCGATTCAAATCTTAAC |
| 4456 | TTTTCTCGATTCAAATCTTAACC |
| 4457 | TTTCTCGATTCAAATCTTAACCC |
| 4458 | TTCTCGATTCAAATCTTAACCCT |
| 4459 | TCTCGATTCAAATCTTAACCCTT |
| 4460 | CTCGATTCAAATCTTAACCCTTA |
| 4461 | TCGATTCAAATCTTAACCCTTAG |
| 4462 | CGATTCAAATCTTAACCCTTAGG |
| 4463 | GATTCAAATCTTAACCCTTAGGA |

| ID | SEQUENCE |
|---|---|
| 4464 | ATTCAAATCTTAACCCTTAGGAC |
| 4465 | TTCAAATCTTAACCCTTAGGACT |
| 4466 | TCAAATCTTAACCCTTAGGACTC |
| 4467 | CAAATCTTAACCCTTAGGACTCT |
| 4468 | AAATCTTAACCCTTAGGACTCTG |
| 4469 | AATCTTAACCCTTAGGACTCTGG |
| 4470 | ATCTTAACCCTTAGGACTCTGGT |
| 4471 | TCTTAACCCTTAGGACTCTGGTA |
| 4472 | CTTAACCCTTAGGACTCTGGTAT |
| 4473 | TTAACCCTTAGGACTCTGGTATT |
| 4474 | TAACCCTTAGGACTCTGGTATTT |
| 4475 | AACCCTTAGGACTCTGGTATTTT |
| 4476 | ACCCTTAGGACTCTGGTATTTTT |
| 4477 | CCCTTAGGACTCTGGTATTTTTG |
| 4478 | CCTTAGGACTCTGGTATTTTTGA |
| 4479 | CTTAGGACTCTGGTATTTTTGAT |
| 4480 | TTAGGACTCTGGTATTTTTGATC |
| 4481 | TAGGACTCTGGTATTTTTGATCT |
| 4482 | AGGACTCTGGTATTTTTGATCTG |
| 4483 | GGACTCTGGTATTTTTGATCTGG |
| 4484 | GACTCTGGTATTTTTGATCTGGC |
| 4485 | ACTCTGGTATTTTTGATCTGGCA |
| 4486 | CTCTGGTATTTTTGATCTGGCAA |
| 4487 | TCTGGTATTTTTGATCTGGCAAC |
| 4488 | CTGGTATTTTTGATCTGGCAACC |
| 4489 | TGGTATTTTTGATCTGGCAACCA |
| 4490 | GGTATTTTTGATCTGGCAACCAT |
| 4491 | GTATTTTTGATCTGGCAACCATA |
| 4492 | TATTTTTGATCTGGCAACCATAT |
| 4493 | ATTTTTGATCTGGCAACCATATT |
| 4494 | TTTTTGATCTGGCAACCATATTT |
| 4495 | TTTTGATCTGGCAACCATATTTC |
| 4496 | TTTGATCTGGCAACCATATTTCT |
| 4497 | TTGATCTGGCAACCATATTTCTG |
| 4498 | TGATCTGGCAACCATATTTCTGG |
| 4499 | GATCTGGCAACCATATTTCTGGA |
| 4500 | ATCTGGCAACCATATTTCTGGAA |
| 4501 | TCTGGCAACCATATTTCTGGAAG |
| 4502 | CTGGCAACCATATTTCTGGAAGT |
| 4503 | TGGCAACCATATTTCTGGAAGTT |
| 4504 | GGCAACCATATTTCTGGAAGTTG |
| 4505 | GCAACCATATTTCTGGAAGTTGA |
| 4506 | CAACCATATTTCTGGAAGTTGAG |
| 4507 | AACCATATTTCTGGAAGTTGAGA |
| 4508 | ACCATATTTCTGGAAGTTGAGAT |
| 4509 | CCATATTTCTGGAAGTTGAGATG |
| 4510 | CATATTTCTGGAAGTTGAGATGT |
| 4511 | ATATTTCTGGAAGTTGAGATGTT |
| 4512 | TATTTCTGGAAGTTGAGATGTTT |
| 4513 | ATTTCTGGAAGTTGAGATGTTTC |
| 4514 | TTTCTGGAAGTTGAGATGTTTCA |
| 4515 | TTCTGGAAGTTGAGATGTTTCAG |
| 4516 | TCTGGAAGTTGAGATGTTTCAGC |
| 4517 | CTGGAAGTTGAGATGTTTCAGCT |
| 4518 | TGGAAGTTGAGATGTTTCAGCTT |
| 4519 | GGAAGTTGAGATGTTTCAGCTTG |
| 4520 | GAAGTTGAGATGTTTCAGCTTGA |
| 4521 | AAGTTGAGATGTTTCAGCTTGAA |

| ID | SEQUENCE |
|---|---|
| 4522 | AGTTGAGATGTTTCAGCTTGAAG |
| 4523 | GTTGAGATGTTTCAGCTTGAAGA |
| 4524 | TTGAGATGTTTCAGCTTGAAGAA |
| 4525 | TGAGATGTTTCAGCTTGAAGAAC |
| 4526 | GAGATGTTTCAGCTTGAAGAACC |
| 4527 | AGATGTTTCAGCTTGAAGAACCA |
| 4528 | GATGTTTCAGCTTGAAGAACCAA |
| 4529 | ATGTTTCAGCTTGAAGAACCAAA |
| 4530 | TGTTTCAGCTTGAAGAACCAAAA |
| 4531 | GTTTCAGCTTGAAGAACCAAAAC |
| 4532 | TTTCAGCTTGAAGAACCAAAACA |
| 4533 | TTCAGCTTGAAGAACCAAAACAG |
| 4534 | TCAGCTTGAAGAACCAAAACAGA |
| 4535 | CAGCTTGAAGAACCAAAACAGAA |
| 4536 | AGCTTGAAGAACCAAAACAGAAG |
| 4537 | GCTTGAAGAACCAAAACAGAAGG |
| 4538 | CTTGAAGAACCAAAACAGAAGGA |
| 4539 | TTGAAGAACCAAAACAGAAGGAA |
| 4540 | TGAAGAACCAAAACAGAAGGAAT |
| 4541 | GAAGAACCAAAACAGAAGGAATA |
| 4542 | AAGAACCAAAACAGAAGGAATAT |
| 4543 | AGAACCAAAACAGAAGGAATATG |
| 4544 | GAACCAAAACAGAAGGAATATGT |
| 4545 | AACCAAAACAGAAGGAATATGTA |
| 4546 | ACCAAAACAGAAGGAATATGTAC |
| 4547 | CCAAAACAGAAGGAATATGTACA |
| 4548 | CAAAACAGAAGGAATATGTACAA |
| 4549 | AAAACAGAAGGAATATGTACAAA |
| 4550 | AAACAGAAGGAATATGTACAAAG |
| 4551 | AACAGAAGGAATATGTACAAAGA |
| 4552 | ACAGAAGGAATATGTACAAAGAA |
| 4553 | CAGAAGGAATATGTACAAAGAAT |
| 4554 | AGAAGGAATATGTACAAAGAATA |
| 4555 | GAAGGAATATGTACAAAGAATAA |
| 4556 | AAGGAATATGTACAAAGAATAAA |
| 4557 | AGGAATATGTACAAAGAATAAAT |
| 4558 | GGAATATGTACAAAGAATAAATT |
| 4559 | GAATATGTACAAAGAATAAATTT |
| 4560 | AATATGTACAAAGAATAAATTTT |
| 4561 | ATATGTACAAAGAATAAATTTTC |
| 4562 | TATGTACAAAGAATAAATTTTCT |
| 4563 | ATGTACAAAGAATAAATTTTCTG |
| 4564 | TGTACAAAGAATAAATTTTCTGC |
| 4565 | GTACAAAGAATAAATTTTCTGCT |
| 4566 | TACAAAGAATAAATTTTCTGCTC |
| 4567 | ACAAAGAATAAATTTTCTGCTCA |
| 4568 | CAAAGAATAAATTTTCTGCTCAC |
| 4569 | AAAGAATAAATTTTCTGCTCACG |
| 4570 | AAGAATAAATTTTCTGCTCACGA |
| 4571 | AGAATAAATTTTCTGCTCACGAT |
| 4572 | GAATAAATTTTCTGCTCACGATG |
| 4573 | AATAAATTTTCTGCTCACGATGA |
| 4574 | ATAAATTTTCTGCTCACGATGAG |
| 4575 | TAAATTTTCTGCTCACGATGAGT |
| 4576 | AAATTTTCTGCTCACGATGAGTT |
| 4577 | AATTTTCTGCTCACGATGAGTTT |
| 4578 | ATTTTCTGCTCACGATGAGTTTA |
| 4579 | TTTTCTGCTCACGATGAGTTTAG |

| ID | SEQUENCE |
|---|---|
| 4580 | TTTCTGCTCACGATGAGTTTAGT |
| 4581 | TTCTGCTCACGATGAGTTTAGTG |
| 4582 | TCTGCTCACGATGAGTTTAGTGT |
| 4583 | CTGCTCACGATGAGTTTAGTGTG |
| 4584 | TGCTCACGATGAGTTTAGTGTGT |
| 4585 | GCTCACGATGAGTTTAGTGTGTA |
| 4586 | CTCACGATGAGTTTAGTGTGTAA |
| 4587 | TCACGATGAGTTTAGTGTGTAAA |
| 4588 | CACGATGAGTTTAGTGTGTAAAG |
| 4589 | ACGATGAGTTTAGTGTGTAAAGT |
| 4590 | CGATGAGTTTAGTGTGTAAAGTT |
| 4591 | GATGAGTTTAGTGTGTAAAGTTT |
| 4592 | ATGAGTTTAGTGTGTAAAGTTTA |
| 4593 | TGAGTTTAGTGTGTAAAGTTTAG |
| 4594 | GAGTTTAGTGTGTAAAGTTTAGA |
| 4595 | AGTTTAGTGTGTAAAGTTTAGAG |
| 4596 | GTTTAGTGTGTAAAGTTTAGAGA |
| 4597 | TTTAGTGTGTAAAGTTTAGAGAC |
| 4598 | TTAGTGTGTAAAGTTTAGAGACA |
| 4599 | TAGTGTGTAAAGTTTAGAGACAT |
| 4600 | AGTGTGTAAAGTTTAGAGACATC |
| 4601 | GTGTGTAAAGTTTAGAGACATCT |
| 4602 | TGTGTAAAGTTTAGAGACATCTG |
| 4603 | GTGTAAAGTTTAGAGACATCTGA |
| 4604 | TGTAAAGTTTAGAGACATCTGAC |
| 4605 | GTAAAGTTTAGAGACATCTGACT |
| 4606 | TAAAGTTTAGAGACATCTGACTT |
| 4607 | AAAGTTTAGAGACATCTGACTTT |
| 4608 | AAGTTTAGAGACATCTGACTTTG |
| 4609 | AGTTTAGAGACATCTGACTTTGA |
| 4610 | GTTTAGAGACATCTGACTTTGAT |
| 4611 | TTTAGAGACATCTGACTTTGATA |
| 4612 | TTAGAGACATCTGACTTTGATAG |
| 4613 | TAGAGACATCTGACTTTGATAGC |
| 4614 | AGAGACATCTGACTTTGATAGCT |
| 4615 | GAGACATCTGACTTTGATAGCTA |
| 4616 | AGACATCTGACTTTGATAGCTAA |
| 4617 | GACATCTGACTTTGATAGCTAAA |
| 4618 | ACATCTGACTTTGATAGCTAAAT |
| 4619 | CATCTGACTTTGATAGCTAAATT |
| 4620 | ATCTGACTTTGATAGCTAAATTA |
| 4621 | TCTGACTTTGATAGCTAAATTAA |
| 4622 | CTGACTTTGATAGCTAAATTAAA |
| 4623 | TGACTTTGATAGCTAAATTAAAC |
| 4624 | GACTTTGATAGCTAAATTAAACC |
| 4625 | ACTTTGATAGCTAAATTAAACCA |
| 4626 | CTTTGATAGCTAAATTAAACCAA |
| 4627 | TTTGATAGCTAAATTAAACCAAA |
| 4628 | TTGATAGCTAAATTAAACCAAAC |
| 4629 | TGATAGCTAAATTAAACCAAACC |
| 4630 | GATAGCTAAATTAAACCAAACCC |
| 4631 | ATAGCTAAATTAAACCAAACCCT |
| 4632 | TAGCTAAATTAAACCAAACCCTA |
| 4633 | AGCTAAATTAAACCAAACCCTAT |
| 4634 | GCTAAATTAAACCAAACCCTATT |
| 4635 | CTAAATTAAACCAAACCCTATTG |
| 4636 | TAAATTAAACCAAACCCTATTGA |
| 4637 | AAATTAAACCAAACCCTATTGAA |

| ID | SEQUENCE |
|---|---|
| 4638 | AATTAAACCAAACCCTATTGAAG |
| 4639 | ATTAAACCAAACCCTATTGAAGA |
| 4640 | TTAAACCAAACCCTATTGAAGAA |
| 4641 | TAAACCAAACCCTATTGAAGAAT |
| 4642 | AAACCAAACCCTATTGAAGAATT |
| 4643 | AACCAAACCCTATTGAAGAATTG |
| 4644 | ACCAAACCCTATTGAAGAATTGA |
| 4645 | CCAAACCCTATTGAAGAATTGAA |
| 4646 | CAAACCCTATTGAAGAATTGAAT |
| 4647 | AAACCCTATTGAAGAATTGAATA |
| 4648 | AACCCTATTGAAGAATTGAATAT |
| 4649 | ACCCTATTGAAGAATTGAATATA |
| 4650 | CCCTATTGAAGAATTGAATATAT |
| 4651 | CCTATTGAAGAATTGAATATATG |
| 4652 | CTATTGAAGAATTGAATATATGC |
| 4653 | TATTGAAGAATTGAATATATGCT |
| 4654 | ATTGAAGAATTGAATATATGCTA |
| 4655 | TTGAAGAATTGAATATATGCTAC |
| 4656 | TGAAGAATTGAATATATGCTACT |
| 4657 | GAAGAATTGAATATATGCTACTT |
| 4658 | AAGAATTGAATATATGCTACTTC |
| 4659 | AGAATTGAATATATGCTACTTCA |
| 4660 | GAATTGAATATATGCTACTTCAA |
| 4661 | AATTGAATATATGCTACTTCAAG |
| 4662 | ATTGAATATATGCTACTTCAAGA |
| 4663 | TTGAATATATGCTACTTCAAGAA |
| 4664 | TGAATATATGCTACTTCAAGAAA |
| 4665 | GAATATATGCTACTTCAAGAAAC |
| 4666 | AATATATGCTACTTCAAGAAACT |
| 4667 | ATATATGCTACTTCAAGAAACTA |
| 4668 | TATATGCTACTTCAAGAAACTAA |
| 4669 | ATATGCTACTTCAAGAAACTAAA |
| 4670 | TATGCTACTTCAAGAAACTAAAT |
| 4671 | ATGCTACTTCAAGAAACTAAATT |
| 4672 | TGCTACTTCAAGAAACTAAATTG |
| 4673 | GCTACTTCAAGAAACTAAATTGA |
| 4674 | CTACTTCAAGAAACTAAATTGAT |
| 4675 | TACTTCAAGAAACTAAATTGATC |
| 4676 | ACTTCAAGAAACTAAATTGATCT |
| 4677 | CTTCAAGAAACTAAATTGATCTC |
| 4678 | TTCAAGAAACTAAATTGATCTCG |
| 4679 | TCAAGAAACTAAATTGATCTCGT |
| 4680 | CAAGAAACTAAATTGATCTCGTA |
| 4681 | AAGAAACTAAATTGATCTCGTAG |
| 4682 | AGAAACTAAATTGATCTCGTAGA |
| 4683 | GAAACTAAATTGATCTCGTAGAA |
| 4684 | AAACTAAATTGATCTCGTAGAAT |
| 4685 | AACTAAATTGATCTCGTAGAATT |
| 4686 | ACTAAATTGATCTCGTAGAATTA |
| 4687 | CTAAATTGATCTCGTAGAATTAT |
| 4688 | TAAATTGATCTCGTAGAATTATC |
| 4689 | AAATTGATCTCGTAGAATTATCT |
| 4690 | AATTGATCTCGTAGAATTATCTT |
| 4691 | ATTGATCTCGTAGAATTATCTTA |
| 4692 | TTGATCTCGTAGAATTATCTTAA |
| 4693 | TGATCTCGTAGAATTATCTTAAT |
| 4694 | GATCTCGTAGAATTATCTTAATA |
| 4695 | ATCTCGTAGAATTATCTTAATAA |

| ID | SEQUENCE |
|---|---|
| 4696 | TCTCGTAGAATTATCTTAATAAA |
| 4697 | CTCGTAGAATTATCTTAATAAAA |
| 4698 | TCGTAGAATTATCTTAATAAAAT |
| 4699 | CGTAGAATTATCTTAATAAAATA |
| 4700 | GTAGAATTATCTTAATAAAATAA |
| 4701 | TAGAATTATCTTAATAAAATAAT |
| 4702 | AGAATTATCTTAATAAAATAATG |
| 4703 | GAATTATCTTAATAAAATAATGG |
| 4704 | AATTATCTTAATAAAATAATGGC |
| 4705 | ATTATCTTAATAAAATAATGGCT |
| 4706 | TTATCTTAATAAAATAATGGCTA |
| 4707 | TATCTTAATAAAATAATGGCTAT |
| 4708 | ATCTTAATAAAATAATGGCTATA |
| 4709 | TCTTAATAAAATAATGGCTATAA |
| 4710 | CTTAATAAAATAATGGCTATAAT |
| 4711 | TTAATAAAATAATGGCTATAATT |
| 4712 | TAATAAAATAATGGCTATAATTT |
| 4713 | AATAAAATAATGGCTATAATTTC |
| 4714 | ATAAAATAATGGCTATAATTTCT |
| 4715 | TAAAATAATGGCTATAATTTCTC |
| 4716 | AAAATAATGGCTATAATTTCTCT |
| 4717 | AAATAATGGCTATAATTTCTCTG |
| 4718 | AATAATGGCTATAATTTCTCTGC |
| 4719 | ATAATGGCTATAATTTCTCTGCA |
| 4720 | TAATGGCTATAATTTCTCTGCAA |
| 4721 | AATGGCTATAATTTCTCTGCAAA |
| 4722 | ATGGCTATAATTTCTCTGCAAAA |
| 4723 | TGGCTATAATTTCTCTGCAAAAT |
| 4724 | GGCTATAATTTCTCTGCAAAATC |
| 4725 | GCTATAATTTCTCTGCAAAATCA |
| 4726 | CTATAATTTCTCTGCAAAATCAG |
| 4727 | TATAATTTCTCTGCAAAATCAGA |
| 4728 | ATAATTTCTCTGCAAAATCAGAT |
| 4729 | TAATTTCTCTGCAAAATCAGATG |
| 4730 | AATTTCTCTGCAAAATCAGATGT |
| 4731 | ATTTCTCTGCAAAATCAGATGTC |
| 4732 | TTTCTCTGCAAAATCAGATGTCA |
| 4733 | TTCTCTGCAAAATCAGATGTCAG |
| 4734 | TCTCTGCAAAATCAGATGTCAGC |
| 4735 | CTCTGCAAAATCAGATGTCAGCA |
| 4736 | TCTGCAAAATCAGATGTCAGCAT |
| 4737 | CTGCAAAATCAGATGTCAGCATA |
| 4738 | TGCAAAATCAGATGTCAGCATAA |
| 4739 | GCAAAATCAGATGTCAGCATAAG |
| 4740 | CAAAATCAGATGTCAGCATAAGC |
| 4741 | AAAATCAGATGTCAGCATAAGCG |
| 4742 | AAATCAGATGTCAGCATAAGCGA |
| 4743 | AATCAGATGTCAGCATAAGCGAT |
| 4744 | ATCAGATGTCAGCATAAGCGATG |
| 4745 | TCAGATGTCAGCATAAGCGATGG |
| 4746 | CAGATGTCAGCATAAGCGATGGA |
| 4747 | AGATGTCAGCATAAGCGATGGAT |
| 4748 | GATGTCAGCATAAGCGATGGATA |
| 4749 | ATGTCAGCATAAGCGATGGATAA |
| 4750 | TGTCAGCATAAGCGATGGATAAT |
| 4751 | GTCAGCATAAGCGATGGATAATA |
| 4752 | TCAGCATAAGCGATGGATAATAC |
| 4753 | CAGCATAAGCGATGGATAATACC |

| ID | SEQUENCE |
|---|---|
| 4754 | AGCATAAGCGATGGATAATACCT |
| 4755 | GCATAAGCGATGGATAATACCTA |
| 4756 | CATAAGCGATGGATAATACCTAA |
| 4757 | ATAAGCGATGGATAATACCTAAT |
| 4758 | TAAGCGATGGATAATACCTAATA |
| 4759 | AAGCGATGGATAATACCTAATAA |
| 4760 | AGCGATGGATAATACCTAATAAA |
| 4761 | GCGATGGATAATACCTAATAAAC |
| 4762 | CGATGGATAATACCTAATAAACT |
| 4763 | GATGGATAATACCTAATAAACTG |
| 4764 | ATGGATAATACCTAATAAACTGC |
| 4765 | TGGATAATACCTAATAAACTGCC |
| 4766 | GGATAATACCTAATAAACTGCCC |
| 4767 | GATAATACCTAATAAACTGCCCT |
| 4768 | ATAATACCTAATAAACTGCCCTC |
| 4769 | TAATACCTAATAAACTGCCCTCA |
| 4770 | AATACCTAATAAACTGCCCTCAG |
| 4771 | ATACCTAATAAACTGCCCTCAGT |
| 4772 | TACCTAATAAACTGCCCTCAGTA |
| 4773 | ACCTAATAAACTGCCCTCAGTAA |
| 4774 | CCTAATAAACTGCCCTCAGTAAA |
| 4775 | CTAATAAACTGCCCTCAGTAAAT |
| 4776 | TAATAAACTGCCCTCAGTAAATC |
| 4777 | AATAAACTGCCCTCAGTAAATCC |
| 4778 | ATAAACTGCCCTCAGTAAATCCA |
| 4779 | TAAACTGCCCTCAGTAAATCCAT |
| 4780 | AAACTGCCCTCAGTAAATCCATG |
| 4781 | AACTGCCCTCAGTAAATCCATGG |
| 4782 | ACTGCCCTCAGTAAATCCATGGT |
| 4783 | CTGCCCTCAGTAAATCCATGGTT |
| 4784 | TGCCCTCAGTAAATCCATGGTTA |
| 4785 | GCCCTCAGTAAATCCATGGTTAA |
| 4786 | CCCTCAGTAAATCCATGGTTAAT |
| 4787 | CCTCAGTAAATCCATGGTTAATA |
| 4788 | CTCAGTAAATCCATGGTTAATAA |
| 4789 | TCAGTAAATCCATGGTTAATAAA |
| 4790 | CAGTAAATCCATGGTTAATAAAT |
| 4791 | AGTAAATCCATGGTTAATAAATG |
| 4792 | GTAAATCCATGGTTAATAAATGT |
| 4793 | TAAATCCATGGTTAATAAATGTG |
| 4794 | AAATCCATGGTTAATAAATGTGG |
| 4795 | AATCCATGGTTAATAAATGTGGT |
| 4796 | ATCCATGGTTAATAAATGTGGTT |
| 4797 | TCCATGGTTAATAAATGTGGTTT |
| 4798 | CCATGGTTAATAAATGTGGTTTC |
| 4799 | CATGGTTAATAAATGTGGTTTCT |
| 4800 | ATGGTTAATAAATGTGGTTTCTA |
| 4801 | TGGTTAATAAATGTGGTTTCTAC |
| 4802 | GGTTAATAAATGTGGTTTCTACA |
| 4803 | GTTAATAAATGTGGTTTCTACAT |
| 4804 | TTAATAAATGTGGTTTCTACATT |

| ID | SEQUENCE |
|---|---|
| 1 | GCGGCCGCAGCAGCCTCCGCCCC |
| 2 | CGGCCGCAGCAGCCTCCGCCCCC |
| 3 | CCCCCCGCACGGTGTGAGCGCCC |
| 4 | CCCCCGCACGGTGTGAGCGCCCG |
| 5 | CCCCGCACGGTGTGAGCGCCCGA |
| 6 | CCCGCACGGTGTGAGCGCCCGAC |
| 7 | CCGCACGGTGTGAGCGCCCGACG |
| 8 | CGCACGGTGTGAGCGCCCGACGC |
| 9 | GCACGGTGTGAGCGCCCGACGCG |
| 10 | CACGGTGTGAGCGCCCGACGCGG |
| 11 | ACGGTGTGAGCGCCCGACGCGGC |
| 12 | CGGTGTGAGCGCCCGACGCGGCC |
| 13 | GGTGTGAGCGCCCGACGCGGCCG |
| 14 | GTGTGAGCGCCCGACGCGGCCGA |
| 15 | TGTGAGCGCCCGACGCGGCCGAG |
| 16 | GTGAGCGCCCGACGCGGCCGAGG |
| 17 | TGAGCGCCCGACGCGGCCGAGGC |
| 18 | GAGCGCCCGACGCGGCCGAGGCG |
| 19 | AGCGCCCGACGCGGCCGAGGCGG |
| 20 | GCGCCCGACGCGGCCGAGGCGGC |
| 21 | CGCCCGACGCGGCCGAGGCGGCC |
| 22 | GCCCGACGCGGCCGAGGCGGCCG |
| 23 | GCGGCCGGAGTCCCGAGCTAGCC |
| 24 | CGGCCGGAGTCCCGAGCTAGCCC |
| 25 | GGCCGGAGTCCCGAGCTAGCCCC |
| 26 | GCCGGAGTCCCGAGCTAGCCCCG |
| 27 | CCGGAGTCCCGAGCTAGCCCCGG |
| 28 | CGGAGTCCCGAGCTAGCCCCGGC |
| 29 | CGCCGCCCAGACCGGACGACAGG |
| 30 | GCCGCCCAGACCGGACGACAGGC |
| 31 | CCGCCCAGACCGGACGACAGGCC |
| 32 | CGCCCAGACCGGACGACAGGCCA |
| 33 | GCCCAGACCGGACGACAGGCCAC |
| 34 | CCCAGACCGGACGACAGGCCACC |
| 35 | CCAGACCGGACGACAGGCCACCT |
| 36 | CAGACCGGACGACAGGCCACCTC |
| 37 | AGACCGGACGACAGGCCACCTCG |
| 38 | GACCGGACGACAGGCCACCTCGT |
| 39 | ACCGGACGACAGGCCACCTCGTC |
| 40 | CCGGACGACAGGCCACCTCGTCG |
| 41 | CGGACGACAGGCCACCTCGTCGG |
| 42 | GGACGACAGGCCACCTCGTCGGC |
| 43 | GACGACAGGCCACCTCGTCGGCG |
| 44 | ACGACAGGCCACCTCGTCGGCGT |
| 45 | CGACAGGCCACCTCGTCGGCGTC |
| 46 | GACAGGCCACCTCGTCGGCGTCC |
| 47 | ACAGGCCACCTCGTCGGCGTCCG |
| 48 | CAGGCCACCTCGTCGGCGTCCGC |
| 49 | AGGCCACCTCGTCGGCGTCCGCC |
| 50 | GGCCACCTCGTCGGCGTCCGCCC |
| 51 | GCCACCTCGTCGGCGTCCGCCCG |
| 52 | CCACCTCGTCGGCGTCCGCCCGA |
| 53 | CACCTCGTCGGCGTCCGCCCGAG |
| 54 | ACCTCGTCGGCGTCCGCCCGAGT |
| 55 | CCTCGTCGGCGTCCGCCCGAGTC |
| 56 | CTCGTCGGCGTCCGCCCGAGTCC |
| 57 | TCGTCGGCGTCCGCCCGAGTCCC |
| 58 | CGTCGGCGTCCGCCCGAGTCCCC |

| ID | SEQUENCE |
|---|---|
| 59 | GTCGGCGTCCGCCCGAGTCCCCG |
| 60 | TCGGCGTCCGCCCGAGTCCCCGC |
| 61 | CGGCGTCCGCCCGAGTCCCCGCC |
| 62 | GGCGTCCGCCCGAGTCCCCGCCT |
| 63 | GCGTCCGCCCGAGTCCCCGCCTC |
| 64 | CGTCCGCCCGAGTCCCCGCCTCG |
| 65 | GTCCGCCCGAGTCCCCGCCTCGC |
| 66 | TCCGCCCGAGTCCCCGCCTCGCC |
| 67 | CCGCCCGAGTCCCCGCCTCGCCG |
| 68 | CGCCCGAGTCCCCGCCTCGCCGC |
| 69 | GCCCGAGTCCCCGCCTCGCCGCC |
| 70 | CCCGAGTCCCCGCCTCGCCGCCA |
| 71 | CCGAGTCCCCGCCTCGCCGCCAA |
| 72 | CGAGTCCCCGCCTCGCCGCCAAC |
| 73 | GAGTCCCCGCCTCGCCGCCAACG |
| 74 | AGTCCCCGCCTCGCCGCCAACGC |
| 75 | GTCCCCGCCTCGCCGCCAACGCC |
| 76 | TCCCCGCCTCGCCGCCAACGCCA |
| 77 | CCCCGCCTCGCCGCCAACGCCAC |
| 78 | CCCGCCTCGCCGCCAACGCCACA |
| 79 | CCGCCTCGCCGCCAACGCCACAA |
| 80 | CGCCTCGCCGCCAACGCCACAAC |
| 81 | GCCTCGCCGCCAACGCCACAACC |
| 82 | CCTCGCCGCCAACGCCACAACCA |
| 83 | CTCGCCGCCAACGCCACAACCAC |
| 84 | TCGCCGCCAACGCCACAACCACC |
| 85 | CGCCGCCAACGCCACAACCACCG |
| 86 | GCCGCCAACGCCACAACCACCGC |
| 87 | CCGCCAACGCCACAACCACCGCG |
| 88 | CGCCAACGCCACAACCACCGCGC |
| 89 | GCCAACGCCACAACCACCGCGCA |
| 90 | CCAACGCCACAACCACCGCGCAC |
| 91 | CAACGCCACAACCACCGCGCACG |
| 92 | AACGCCACAACCACCGCGCACGG |
| 93 | ACGCCACAACCACCGCGCACGGC |
| 94 | CGCCACAACCACCGCGCACGGCC |
| 95 | GCCACAACCACCGCGCACGGCCC |
| 96 | CCACAACCACCGCGCACGGCCCC |
| 97 | CACAACCACCGCGCACGGCCCCC |
| 98 | ACAACCACCGCGCACGGCCCCCT |
| 99 | CAACCACCGCGCACGGCCCCCTG |
| 100 | AACCACCGCGCACGGCCCCCTGA |
| 101 | ACCACCGCGCACGGCCCCCTGAC |
| 102 | CCACCGCGCACGGCCCCCTGACT |
| 103 | CACCGCGCACGGCCCCCTGACTC |
| 104 | ACCGCGCACGGCCCCCTGACTCC |
| 105 | CCGCGCACGGCCCCCTGACTCCG |
| 106 | CGCGCACGGCCCCCTGACTCCGT |
| 107 | GCGCACGGCCCCCTGACTCCGTC |
| 108 | CGCACGGCCCCCTGACTCCGTCC |
| 109 | GCACGGCCCCCTGACTCCGTCCA |
| 110 | CACGGCCCCCTGACTCCGTCCAG |
| 111 | ACGGCCCCCTGACTCCGTCCAGT |
| 112 | CGGCCCCCTGACTCCGTCCAGTA |
| 113 | GGCCCCCTGACTCCGTCCAGTAT |
| 114 | GCCCCCTGACTCCGTCCAGTATT |
| 115 | CCCCCTGACTCCGTCCAGTATTG |
| 116 | CCCCTGACTCCGTCCAGTATTGA |

| ID | SEQUENCE |
|---|---|
| 117 | CCCTGACTCCGTCCAGTATTGAT |
| 118 | CCTGACTCCGTCCAGTATTGATC |
| 119 | CTGACTCCGTCCAGTATTGATCG |
| 120 | TGACTCCGTCCAGTATTGATCGG |
| 121 | GACTCCGTCCAGTATTGATCGGG |
| 122 | ACTCCGTCCAGTATTGATCGGGA |
| 123 | CTCCGTCCAGTATTGATCGGGAG |
| 124 | TCCGTCCAGTATTGATCGGGAGA |
| 125 | CCGTCCAGTATTGATCGGGAGAG |
| 126 | CGTCCAGTATTGATCGGGAGAGC |
| 127 | GTCCAGTATTGATCGGGAGAGCC |
| 128 | TCCAGTATTGATCGGGAGAGCCG |
| 129 | CCAGTATTGATCGGGAGAGCCGG |
| 130 | CAGTATTGATCGGGAGAGCCGGA |
| 131 | AGTATTGATCGGGAGAGCCGGAG |
| 132 | GTATTGATCGGGAGAGCCGGAGC |
| 133 | TATTGATCGGGAGAGCCGGAGCG |
| 134 | ATTGATCGGGAGAGCCGGAGCGA |
| 135 | TTGATCGGGAGAGCCGGAGCGAG |
| 136 | TGATCGGGAGAGCCGGAGCGAGC |
| 137 | GATCGGGAGAGCCGGAGCGAGCT |
| 138 | ATCGGGAGAGCCGGAGCGAGCTC |
| 139 | TCGGGAGAGCCGGAGCGAGCTCT |
| 140 | CGGGAGAGCCGGAGCGAGCTCTT |
| 141 | GGGAGAGCCGGAGCGAGCTCTTC |
| 142 | GGAGAGCCGGAGCGAGCTCTTCG |
| 143 | GAGAGCCGGAGCGAGCTCTTCGG |
| 144 | AGAGCCGGAGCGAGCTCTTCGGG |
| 145 | GAGCCGGAGCGAGCTCTTCGGGG |
| 146 | AGCCGGAGCGAGCTCTTCGGGGA |
| 147 | GCCGGAGCGAGCTCTTCGGGGAG |
| 148 | CCGGAGCGAGCTCTTCGGGGAGC |
| 149 | CGGAGCGAGCTCTTCGGGGAGCA |
| 150 | GGAGCGAGCTCTTCGGGGAGCAG |
| 151 | GAGCGAGCTCTTCGGGGAGCAGC |
| 152 | ATGCGACCCTCCGGGACGGCCGG |
| 153 | TGCGACCCTCCGGGACGGCCGGG |
| 154 | GCCGGGGCAGCGCTCCTGGCGCT |
| 155 | CCGGGGCAGCGCTCCTGGCGCTG |
| 156 | CGGGGCAGCGCTCCTGGCGCTGC |
| 157 | GGGGCAGCGCTCCTGGCGCTGCT |
| 158 | GGGCAGCGCTCCTGGCGCTGCTG |
| 159 | GGCAGCGCTCCTGGCGCTGCTGG |
| 160 | GCAGCGCTCCTGGCGCTGCTGGC |
| 161 | CAGCGCTCCTGGCGCTGCTGGCT |
| 162 | AGCGCTCCTGGCGCTGCTGGCTG |
| 163 | GCGCTCCTGGCGCTGCTGGCTGC |
| 164 | CGCTCCTGGCGCTGCTGGCTGCG |
| 165 | GCTCCTGGCGCTGCTGGCTGCGC |
| 166 | CTCCTGGCGCTGCTGGCTGCGCT |
| 167 | TCCTGGCGCTGCTGGCTGCGCTC |
| 168 | CCTGGCGCTGCTGGCTGCGCTCT |
| 169 | CTGGCGCTGCTGGCTGCGCTCTG |
| 170 | TGGCGCTGCTGGCTGCGCTCTGC |
| 171 | GGCGCTGCTGGCTGCGCTCTGCC |
| 172 | GCGCTGCTGGCTGCGCTCTGCCC |
| 173 | CGCTGCTGGCTGCGCTCTGCCCG |
| 174 | GCTGCTGGCTGCGCTCTGCCCGG |

| ID | SEQUENCE |
|---|---|
| 175 | CTGCTGGCTGCGCTCTGCCCGGC |
| 176 | TGCTGGCTGCGCTCTGCCCGGCG |
| 177 | GCTGGCTGCGCTCTGCCCGGCGA |
| 178 | CTGGCTGCGCTCTGCCCGGCGAG |
| 179 | TGGCTGCGCTCTGCCCGGCGAGT |
| 180 | GGCTGCGCTCTGCCCGGCGAGTC |
| 181 | GCTGCGCTCTGCCCGGCGAGTCG |
| 182 | CTGCGCTCTGCCCGGCGAGTCGG |
| 183 | TGCGCTCTGCCCGGCGAGTCGGG |
| 184 | GCGCTCTGCCCGGCGAGTCGGGC |
| 185 | CGCTCTGCCCGGCGAGTCGGGCT |
| 186 | GCTCTGCCCGGCGAGTCGGGCTC |
| 187 | CTCTGCCCGGCGAGTCGGGCTCT |
| 188 | TCTGCCCGGCGAGTCGGGCTCTG |
| 189 | CTGCCCGGCGAGTCGGGCTCTGG |
| 190 | TGCCCGGCGAGTCGGGCTCTGGA |
| 191 | GCCCGGCGAGTCGGGCTCTGGAG |
| 192 | CCCGGCGAGTCGGGCTCTGGAGG |
| 193 | CCGGCGAGTCGGGCTCTGGAGGA |
| 194 | CGGCGAGTCGGGCTCTGGAGGAA |
| 195 | GGCGAGTCGGGCTCTGGAGGAAA |
| 196 | GCGAGTCGGGCTCTGGAGGAAAA |
| 197 | CGAGTCGGGCTCTGGAGGAAAAG |
| 198 | GAGTCGGGCTCTGGAGGAAAAGA |
| 199 | AGTCGGGCTCTGGAGGAAAAGAA |
| 200 | GTCGGGCTCTGGAGGAAAAGAAA |
| 201 | TCGGGCTCTGGAGGAAAAGAAAG |
| 202 | CGGGCTCTGGAGGAAAAGAAAGT |
| 203 | GGGCTCTGGAGGAAAAGAAAGTT |
| 204 | GGCTCTGGAGGAAAAGAAAGTTT |
| 205 | GCTCTGGAGGAAAAGAAAGTTTG |
| 206 | CTCTGGAGGAAAAGAAAGTTTGC |
| 207 | TCTGGAGGAAAAGAAAGTTTGCC |
| 208 | CTGGAGGAAAAGAAAGTTTGCCA |
| 209 | TGGAGGAAAAGAAAGTTTGCCAA |
| 210 | GGAGGAAAAGAAAGTTTGCCAAG |
| 211 | GAGGAAAAGAAAGTTTGCCAAGG |
| 212 | AGGAAAAGAAAGTTTGCCAAGGC |
| 213 | GGAAAAGAAAGTTTGCCAAGGCA |
| 214 | GAAAAGAAAGTTTGCCAAGGCAC |
| 215 | AAAAGAAAGTTTGCCAAGGCACG |
| 216 | AAAGAAAGTTTGCCAAGGCACGA |
| 217 | AAGAAAGTTTGCCAAGGCACGAG |
| 218 | AGAAAGTTTGCCAAGGCACGAGT |
| 219 | GAAAGTTTGCCAAGGCACGAGTA |
| 220 | AAAGTTTGCCAAGGCACGAGTAA |
| 221 | AAGTTTGCCAAGGCACGAGTAAC |
| 222 | AGTTTGCCAAGGCACGAGTAACA |
| 223 | GTTTGCCAAGGCACGAGTAACAA |
| 224 | TTTGCCAAGGCACGAGTAACAAG |
| 225 | TTGCCAAGGCACGAGTAACAAGC |
| 226 | TGCCAAGGCACGAGTAACAAGCT |
| 227 | GCCAAGGCACGAGTAACAAGCTC |
| 228 | CCAAGGCACGAGTAACAAGCTCA |
| 229 | CAAGGCACGAGTAACAAGCTCAC |
| 230 | AAGGCACGAGTAACAAGCTCACG |
| 231 | AGGCACGAGTAACAAGCTCACGC |
| 232 | GGCACGAGTAACAAGCTCACGCA |

| ID | SEQUENCE |
|---|---|
| 233 | GCACGAGTAACAAGCTCACGCAG |
| 234 | CACGAGTAACAAGCTCACGCAGT |
| 235 | ACGAGTAACAAGCTCACGCAGTT |
| 236 | CGAGTAACAAGCTCACGCAGTTG |
| 237 | GAGTAACAAGCTCACGCAGTTGG |
| 238 | AGTAACAAGCTCACGCAGTTGGG |
| 239 | GTAACAAGCTCACGCAGTTGGGC |
| 240 | TAACAAGCTCACGCAGTTGGGCA |
| 241 | AACAAGCTCACGCAGTTGGGCAC |
| 242 | ACAAGCTCACGCAGTTGGGCACT |
| 243 | CAAGCTCACGCAGTTGGGCACTT |
| 244 | AAGCTCACGCAGTTGGGCACTTT |
| 245 | AGCTCACGCAGTTGGGCACTTTT |
| 246 | GCTCACGCAGTTGGGCACTTTTG |
| 247 | CTCACGCAGTTGGGCACTTTTGA |
| 248 | TCACGCAGTTGGGCACTTTTGAA |
| 249 | CACGCAGTTGGGCACTTTTGAAG |
| 250 | ACGCAGTTGGGCACTTTTGAAGA |
| 251 | CGCAGTTGGGCACTTTTGAAGAT |
| 252 | GCAGTTGGGCACTTTTGAAGATC |
| 253 | CAGTTGGGCACTTTTGAAGATCA |
| 254 | AGTTGGGCACTTTTGAAGATCAT |
| 255 | GTTGGGCACTTTTGAAGATCATT |
| 256 | TTGGGCACTTTTGAAGATCATTT |
| 257 | TGGGCACTTTTGAAGATCATTTT |
| 258 | GGGCACTTTTGAAGATCATTTTC |
| 259 | GGCACTTTTGAAGATCATTTTCT |
| 260 | GCACTTTTGAAGATCATTTTCTC |
| 261 | CACTTTTGAAGATCATTTTCTCA |
| 262 | ACTTTTGAAGATCATTTTCTCAG |
| 263 | CTTTTGAAGATCATTTTCTCAGC |
| 264 | TTTTGAAGATCATTTTCTCAGCC |
| 265 | TTTGAAGATCATTTTCTCAGCCT |
| 266 | TTGAAGATCATTTTCTCAGCCTC |
| 267 | TGAAGATCATTTTCTCAGCCTCC |
| 268 | GAAGATCATTTTCTCAGCCTCCA |
| 269 | AAGATCATTTTCTCAGCCTCCAG |
| 270 | AGATCATTTTCTCAGCCTCCAGA |
| 271 | GATCATTTTCTCAGCCTCCAGAG |
| 272 | ATCATTTTCTCAGCCTCCAGAGG |
| 273 | TCATTTTCTCAGCCTCCAGAGGA |
| 274 | CATTTTCTCAGCCTCCAGAGGAT |
| 275 | ATTTTCTCAGCCTCCAGAGGATG |
| 276 | TTTTCTCAGCCTCCAGAGGATGT |
| 277 | TTTCTCAGCCTCCAGAGGATGTT |
| 278 | TTCTCAGCCTCCAGAGGATGTTC |
| 279 | TCTCAGCCTCCAGAGGATGTTCA |
| 280 | CTCAGCCTCCAGAGGATGTTCAA |
| 281 | TCAGCCTCCAGAGGATGTTCAAT |
| 282 | CAGCCTCCAGAGGATGTTCAATA |
| 283 | AGCCTCCAGAGGATGTTCAATAA |
| 284 | GCCTCCAGAGGATGTTCAATAAC |
| 285 | CCTCCAGAGGATGTTCAATAACT |
| 286 | CTCCAGAGGATGTTCAATAACTG |
| 287 | TCCAGAGGATGTTCAATAACTGT |
| 288 | CCAGAGGATGTTCAATAACTGTG |
| 289 | CAGAGGATGTTCAATAACTGTGA |
| 290 | AGAGGATGTTCAATAACTGTGAG |

| ID | SEQUENCE |
|---|---|
| 291 | GAGGATGTTCAATAACTGTGAGG |
| 292 | AGGATGTTCAATAACTGTGAGGT |
| 293 | GGATGTTCAATAACTGTGAGGTG |
| 294 | GATGTTCAATAACTGTGAGGTGG |
| 295 | ATGTTCAATAACTGTGAGGTGGT |
| 296 | TGTTCAATAACTGTGAGGTGGTC |
| 297 | GTTCAATAACTGTGAGGTGGTCC |
| 298 | TTCAATAACTGTGAGGTGGTCCT |
| 299 | TCAATAACTGTGAGGTGGTCCTT |
| 300 | CAATAACTGTGAGGTGGTCCTTG |
| 301 | AATAACTGTGAGGTGGTCCTTGG |
| 302 | ATAACTGTGAGGTGGTCCTTGGG |
| 303 | TAACTGTGAGGTGGTCCTTGGGA |
| 304 | AACTGTGAGGTGGTCCTTGGGAA |
| 305 | ACTGTGAGGTGGTCCTTGGGAAT |
| 306 | CTGTGAGGTGGTCCTTGGGAATT |
| 307 | TGTGAGGTGGTCCTTGGGAATTT |
| 308 | GTGAGGTGGTCCTTGGGAATTTG |
| 309 | TGAGGTGGTCCTTGGGAATTTGG |
| 310 | GAGGTGGTCCTTGGGAATTTGGA |
| 311 | AGGTGGTCCTTGGGAATTTGGAA |
| 312 | GGTGGTCCTTGGGAATTTGGAAA |
| 313 | GTGGTCCTTGGGAATTTGGAAAT |
| 314 | TGGTCCTTGGGAATTTGGAAATT |
| 315 | GGTCCTTGGGAATTTGGAAATTA |
| 316 | GTCCTTGGGAATTTGGAAATTAC |
| 317 | TCCTTGGGAATTTGGAAATTACC |
| 318 | CCTTGGGAATTTGGAAATTACCT |
| 319 | CTTGGGAATTTGGAAATTACCTA |
| 320 | TTGGGAATTTGGAAATTACCTAT |
| 321 | TGGGAATTTGGAAATTACCTATG |
| 322 | GGGAATTTGGAAATTACCTATGT |
| 323 | GGAATTTGGAAATTACCTATGTG |
| 324 | GAATTTGGAAATTACCTATGTGC |
| 325 | AATTTGGAAATTACCTATGTGCA |
| 326 | ATTTGGAAATTACCTATGTGCAG |
| 327 | TTTGGAAATTACCTATGTGCAGA |
| 328 | TTGGAAATTACCTATGTGCAGAG |
| 329 | TGGAAATTACCTATGTGCAGAGG |
| 330 | GGAAATTACCTATGTGCAGAGGA |
| 331 | GAAATTACCTATGTGCAGAGGAA |
| 332 | AAATTACCTATGTGCAGAGGAAT |
| 333 | AATTACCTATGTGCAGAGGAATT |
| 334 | ATTACCTATGTGCAGAGGAATTA |
| 335 | TTACCTATGTGCAGAGGAATTAT |
| 336 | TACCTATGTGCAGAGGAATTATG |
| 337 | ACCTATGTGCAGAGGAATTATGA |
| 338 | CCTATGTGCAGAGGAATTATGAT |
| 339 | CTATGTGCAGAGGAATTATGATC |
| 340 | TATGTGCAGAGGAATTATGATCT |
| 341 | ATGTGCAGAGGAATTATGATCTT |
| 342 | TGTGCAGAGGAATTATGATCTTT |
| 343 | GTGCAGAGGAATTATGATCTTTC |
| 344 | TGCAGAGGAATTATGATCTTTCC |
| 345 | GCAGAGGAATTATGATCTTTCCT |
| 346 | CAGAGGAATTATGATCTTTCCTT |
| 347 | AGAGGAATTATGATCTTTCCTTC |
| 348 | GAGGAATTATGATCTTTCCTTCT |

| ID | SEQUENCE |
|---|---|
| 349 | AGGAATTATGATCTTTCCTTCTT |
| 350 | GGAATTATGATCTTTCCTTCTTA |
| 351 | GAATTATGATCTTTCCTTCTTAA |
| 352 | AATTATGATCTTTCCTTCTTAAA |
| 353 | ATTATGATCTTTCCTTCTTAAAG |
| 354 | TTATGATCTTTCCTTCTTAAAGA |
| 355 | TATGATCTTTCCTTCTTAAAGAC |
| 356 | ATGATCTTTCCTTCTTAAAGACC |
| 357 | TGATCTTTCCTTCTTAAAGACCA |
| 358 | GATCTTTCCTTCTTAAAGACCAT |
| 359 | ATCTTTCCTTCTTAAAGACCATC |
| 360 | TCTTTCCTTCTTAAAGACCATCC |
| 361 | CTTTCCTTCTTAAAGACCATCCA |
| 362 | TTTCCTTCTTAAAGACCATCCAG |
| 363 | TTCCTTCTTAAAGACCATCCAGG |
| 364 | TCCTTCTTAAAGACCATCCAGGA |
| 365 | CCTTCTTAAAGACCATCCAGGAG |
| 366 | CTTCTTAAAGACCATCCAGGAGG |
| 367 | TTCTTAAAGACCATCCAGGAGGT |
| 368 | TCTTAAAGACCATCCAGGAGGTG |
| 369 | CTTAAAGACCATCCAGGAGGTGG |
| 370 | TTAAAGACCATCCAGGAGGTGGC |
| 371 | TAAAGACCATCCAGGAGGTGGCT |
| 372 | AAAGACCATCCAGGAGGTGGCTG |
| 373 | AAGACCATCCAGGAGGTGGCTGG |
| 374 | AGACCATCCAGGAGGTGGCTGGT |
| 375 | GACCATCCAGGAGGTGGCTGGTT |
| 376 | ACCATCCAGGAGGTGGCTGGTTA |
| 377 | CCATCCAGGAGGTGGCTGGTTAT |
| 378 | CATCCAGGAGGTGGCTGGTTATG |
| 379 | ATCCAGGAGGTGGCTGGTTATGT |
| 380 | TCCAGGAGGTGGCTGGTTATGTC |
| 381 | CCAGGAGGTGGCTGGTTATGTCC |
| 382 | CAGGAGGTGGCTGGTTATGTCCT |
| 383 | AGGAGGTGGCTGGTTATGTCCTC |
| 384 | GGAGGTGGCTGGTTATGTCCTCA |
| 385 | GAGGTGGCTGGTTATGTCCTCAT |
| 386 | AGGTGGCTGGTTATGTCCTCATT |
| 387 | GGTGGCTGGTTATGTCCTCATTG |
| 388 | GTGGCTGGTTATGTCCTCATTGC |
| 389 | TGGCTGGTTATGTCCTCATTGCC |
| 390 | GGCTGGTTATGTCCTCATTGCCC |
| 391 | GCTGGTTATGTCCTCATTGCCCT |
| 392 | CTGGTTATGTCCTCATTGCCCTC |
| 393 | TGGTTATGTCCTCATTGCCCTCA |
| 394 | GGTTATGTCCTCATTGCCCTCAA |
| 395 | GTTATGTCCTCATTGCCCTCAAC |
| 396 | TTATGTCCTCATTGCCCTCAACA |
| 397 | TATGTCCTCATTGCCCTCAACAC |
| 398 | ATGTCCTCATTGCCCTCAACACA |
| 399 | TGTCCTCATTGCCCTCAACACAG |
| 400 | GTCCTCATTGCCCTCAACACAGT |
| 401 | TCCTCATTGCCCTCAACACAGTG |
| 402 | CCTCATTGCCCTCAACACAGTGG |
| 403 | CTCATTGCCCTCAACACAGTGGA |
| 404 | TCATTGCCCTCAACACAGTGGAG |
| 405 | CATTGCCCTCAACACAGTGGAGC |
| 406 | ATTGCCCTCAACACAGTGGAGCG |

| ID | SEQUENCE |
|---|---|
| 407 | TTGCCCTCAACACAGTGGAGCGA |
| 408 | TGCCCTCAACACAGTGGAGCGAA |
| 409 | GCCCTCAACACAGTGGAGCGAAT |
| 410 | CCCTCAACACAGTGGAGCGAATT |
| 411 | CCTCAACACAGTGGAGCGAATTC |
| 412 | CTCAACACAGTGGAGCGAATTCC |
| 413 | TCAACACAGTGGAGCGAATTCCT |
| 414 | CAACACAGTGGAGCGAATTCCTT |
| 415 | AACACAGTGGAGCGAATTCCTTT |
| 416 | ACACAGTGGAGCGAATTCCTTTG |
| 417 | CACAGTGGAGCGAATTCCTTTGG |
| 418 | ACAGTGGAGCGAATTCCTTTGGA |
| 419 | CAGTGGAGCGAATTCCTTTGGAA |
| 420 | AGTGGAGCGAATTCCTTTGGAAA |
| 421 | GTGGAGCGAATTCCTTTGGAAAA |
| 422 | TGGAGCGAATTCCTTTGGAAAAC |
| 423 | GGAGCGAATTCCTTTGGAAAACC |
| 424 | GAGCGAATTCCTTTGGAAAACCT |
| 425 | AGCGAATTCCTTTGGAAAACCTG |
| 426 | GCGAATTCCTTTGGAAAACCTGC |
| 427 | CGAATTCCTTTGGAAAACCTGCA |
| 428 | GAATTCCTTTGGAAAACCTGCAG |
| 429 | AATTCCTTTGGAAAACCTGCAGA |
| 430 | ATTCCTTTGGAAAACCTGCAGAT |
| 431 | TTCCTTTGGAAAACCTGCAGATC |
| 432 | TCCTTTGGAAAACCTGCAGATCA |
| 433 | CCTTTGGAAAACCTGCAGATCAT |
| 434 | CTTTGGAAAACCTGCAGATCATC |
| 435 | TTTGGAAAACCTGCAGATCATCA |
| 436 | TTGGAAAACCTGCAGATCATCAG |
| 437 | TGGAAAACCTGCAGATCATCAGA |
| 438 | GGAAAACCTGCAGATCATCAGAG |
| 439 | GAAAACCTGCAGATCATCAGAGG |
| 440 | AAAACCTGCAGATCATCAGAGGA |
| 441 | AAACCTGCAGATCATCAGAGGAA |
| 442 | AACCTGCAGATCATCAGAGGAAA |
| 443 | ACCTGCAGATCATCAGAGGAAAT |
| 444 | CCTGCAGATCATCAGAGGAAATA |
| 445 | CTGCAGATCATCAGAGGAAATAT |
| 446 | TGCAGATCATCAGAGGAAATATG |
| 447 | GCAGATCATCAGAGGAAATATGT |
| 448 | CAGATCATCAGAGGAAATATGTA |
| 449 | AGATCATCAGAGGAAATATGTAC |
| 450 | GATCATCAGAGGAAATATGTACT |
| 451 | ATCATCAGAGGAAATATGTACTA |
| 452 | TCATCAGAGGAAATATGTACTAC |
| 453 | CATCAGAGGAAATATGTACTACG |
| 454 | ATCAGAGGAAATATGTACTACGA |
| 455 | TCAGAGGAAATATGTACTACGAA |
| 456 | CAGAGGAAATATGTACTACGAAA |
| 457 | AGAGGAAATATGTACTACGAAAA |
| 458 | GAGGAAATATGTACTACGAAAAT |
| 459 | AGGAAATATGTACTACGAAAATT |
| 460 | GGAAATATGTACTACGAAAATTC |
| 461 | GAAATATGTACTACGAAAATTCC |
| 462 | AAATATGTACTACGAAAATTCCT |
| 463 | AATATGTACTACGAAAATTCCTA |
| 464 | ATATGTACTACGAAAATTCCTAT |

| ID | SEQUENCE |
|---|---|
| 465 | TATGTACTACGAAAATTCCTATG |
| 466 | ATGTACTACGAAAATTCCTATGC |
| 467 | TGTACTACGAAAATTCCTATGCC |
| 468 | GTACTACGAAAATTCCTATGCCT |
| 469 | TACTACGAAAATTCCTATGCCTT |
| 470 | ACTACGAAAATTCCTATGCCTTA |
| 471 | CTACGAAAATTCCTATGCCTTAG |
| 472 | TACGAAAATTCCTATGCCTTAGC |
| 473 | ACGAAAATTCCTATGCCTTAGCA |
| 474 | CGAAAATTCCTATGCCTTAGCAG |
| 475 | GAAAATTCCTATGCCTTAGCAGT |
| 476 | AAAATTCCTATGCCTTAGCAGTC |
| 477 | AAATTCCTATGCCTTAGCAGTCT |
| 478 | AATTCCTATGCCTTAGCAGTCTT |
| 479 | ATTCCTATGCCTTAGCAGTCTTA |
| 480 | TTCCTATGCCTTAGCAGTCTTAT |
| 481 | TCCTATGCCTTAGCAGTCTTATC |
| 482 | CCTATGCCTTAGCAGTCTTATCT |
| 483 | CTATGCCTTAGCAGTCTTATCTA |
| 484 | TATGCCTTAGCAGTCTTATCTAA |
| 485 | ATGCCTTAGCAGTCTTATCTAAC |
| 486 | TGCCTTAGCAGTCTTATCTAACT |
| 487 | GCCTTAGCAGTCTTATCTAACTA |
| 488 | CCTTAGCAGTCTTATCTAACTAT |
| 489 | CTTAGCAGTCTTATCTAACTATG |
| 490 | TTAGCAGTCTTATCTAACTATGA |
| 491 | TAGCAGTCTTATCTAACTATGAT |
| 492 | AGCAGTCTTATCTAACTATGATG |
| 493 | GCAGTCTTATCTAACTATGATGC |
| 494 | CAGTCTTATCTAACTATGATGCA |
| 495 | AGTCTTATCTAACTATGATGCAA |
| 496 | GTCTTATCTAACTATGATGCAAA |
| 497 | TCTTATCTAACTATGATGCAAAT |
| 498 | CTTATCTAACTATGATGCAAATA |
| 499 | TTATCTAACTATGATGCAAATAA |
| 500 | TATCTAACTATGATGCAAATAAA |
| 501 | ATCTAACTATGATGCAAATAAAA |
| 502 | TCTAACTATGATGCAAATAAAAC |
| 503 | CTAACTATGATGCAAATAAAACC |
| 504 | TAACTATGATGCAAATAAAACCG |
| 505 | AACTATGATGCAAATAAAACCGG |
| 506 | ACTATGATGCAAATAAAACCGGA |
| 507 | CTATGATGCAAATAAAACCGGAC |
| 508 | TATGATGCAAATAAAACCGGACT |
| 509 | ATGATGCAAATAAAACCGGACTG |
| 510 | TGATGCAAATAAAACCGGACTGA |
| 511 | GATGCAAATAAAACCGGACTGAA |
| 512 | ATGCAAATAAAACCGGACTGAAG |
| 513 | TGCAAATAAAACCGGACTGAAGG |
| 514 | GCAAATAAAACCGGACTGAAGGA |
| 515 | CAAATAAAACCGGACTGAAGGAG |
| 516 | AAATAAAACCGGACTGAAGGAGC |
| 517 | AATAAAACCGGACTGAAGGAGCT |
| 518 | ATAAAACCGGACTGAAGGAGCTG |
| 519 | TAAAACCGGACTGAAGGAGCTGC |
| 520 | AAAACCGGACTGAAGGAGCTGCC |
| 521 | AAACCGGACTGAAGGAGCTGCCC |
| 522 | AACCGGACTGAAGGAGCTGCCCA |

| ID | SEQUENCE |
|---|---|
| 523 | ACCGGACTGAAGGAGCTGCCCAT |
| 524 | CCGGACTGAAGGAGCTGCCCATG |
| 525 | CGGACTGAAGGAGCTGCCCATGA |
| 526 | GGACTGAAGGAGCTGCCCATGAG |
| 527 | GACTGAAGGAGCTGCCCATGAGA |
| 528 | ACTGAAGGAGCTGCCCATGAGAA |
| 529 | CTGAAGGAGCTGCCCATGAGAAA |
| 530 | TGAAGGAGCTGCCCATGAGAAAT |
| 531 | GAAGGAGCTGCCCATGAGAAATT |
| 532 | AAGGAGCTGCCCATGAGAAATTT |
| 533 | AGGAGCTGCCCATGAGAAATTTA |
| 534 | GGAGCTGCCCATGAGAAATTTAC |
| 535 | GAGCTGCCCATGAGAAATTTACA |
| 536 | AGCTGCCCATGAGAAATTTACAG |
| 537 | GCTGCCCATGAGAAATTTACAGG |
| 538 | CTGCCCATGAGAAATTTACAGGA |
| 539 | TGCCCATGAGAAATTTACAGGAA |
| 540 | GCCCATGAGAAATTTACAGGAAA |
| 541 | CCCATGAGAAATTTACAGGAAAT |
| 542 | CCATGAGAAATTTACAGGAAATC |
| 543 | CATGAGAAATTTACAGGAAATCC |
| 544 | ATGAGAAATTTACAGGAAATCCT |
| 545 | TGAGAAATTTACAGGAAATCCTG |
| 546 | GAGAAATTTACAGGAAATCCTGC |
| 547 | AGAAATTTACAGGAAATCCTGCA |
| 548 | GAAATTTACAGGAAATCCTGCAT |
| 549 | AAATTTACAGGAAATCCTGCATG |
| 550 | AATTTACAGGAAATCCTGCATGG |
| 551 | ATTTACAGGAAATCCTGCATGGC |
| 552 | TTTACAGGAAATCCTGCATGGCG |
| 553 | TTACAGGAAATCCTGCATGGCGC |
| 554 | TACAGGAAATCCTGCATGGCGCC |
| 555 | ACAGGAAATCCTGCATGGCGCCG |
| 556 | CAGGAAATCCTGCATGGCGCCGT |
| 557 | AGGAAATCCTGCATGGCGCCGTG |
| 558 | GGAAATCCTGCATGGCGCCGTGC |
| 559 | GAAATCCTGCATGGCGCCGTGCG |
| 560 | AAATCCTGCATGGCGCCGTGCGG |
| 561 | AATCCTGCATGGCGCCGTGCGGT |
| 562 | ATCCTGCATGGCGCCGTGCGGTT |
| 563 | TCCTGCATGGCGCCGTGCGGTTC |
| 564 | CCTGCATGGCGCCGTGCGGTTCA |
| 565 | CTGCATGGCGCCGTGCGGTTCAG |
| 566 | TGCATGGCGCCGTGCGGTTCAGC |
| 567 | GCATGGCGCCGTGCGGTTCAGCA |
| 568 | CATGGCGCCGTGCGGTTCAGCAA |
| 569 | ATGGCGCCGTGCGGTTCAGCAAC |
| 570 | TGGCGCCGTGCGGTTCAGCAACA |
| 571 | GGCGCCGTGCGGTTCAGCAACAA |
| 572 | GCGCCGTGCGGTTCAGCAACAAC |
| 573 | CGCCGTGCGGTTCAGCAACAACC |
| 574 | GCCGTGCGGTTCAGCAACAACCC |
| 575 | CCGTGCGGTTCAGCAACAACCCT |
| 576 | CGTGCGGTTCAGCAACAACCCTG |
| 577 | GTGCGGTTCAGCAACAACCCTGC |
| 578 | TGCGGTTCAGCAACAACCCTGCC |
| 579 | GCGGTTCAGCAACAACCCTGCCC |
| 580 | CGGTTCAGCAACAACCCTGCCCT |

| ID | SEQUENCE |
|---|---|
| 581 | GGTTCAGCAACAACCCTGCCCTG |
| 582 | GTTCAGCAACAACCCTGCCCTGT |
| 583 | TTCAGCAACAACCCTGCCCTGTG |
| 584 | TCAGCAACAACCCTGCCCTGTGC |
| 585 | CAGCAACAACCCTGCCCTGTGCA |
| 586 | AGCAACAACCCTGCCCTGTGCAA |
| 587 | GCAACAACCCTGCCCTGTGCAAC |
| 588 | CAACAACCCTGCCCTGTGCAACG |
| 589 | AACAACCCTGCCCTGTGCAACGT |
| 590 | ACAACCCTGCCCTGTGCAACGTG |
| 591 | CAACCCTGCCCTGTGCAACGTGG |
| 592 | AACCCTGCCCTGTGCAACGTGGA |
| 593 | ACCCTGCCCTGTGCAACGTGGAG |
| 594 | CCCTGCCCTGTGCAACGTGGAGA |
| 595 | CCTGCCCTGTGCAACGTGGAGAG |
| 596 | CTGCCCTGTGCAACGTGGAGAGC |
| 597 | TGCCCTGTGCAACGTGGAGAGCA |
| 598 | GCCCTGTGCAACGTGGAGAGCAT |
| 599 | CCCTGTGCAACGTGGAGAGCATC |
| 600 | CCTGTGCAACGTGGAGAGCATCC |
| 601 | CTGTGCAACGTGGAGAGCATCCA |
| 602 | TGTGCAACGTGGAGAGCATCCAG |
| 603 | GTGCAACGTGGAGAGCATCCAGT |
| 604 | TGCAACGTGGAGAGCATCCAGTG |
| 605 | GCAACGTGGAGAGCATCCAGTGG |
| 606 | CAACGTGGAGAGCATCCAGTGGC |
| 607 | AACGTGGAGAGCATCCAGTGGCG |
| 608 | ACGTGGAGAGCATCCAGTGGCGG |
| 609 | CGTGGAGAGCATCCAGTGGCGGG |
| 610 | GTGGAGAGCATCCAGTGGCGGGA |
| 611 | TGGAGAGCATCCAGTGGCGGGAC |
| 612 | GGAGAGCATCCAGTGGCGGGACA |
| 613 | GAGAGCATCCAGTGGCGGGACAT |
| 614 | AGAGCATCCAGTGGCGGGACATA |
| 615 | GAGCATCCAGTGGCGGGACATAG |
| 616 | AGCATCCAGTGGCGGGACATAGT |
| 617 | GCATCCAGTGGCGGGACATAGTC |
| 618 | CATCCAGTGGCGGGACATAGTCA |
| 619 | ATCCAGTGGCGGGACATAGTCAG |
| 620 | TCCAGTGGCGGGACATAGTCAGC |
| 621 | CCAGTGGCGGGACATAGTCAGCA |
| 622 | CAGTGGCGGGACATAGTCAGCAG |
| 623 | AGTGGCGGGACATAGTCAGCAGT |
| 624 | GTGGCGGGACATAGTCAGCAGTG |
| 625 | TGGCGGGACATAGTCAGCAGTGA |
| 626 | GGCGGGACATAGTCAGCAGTGAC |
| 627 | GCGGGACATAGTCAGCAGTGACT |
| 628 | CGGGACATAGTCAGCAGTGACTT |
| 629 | GGGACATAGTCAGCAGTGACTTT |
| 630 | GGACATAGTCAGCAGTGACTTTC |
| 631 | GACATAGTCAGCAGTGACTTTCT |
| 632 | ACATAGTCAGCAGTGACTTTCTC |
| 633 | CATAGTCAGCAGTGACTTTCTCA |
| 634 | ATAGTCAGCAGTGACTTTCTCAG |
| 635 | TAGTCAGCAGTGACTTTCTCAGC |
| 636 | AGTCAGCAGTGACTTTCTCAGCA |
| 637 | GTCAGCAGTGACTTTCTCAGCAA |
| 638 | TCAGCAGTGACTTTCTCAGCAAC |

| ID | SEQUENCE |
|---|---|
| 639 | CAGCAGTGACTTTCTCAGCAACA |
| 640 | AGCAGTGACTTTCTCAGCAACAT |
| 641 | GCAGTGACTTTCTCAGCAACATG |
| 642 | CAGTGACTTTCTCAGCAACATGT |
| 643 | AGTGACTTTCTCAGCAACATGTC |
| 644 | GTGACTTTCTCAGCAACATGTCG |
| 645 | TGACTTTCTCAGCAACATGTCGA |
| 646 | GACTTTCTCAGCAACATGTCGAT |
| 647 | ACTTTCTCAGCAACATGTCGATG |
| 648 | CTTTCTCAGCAACATGTCGATGG |
| 649 | TTTCTCAGCAACATGTCGATGGA |
| 650 | TTCTCAGCAACATGTCGATGGAC |
| 651 | TCTCAGCAACATGTCGATGGACT |
| 652 | CTCAGCAACATGTCGATGGACTT |
| 653 | TCAGCAACATGTCGATGGACTTC |
| 654 | CAGCAACATGTCGATGGACTTCC |
| 655 | AGCAACATGTCGATGGACTTCCA |
| 656 | GCAACATGTCGATGGACTTCCAG |
| 657 | CAACATGTCGATGGACTTCCAGA |
| 658 | AACATGTCGATGGACTTCCAGAA |
| 659 | ACATGTCGATGGACTTCCAGAAC |
| 660 | CATGTCGATGGACTTCCAGAACC |
| 661 | ATGTCGATGGACTTCCAGAACCA |
| 662 | TGTCGATGGACTTCCAGAACCAC |
| 663 | GTCGATGGACTTCCAGAACCACC |
| 664 | TCGATGGACTTCCAGAACCACCT |
| 665 | CGATGGACTTCCAGAACCACCTG |
| 666 | GATGGACTTCCAGAACCACCTGG |
| 667 | ATGGACTTCCAGAACCACCTGGG |
| 668 | TGGACTTCCAGAACCACCTGGGC |
| 669 | GGACTTCCAGAACCACCTGGGCA |
| 670 | GACTTCCAGAACCACCTGGGCAG |
| 671 | ACTTCCAGAACCACCTGGGCAGC |
| 672 | CTTCCAGAACCACCTGGGCAGCT |
| 673 | TTCCAGAACCACCTGGGCAGCTG |
| 674 | TCCAGAACCACCTGGGCAGCTGC |
| 675 | CCAGAACCACCTGGGCAGCTGCC |
| 676 | CAGAACCACCTGGGCAGCTGCCA |
| 677 | AGAACCACCTGGGCAGCTGCCAA |
| 678 | GAACCACCTGGGCAGCTGCCAAA |
| 679 | AACCACCTGGGCAGCTGCCAAAA |
| 680 | ACCACCTGGGCAGCTGCCAAAAG |
| 681 | CCACCTGGGCAGCTGCCAAAAGT |
| 682 | CACCTGGGCAGCTGCCAAAAGTG |
| 683 | ACCTGGGCAGCTGCCAAAAGTGT |
| 684 | CCTGGGCAGCTGCCAAAAGTGTG |
| 685 | CTGGGCAGCTGCCAAAAGTGTGA |
| 686 | TGGGCAGCTGCCAAAAGTGTGAT |
| 687 | GGGCAGCTGCCAAAAGTGTGATC |
| 688 | GGCAGCTGCCAAAAGTGTGATCC |
| 689 | GCAGCTGCCAAAAGTGTGATCCA |
| 690 | CAGCTGCCAAAAGTGTGATCCAA |
| 691 | AGCTGCCAAAAGTGTGATCCAAG |
| 692 | GCTGCCAAAAGTGTGATCCAAGC |
| 693 | CTGCCAAAAGTGTGATCCAAGCT |
| 694 | TGCCAAAAGTGTGATCCAAGCTG |
| 695 | GCCAAAAGTGTGATCCAAGCTGT |
| 696 | CCAAAAGTGTGATCCAAGCTGTC |

| ID | SEQUENCE |
|---|---|
| 697 | CAAAAGTGTGATCCAAGCTGTCC |
| 698 | AAAAGTGTGATCCAAGCTGTCCC |
| 699 | AAAGTGTGATCCAAGCTGTCCCA |
| 700 | AAGTGTGATCCAAGCTGTCCCAA |
| 701 | AGTGTGATCCAAGCTGTCCCAAT |
| 702 | GTGTGATCCAAGCTGTCCCAATG |
| 703 | TGTGATCCAAGCTGTCCCAATGG |
| 704 | GTGATCCAAGCTGTCCCAATGGG |
| 705 | TGATCCAAGCTGTCCCAATGGGA |
| 706 | GATCCAAGCTGTCCCAATGGGAG |
| 707 | ATCCAAGCTGTCCCAATGGGAGC |
| 708 | TCCAAGCTGTCCCAATGGGAGCT |
| 709 | CCAAGCTGTCCCAATGGGAGCTG |
| 710 | CAAGCTGTCCCAATGGGAGCTGC |
| 711 | AAGCTGTCCCAATGGGAGCTGCT |
| 712 | AGCTGTCCCAATGGGAGCTGCTG |
| 713 | GCTGTCCCAATGGGAGCTGCTGG |
| 714 | CTGTCCCAATGGGAGCTGCTGGG |
| 715 | TGTCCCAATGGGAGCTGCTGGGG |
| 716 | GTCCCAATGGGAGCTGCTGGGGT |
| 717 | TCCCAATGGGAGCTGCTGGGGTG |
| 718 | CCCAATGGGAGCTGCTGGGGTGC |
| 719 | CCAATGGGAGCTGCTGGGGTGCA |
| 720 | CAATGGGAGCTGCTGGGGTGCAG |
| 721 | AATGGGAGCTGCTGGGGTGCAGG |
| 722 | ATGGGAGCTGCTGGGGTGCAGGA |
| 723 | TGGGAGCTGCTGGGGTGCAGGAG |
| 724 | GGGAGCTGCTGGGGTGCAGGAGA |
| 725 | GGAGCTGCTGGGGTGCAGGAGAG |
| 726 | GAGCTGCTGGGGTGCAGGAGAGG |
| 727 | AGCTGCTGGGGTGCAGGAGAGGA |
| 728 | GCTGCTGGGGTGCAGGAGAGGAG |
| 729 | CTGCTGGGGTGCAGGAGAGGAGA |
| 730 | TGCTGGGGTGCAGGAGAGGAGAA |
| 731 | GCTGGGGTGCAGGAGAGGAGAAC |
| 732 | CTGGGGTGCAGGAGAGGAGAACT |
| 733 | TGGGGTGCAGGAGAGGAGAACTG |
| 734 | GGGGTGCAGGAGAGGAGAACTGC |
| 735 | GGGTGCAGGAGAGGAGAACTGCC |
| 736 | GGTGCAGGAGAGGAGAACTGCCA |
| 737 | GTGCAGGAGAGGAGAACTGCCAG |
| 738 | TGCAGGAGAGGAGAACTGCCAGA |
| 739 | GCAGGAGAGGAGAACTGCCAGAA |
| 740 | CAGGAGAGGAGAACTGCCAGAAA |
| 741 | AGGAGAGGAGAACTGCCAGAAAC |
| 742 | GGAGAGGAGAACTGCCAGAAACT |
| 743 | GAGAGGAGAACTGCCAGAAACTG |
| 744 | AGAGGAGAACTGCCAGAAACTGA |
| 745 | GAGGAGAACTGCCAGAAACTGAC |
| 746 | AGGAGAACTGCCAGAAACTGACC |
| 747 | GGAGAACTGCCAGAAACTGACCA |
| 748 | GAGAACTGCCAGAAACTGACCAA |
| 749 | AGAACTGCCAGAAACTGACCAAA |
| 750 | GAACTGCCAGAAACTGACCAAAA |
| 751 | AACTGCCAGAAACTGACCAAAAT |
| 752 | ACTGCCAGAAACTGACCAAAATC |
| 753 | CTGCCAGAAACTGACCAAAATCA |
| 754 | TGCCAGAAACTGACCAAAATCAT |

| ID | SEQUENCE |
|---|---|
| 755 | GCCAGAAACTGACCAAAATCATC |
| 756 | CCAGAAACTGACCAAAATCATCT |
| 757 | CAGAAACTGACCAAAATCATCTG |
| 758 | AGAAACTGACCAAAATCATCTGT |
| 759 | GAAACTGACCAAAATCATCTGTG |
| 760 | AAACTGACCAAAATCATCTGTGC |
| 761 | AACTGACCAAAATCATCTGTGCC |
| 762 | ACTGACCAAAATCATCTGTGCCC |
| 763 | CTGACCAAAATCATCTGTGCCCA |
| 764 | TGACCAAAATCATCTGTGCCCAG |
| 765 | GACCAAAATCATCTGTGCCCAGC |
| 766 | ACCAAAATCATCTGTGCCCAGCA |
| 767 | CCAAAATCATCTGTGCCCAGCAG |
| 768 | CAAAATCATCTGTGCCCAGCAGT |
| 769 | AAAATCATCTGTGCCCAGCAGTG |
| 770 | AAATCATCTGTGCCCAGCAGTGC |
| 771 | AATCATCTGTGCCCAGCAGTGCT |
| 772 | ATCATCTGTGCCCAGCAGTGCTC |
| 773 | TCATCTGTGCCCAGCAGTGCTCC |
| 774 | CATCTGTGCCCAGCAGTGCTCCG |
| 775 | ATCTGTGCCCAGCAGTGCTCCGG |
| 776 | TCTGTGCCCAGCAGTGCTCCGGG |
| 777 | CTGTGCCCAGCAGTGCTCCGGGC |
| 778 | TGTGCCCAGCAGTGCTCCGGGCG |
| 779 | GTGCCCAGCAGTGCTCCGGGCGC |
| 780 | TGCCCAGCAGTGCTCCGGGCGCT |
| 781 | GCCCAGCAGTGCTCCGGGCGCTG |
| 782 | CCCAGCAGTGCTCCGGGCGCTGC |
| 783 | CCAGCAGTGCTCCGGGCGCTGCC |
| 784 | CAGCAGTGCTCCGGGCGCTGCCG |
| 785 | AGCAGTGCTCCGGGCGCTGCCGT |
| 786 | GCAGTGCTCCGGGCGCTGCCGTG |
| 787 | CAGTGCTCCGGGCGCTGCCGTGG |
| 788 | AGTGCTCCGGGCGCTGCCGTGGC |
| 789 | GTGCTCCGGGCGCTGCCGTGGCA |
| 790 | TGCTCCGGGCGCTGCCGTGGCAA |
| 791 | GCTCCGGGCGCTGCCGTGGCAAG |
| 792 | CTCCGGGCGCTGCCGTGGCAAGT |
| 793 | TCCGGGCGCTGCCGTGGCAAGTC |
| 794 | CCGGGCGCTGCCGTGGCAAGTCC |
| 795 | CGGGCGCTGCCGTGGCAAGTCCC |
| 796 | GGGCGCTGCCGTGGCAAGTCCCC |
| 797 | GGCGCTGCCGTGGCAAGTCCCCC |
| 798 | GCGCTGCCGTGGCAAGTCCCCCA |
| 799 | CGCTGCCGTGGCAAGTCCCCCAG |
| 800 | GCTGCCGTGGCAAGTCCCCCAGT |
| 801 | CTGCCGTGGCAAGTCCCCCAGTG |
| 802 | TGCCGTGGCAAGTCCCCCAGTGA |
| 803 | GCCGTGGCAAGTCCCCCAGTGAC |
| 804 | CCGTGGCAAGTCCCCCAGTGACT |
| 805 | CGTGGCAAGTCCCCCAGTGACTG |
| 806 | GTGGCAAGTCCCCCAGTGACTGC |
| 807 | TGGCAAGTCCCCCAGTGACTGCT |
| 808 | GGCAAGTCCCCCAGTGACTGCTG |
| 809 | GCAAGTCCCCCAGTGACTGCTGC |
| 810 | CAAGTCCCCCAGTGACTGCTGCC |
| 811 | AAGTCCCCCAGTGACTGCTGCCA |
| 812 | AGTCCCCCAGTGACTGCTGCCAC |

| ID | SEQUENCE |
|---|---|
| 813 | GTCCCCCAGTGACTGCTGCCACA |
| 814 | TCCCCCAGTGACTGCTGCCACAA |
| 815 | CCCCCAGTGACTGCTGCCACAAC |
| 816 | CCCCAGTGACTGCTGCCACAACC |
| 817 | CCCAGTGACTGCTGCCACAACCA |
| 818 | CCAGTGACTGCTGCCACAACCAG |
| 819 | CAGTGACTGCTGCCACAACCAGT |
| 820 | AGTGACTGCTGCCACAACCAGTG |
| 821 | GTGACTGCTGCCACAACCAGTGT |
| 822 | TGACTGCTGCCACAACCAGTGTG |
| 823 | GACTGCTGCCACAACCAGTGTGC |
| 824 | ACTGCTGCCACAACCAGTGTGCT |
| 825 | CTGCTGCCACAACCAGTGTGCTG |
| 826 | TGCTGCCACAACCAGTGTGCTGC |
| 827 | GCTGCCACAACCAGTGTGCTGCA |
| 828 | CTGCCACAACCAGTGTGCTGCAG |
| 829 | TGCCACAACCAGTGTGCTGCAGG |
| 830 | GCCACAACCAGTGTGCTGCAGGC |
| 831 | CCACAACCAGTGTGCTGCAGGCT |
| 832 | CACAACCAGTGTGCTGCAGGCTG |
| 833 | ACAACCAGTGTGCTGCAGGCTGC |
| 834 | CAACCAGTGTGCTGCAGGCTGCA |
| 835 | AACCAGTGTGCTGCAGGCTGCAC |
| 836 | ACCAGTGTGCTGCAGGCTGCACA |
| 837 | CCAGTGTGCTGCAGGCTGCACAG |
| 838 | CAGTGTGCTGCAGGCTGCACAGG |
| 839 | AGTGTGCTGCAGGCTGCACAGGC |
| 840 | GTGTGCTGCAGGCTGCACAGGCC |
| 841 | TGTGCTGCAGGCTGCACAGGCCC |
| 842 | GTGCTGCAGGCTGCACAGGCCCC |
| 843 | TGCTGCAGGCTGCACAGGCCCCC |
| 844 | GCTGCAGGCTGCACAGGCCCCCG |
| 845 | CCCCGGGAGAGCGACTGCCTGG |
| 846 | CCCCGGGAGAGCGACTGCCTGGT |
| 847 | CCCGGGAGAGCGACTGCCTGGTC |
| 848 | CCGGGAGAGCGACTGCCTGGTCT |
| 849 | CGGGAGAGCGACTGCCTGGTCTG |
| 850 | GGGAGAGCGACTGCCTGGTCTGC |
| 851 | GGAGAGCGACTGCCTGGTCTGCC |
| 852 | GAGAGCGACTGCCTGGTCTGCCG |
| 853 | AGAGCGACTGCCTGGTCTGCCGC |
| 854 | GAGCGACTGCCTGGTCTGCCGCA |
| 855 | AGCGACTGCCTGGTCTGCCGCAA |
| 856 | GCGACTGCCTGGTCTGCCGCAAA |
| 857 | CGACTGCCTGGTCTGCCGCAAAT |
| 858 | GACTGCCTGGTCTGCCGCAAATT |
| 859 | ACTGCCTGGTCTGCCGCAAATTC |
| 860 | CTGCCTGGTCTGCCGCAAATTCC |
| 861 | TGCCTGGTCTGCCGCAAATTCCG |
| 862 | GCCTGGTCTGCCGCAAATTCCGA |
| 863 | CCTGGTCTGCCGCAAATTCCGAG |
| 864 | CTGGTCTGCCGCAAATTCCGAGA |
| 865 | TGGTCTGCCGCAAATTCCGAGAC |
| 866 | GGTCTGCCGCAAATTCCGAGACG |
| 867 | GTCTGCCGCAAATTCCGAGACGA |
| 868 | TCTGCCGCAAATTCCGAGACGAA |
| 869 | CTGCCGCAAATTCCGAGACGAAG |
| 870 | TGCCGCAAATTCCGAGACGAAGC |

| ID | SEQUENCE |
|---|---|
| 871 | GCCGCAAATTCCGAGACGAAGCC |
| 872 | CCGCAAATTCCGAGACGAAGCCA |
| 873 | CGCAAATTCCGAGACGAAGCCAC |
| 874 | GCAAATTCCGAGACGAAGCCACG |
| 875 | CAAATTCCGAGACGAAGCCACGT |
| 876 | AAATTCCGAGACGAAGCCACGTG |
| 877 | AATTCCGAGACGAAGCCACGTGC |
| 878 | ATTCCGAGACGAAGCCACGTGCA |
| 879 | TTCCGAGACGAAGCCACGTGCAA |
| 880 | TCCGAGACGAAGCCACGTGCAAG |
| 881 | CCGAGACGAAGCCACGTGCAAGG |
| 882 | CGAGACGAAGCCACGTGCAAGGA |
| 883 | GAGACGAAGCCACGTGCAAGGAC |
| 884 | AGACGAAGCCACGTGCAAGGACA |
| 885 | GACGAAGCCACGTGCAAGGACAC |
| 886 | ACGAAGCCACGTGCAAGGACACC |
| 887 | CGAAGCCACGTGCAAGGACACCT |
| 888 | GAAGCCACGTGCAAGGACACCTG |
| 889 | AAGCCACGTGCAAGGACACCTGC |
| 890 | AGCCACGTGCAAGGACACCTGCC |
| 891 | GCCACGTGCAAGGACACCTGCCC |
| 892 | CCACGTGCAAGGACACCTGCCCC |
| 893 | CACGTGCAAGGACACCTGCCCCC |
| 894 | ACGTGCAAGGACACCTGCCCCCC |
| 895 | CGTGCAAGGACACCTGCCCCCCA |
| 896 | GTGCAAGGACACCTGCCCCCCAC |
| 897 | TGCAAGGACACCTGCCCCCCACT |
| 898 | GCAAGGACACCTGCCCCCCACTC |
| 899 | CAAGGACACCTGCCCCCCACTCA |
| 900 | AAGGACACCTGCCCCCCACTCAT |
| 901 | AGGACACCTGCCCCCCACTCATG |
| 902 | GGACACCTGCCCCCCACTCATGC |
| 903 | GACACCTGCCCCCCACTCATGCT |
| 904 | ACACCTGCCCCCCACTCATGCTC |
| 905 | CACCTGCCCCCCACTCATGCTCT |
| 906 | ACCTGCCCCCCACTCATGCTCTA |
| 907 | CCTGCCCCCCACTCATGCTCTAC |
| 908 | CTGCCCCCCACTCATGCTCTACA |
| 909 | TGCCCCCCACTCATGCTCTACAA |
| 910 | GCCCCCCACTCATGCTCTACAAC |
| 911 | CCCCCCACTCATGCTCTACAACC |
| 912 | CCCCCACTCATGCTCTACAACCC |
| 913 | CCCCACTCATGCTCTACAACCCC |
| 914 | CCCACTCATGCTCTACAACCCCA |
| 915 | CCACTCATGCTCTACAACCCCAC |
| 916 | CACTCATGCTCTACAACCCCACC |
| 917 | ACTCATGCTCTACAACCCCACCA |
| 918 | CTCATGCTCTACAACCCCACCAC |
| 919 | TCATGCTCTACAACCCCACCACG |
| 920 | CATGCTCTACAACCCCACCACGT |
| 921 | ATGCTCTACAACCCCACCACGTA |
| 922 | TGCTCTACAACCCCACCACGTAC |
| 923 | GCTCTACAACCCCACCACGTACC |
| 924 | CTCTACAACCCCACCACGTACCA |
| 925 | TCTACAACCCCACCACGTACCAG |
| 926 | CTACAACCCCACCACGTACCAGA |
| 927 | TACAACCCCACCACGTACCAGAT |
| 928 | ACAACCCCACCACGTACCAGATG |

| ID | SEQUENCE |
|---|---|
| 929 | CAACCCCACCACGTACCAGATGG |
| 930 | AACCCCACCACGTACCAGATGGA |
| 931 | ACCCCACCACGTACCAGATGGAT |
| 932 | CCCCACCACGTACCAGATGGATG |
| 933 | CCCACCACGTACCAGATGGATGT |
| 934 | CCACCACGTACCAGATGGATGTG |
| 935 | CACCACGTACCAGATGGATGTGA |
| 936 | ACCACGTACCAGATGGATGTGAA |
| 937 | CCACGTACCAGATGGATGTGAAC |
| 938 | CACGTACCAGATGGATGTGAACC |
| 939 | ACGTACCAGATGGATGTGAACCC |
| 940 | CGTACCAGATGGATGTGAACCCC |
| 941 | GTACCAGATGGATGTGAACCCCG |
| 942 | TACCAGATGGATGTGAACCCCGA |
| 943 | ACCAGATGGATGTGAACCCCGAG |
| 944 | CCAGATGGATGTGAACCCCGAGG |
| 945 | CAGATGGATGTGAACCCCGAGGG |
| 946 | AGATGGATGTGAACCCCGAGGGC |
| 947 | GATGGATGTGAACCCCGAGGGCA |
| 948 | ATGGATGTGAACCCCGAGGGCAA |
| 949 | TGGATGTGAACCCCGAGGGCAAA |
| 950 | GGATGTGAACCCCGAGGGCAAAT |
| 951 | GATGTGAACCCCGAGGGCAAATA |
| 952 | ATGTGAACCCCGAGGGCAAATAC |
| 953 | TGTGAACCCCGAGGGCAAATACA |
| 954 | GTGAACCCCGAGGGCAAATACAG |
| 955 | TGAACCCCGAGGGCAAATACAGC |
| 956 | GAACCCCGAGGGCAAATACAGCT |
| 957 | AACCCCGAGGGCAAATACAGCTT |
| 958 | ACCCCGAGGGCAAATACAGCTTT |
| 959 | CCCCGAGGGCAAATACAGCTTTG |
| 960 | CCCGAGGGCAAATACAGCTTTGG |
| 961 | CCGAGGGCAAATACAGCTTTGGT |
| 962 | CGAGGGCAAATACAGCTTTGGTG |
| 963 | GAGGGCAAATACAGCTTTGGTGC |
| 964 | AGGGCAAATACAGCTTTGGTGCC |
| 965 | GGGCAAATACAGCTTTGGTGCCA |
| 966 | GGCAAATACAGCTTTGGTGCCAC |
| 967 | GCAAATACAGCTTTGGTGCCACC |
| 968 | CAAATACAGCTTTGGTGCCACCT |
| 969 | AAATACAGCTTTGGTGCCACCTG |
| 970 | AATACAGCTTTGGTGCCACCTGC |
| 971 | ATACAGCTTTGGTGCCACCTGCG |
| 972 | TACAGCTTTGGTGCCACCTGCGT |
| 973 | ACAGCTTTGGTGCCACCTGCGTG |
| 974 | CAGCTTTGGTGCCACCTGCGTGA |
| 975 | AGCTTTGGTGCCACCTGCGTGAA |
| 976 | GCTTTGGTGCCACCTGCGTGAAG |
| 977 | CTTTGGTGCCACCTGCGTGAAGA |
| 978 | TTTGGTGCCACCTGCGTGAAGAA |
| 979 | TTGGTGCCACCTGCGTGAAGAAG |
| 980 | TGGTGCCACCTGCGTGAAGAAGT |
| 981 | GGTGCCACCTGCGTGAAGAAGTG |
| 982 | GTGCCACCTGCGTGAAGAAGTGT |
| 983 | TGCCACCTGCGTGAAGAAGTGTC |
| 984 | GCCACCTGCGTGAAGAAGTGTCC |
| 985 | CCACCTGCGTGAAGAAGTGTCCC |
| 986 | CACCTGCGTGAAGAAGTGTCCCC |

| ID | SEQUENCE |
|---|---|
| 987 | ACCTGCGTGAAGAAGTGTCCCCG |
| 988 | CCTGCGTGAAGAAGTGTCCCCGT |
| 989 | CTGCGTGAAGAAGTGTCCCCGTA |
| 990 | TGCGTGAAGAAGTGTCCCCGTAA |
| 991 | GCGTGAAGAAGTGTCCCCGTAAT |
| 992 | CGTGAAGAAGTGTCCCCGTAATT |
| 993 | GTGAAGAAGTGTCCCCGTAATTA |
| 994 | TGAAGAAGTGTCCCCGTAATTAT |
| 995 | GAAGAAGTGTCCCCGTAATTATG |
| 996 | AAGAAGTGTCCCCGTAATTATGT |
| 997 | AGAAGTGTCCCCGTAATTATGTG |
| 998 | GAAGTGTCCCCGTAATTATGTGG |
| 999 | AAGTGTCCCCGTAATTATGTGGT |
| 1000 | AGTGTCCCCGTAATTATGTGGTG |
| 1001 | GTGTCCCCGTAATTATGTGGTGA |
| 1002 | TGTCCCCGTAATTATGTGGTGAC |
| 1003 | GTCCCCGTAATTATGTGGTGACA |
| 1004 | TCCCCGTAATTATGTGGTGACAG |
| 1005 | CCCCGTAATTATGTGGTGACAGA |
| 1006 | CCCGTAATTATGTGGTGACAGAT |
| 1007 | CCGTAATTATGTGGTGACAGATC |
| 1008 | CGTAATTATGTGGTGACAGATCA |
| 1009 | GTAATTATGTGGTGACAGATCAC |
| 1010 | TAATTATGTGGTGACAGATCACG |
| 1011 | AATTATGTGGTGACAGATCACGG |
| 1012 | ATTATGTGGTGACAGATCACGGC |
| 1013 | TTATGTGGTGACAGATCACGGCT |
| 1014 | TATGTGGTGACAGATCACGGCTC |
| 1015 | ATGTGGTGACAGATCACGGCTCG |
| 1016 | TGTGGTGACAGATCACGGCTCGT |
| 1017 | GTGGTGACAGATCACGGCTCGTG |
| 1018 | TGGTGACAGATCACGGCTCGTGC |
| 1019 | GGTGACAGATCACGGCTCGTGCG |
| 1020 | GTGACAGATCACGGCTCGTGCGT |
| 1021 | TGACAGATCACGGCTCGTGCGTC |
| 1022 | GACAGATCACGGCTCGTGCGTCC |
| 1023 | ACAGATCACGGCTCGTGCGTCCG |
| 1024 | CAGATCACGGCTCGTGCGTCCGA |
| 1025 | AGATCACGGCTCGTGCGTCCGAG |
| 1026 | GATCACGGCTCGTGCGTCCGAGC |
| 1027 | ATCACGGCTCGTGCGTCCGAGCC |
| 1028 | TCACGGCTCGTGCGTCCGAGCCT |
| 1029 | CACGGCTCGTGCGTCCGAGCCTG |
| 1030 | ACGGCTCGTGCGTCCGAGCCTGT |
| 1031 | CGGCTCGTGCGTCCGAGCCTGTG |
| 1032 | GGCTCGTGCGTCCGAGCCTGTGG |
| 1033 | GCTCGTGCGTCCGAGCCTGTGGG |
| 1034 | CTCGTGCGTCCGAGCCTGTGGGG |
| 1035 | TCGTGCGTCCGAGCCTGTGGGGC |
| 1036 | CGTGCGTCCGAGCCTGTGGGGCC |
| 1037 | GTGCGTCCGAGCCTGTGGGGCCG |
| 1038 | TGCGTCCGAGCCTGTGGGGCCGA |
| 1039 | GCGTCCGAGCCTGTGGGGCCGAC |
| 1040 | CGTCCGAGCCTGTGGGGCCGACA |
| 1041 | GTCCGAGCCTGTGGGGCCGACAG |
| 1042 | TCCGAGCCTGTGGGGCCGACAGC |
| 1043 | CCGAGCCTGTGGGGCCGACAGCT |
| 1044 | CGAGCCTGTGGGGCCGACAGCTA |

| ID | SEQUENCE |
|---|---|
| 1045 | GAGCCTGTGGGGCCGACAGCTAT |
| 1046 | AGCCTGTGGGGCCGACAGCTATG |
| 1047 | GCCTGTGGGGCCGACAGCTATGA |
| 1048 | CCTGTGGGGCCGACAGCTATGAG |
| 1049 | CTGTGGGGCCGACAGCTATGAGA |
| 1050 | TGTGGGGCCGACAGCTATGAGAT |
| 1051 | GTGGGGCCGACAGCTATGAGATG |
| 1052 | TGGGGCCGACAGCTATGAGATGG |
| 1053 | GGGGCCGACAGCTATGAGATGGA |
| 1054 | GGGCCGACAGCTATGAGATGGAG |
| 1055 | GGCCGACAGCTATGAGATGGAGG |
| 1056 | GCCGACAGCTATGAGATGGAGGA |
| 1057 | CCGACAGCTATGAGATGGAGGAA |
| 1058 | CGACAGCTATGAGATGGAGGAAG |
| 1059 | GACAGCTATGAGATGGAGGAAGA |
| 1060 | ACAGCTATGAGATGGAGGAAGAC |
| 1061 | CAGCTATGAGATGGAGGAAGACG |
| 1062 | AGCTATGAGATGGAGGAAGACGG |
| 1063 | GCTATGAGATGGAGGAAGACGGC |
| 1064 | CTATGAGATGGAGGAAGACGGCG |
| 1065 | TATGAGATGGAGGAAGACGGCGT |
| 1066 | ATGAGATGGAGGAAGACGGCGTC |
| 1067 | TGAGATGGAGGAAGACGGCGTCC |
| 1068 | GAGATGGAGGAAGACGGCGTCCG |
| 1069 | AGATGGAGGAAGACGGCGTCCGC |
| 1070 | GATGGAGGAAGACGGCGTCCGCA |
| 1071 | ATGGAGGAAGACGGCGTCCGCAA |
| 1072 | TGGAGGAAGACGGCGTCCGCAAG |
| 1073 | GGAGGAAGACGGCGTCCGCAAGT |
| 1074 | GAGGAAGACGGCGTCCGCAAGTG |
| 1075 | AGGAAGACGGCGTCCGCAAGTGT |
| 1076 | GGAAGACGGCGTCCGCAAGTGTA |
| 1077 | GAAGACGGCGTCCGCAAGTGTAA |
| 1078 | AAGACGGCGTCCGCAAGTGTAAG |
| 1079 | AGACGGCGTCCGCAAGTGTAAGA |
| 1080 | GACGGCGTCCGCAAGTGTAAGAA |
| 1081 | ACGGCGTCCGCAAGTGTAAGAAG |
| 1082 | CGGCGTCCGCAAGTGTAAGAAGT |
| 1083 | GGCGTCCGCAAGTGTAAGAAGTG |
| 1084 | GCGTCCGCAAGTGTAAGAAGTGC |
| 1085 | CGTCCGCAAGTGTAAGAAGTGCG |
| 1086 | GTCCGCAAGTGTAAGAAGTGCGA |
| 1087 | TCCGCAAGTGTAAGAAGTGCGAA |
| 1088 | CCGCAAGTGTAAGAAGTGCGAAG |
| 1089 | CGCAAGTGTAAGAAGTGCGAAGG |
| 1090 | GCAAGTGTAAGAAGTGCGAAGGG |
| 1091 | CAAGTGTAAGAAGTGCGAAGGGC |
| 1092 | AAGTGTAAGAAGTGCGAAGGGCC |
| 1093 | AGTGTAAGAAGTGCGAAGGGCCT |
| 1094 | GTGTAAGAAGTGCGAAGGGCCTT |
| 1095 | TGTAAGAAGTGCGAAGGGCCTTG |
| 1096 | GTAAGAAGTGCGAAGGGCCTTGC |
| 1097 | TAAGAAGTGCGAAGGGCCTTGCC |
| 1098 | AAGAAGTGCGAAGGGCCTTGCCG |
| 1099 | AGAAGTGCGAAGGGCCTTGCCGC |
| 1100 | GAAGTGCGAAGGGCCTTGCCGCA |
| 1101 | AAGTGCGAAGGGCCTTGCCGCAA |
| 1102 | AGTGCGAAGGGCCTTGCCGCAAA |

| ID | SEQUENCE |
|---|---|
| 1103 | GTGCGAAGGGCCTTGCCGCAAAG |
| 1104 | TGCGAAGGGCCTTGCCGCAAAGT |
| 1105 | GCGAAGGGCCTTGCCGCAAAGTG |
| 1106 | CGAAGGGCCTTGCCGCAAAGTGT |
| 1107 | GAAGGGCCTTGCCGCAAAGTGTG |
| 1108 | AAGGGCCTTGCCGCAAAGTGTGT |
| 1109 | AGGGCCTTGCCGCAAAGTGTGTA |
| 1110 | GGGCCTTGCCGCAAAGTGTGTAA |
| 1111 | GGCCTTGCCGCAAAGTGTGTAAC |
| 1112 | GCCTTGCCGCAAAGTGTGTAACG |
| 1113 | CCTTGCCGCAAAGTGTGTAACGG |
| 1114 | CTTGCCGCAAAGTGTGTAACGGA |
| 1115 | TTGCCGCAAAGTGTGTAACGGAA |
| 1116 | TGCCGCAAAGTGTGTAACGGAAT |
| 1117 | GCCGCAAAGTGTGTAACGGAATA |
| 1118 | CCGCAAAGTGTGTAACGGAATAG |
| 1119 | CGCAAAGTGTGTAACGGAATAGG |
| 1120 | GCAAAGTGTGTAACGGAATAGGT |
| 1121 | CAAAGTGTGTAACGGAATAGGTA |
| 1122 | AAAGTGTGTAACGGAATAGGTAT |
| 1123 | AAGTGTGTAACGGAATAGGTATT |
| 1124 | AGTGTGTAACGGAATAGGTATTG |
| 1125 | GTGTGTAACGGAATAGGTATTGG |
| 1126 | TGTGTAACGGAATAGGTATTGGT |
| 1127 | GTGTAACGGAATAGGTATTGGTG |
| 1128 | TGTAACGGAATAGGTATTGGTGA |
| 1129 | GTAACGGAATAGGTATTGGTGAA |
| 1130 | TAACGGAATAGGTATTGGTGAAT |
| 1131 | AACGGAATAGGTATTGGTGAATT |
| 1132 | ACGGAATAGGTATTGGTGAATTT |
| 1133 | CGGAATAGGTATTGGTGAATTTA |
| 1134 | GGAATAGGTATTGGTGAATTTAA |
| 1135 | GAATAGGTATTGGTGAATTTAAA |
| 1136 | AATAGGTATTGGTGAATTTAAAG |
| 1137 | ATAGGTATTGGTGAATTTAAAGA |
| 1138 | TAGGTATTGGTGAATTTAAAGAC |
| 1139 | AGGTATTGGTGAATTTAAAGACT |
| 1140 | GGTATTGGTGAATTTAAAGACTC |
| 1141 | GTATTGGTGAATTTAAAGACTCA |
| 1142 | TATTGGTGAATTTAAAGACTCAC |
| 1143 | ATTGGTGAATTTAAAGACTCACT |
| 1144 | TTGGTGAATTTAAAGACTCACTC |
| 1145 | TGGTGAATTTAAAGACTCACTCT |
| 1146 | GGTGAATTTAAAGACTCACTCTC |
| 1147 | GTGAATTTAAAGACTCACTCTCC |
| 1148 | TGAATTTAAAGACTCACTCTCCA |
| 1149 | GAATTTAAAGACTCACTCTCCAT |
| 1150 | AATTTAAAGACTCACTCTCCATA |
| 1151 | ATTTAAAGACTCACTCTCCATAA |
| 1152 | TTTAAAGACTCACTCTCCATAAA |
| 1153 | TTAAAGACTCACTCTCCATAAAT |
| 1154 | TAAAGACTCACTCTCCATAAATG |
| 1155 | AAAGACTCACTCTCCATAAATGC |
| 1156 | AAGACTCACTCTCCATAAATGCT |
| 1157 | AGACTCACTCTCCATAAATGCTA |
| 1158 | GACTCACTCTCCATAAATGCTAC |
| 1159 | ACTCACTCTCCATAAATGCTACG |
| 1160 | CTCACTCTCCATAAATGCTACGA |

| ID | SEQUENCE |
|---|---|
| 1161 | TCACTCTCCATAAATGCTACGAA |
| 1162 | CACTCTCCATAAATGCTACGAAT |
| 1163 | ACTCTCCATAAATGCTACGAATA |
| 1164 | CTCTCCATAAATGCTACGAATAT |
| 1165 | TCTCCATAAATGCTACGAATATT |
| 1166 | CTCCATAAATGCTACGAATATTA |
| 1167 | TCCATAAATGCTACGAATATTAA |
| 1168 | CCATAAATGCTACGAATATTAAA |
| 1169 | CATAAATGCTACGAATATTAAAC |
| 1170 | ATAAATGCTACGAATATTAAACA |
| 1171 | TAAATGCTACGAATATTAAACAC |
| 1172 | AAATGCTACGAATATTAAACACT |
| 1173 | AATGCTACGAATATTAAACACTT |
| 1174 | ATGCTACGAATATTAAACACTTC |
| 1175 | TGCTACGAATATTAAACACTTCA |
| 1176 | GCTACGAATATTAAACACTTCAA |
| 1177 | CTACGAATATTAAACACTTCAAA |
| 1178 | TACGAATATTAAACACTTCAAAA |
| 1179 | ACGAATATTAAACACTTCAAAAA |
| 1180 | CGAATATTAAACACTTCAAAAAC |
| 1181 | GAATATTAAACACTTCAAAAACT |
| 1182 | AATATTAAACACTTCAAAAACTG |
| 1183 | ATATTAAACACTTCAAAAACTGC |
| 1184 | TATTAAACACTTCAAAAACTGCA |
| 1185 | ATTAAACACTTCAAAAACTGCAC |
| 1186 | TTAAACACTTCAAAAACTGCACC |
| 1187 | TAAACACTTCAAAAACTGCACCT |
| 1188 | AAACACTTCAAAAACTGCACCTC |
| 1189 | AACACTTCAAAAACTGCACCTCC |
| 1190 | ACACTTCAAAAACTGCACCTCCA |
| 1191 | CACTTCAAAAACTGCACCTCCAT |
| 1192 | ACTTCAAAAACTGCACCTCCATC |
| 1193 | CTTCAAAAACTGCACCTCCATCA |
| 1194 | TTCAAAAACTGCACCTCCATCAG |
| 1195 | TCAAAAACTGCACCTCCATCAGT |
| 1196 | CAAAAACTGCACCTCCATCAGTG |
| 1197 | AAAAACTGCACCTCCATCAGTGG |
| 1198 | AAAACTGCACCTCCATCAGTGGC |
| 1199 | AAACTGCACCTCCATCAGTGGCG |
| 1200 | AACTGCACCTCCATCAGTGGCGA |
| 1201 | ACTGCACCTCCATCAGTGGCGAT |
| 1202 | CTGCACCTCCATCAGTGGCGATC |
| 1203 | TGCACCTCCATCAGTGGCGATCT |
| 1204 | GCACCTCCATCAGTGGCGATCTC |
| 1205 | CACCTCCATCAGTGGCGATCTCC |
| 1206 | ACCTCCATCAGTGGCGATCTCCA |
| 1207 | CCTCCATCAGTGGCGATCTCCAC |
| 1208 | CTCCATCAGTGGCGATCTCCACA |
| 1209 | TCCATCAGTGGCGATCTCCACAT |
| 1210 | CCATCAGTGGCGATCTCCACATC |
| 1211 | CATCAGTGGCGATCTCCACATCC |
| 1212 | ATCAGTGGCGATCTCCACATCCT |
| 1213 | TCAGTGGCGATCTCCACATCCTG |
| 1214 | CAGTGGCGATCTCCACATCCTGC |
| 1215 | AGTGGCGATCTCCACATCCTGCC |
| 1216 | GTGGCGATCTCCACATCCTGCCG |
| 1217 | TGGCGATCTCCACATCCTGCCGG |
| 1218 | GGCGATCTCCACATCCTGCCGGT |

| ID | SEQUENCE |
|---|---|
| 1219 | GCGATCTCCACATCCTGCCGGTG |
| 1220 | CGATCTCCACATCCTGCCGGTGG |
| 1221 | GATCTCCACATCCTGCCGGTGGC |
| 1222 | ATCTCCACATCCTGCCGGTGGCA |
| 1223 | TCTCCACATCCTGCCGGTGGCAT |
| 1224 | CTCCACATCCTGCCGGTGGCATT |
| 1225 | TCCACATCCTGCCGGTGGCATTT |
| 1226 | CCACATCCTGCCGGTGGCATTTA |
| 1227 | CACATCCTGCCGGTGGCATTTAG |
| 1228 | ACATCCTGCCGGTGGCATTTAGG |
| 1229 | CATCCTGCCGGTGGCATTTAGGG |
| 1230 | ATCCTGCCGGTGGCATTTAGGGG |
| 1231 | TCCTGCCGGTGGCATTTAGGGGT |
| 1232 | CCTGCCGGTGGCATTTAGGGGTG |
| 1233 | CTGCCGGTGGCATTTAGGGGTGA |
| 1234 | TGCCGGTGGCATTTAGGGGTGAC |
| 1235 | GCCGGTGGCATTTAGGGGTGACT |
| 1236 | CCGGTGGCATTTAGGGGTGACTC |
| 1237 | CGGTGGCATTTAGGGGTGACTCC |
| 1238 | GGTGGCATTTAGGGGTGACTCCT |
| 1239 | GTGGCATTTAGGGGTGACTCCTT |
| 1240 | TGGCATTTAGGGGTGACTCCTTC |
| 1241 | GGCATTTAGGGGTGACTCCTTCA |
| 1242 | GCATTTAGGGGTGACTCCTTCAC |
| 1243 | CATTTAGGGGTGACTCCTTCACA |
| 1244 | ATTTAGGGGTGACTCCTTCACAC |
| 1245 | TTTAGGGGTGACTCCTTCACACA |
| 1246 | TTAGGGGTGACTCCTTCACACAT |
| 1247 | TAGGGGTGACTCCTTCACACATA |
| 1248 | AGGGGTGACTCCTTCACACATAC |
| 1249 | GGGGTGACTCCTTCACACATACT |
| 1250 | GGGTGACTCCTTCACACATACTC |
| 1251 | GGTGACTCCTTCACACATACTCC |
| 1252 | GTGACTCCTTCACACATACTCCT |
| 1253 | TGACTCCTTCACACATACTCCTC |
| 1254 | GACTCCTTCACACATACTCCTCC |
| 1255 | ACTCCTTCACACATACTCCTCCT |
| 1256 | CTCCTTCACACATACTCCTCCTC |
| 1257 | TCCTTCACACATACTCCTCCTCT |
| 1258 | CCTTCACACATACTCCTCCTCTG |
| 1259 | CTTCACACATACTCCTCCTCTGG |
| 1260 | TTCACACATACTCCTCCTCTGGA |
| 1261 | TCACACATACTCCTCCTCTGGAT |
| 1262 | CACACATACTCCTCCTCTGGATC |
| 1263 | ACACATACTCCTCCTCTGGATCC |
| 1264 | CACATACTCCTCCTCTGGATCCA |
| 1265 | ACATACTCCTCCTCTGGATCCAC |
| 1266 | CATACTCCTCCTCTGGATCCACA |
| 1267 | ATACTCCTCCTCTGGATCCACAG |
| 1268 | TACTCCTCCTCTGGATCCACAGG |
| 1269 | ACTCCTCCTCTGGATCCACAGGA |
| 1270 | CTCCTCCTCTGGATCCACAGGAA |
| 1271 | TCCTCCTCTGGATCCACAGGAAC |
| 1272 | CCTCCTCTGGATCCACAGGAACT |
| 1273 | CTCCTCTGGATCCACAGGAACTG |
| 1274 | TCCTCTGGATCCACAGGAACTGG |
| 1275 | CCTCTGGATCCACAGGAACTGGA |
| 1276 | CTCTGGATCCACAGGAACTGGAT |

| ID | SEQUENCE |
|---|---|
| 1277 | TCTGGATCCACAGGAACTGGATA |
| 1278 | CTGGATCCACAGGAACTGGATAT |
| 1279 | TGGATCCACAGGAACTGGATATT |
| 1280 | GGATCCACAGGAACTGGATATTC |
| 1281 | GATCCACAGGAACTGGATATTCT |
| 1282 | ATCCACAGGAACTGGATATTCTG |
| 1283 | TCCACAGGAACTGGATATTCTGA |
| 1284 | CCACAGGAACTGGATATTCTGAA |
| 1285 | CACAGGAACTGGATATTCTGAAA |
| 1286 | ACAGGAACTGGATATTCTGAAAA |
| 1287 | CAGGAACTGGATATTCTGAAAAC |
| 1288 | AGGAACTGGATATTCTGAAAACC |
| 1289 | GGAACTGGATATTCTGAAAACCG |
| 1290 | GAACTGGATATTCTGAAAACCGT |
| 1291 | AACTGGATATTCTGAAAACCGTA |
| 1292 | ACTGGATATTCTGAAAACCGTAA |
| 1293 | CTGGATATTCTGAAAACCGTAAA |
| 1294 | TGGATATTCTGAAAACCGTAAAG |
| 1295 | GGATATTCTGAAAACCGTAAAGG |
| 1296 | GATATTCTGAAAACCGTAAAGGA |
| 1297 | ATATTCTGAAAACCGTAAAGGAA |
| 1298 | TATTCTGAAAACCGTAAAGGAAA |
| 1299 | ATTCTGAAAACCGTAAAGGAAAT |
| 1300 | TTCTGAAAACCGTAAAGGAAATC |
| 1301 | TCTGAAAACCGTAAAGGAAATCA |
| 1302 | CTGAAAACCGTAAAGGAAATCAC |
| 1303 | TGAAAACCGTAAAGGAAATCACA |
| 1304 | GAAAACCGTAAAGGAAATCACAG |
| 1305 | AAAACCGTAAAGGAAATCACAGG |
| 1306 | AAACCGTAAAGGAAATCACAGGG |
| 1307 | AACCGTAAAGGAAATCACAGGGT |
| 1308 | ACCGTAAAGGAAATCACAGGGTT |
| 1309 | CCGTAAAGGAAATCACAGGGTTT |
| 1310 | CGTAAAGGAAATCACAGGGTTTT |
| 1311 | GTAAAGGAAATCACAGGGTTTTT |
| 1312 | TAAAGGAAATCACAGGGTTTTTG |
| 1313 | AAAGGAAATCACAGGGTTTTTGC |
| 1314 | AAGGAAATCACAGGGTTTTTGCT |
| 1315 | AGGAAATCACAGGGTTTTTGCTG |
| 1316 | GGAAATCACAGGGTTTTTGCTGA |
| 1317 | GAAATCACAGGGTTTTTGCTGAT |
| 1318 | AAATCACAGGGTTTTTGCTGATT |
| 1319 | AATCACAGGGTTTTTGCTGATTC |
| 1320 | ATCACAGGGTTTTTGCTGATTCA |
| 1321 | TCACAGGGTTTTTGCTGATTCAG |
| 1322 | CACAGGGTTTTTGCTGATTCAGG |
| 1323 | ACAGGGTTTTTGCTGATTCAGGC |
| 1324 | CAGGGTTTTTGCTGATTCAGGCT |
| 1325 | AGGGTTTTTGCTGATTCAGGCTT |
| 1326 | GGGTTTTTGCTGATTCAGGCTTG |
| 1327 | GGTTTTTGCTGATTCAGGCTTGG |
| 1328 | GTTTTTGCTGATTCAGGCTTGGC |
| 1329 | TTTTTGCTGATTCAGGCTTGGCC |
| 1330 | TTTTGCTGATTCAGGCTTGGCCT |
| 1331 | TTTGCTGATTCAGGCTTGGCCTG |
| 1332 | TTGCTGATTCAGGCTTGGCCTGA |
| 1333 | TGCTGATTCAGGCTTGGCCTGAA |
| 1334 | GCTGATTCAGGCTTGGCCTGAAA |

| ID | SEQUENCE |
|---|---|
| 1335 | CTGATTCAGGCTTGGCCTGAAAA |
| 1336 | TGATTCAGGCTTGGCCTGAAAAC |
| 1337 | GATTCAGGCTTGGCCTGAAAACA |
| 1338 | ATTCAGGCTTGGCCTGAAAACAG |
| 1339 | TTCAGGCTTGGCCTGAAAACAGG |
| 1340 | TCAGGCTTGGCCTGAAAACAGGA |
| 1341 | CAGGCTTGGCCTGAAAACAGGAC |
| 1342 | AGGCTTGGCCTGAAAACAGGACG |
| 1343 | GGCTTGGCCTGAAAACAGGACGG |
| 1344 | GCTTGGCCTGAAAACAGGACGGA |
| 1345 | CTTGGCCTGAAAACAGGACGGAC |
| 1346 | TTGGCCTGAAAACAGGACGGACC |
| 1347 | TGGCCTGAAAACAGGACGGACCT |
| 1348 | GGCCTGAAAACAGGACGGACCTC |
| 1349 | GCCTGAAAACAGGACGGACCTCC |
| 1350 | CCTGAAAACAGGACGGACCTCCA |
| 1351 | CTGAAAACAGGACGGACCTCCAT |
| 1352 | TGAAAACAGGACGGACCTCCATG |
| 1353 | GAAAACAGGACGGACCTCCATGC |
| 1354 | AAAACAGGACGGACCTCCATGCC |
| 1355 | AAACAGGACGGACCTCCATGCCT |
| 1356 | AACAGGACGGACCTCCATGCCTT |
| 1357 | ACAGGACGGACCTCCATGCCTTT |
| 1358 | CAGGACGGACCTCCATGCCTTTG |
| 1359 | AGGACGGACCTCCATGCCTTTGA |
| 1360 | GGACGGACCTCCATGCCTTTGAG |
| 1361 | GACGGACCTCCATGCCTTTGAGA |
| 1362 | ACGGACCTCCATGCCTTTGAGAA |
| 1363 | CGGACCTCCATGCCTTTGAGAAC |
| 1364 | GGACCTCCATGCCTTTGAGAACC |
| 1365 | GACCTCCATGCCTTTGAGAACCT |
| 1366 | ACCTCCATGCCTTTGAGAACCTA |
| 1367 | CCTCCATGCCTTTGAGAACCTAG |
| 1368 | CTCCATGCCTTTGAGAACCTAGA |
| 1369 | TCCATGCCTTTGAGAACCTAGAA |
| 1370 | CCATGCCTTTGAGAACCTAGAAA |
| 1371 | CATGCCTTTGAGAACCTAGAAAT |
| 1372 | ATGCCTTTGAGAACCTAGAAATC |
| 1373 | TGCCTTTGAGAACCTAGAAATCA |
| 1374 | GCCTTTGAGAACCTAGAAATCAT |
| 1375 | CCTTTGAGAACCTAGAAATCATA |
| 1376 | CTTTGAGAACCTAGAAATCATAC |
| 1377 | TTTGAGAACCTAGAAATCATACG |
| 1378 | TTGAGAACCTAGAAATCATACGC |
| 1379 | TGAGAACCTAGAAATCATACGCG |
| 1380 | GAGAACCTAGAAATCATACGCGG |
| 1381 | AGAACCTAGAAATCATACGCGGC |
| 1382 | GAACCTAGAAATCATACGCGGCA |
| 1383 | AACCTAGAAATCATACGCGGCAG |
| 1384 | ACCTAGAAATCATACGCGGCAGG |
| 1385 | CCTAGAAATCATACGCGGCAGGA |
| 1386 | CTAGAAATCATACGCGGCAGGAC |
| 1387 | TAGAAATCATACGCGGCAGGACC |
| 1388 | AGAAATCATACGCGGCAGGACCA |
| 1389 | GAAATCATACGCGGCAGGACCAA |
| 1390 | AAATCATACGCGGCAGGACCAAG |
| 1391 | AATCATACGCGGCAGGACCAAGC |
| 1392 | ATCATACGCGGCAGGACCAAGCA |

| ID | SEQUENCE |
|---|---|
| 1393 | TCATACGCGGCAGGACCAAGCAA |
| 1394 | CATACGCGGCAGGACCAAGCAAC |
| 1395 | ATACGCGGCAGGACCAAGCAACA |
| 1396 | TACGCGGCAGGACCAAGCAACAT |
| 1397 | ACGCGGCAGGACCAAGCAACATG |
| 1398 | CGCGGCAGGACCAAGCAACATGG |
| 1399 | GCGGCAGGACCAAGCAACATGGT |
| 1400 | CGGCAGGACCAAGCAACATGGTC |
| 1401 | GGCAGGACCAAGCAACATGGTCA |
| 1402 | GCAGGACCAAGCAACATGGTCAG |
| 1403 | CAGGACCAAGCAACATGGTCAGT |
| 1404 | AGGACCAAGCAACATGGTCAGTT |
| 1405 | GGACCAAGCAACATGGTCAGTTT |
| 1406 | GACCAAGCAACATGGTCAGTTTT |
| 1407 | ACCAAGCAACATGGTCAGTTTTC |
| 1408 | CCAAGCAACATGGTCAGTTTTCT |
| 1409 | CAAGCAACATGGTCAGTTTTCTC |
| 1410 | AAGCAACATGGTCAGTTTTCTCT |
| 1411 | AGCAACATGGTCAGTTTTCTCTT |
| 1412 | GCAACATGGTCAGTTTTCTCTTG |
| 1413 | CAACATGGTCAGTTTTCTCTTGC |
| 1414 | AACATGGTCAGTTTTCTCTTGCA |
| 1415 | ACATGGTCAGTTTTCTCTTGCAG |
| 1416 | CATGGTCAGTTTTCTCTTGCAGT |
| 1417 | ATGGTCAGTTTTCTCTTGCAGTC |
| 1418 | TGGTCAGTTTTCTCTTGCAGTCG |
| 1419 | GGTCAGTTTTCTCTTGCAGTCGT |
| 1420 | GTCAGTTTTCTCTTGCAGTCGTC |
| 1421 | TCAGTTTTCTCTTGCAGTCGTCA |
| 1422 | CAGTTTTCTCTTGCAGTCGTCAG |
| 1423 | AGTTTTCTCTTGCAGTCGTCAGC |
| 1424 | GTTTTCTCTTGCAGTCGTCAGCC |
| 1425 | TTTTCTCTTGCAGTCGTCAGCCT |
| 1426 | TTTCTCTTGCAGTCGTCAGCCTG |
| 1427 | TTCTCTTGCAGTCGTCAGCCTGA |
| 1428 | TCTCTTGCAGTCGTCAGCCTGAA |
| 1429 | CTCTTGCAGTCGTCAGCCTGAAC |
| 1430 | TCTTGCAGTCGTCAGCCTGAACA |
| 1431 | CTTGCAGTCGTCAGCCTGAACAT |
| 1432 | TTGCAGTCGTCAGCCTGAACATA |
| 1433 | TGCAGTCGTCAGCCTGAACATAA |
| 1434 | GCAGTCGTCAGCCTGAACATAAC |
| 1435 | CAGTCGTCAGCCTGAACATAACA |
| 1436 | AGTCGTCAGCCTGAACATAACAT |
| 1437 | GTCGTCAGCCTGAACATAACATC |
| 1438 | TCGTCAGCCTGAACATAACATCC |
| 1439 | CGTCAGCCTGAACATAACATCCT |
| 1440 | GTCAGCCTGAACATAACATCCTT |
| 1441 | TCAGCCTGAACATAACATCCTTG |
| 1442 | CAGCCTGAACATAACATCCTTGG |
| 1443 | AGCCTGAACATAACATCCTTGGG |
| 1444 | GCCTGAACATAACATCCTTGGGA |
| 1445 | CCTGAACATAACATCCTTGGGAT |
| 1446 | CTGAACATAACATCCTTGGGATT |
| 1447 | TGAACATAACATCCTTGGGATTA |
| 1448 | GAACATAACATCCTTGGGATTAC |
| 1449 | AACATAACATCCTTGGGATTACG |
| 1450 | ACATAACATCCTTGGGATTACGC |

| ID | SEQUENCE |
|---|---|
| 1451 | CATAACATCCTTGGGATTACGCT |
| 1452 | ATAACATCCTTGGGATTACGCTC |
| 1453 | TAACATCCTTGGGATTACGCTCC |
| 1454 | AACATCCTTGGGATTACGCTCCC |
| 1455 | ACATCCTTGGGATTACGCTCCCT |
| 1456 | CATCCTTGGGATTACGCTCCCTC |
| 1457 | ATCCTTGGGATTACGCTCCCTCA |
| 1458 | TCCTTGGGATTACGCTCCCTCAA |
| 1459 | CCTTGGGATTACGCTCCCTCAAG |
| 1460 | CTTGGGATTACGCTCCCTCAAGG |
| 1461 | TTGGGATTACGCTCCCTCAAGGA |
| 1462 | TGGGATTACGCTCCCTCAAGGAG |
| 1463 | GGGATTACGCTCCCTCAAGGAGA |
| 1464 | GGATTACGCTCCCTCAAGGAGAT |
| 1465 | GATTACGCTCCCTCAAGGAGATA |
| 1466 | ATTACGCTCCCTCAAGGAGATAA |
| 1467 | TTACGCTCCCTCAAGGAGATAAG |
| 1468 | TACGCTCCCTCAAGGAGATAAGT |
| 1469 | ACGCTCCCTCAAGGAGATAAGTG |
| 1470 | CGCTCCCTCAAGGAGATAAGTGA |
| 1471 | GCTCCCTCAAGGAGATAAGTGAT |
| 1472 | CTCCCTCAAGGAGATAAGTGATG |
| 1473 | TCCCTCAAGGAGATAAGTGATGG |
| 1474 | CCCTCAAGGAGATAAGTGATGGA |
| 1475 | CCTCAAGGAGATAAGTGATGGAG |
| 1476 | CTCAAGGAGATAAGTGATGGAGA |
| 1477 | TCAAGGAGATAAGTGATGGAGAT |
| 1478 | CAAGGAGATAAGTGATGGAGATG |
| 1479 | AAGGAGATAAGTGATGGAGATGT |
| 1480 | AGGAGATAAGTGATGGAGATGTG |
| 1481 | GGAGATAAGTGATGGAGATGTGA |
| 1482 | GAGATAAGTGATGGAGATGTGAT |
| 1483 | AGATAAGTGATGGAGATGTGATA |
| 1484 | GATAAGTGATGGAGATGTGATAA |
| 1485 | ATAAGTGATGGAGATGTGATAAT |
| 1486 | TAAGTGATGGAGATGTGATAATT |
| 1487 | AAGTGATGGAGATGTGATAATTT |
| 1488 | AGTGATGGAGATGTGATAATTTC |
| 1489 | GTGATGGAGATGTGATAATTTCA |
| 1490 | TGATGGAGATGTGATAATTTCAG |
| 1491 | GATGGAGATGTGATAATTTCAGG |
| 1492 | ATGGAGATGTGATAATTTCAGGA |
| 1493 | TGGAGATGTGATAATTTCAGGAA |
| 1494 | GGAGATGTGATAATTTCAGGAAA |
| 1495 | GAGATGTGATAATTTCAGGAAAC |
| 1496 | AGATGTGATAATTTCAGGAAACA |
| 1497 | GATGTGATAATTTCAGGAAACAA |
| 1498 | ATGTGATAATTTCAGGAAACAAA |
| 1499 | TGTGATAATTTCAGGAAACAAAA |
| 1500 | GTGATAATTTCAGGAAACAAAAA |
| 1501 | TGATAATTTCAGGAAACAAAAAT |
| 1502 | GATAATTTCAGGAAACAAAAATT |
| 1503 | ATAATTTCAGGAAACAAAAATTT |
| 1504 | TAATTTCAGGAAACAAAAATTTG |
| 1505 | AATTTCAGGAAACAAAAATTTGT |
| 1506 | ATTTCAGGAAACAAAAATTTGTG |
| 1507 | TTTCAGGAAACAAAAATTTGTGC |
| 1508 | TTCAGGAAACAAAAATTTGTGCT |

| ID | SEQUENCE |
|---|---|
| 1509 | TCAGGAAACAAAAATTTGTGCTA |
| 1510 | CAGGAAACAAAAATTTGTGCTAT |
| 1511 | AGGAAACAAAAATTTGTGCTATG |
| 1512 | GGAAACAAAAATTTGTGCTATGC |
| 1513 | GAAACAAAAATTTGTGCTATGCA |
| 1514 | AAACAAAAATTTGTGCTATGCAA |
| 1515 | AACAAAAATTTGTGCTATGCAAA |
| 1516 | ACAAAAATTTGTGCTATGCAAAT |
| 1517 | CAAAAATTTGTGCTATGCAAATA |
| 1518 | AAAAATTTGTGCTATGCAAATAC |
| 1519 | AAAATTTGTGCTATGCAAATACA |
| 1520 | AAATTTGTGCTATGCAAATACAA |
| 1521 | AATTTGTGCTATGCAAATACAAT |
| 1522 | ATTTGTGCTATGCAAATACAATA |
| 1523 | TTTGTGCTATGCAAATACAATAA |
| 1524 | TTGTGCTATGCAAATACAATAAA |
| 1525 | TGTGCTATGCAAATACAATAAAC |
| 1526 | GTGCTATGCAAATACAATAAACT |
| 1527 | TGCTATGCAAATACAATAAACTG |
| 1528 | GCTATGCAAATACAATAAACTGG |
| 1529 | CTATGCAAATACAATAAACTGGA |
| 1530 | TATGCAAATACAATAAACTGGAA |
| 1531 | ATGCAAATACAATAAACTGGAAA |
| 1532 | TGCAAATACAATAAACTGGAAAA |
| 1533 | GCAAATACAATAAACTGGAAAAA |
| 1534 | CAAATACAATAAACTGGAAAAAA |
| 1535 | AAATACAATAAACTGGAAAAAAC |
| 1536 | AATACAATAAACTGGAAAAAACT |
| 1537 | ATACAATAAACTGGAAAAAACTG |
| 1538 | TACAATAAACTGGAAAAAACTGT |
| 1539 | ACAATAAACTGGAAAAAACTGTT |
| 1540 | CAATAAACTGGAAAAAACTGTTT |
| 1541 | AATAAACTGGAAAAAACTGTTTG |
| 1542 | ATAAACTGGAAAAAACTGTTTGG |
| 1543 | TAAACTGGAAAAAACTGTTTGGG |
| 1544 | AAACTGGAAAAAACTGTTTGGGA |
| 1545 | AACTGGAAAAAACTGTTTGGGAC |
| 1546 | ACTGGAAAAAACTGTTTGGGACC |
| 1547 | CTGGAAAAAACTGTTTGGGACCT |
| 1548 | TGGAAAAAACTGTTTGGGACCTC |
| 1549 | GGAAAAAACTGTTTGGGACCTCC |
| 1550 | GAAAAAACTGTTTGGGACCTCCG |
| 1551 | AAAAAACTGTTTGGGACCTCCGG |
| 1552 | AAAAACTGTTTGGGACCTCCGGT |
| 1553 | AAAACTGTTTGGGACCTCCGGTC |
| 1554 | AAACTGTTTGGGACCTCCGGTCA |
| 1555 | AACTGTTTGGGACCTCCGGTCAG |
| 1556 | ACTGTTTGGGACCTCCGGTCAGA |
| 1557 | CTGTTTGGGACCTCCGGTCAGAA |
| 1558 | TGTTTGGGACCTCCGGTCAGAAA |
| 1559 | GTTTGGGACCTCCGGTCAGAAAA |
| 1560 | TTTGGGACCTCCGGTCAGAAAAC |
| 1561 | TTGGGACCTCCGGTCAGAAAACC |
| 1562 | TGGGACCTCCGGTCAGAAAACCA |
| 1563 | GGGACCTCCGGTCAGAAAACCAA |
| 1564 | GGACCTCCGGTCAGAAAACCAAA |
| 1565 | GACCTCCGGTCAGAAAACCAAAA |
| 1566 | ACCTCCGGTCAGAAAACCAAAAT |

| ID | SEQUENCE |
|---|---|
| 1567 | CCTCCGGTCAGAAAACCAAAATT |
| 1568 | CTCCGGTCAGAAAACCAAAATTA |
| 1569 | TCCGGTCAGAAAACCAAAATTAT |
| 1570 | CCGGTCAGAAAACCAAAATTATA |
| 1571 | CGGTCAGAAAACCAAAATTATAA |
| 1572 | GGTCAGAAAACCAAAATTATAAG |
| 1573 | GTCAGAAAACCAAAATTATAAGC |
| 1574 | TCAGAAAACCAAAATTATAAGCA |
| 1575 | CAGAAAACCAAAATTATAAGCAA |
| 1576 | AGAAAACCAAAATTATAAGCAAC |
| 1577 | GAAAACCAAAATTATAAGCAACA |
| 1578 | AAAACCAAAATTATAAGCAACAG |
| 1579 | AAACCAAAATTATAAGCAACAGA |
| 1580 | AACCAAAATTATAAGCAACAGAG |
| 1581 | ACCAAAATTATAAGCAACAGAGG |
| 1582 | CCAAAATTATAAGCAACAGAGGT |
| 1583 | CAAAATTATAAGCAACAGAGGTG |
| 1584 | AAAATTATAAGCAACAGAGGTGA |
| 1585 | AAATTATAAGCAACAGAGGTGAA |
| 1586 | AATTATAAGCAACAGAGGTGAAA |
| 1587 | ATTATAAGCAACAGAGGTGAAAA |
| 1588 | TTATAAGCAACAGAGGTGAAAAC |
| 1589 | TATAAGCAACAGAGGTGAAAACA |
| 1590 | ATAAGCAACAGAGGTGAAAACAG |
| 1591 | TAAGCAACAGAGGTGAAAACAGC |
| 1592 | AAGCAACAGAGGTGAAAACAGCT |
| 1593 | AGCAACAGAGGTGAAAACAGCTG |
| 1594 | GCAACAGAGGTGAAAACAGCTGC |
| 1595 | CAACAGAGGTGAAAACAGCTGCA |
| 1596 | AACAGAGGTGAAAACAGCTGCAA |
| 1597 | ACAGAGGTGAAAACAGCTGCAAG |
| 1598 | CAGAGGTGAAAACAGCTGCAAGG |
| 1599 | AGAGGTGAAAACAGCTGCAAGGC |
| 1600 | GAGGTGAAAACAGCTGCAAGGCC |
| 1601 | AGGTGAAAACAGCTGCAAGGCCA |
| 1602 | GGTGAAAACAGCTGCAAGGCCAC |
| 1603 | GTGAAAACAGCTGCAAGGCCACA |
| 1604 | TGAAAACAGCTGCAAGGCCACAG |
| 1605 | GAAAACAGCTGCAAGGCCACAGG |
| 1606 | AAAACAGCTGCAAGGCCACAGGC |
| 1607 | AAACAGCTGCAAGGCCACAGGCC |
| 1608 | AACAGCTGCAAGGCCACAGGCCA |
| 1609 | ACAGCTGCAAGGCCACAGGCCAG |
| 1610 | CAGCTGCAAGGCCACAGGCCAGG |
| 1611 | AGCTGCAAGGCCACAGGCCAGGT |
| 1612 | GCTGCAAGGCCACAGGCCAGGTC |
| 1613 | CTGCAAGGCCACAGGCCAGGTCT |
| 1614 | TGCAAGGCCACAGGCCAGGTCTG |
| 1615 | GCAAGGCCACAGGCCAGGTCTGC |
| 1616 | CAAGGCCACAGGCCAGGTCTGCC |
| 1617 | AAGGCCACAGGCCAGGTCTGCCA |
| 1618 | AGGCCACAGGCCAGGTCTGCCAT |
| 1619 | GGCCACAGGCCAGGTCTGCCATG |
| 1620 | GCCACAGGCCAGGTCTGCCATGC |
| 1621 | CCACAGGCCAGGTCTGCCATGCC |
| 1622 | CACAGGCCAGGTCTGCCATGCCT |
| 1623 | ACAGGCCAGGTCTGCCATGCCTT |
| 1624 | CAGGCCAGGTCTGCCATGCCTTG |

| ID | SEQUENCE |
|---|---|
| 1625 | AGGCCAGGTCTGCCATGCCTTGT |
| 1626 | GGCCAGGTCTGCCATGCCTTGTG |
| 1627 | GCCAGGTCTGCCATGCCTTGTGC |
| 1628 | CCAGGTCTGCCATGCCTTGTGCT |
| 1629 | CAGGTCTGCCATGCCTTGTGCTC |
| 1630 | AGGTCTGCCATGCCTTGTGCTCC |
| 1631 | GGTCTGCCATGCCTTGTGCTCCC |
| 1632 | GTCTGCCATGCCTTGTGCTCCCC |
| 1633 | TCTGCCATGCCTTGTGCTCCCCC |
| 1634 | CTGCCATGCCTTGTGCTCCCCCG |
| 1635 | TGCCATGCCTTGTGCTCCCCCGA |
| 1636 | GCCATGCCTTGTGCTCCCCCGAG |
| 1637 | CCATGCCTTGTGCTCCCCCGAGG |
| 1638 | CATGCCTTGTGCTCCCCCGAGGG |
| 1639 | ATGCCTTGTGCTCCCCCGAGGGC |
| 1640 | TGCCTTGTGCTCCCCCGAGGGCT |
| 1641 | GCCTTGTGCTCCCCCGAGGGCTG |
| 1642 | CCTTGTGCTCCCCCGAGGGCTGC |
| 1643 | CTTGTGCTCCCCCGAGGGCTGCT |
| 1644 | TTGTGCTCCCCCGAGGGCTGCTG |
| 1645 | TGTGCTCCCCCGAGGGCTGCTGG |
| 1646 | GTGCTCCCCCGAGGGCTGCTGGG |
| 1647 | TGCTCCCCCGAGGGCTGCTGGGG |
| 1648 | GCTCCCCCGAGGGCTGCTGGGGC |
| 1649 | CTCCCCCGAGGGCTGCTGGGGCC |
| 1650 | TCCCCCGAGGGCTGCTGGGGCCC |
| 1651 | CCCCCGAGGGCTGCTGGGGCCCG |
| 1652 | GGGCCCGGAGCCCAGGGACTGCG |
| 1653 | GGCCCGGAGCCCAGGGACTGCGT |
| 1654 | GCCCGGAGCCCAGGGACTGCGTC |
| 1655 | CCCGGAGCCCAGGGACTGCGTCT |
| 1656 | CCGGAGCCCAGGGACTGCGTCTC |
| 1657 | CGGAGCCCAGGGACTGCGTCTCT |
| 1658 | GGAGCCCAGGGACTGCGTCTCTT |
| 1659 | GAGCCCAGGGACTGCGTCTCTTG |
| 1660 | AGCCCAGGGACTGCGTCTCTTGC |
| 1661 | GCCCAGGGACTGCGTCTCTTGCC |
| 1662 | CCCAGGGACTGCGTCTCTTGCCG |
| 1663 | CCAGGGACTGCGTCTCTTGCCGG |
| 1664 | CAGGGACTGCGTCTCTTGCCGGA |
| 1665 | AGGGACTGCGTCTCTTGCCGGAA |
| 1666 | GGGACTGCGTCTCTTGCCGGAAT |
| 1667 | GGACTGCGTCTCTTGCCGGAATG |
| 1668 | GACTGCGTCTCTTGCCGGAATGT |
| 1669 | ACTGCGTCTCTTGCCGGAATGTC |
| 1670 | CTGCGTCTCTTGCCGGAATGTCA |
| 1671 | TGCGTCTCTTGCCGGAATGTCAG |
| 1672 | GCGTCTCTTGCCGGAATGTCAGC |
| 1673 | CGTCTCTTGCCGGAATGTCAGCC |
| 1674 | GTCTCTTGCCGGAATGTCAGCCG |
| 1675 | TCTCTTGCCGGAATGTCAGCCGA |
| 1676 | CTCTTGCCGGAATGTCAGCCGAG |
| 1677 | TCTTGCCGGAATGTCAGCCGAGG |
| 1678 | CTTGCCGGAATGTCAGCCGAGGC |
| 1679 | TTGCCGGAATGTCAGCCGAGGCA |
| 1680 | TGCCGGAATGTCAGCCGAGGCAG |
| 1681 | GCCGGAATGTCAGCCGAGGCAGG |
| 1682 | CCGGAATGTCAGCCGAGGCAGGG |

| ID | SEQUENCE |
|---|---|
| 1683 | CGGAATGTCAGCCGAGGCAGGGA |
| 1684 | GGAATGTCAGCCGAGGCAGGGAA |
| 1685 | GAATGTCAGCCGAGGCAGGGAAT |
| 1686 | AATGTCAGCCGAGGCAGGGAATG |
| 1687 | ATGTCAGCCGAGGCAGGGAATGC |
| 1688 | TGTCAGCCGAGGCAGGGAATGCG |
| 1689 | GTCAGCCGAGGCAGGGAATGCGT |
| 1690 | TCAGCCGAGGCAGGGAATGCGTG |
| 1691 | CAGCCGAGGCAGGGAATGCGTGG |
| 1692 | AGCCGAGGCAGGGAATGCGTGGA |
| 1693 | GCCGAGGCAGGGAATGCGTGGAC |
| 1694 | CCGAGGCAGGGAATGCGTGGACA |
| 1695 | CGAGGCAGGGAATGCGTGGACAA |
| 1696 | GAGGCAGGGAATGCGTGGACAAG |
| 1697 | AGGCAGGGAATGCGTGGACAAGT |
| 1698 | GGCAGGGAATGCGTGGACAAGTG |
| 1699 | GCAGGGAATGCGTGGACAAGTGC |
| 1700 | CAGGGAATGCGTGGACAAGTGCA |
| 1701 | AGGGAATGCGTGGACAAGTGCAA |
| 1702 | GGGAATGCGTGGACAAGTGCAAC |
| 1703 | GGAATGCGTGGACAAGTGCAACC |
| 1704 | GAATGCGTGGACAAGTGCAACCT |
| 1705 | AATGCGTGGACAAGTGCAACCTT |
| 1706 | ATGCGTGGACAAGTGCAACCTTC |
| 1707 | TGCGTGGACAAGTGCAACCTTCT |
| 1708 | GCGTGGACAAGTGCAACCTTCTG |
| 1709 | CGTGGACAAGTGCAACCTTCTGG |
| 1710 | GTGGACAAGTGCAACCTTCTGGA |
| 1711 | TGGACAAGTGCAACCTTCTGGAG |
| 1712 | GGACAAGTGCAACCTTCTGGAGG |
| 1713 | GACAAGTGCAACCTTCTGGAGGG |
| 1714 | ACAAGTGCAACCTTCTGGAGGGT |
| 1715 | CAAGTGCAACCTTCTGGAGGGTG |
| 1716 | AAGTGCAACCTTCTGGAGGGTGA |
| 1717 | AGTGCAACCTTCTGGAGGGTGAG |
| 1718 | GTGCAACCTTCTGGAGGGTGAGC |
| 1719 | TGCAACCTTCTGGAGGGTGAGCC |
| 1720 | GCAACCTTCTGGAGGGTGAGCCA |
| 1721 | CAACCTTCTGGAGGGTGAGCCAA |
| 1722 | AACCTTCTGGAGGGTGAGCCAAG |
| 1723 | ACCTTCTGGAGGGTGAGCCAAGG |
| 1724 | CCTTCTGGAGGGTGAGCCAAGGG |
| 1725 | CTTCTGGAGGGTGAGCCAAGGGA |
| 1726 | TTCTGGAGGGTGAGCCAAGGGAG |
| 1727 | TCTGGAGGGTGAGCCAAGGGAGT |
| 1728 | CTGGAGGGTGAGCCAAGGGAGTT |
| 1729 | TGGAGGGTGAGCCAAGGGAGTTT |
| 1730 | GGAGGGTGAGCCAAGGGAGTTTG |
| 1731 | GAGGGTGAGCCAAGGGAGTTTGT |
| 1732 | AGGGTGAGCCAAGGGAGTTTGTG |
| 1733 | GGGTGAGCCAAGGGAGTTTGTGG |
| 1734 | GGTGAGCCAAGGGAGTTTGTGGA |
| 1735 | GTGAGCCAAGGGAGTTTGTGGAG |
| 1736 | TGAGCCAAGGGAGTTTGTGGAGA |
| 1737 | GAGCCAAGGGAGTTTGTGGAGAA |
| 1738 | AGCCAAGGGAGTTTGTGGAGAAC |
| 1739 | GCCAAGGGAGTTTGTGGAGAACT |
| 1740 | CCAAGGGAGTTTGTGGAGAACTC |

| ID | SEQUENCE |
|---|---|
| 1741 | CAAGGGAGTTTGTGGAGAACTCT |
| 1742 | AAGGGAGTTTGTGGAGAACTCTG |
| 1743 | AGGGAGTTTGTGGAGAACTCTGA |
| 1744 | GGGAGTTTGTGGAGAACTCTGAG |
| 1745 | GGAGTTTGTGGAGAACTCTGAGT |
| 1746 | GAGTTTGTGGAGAACTCTGAGTG |
| 1747 | AGTTTGTGGAGAACTCTGAGTGC |
| 1748 | GTTTGTGGAGAACTCTGAGTGCA |
| 1749 | TTTGTGGAGAACTCTGAGTGCAT |
| 1750 | TTGTGGAGAACTCTGAGTGCATA |
| 1751 | TGTGGAGAACTCTGAGTGCATAC |
| 1752 | GTGGAGAACTCTGAGTGCATACA |
| 1753 | TGGAGAACTCTGAGTGCATACAG |
| 1754 | GGAGAACTCTGAGTGCATACAGT |
| 1755 | GAGAACTCTGAGTGCATACAGTG |
| 1756 | AGAACTCTGAGTGCATACAGTGC |
| 1757 | GAACTCTGAGTGCATACAGTGCC |
| 1758 | AACTCTGAGTGCATACAGTGCCA |
| 1759 | ACTCTGAGTGCATACAGTGCCAC |
| 1760 | CTCTGAGTGCATACAGTGCCACC |
| 1761 | TCTGAGTGCATACAGTGCCACCC |
| 1762 | CTGAGTGCATACAGTGCCACCCA |
| 1763 | TGAGTGCATACAGTGCCACCCAG |
| 1764 | GAGTGCATACAGTGCCACCCAGA |
| 1765 | AGTGCATACAGTGCCACCCAGAG |
| 1766 | GTGCATACAGTGCCACCCAGAGT |
| 1767 | TGCATACAGTGCCACCCAGAGTG |
| 1768 | GCATACAGTGCCACCCAGAGTGC |
| 1769 | CATACAGTGCCACCCAGAGTGCC |
| 1770 | ATACAGTGCCACCCAGAGTGCCT |
| 1771 | TACAGTGCCACCCAGAGTGCCTG |
| 1772 | ACAGTGCCACCCAGAGTGCCTGC |
| 1773 | CAGTGCCACCCAGAGTGCCTGCC |
| 1774 | AGTGCCACCCAGAGTGCCTGCCT |
| 1775 | GTGCCACCCAGAGTGCCTGCCTC |
| 1776 | TGCCACCCAGAGTGCCTGCCTCA |
| 1777 | GCCACCCAGAGTGCCTGCCTCAG |
| 1778 | CCACCCAGAGTGCCTGCCTCAGG |
| 1779 | CACCCAGAGTGCCTGCCTCAGGC |
| 1780 | ACCCAGAGTGCCTGCCTCAGGCC |
| 1781 | CCCAGAGTGCCTGCCTCAGGCCA |
| 1782 | CCAGAGTGCCTGCCTCAGGCCAT |
| 1783 | CAGAGTGCCTGCCTCAGGCCATG |
| 1784 | AGAGTGCCTGCCTCAGGCCATGA |
| 1785 | GAGTGCCTGCCTCAGGCCATGAA |
| 1786 | AGTGCCTGCCTCAGGCCATGAAC |
| 1787 | GTGCCTGCCTCAGGCCATGAACA |
| 1788 | TGCCTGCCTCAGGCCATGAACAT |
| 1789 | GCCTGCCTCAGGCCATGAACATC |
| 1790 | CCTGCCTCAGGCCATGAACATCA |
| 1791 | CTGCCTCAGGCCATGAACATCAC |
| 1792 | TGCCTCAGGCCATGAACATCACC |
| 1793 | GCCTCAGGCCATGAACATCACCT |
| 1794 | CCTCAGGCCATGAACATCACCTG |
| 1795 | CTCAGGCCATGAACATCACCTGC |
| 1796 | TCAGGCCATGAACATCACCTGCA |
| 1797 | CAGGCCATGAACATCACCTGCAC |
| 1798 | AGGCCATGAACATCACCTGCACA |

| ID | SEQUENCE |
|---|---|
| 1799 | GGCCATGAACATCACCTGCACAG |
| 1800 | GCCATGAACATCACCTGCACAGG |
| 1801 | CCATGAACATCACCTGCACAGGA |
| 1802 | CATGAACATCACCTGCACAGGAC |
| 1803 | ATGAACATCACCTGCACAGGACG |
| 1804 | TGAACATCACCTGCACAGGACGG |
| 1805 | GAACATCACCTGCACAGGACGGG |
| 1806 | AACATCACCTGCACAGGACGGGG |
| 1807 | ACATCACCTGCACAGGACGGGGA |
| 1808 | CATCACCTGCACAGGACGGGGAC |
| 1809 | ATCACCTGCACAGGACGGGGACC |
| 1810 | TCACCTGCACAGGACGGGGACCA |
| 1811 | CACCTGCACAGGACGGGGACCAG |
| 1812 | ACCTGCACAGGACGGGGACCAGA |
| 1813 | CCTGCACAGGACGGGGACCAGAC |
| 1814 | CTGCACAGGACGGGGACCAGACA |
| 1815 | TGCACAGGACGGGGACCAGACAA |
| 1816 | GCACAGGACGGGGACCAGACAAC |
| 1817 | CACAGGACGGGGACCAGACAACT |
| 1818 | ACAGGACGGGGACCAGACAACTG |
| 1819 | CAGGACGGGGACCAGACAACTGT |
| 1820 | AGGACGGGGACCAGACAACTGTA |
| 1821 | GGACGGGGACCAGACAACTGTAT |
| 1822 | GACGGGGACCAGACAACTGTATC |
| 1823 | ACGGGGACCAGACAACTGTATCC |
| 1824 | CGGGGACCAGACAACTGTATCCA |
| 1825 | GGGGACCAGACAACTGTATCCAG |
| 1826 | GGGACCAGACAACTGTATCCAGT |
| 1827 | GGACCAGACAACTGTATCCAGTG |
| 1828 | GACCAGACAACTGTATCCAGTGT |
| 1829 | ACCAGACAACTGTATCCAGTGTG |
| 1830 | CCAGACAACTGTATCCAGTGTGC |
| 1831 | CAGACAACTGTATCCAGTGTGCC |
| 1832 | AGACAACTGTATCCAGTGTGCCC |
| 1833 | GACAACTGTATCCAGTGTGCCCA |
| 1834 | ACAACTGTATCCAGTGTGCCCAC |
| 1835 | CAACTGTATCCAGTGTGCCCACT |
| 1836 | AACTGTATCCAGTGTGCCCACTA |
| 1837 | ACTGTATCCAGTGTGCCCACTAC |
| 1838 | CTGTATCCAGTGTGCCCACTACA |
| 1839 | TGTATCCAGTGTGCCCACTACAT |
| 1840 | GTATCCAGTGTGCCCACTACATT |
| 1841 | TATCCAGTGTGCCCACTACATTG |
| 1842 | ATCCAGTGTGCCCACTACATTGA |
| 1843 | TCCAGTGTGCCCACTACATTGAC |
| 1844 | CCAGTGTGCCCACTACATTGACG |
| 1845 | CAGTGTGCCCACTACATTGACGG |
| 1846 | AGTGTGCCCACTACATTGACGGC |
| 1847 | GTGTGCCCACTACATTGACGGCC |
| 1848 | TGTGCCCACTACATTGACGGCCC |
| 1849 | GTGCCCACTACATTGACGGCCCC |
| 1850 | TGCCCACTACATTGACGGCCCCC |
| 1851 | GCCCACTACATTGACGGCCCCCA |
| 1852 | CCCACTACATTGACGGCCCCCAC |
| 1853 | CCACTACATTGACGGCCCCCACT |
| 1854 | CACTACATTGACGGCCCCCACTG |
| 1855 | ACTACATTGACGGCCCCCACTGC |
| 1856 | CTACATTGACGGCCCCCACTGCG |

| ID | SEQUENCE |
|---|---|
| 1857 | TACATTGACGGCCCCCACTGCGT |
| 1858 | ACATTGACGGCCCCCACTGCGTC |
| 1859 | CATTGACGGCCCCCACTGCGTCA |
| 1860 | ATTGACGGCCCCCACTGCGTCAA |
| 1861 | TTGACGGCCCCCACTGCGTCAAG |
| 1862 | TGACGGCCCCCACTGCGTCAAGA |
| 1863 | GACGGCCCCCACTGCGTCAAGAC |
| 1864 | ACGGCCCCCACTGCGTCAAGACC |
| 1865 | CGGCCCCCACTGCGTCAAGACCT |
| 1866 | GGCCCCCACTGCGTCAAGACCTG |
| 1867 | GCCCCCACTGCGTCAAGACCTGC |
| 1868 | CCCCCACTGCGTCAAGACCTGCC |
| 1869 | CCCCACTGCGTCAAGACCTGCCC |
| 1870 | CCCACTGCGTCAAGACCTGCCCG |
| 1871 | CCACTGCGTCAAGACCTGCCCGG |
| 1872 | CACTGCGTCAAGACCTGCCCGGC |
| 1873 | ACTGCGTCAAGACCTGCCCGGCA |
| 1874 | CTGCGTCAAGACCTGCCCGGCAG |
| 1875 | TGCGTCAAGACCTGCCCGGCAGG |
| 1876 | GCGTCAAGACCTGCCCGGCAGGA |
| 1877 | CGTCAAGACCTGCCCGGCAGGAG |
| 1878 | GTCAAGACCTGCCCGGCAGGAGT |
| 1879 | TCAAGACCTGCCCGGCAGGAGTC |
| 1880 | CAAGACCTGCCCGGCAGGAGTCA |
| 1881 | AAGACCTGCCCGGCAGGAGTCAT |
| 1882 | AGACCTGCCCGGCAGGAGTCATG |
| 1883 | GACCTGCCCGGCAGGAGTCATGG |
| 1884 | ACCTGCCCGGCAGGAGTCATGGG |
| 1885 | CCTGCCCGGCAGGAGTCATGGGA |
| 1886 | CTGCCCGGCAGGAGTCATGGGAG |
| 1887 | TGCCCGGCAGGAGTCATGGGAGA |
| 1888 | GCCCGGCAGGAGTCATGGGAGAA |
| 1889 | CCCGGCAGGAGTCATGGGAGAAA |
| 1890 | CCGGCAGGAGTCATGGGAGAAAA |
| 1891 | CGGCAGGAGTCATGGGAGAAAAC |
| 1892 | GGCAGGAGTCATGGGAGAAAACA |
| 1893 | GCAGGAGTCATGGGAGAAAACAA |
| 1894 | CAGGAGTCATGGGAGAAAACAAC |
| 1895 | AGGAGTCATGGGAGAAAACAACA |
| 1896 | GGAGTCATGGGAGAAAACAACAC |
| 1897 | GAGTCATGGGAGAAAACAACACC |
| 1898 | AGTCATGGGAGAAAACAACACCC |
| 1899 | GTCATGGGAGAAAACAACACCCT |
| 1900 | TCATGGGAGAAAACAACACCCTG |
| 1901 | CATGGGAGAAAACAACACCCTGG |
| 1902 | ATGGGAGAAAACAACACCCTGGT |
| 1903 | TGGGAGAAAACAACACCCTGGTC |
| 1904 | GGGAGAAAACAACACCCTGGTCT |
| 1905 | GGAGAAAACAACACCCTGGTCTG |
| 1906 | GAGAAAACAACACCCTGGTCTGG |
| 1907 | AGAAAACAACACCCTGGTCTGGA |
| 1908 | GAAAACAACACCCTGGTCTGGAA |
| 1909 | AAAACAACACCCTGGTCTGGAAG |
| 1910 | AAACAACACCCTGGTCTGGAAGT |
| 1911 | AACAACACCCTGGTCTGGAAGTA |
| 1912 | ACAACACCCTGGTCTGGAAGTAC |
| 1913 | CAACACCCTGGTCTGGAAGTACG |
| 1914 | AACACCCTGGTCTGGAAGTACGC |

| ID | SEQUENCE |
|---|---|
| 1915 | ACACCCTGGTCTGGAAGTACGCA |
| 1916 | CACCCTGGTCTGGAAGTACGCAG |
| 1917 | ACCCTGGTCTGGAAGTACGCAGA |
| 1918 | CCCTGGTCTGGAAGTACGCAGAC |
| 1919 | CCTGGTCTGGAAGTACGCAGACG |
| 1920 | CTGGTCTGGAAGTACGCAGACGC |
| 1921 | TGGTCTGGAAGTACGCAGACGCC |
| 1922 | GGTCTGGAAGTACGCAGACGCCG |
| 1923 | GTCTGGAAGTACGCAGACGCCGG |
| 1924 | TCTGGAAGTACGCAGACGCCGGC |
| 1925 | CTGGAAGTACGCAGACGCCGGCC |
| 1926 | TGGAAGTACGCAGACGCCGGCCA |
| 1927 | GGAAGTACGCAGACGCCGGCCAT |
| 1928 | GAAGTACGCAGACGCCGGCCATG |
| 1929 | AAGTACGCAGACGCCGGCCATGT |
| 1930 | AGTACGCAGACGCCGGCCATGTG |
| 1931 | GTACGCAGACGCCGGCCATGTGT |
| 1932 | TACGCAGACGCCGGCCATGTGTG |
| 1933 | ACGCAGACGCCGGCCATGTGTGC |
| 1934 | CGCAGACGCCGGCCATGTGTGCC |
| 1935 | GCAGACGCCGGCCATGTGTGCCA |
| 1936 | CAGACGCCGGCCATGTGTGCCAC |
| 1937 | AGACGCCGGCCATGTGTGCCACC |
| 1938 | GACGCCGGCCATGTGTGCCACCT |
| 1939 | ACGCCGGCCATGTGTGCCACCTG |
| 1940 | CGCCGGCCATGTGTGCCACCTGT |
| 1941 | GCCGGCCATGTGTGCCACCTGTG |
| 1942 | CCGGCCATGTGTGCCACCTGTGC |
| 1943 | CGGCCATGTGTGCCACCTGTGCC |
| 1944 | GGCCATGTGTGCCACCTGTGCCA |
| 1945 | GCCATGTGTGCCACCTGTGCCAT |
| 1946 | CCATGTGTGCCACCTGTGCCATC |
| 1947 | CATGTGTGCCACCTGTGCCATCC |
| 1948 | ATGTGTGCCACCTGTGCCATCCA |
| 1949 | TGTGTGCCACCTGTGCCATCCAA |
| 1950 | GTGTGCCACCTGTGCCATCCAAA |
| 1951 | TGTGCCACCTGTGCCATCCAAAC |
| 1952 | GTGCCACCTGTGCCATCCAAACT |
| 1953 | TGCCACCTGTGCCATCCAAACTG |
| 1954 | GCCACCTGTGCCATCCAAACTGC |
| 1955 | CCACCTGTGCCATCCAAACTGCA |
| 1956 | CACCTGTGCCATCCAAACTGCAC |
| 1957 | ACCTGTGCCATCCAAACTGCACC |
| 1958 | CCTGTGCCATCCAAACTGCACCT |
| 1959 | CTGTGCCATCCAAACTGCACCTA |
| 1960 | TGTGCCATCCAAACTGCACCTAC |
| 1961 | GTGCCATCCAAACTGCACCTACG |
| 1962 | TGCCATCCAAACTGCACCTACGG |
| 1963 | GCCATCCAAACTGCACCTACGGA |
| 1964 | CCATCCAAACTGCACCTACGGAT |
| 1965 | CATCCAAACTGCACCTACGGATG |
| 1966 | ATCCAAACTGCACCTACGGATGC |
| 1967 | TCCAAACTGCACCTACGGATGCA |
| 1968 | CCAAACTGCACCTACGGATGCAC |
| 1969 | CAAACTGCACCTACGGATGCACT |
| 1970 | AAACTGCACCTACGGATGCACTG |
| 1971 | AACTGCACCTACGGATGCACTGG |
| 1972 | ACTGCACCTACGGATGCACTGGG |

| ID | SEQUENCE |
|---|---|
| 1973 | CTGCACCTACGGATGCACTGGGC |
| 1974 | TGCACCTACGGATGCACTGGGCC |
| 1975 | GCACCTACGGATGCACTGGGCCA |
| 1976 | CACCTACGGATGCACTGGGCCAG |
| 1977 | ACCTACGGATGCACTGGGCCAGG |
| 1978 | CCTACGGATGCACTGGGCCAGGT |
| 1979 | CTACGGATGCACTGGGCCAGGTC |
| 1980 | TACGGATGCACTGGGCCAGGTCT |
| 1981 | ACGGATGCACTGGGCCAGGTCTT |
| 1982 | CGGATGCACTGGGCCAGGTCTTG |
| 1983 | GGATGCACTGGGCCAGGTCTTGA |
| 1984 | GATGCACTGGGCCAGGTCTTGAA |
| 1985 | ATGCACTGGGCCAGGTCTTGAAG |
| 1986 | TGCACTGGGCCAGGTCTTGAAGG |
| 1987 | GCACTGGGCCAGGTCTTGAAGGC |
| 1988 | CACTGGGCCAGGTCTTGAAGGCT |
| 1989 | ACTGGGCCAGGTCTTGAAGGCTG |
| 1990 | CTGGGCCAGGTCTTGAAGGCTGT |
| 1991 | TGGGCCAGGTCTTGAAGGCTGTC |
| 1992 | GGGCCAGGTCTTGAAGGCTGTCC |
| 1993 | GGCCAGGTCTTGAAGGCTGTCCA |
| 1994 | GCCAGGTCTTGAAGGCTGTCCAA |
| 1995 | CCAGGTCTTGAAGGCTGTCCAAC |
| 1996 | CAGGTCTTGAAGGCTGTCCAACG |
| 1997 | AGGTCTTGAAGGCTGTCCAACGA |
| 1998 | GGTCTTGAAGGCTGTCCAACGAA |
| 1999 | GTCTTGAAGGCTGTCCAACGAAT |
| 2000 | TCTTGAAGGCTGTCCAACGAATG |
| 2001 | CTTGAAGGCTGTCCAACGAATGG |
| 2002 | TTGAAGGCTGTCCAACGAATGGG |
| 2003 | TGAAGGCTGTCCAACGAATGGGC |
| 2004 | GAAGGCTGTCCAACGAATGGGCC |
| 2005 | AAGGCTGTCCAACGAATGGGCCT |
| 2006 | AGGCTGTCCAACGAATGGGCCTA |
| 2007 | GGCTGTCCAACGAATGGGCCTAA |
| 2008 | GCTGTCCAACGAATGGGCCTAAG |
| 2009 | CTGTCCAACGAATGGGCCTAAGA |
| 2010 | TGTCCAACGAATGGGCCTAAGAT |
| 2011 | GTCCAACGAATGGGCCTAAGATC |
| 2012 | TCCAACGAATGGGCCTAAGATCC |
| 2013 | CCAACGAATGGGCCTAAGATCCC |
| 2014 | CAACGAATGGGCCTAAGATCCCG |
| 2015 | AACGAATGGGCCTAAGATCCCGT |
| 2016 | ACGAATGGGCCTAAGATCCCGTC |
| 2017 | CGAATGGGCCTAAGATCCCGTCC |
| 2018 | GAATGGGCCTAAGATCCCGTCCA |
| 2019 | AATGGGCCTAAGATCCCGTCCAT |
| 2020 | ATGGGCCTAAGATCCCGTCCATC |
| 2021 | TGGGCCTAAGATCCCGTCCATCG |
| 2022 | GGGCCTAAGATCCCGTCCATCGC |
| 2023 | GGCCTAAGATCCCGTCCATCGCC |
| 2024 | GCCTAAGATCCCGTCCATCGCCA |
| 2025 | CCTAAGATCCCGTCCATCGCCAC |
| 2026 | CTAAGATCCCGTCCATCGCCACT |
| 2027 | TAAGATCCCGTCCATCGCCACTG |
| 2028 | AAGATCCCGTCCATCGCCACTGG |
| 2029 | AGATCCCGTCCATCGCCACTGGG |
| 2030 | GATCCCGTCCATCGCCACTGGGA |

| ID | SEQUENCE |
|---|---|
| 2031 | ATCCCGTCCATCGCCACTGGGAT |
| 2032 | TCCCGTCCATCGCCACTGGGATG |
| 2033 | CCCGTCCATCGCCACTGGGATGG |
| 2034 | CCGTCCATCGCCACTGGGATGGT |
| 2035 | CGTCCATCGCCACTGGGATGGTG |
| 2036 | GTCCATCGCCACTGGGATGGTGG |
| 2037 | TCCATCGCCACTGGGATGGTGGG |
| 2038 | CCATCGCCACTGGGATGGTGGGG |
| 2039 | CATCGCCACTGGGATGGTGGGGG |
| 2040 | ATCGCCACTGGGATGGTGGGGGC |
| 2041 | TCGCCACTGGGATGGTGGGGGCC |
| 2042 | CGCCACTGGGATGGTGGGGGCCC |
| 2043 | GCCACTGGGATGGTGGGGGCCCT |
| 2044 | CCACTGGGATGGTGGGGGCCCTC |
| 2045 | CACTGGGATGGTGGGGGCCCTCC |
| 2046 | ACTGGGATGGTGGGGGCCCTCCT |
| 2047 | CTGGGATGGTGGGGGCCCTCCTC |
| 2048 | TGGGATGGTGGGGGCCCTCCTCT |
| 2049 | GGGATGGTGGGGGCCCTCCTCTT |
| 2050 | GGATGGTGGGGGCCCTCCTCTTG |
| 2051 | GATGGTGGGGGCCCTCCTCTTGC |
| 2052 | ATGGTGGGGGCCCTCCTCTTGCT |
| 2053 | TGGTGGGGGCCCTCCTCTTGCTG |
| 2054 | GGTGGGGGCCCTCCTCTTGCTGC |
| 2055 | GTGGGGGCCCTCCTCTTGCTGCT |
| 2056 | TGGGGGCCCTCCTCTTGCTGCTG |
| 2057 | GGGGGCCCTCCTCTTGCTGCTGG |
| 2058 | GGGGCCCTCCTCTTGCTGCTGGT |
| 2059 | GGGCCCTCCTCTTGCTGCTGGTG |
| 2060 | GGCCCTCCTCTTGCTGCTGGTGG |
| 2061 | GCCCTCCTCTTGCTGCTGGTGGT |
| 2062 | CCCTCCTCTTGCTGCTGGTGGTG |
| 2063 | CCTCCTCTTGCTGCTGGTGGTGG |
| 2064 | CTCCTCTTGCTGCTGGTGGTGGC |
| 2065 | TCCTCTTGCTGCTGGTGGTGGCC |
| 2066 | CCTCTTGCTGCTGGTGGTGGCCC |
| 2067 | CTCTTGCTGCTGGTGGTGGCCCT |
| 2068 | TCTTGCTGCTGGTGGTGGCCCTG |
| 2069 | CTTGCTGCTGGTGGTGGCCCTGG |
| 2070 | TTGCTGCTGGTGGTGGCCCTGGG |
| 2071 | TGCTGCTGGTGGTGGCCCTGGGG |
| 2072 | GCTGCTGGTGGTGGCCCTGGGGA |
| 2073 | CTGCTGGTGGTGGCCCTGGGGAT |
| 2074 | TGCTGGTGGTGGCCCTGGGGATC |
| 2075 | GCTGGTGGTGGCCCTGGGGATCG |
| 2076 | CTGGTGGTGGCCCTGGGGATCGG |
| 2077 | TGGTGGTGGCCCTGGGGATCGGC |
| 2078 | GGTGGTGGCCCTGGGGATCGGCC |
| 2079 | GTGGTGGCCCTGGGGATCGGCCT |
| 2080 | TGGTGGCCCTGGGGATCGGCCTC |
| 2081 | GGTGGCCCTGGGGATCGGCCTCT |
| 2082 | GTGGCCCTGGGGATCGGCCTCTT |
| 2083 | TGGCCCTGGGGATCGGCCTCTTC |
| 2084 | GGCCCTGGGGATCGGCCTCTTCA |
| 2085 | GCCCTGGGGATCGGCCTCTTCAT |
| 2086 | CCCTGGGGATCGGCCTCTTCATG |
| 2087 | CCTGGGGATCGGCCTCTTCATGC |
| 2088 | CTGGGGATCGGCCTCTTCATGCG |

| ID | SEQUENCE |
|---|---|
| 2089 | TGGGGATCGGCCTCTTCATGCGA |
| 2090 | GGGGATCGGCCTCTTCATGCGAA |
| 2091 | GGGATCGGCCTCTTCATGCGAAG |
| 2092 | GGATCGGCCTCTTCATGCGAAGG |
| 2093 | GATCGGCCTCTTCATGCGAAGGC |
| 2094 | ATCGGCCTCTTCATGCGAAGGCG |
| 2095 | TCGGCCTCTTCATGCGAAGGCGC |
| 2096 | CGGCCTCTTCATGCGAAGGCGCC |
| 2097 | GGCCTCTTCATGCGAAGGCGCCA |
| 2098 | GCCTCTTCATGCGAAGGCGCCAC |
| 2099 | CCTCTTCATGCGAAGGCGCCACA |
| 2100 | CTCTTCATGCGAAGGCGCCACAT |
| 2101 | TCTTCATGCGAAGGCGCCACATC |
| 2102 | CTTCATGCGAAGGCGCCACATCG |
| 2103 | TTCATGCGAAGGCGCCACATCGT |
| 2104 | TCATGCGAAGGCGCCACATCGTT |
| 2105 | CATGCGAAGGCGCCACATCGTTC |
| 2106 | ATGCGAAGGCGCCACATCGTTCG |
| 2107 | TGCGAAGGCGCCACATCGTTCGG |
| 2108 | GCGAAGGCGCCACATCGTTCGGA |
| 2109 | CGAAGGCGCCACATCGTTCGGAA |
| 2110 | GAAGGCGCCACATCGTTCGGAAG |
| 2111 | AAGGCGCCACATCGTTCGGAAGC |
| 2112 | AGGCGCCACATCGTTCGGAAGCG |
| 2113 | GGCGCCACATCGTTCGGAAGCGC |
| 2114 | GCGCCACATCGTTCGGAAGCGCA |
| 2115 | CGCCACATCGTTCGGAAGCGCAC |
| 2116 | GCCACATCGTTCGGAAGCGCACG |
| 2117 | CCACATCGTTCGGAAGCGCACGC |
| 2118 | CACATCGTTCGGAAGCGCACGCT |
| 2119 | ACATCGTTCGGAAGCGCACGCTG |
| 2120 | CATCGTTCGGAAGCGCACGCTGC |
| 2121 | ATCGTTCGGAAGCGCACGCTGCG |
| 2122 | TCGTTCGGAAGCGCACGCTGCGG |
| 2123 | CGTTCGGAAGCGCACGCTGCGGA |
| 2124 | GTTCGGAAGCGCACGCTGCGGAG |
| 2125 | TTCGGAAGCGCACGCTGCGGAGG |
| 2126 | TCGGAAGCGCACGCTGCGGAGGC |
| 2127 | CGGAAGCGCACGCTGCGGAGGCT |
| 2128 | GGAAGCGCACGCTGCGGAGGCTG |
| 2129 | GAAGCGCACGCTGCGGAGGCTGC |
| 2130 | AAGCGCACGCTGCGGAGGCTGCT |
| 2131 | AGCGCACGCTGCGGAGGCTGCTG |
| 2132 | GCGCACGCTGCGGAGGCTGCTGC |
| 2133 | CGCACGCTGCGGAGGCTGCTGCA |
| 2134 | GCACGCTGCGGAGGCTGCTGCAG |
| 2135 | CACGCTGCGGAGGCTGCTGCAGG |
| 2136 | ACGCTGCGGAGGCTGCTGCAGGA |
| 2137 | CGCTGCGGAGGCTGCTGCAGGAG |
| 2138 | GCTGCGGAGGCTGCTGCAGGAGA |
| 2139 | CTGCGGAGGCTGCTGCAGGAGAG |
| 2140 | TGCGGAGGCTGCTGCAGGAGAGG |
| 2141 | GCGGAGGCTGCTGCAGGAGAGGG |
| 2142 | CGGAGGCTGCTGCAGGAGAGGGA |
| 2143 | GGAGGCTGCTGCAGGAGAGGGAG |
| 2144 | GAGGCTGCTGCAGGAGAGGGAGC |
| 2145 | AGGCTGCTGCAGGAGAGGGAGCT |
| 2146 | GGCTGCTGCAGGAGAGGGAGCTT |

| ID | SEQUENCE |
|---|---|
| 2147 | GCTGCTGCAGGAGAGGGAGCTTG |
| 2148 | CTGCTGCAGGAGAGGGAGCTTGT |
| 2149 | TGCTGCAGGAGAGGGAGCTTGTG |
| 2150 | GCTGCAGGAGAGGGAGCTTGTGG |
| 2151 | CTGCAGGAGAGGGAGCTTGTGGA |
| 2152 | TGCAGGAGAGGGAGCTTGTGGAG |
| 2153 | GCAGGAGAGGGAGCTTGTGGAGC |
| 2154 | CAGGAGAGGGAGCTTGTGGAGCC |
| 2155 | AGGAGAGGGAGCTTGTGGAGCCT |
| 2156 | GGAGAGGGAGCTTGTGGAGCCTC |
| 2157 | GAGAGGGAGCTTGTGGAGCCTCT |
| 2158 | AGAGGGAGCTTGTGGAGCCTCTT |
| 2159 | GAGGGAGCTTGTGGAGCCTCTTA |
| 2160 | AGGGAGCTTGTGGAGCCTCTTAC |
| 2161 | GGGAGCTTGTGGAGCCTCTTACA |
| 2162 | GGAGCTTGTGGAGCCTCTTACAC |
| 2163 | GAGCTTGTGGAGCCTCTTACACC |
| 2164 | AGCTTGTGGAGCCTCTTACACCC |
| 2165 | GCTTGTGGAGCCTCTTACACCCA |
| 2166 | CTTGTGGAGCCTCTTACACCCAG |
| 2167 | TTGTGGAGCCTCTTACACCCAGT |
| 2168 | TGTGGAGCCTCTTACACCCAGTG |
| 2169 | GTGGAGCCTCTTACACCCAGTGG |
| 2170 | TGGAGCCTCTTACACCCAGTGGA |
| 2171 | GGAGCCTCTTACACCCAGTGGAG |
| 2172 | GAGCCTCTTACACCCAGTGGAGA |
| 2173 | AGCCTCTTACACCCAGTGGAGAA |
| 2174 | GCCTCTTACACCCAGTGGAGAAG |
| 2175 | CCTCTTACACCCAGTGGAGAAGC |
| 2176 | CTCTTACACCCAGTGGAGAAGCT |
| 2177 | TCTTACACCCAGTGGAGAAGCTC |
| 2178 | CTTACACCCAGTGGAGAAGCTCC |
| 2179 | TTACACCCAGTGGAGAAGCTCCC |
| 2180 | TACACCCAGTGGAGAAGCTCCCA |
| 2181 | ACACCCAGTGGAGAAGCTCCCAA |
| 2182 | CACCCAGTGGAGAAGCTCCCAAC |
| 2183 | ACCCAGTGGAGAAGCTCCCAACC |
| 2184 | CCCAGTGGAGAAGCTCCCAACCA |
| 2185 | CCAGTGGAGAAGCTCCCAACCAA |
| 2186 | CAGTGGAGAAGCTCCCAACCAAG |
| 2187 | AGTGGAGAAGCTCCCAACCAAGC |
| 2188 | GTGGAGAAGCTCCCAACCAAGCT |
| 2189 | TGGAGAAGCTCCCAACCAAGCTC |
| 2190 | GGAGAAGCTCCCAACCAAGCTCT |
| 2191 | GAGAAGCTCCCAACCAAGCTCTC |
| 2192 | AGAAGCTCCCAACCAAGCTCTCT |
| 2193 | GAAGCTCCCAACCAAGCTCTCTT |
| 2194 | AAGCTCCCAACCAAGCTCTCTTG |
| 2195 | AGCTCCCAACCAAGCTCTCTTGA |
| 2196 | GCTCCCAACCAAGCTCTCTTGAG |
| 2197 | CTCCCAACCAAGCTCTCTTGAGG |
| 2198 | TCCCAACCAAGCTCTCTTGAGGA |
| 2199 | CCCAACCAAGCTCTCTTGAGGAT |
| 2200 | CCAACCAAGCTCTCTTGAGGATC |
| 2201 | CAACCAAGCTCTCTTGAGGATCT |
| 2202 | AACCAAGCTCTCTTGAGGATCTT |
| 2203 | ACCAAGCTCTCTTGAGGATCTTG |
| 2204 | CCAAGCTCTCTTGAGGATCTTGA |

| ID | SEQUENCE |
|---|---|
| 2205 | CAAGCTCTCTTGAGGATCTTGAA |
| 2206 | AAGCTCTCTTGAGGATCTTGAAG |
| 2207 | AGCTCTCTTGAGGATCTTGAAGG |
| 2208 | GCTCTCTTGAGGATCTTGAAGGA |
| 2209 | CTCTCTTGAGGATCTTGAAGGAA |
| 2210 | TCTCTTGAGGATCTTGAAGGAAA |
| 2211 | CTCTTGAGGATCTTGAAGGAAAC |
| 2212 | TCTTGAGGATCTTGAAGGAAACT |
| 2213 | CTTGAGGATCTTGAAGGAAACTG |
| 2214 | TTGAGGATCTTGAAGGAAACTGA |
| 2215 | TGAGGATCTTGAAGGAAACTGAA |
| 2216 | GAGGATCTTGAAGGAAACTGAAT |
| 2217 | AGGATCTTGAAGGAAACTGAATT |
| 2218 | GGATCTTGAAGGAAACTGAATTC |
| 2219 | GATCTTGAAGGAAACTGAATTCA |
| 2220 | ATCTTGAAGGAAACTGAATTCAA |
| 2221 | TCTTGAAGGAAACTGAATTCAAA |
| 2222 | CTTGAAGGAAACTGAATTCAAAA |
| 2223 | TTGAAGGAAACTGAATTCAAAAA |
| 2224 | TGAAGGAAACTGAATTCAAAAAG |
| 2225 | GAAGGAAACTGAATTCAAAAAGA |
| 2226 | AAGGAAACTGAATTCAAAAAGAT |
| 2227 | AGGAAACTGAATTCAAAAAGATC |
| 2228 | GGAAACTGAATTCAAAAAGATCA |
| 2229 | GAAACTGAATTCAAAAAGATCAA |
| 2230 | AAACTGAATTCAAAAAGATCAAA |
| 2231 | AACTGAATTCAAAAAGATCAAAG |
| 2232 | ACTGAATTCAAAAAGATCAAAGT |
| 2233 | CTGAATTCAAAAAGATCAAAGTG |
| 2234 | TGAATTCAAAAAGATCAAAGTGC |
| 2235 | GAATTCAAAAAGATCAAAGTGCT |
| 2236 | AATTCAAAAAGATCAAAGTGCTG |
| 2237 | ATTCAAAAAGATCAAAGTGCTGG |
| 2238 | TTCAAAAAGATCAAAGTGCTGGG |
| 2239 | TCAAAAAGATCAAAGTGCTGGGC |
| 2240 | CAAAAAGATCAAAGTGCTGGGCT |
| 2241 | AAAAAGATCAAAGTGCTGGGCTC |
| 2242 | AAAAGATCAAAGTGCTGGGCTCC |
| 2243 | AAAGATCAAAGTGCTGGGCTCCG |
| 2244 | AAGATCAAAGTGCTGGGCTCCGG |
| 2245 | AGATCAAAGTGCTGGGCTCCGGT |
| 2246 | GATCAAAGTGCTGGGCTCCGGTG |
| 2247 | ATCAAAGTGCTGGGCTCCGGTGC |
| 2248 | TCAAAGTGCTGGGCTCCGGTGCG |
| 2249 | CAAAGTGCTGGGCTCCGGTGCGT |
| 2250 | AAAGTGCTGGGCTCCGGTGCGTT |
| 2251 | AAGTGCTGGGCTCCGGTGCGTTC |
| 2252 | AGTGCTGGGCTCCGGTGCGTTCG |
| 2253 | GTGCTGGGCTCCGGTGCGTTCGG |
| 2254 | TGCTGGGCTCCGGTGCGTTCGGC |
| 2255 | GCTGGGCTCCGGTGCGTTCGGCA |
| 2256 | CTGGGCTCCGGTGCGTTCGGCAC |
| 2257 | TGGGCTCCGGTGCGTTCGGCACG |
| 2258 | GGGCTCCGGTGCGTTCGGCACGG |
| 2259 | GGCTCCGGTGCGTTCGGCACGGT |
| 2260 | GCTCCGGTGCGTTCGGCACGGTG |
| 2261 | CTCCGGTGCGTTCGGCACGGTGT |
| 2262 | TCCGGTGCGTTCGGCACGGTGTA |

| ID | SEQUENCE |
|---|---|
| 2263 | CCGGTGCGTTCGGCACGGTGTAT |
| 2264 | CGGTGCGTTCGGCACGGTGTATA |
| 2265 | GGTGCGTTCGGCACGGTGTATAA |
| 2266 | GTGCGTTCGGCACGGTGTATAAG |
| 2267 | TGCGTTCGGCACGGTGTATAAGG |
| 2268 | GCGTTCGGCACGGTGTATAAGGG |
| 2269 | CGTTCGGCACGGTGTATAAGGGA |
| 2270 | GTTCGGCACGGTGTATAAGGGAC |
| 2271 | TTCGGCACGGTGTATAAGGGACT |
| 2272 | TCGGCACGGTGTATAAGGGACTC |
| 2273 | CGGCACGGTGTATAAGGGACTCT |
| 2274 | GGCACGGTGTATAAGGGACTCTG |
| 2275 | GCACGGTGTATAAGGGACTCTGG |
| 2276 | CACGGTGTATAAGGGACTCTGGA |
| 2277 | ACGGTGTATAAGGGACTCTGGAT |
| 2278 | CGGTGTATAAGGGACTCTGGATC |
| 2279 | GGTGTATAAGGGACTCTGGATCC |
| 2280 | GTGTATAAGGGACTCTGGATCCC |
| 2281 | TGTATAAGGGACTCTGGATCCCA |
| 2282 | GTATAAGGGACTCTGGATCCCAG |
| 2283 | TATAAGGGACTCTGGATCCCAGA |
| 2284 | ATAAGGGACTCTGGATCCCAGAA |
| 2285 | TAAGGGACTCTGGATCCCAGAAG |
| 2286 | AAGGGACTCTGGATCCCAGAAGG |
| 2287 | AGGGACTCTGGATCCCAGAAGGT |
| 2288 | GGGACTCTGGATCCCAGAAGGTG |
| 2289 | GGACTCTGGATCCCAGAAGGTGA |
| 2290 | GACTCTGGATCCCAGAAGGTGAG |
| 2291 | ACTCTGGATCCCAGAAGGTGAGA |
| 2292 | CTCTGGATCCCAGAAGGTGAGAA |
| 2293 | TCTGGATCCCAGAAGGTGAGAAA |
| 2294 | CTGGATCCCAGAAGGTGAGAAAG |
| 2295 | TGGATCCCAGAAGGTGAGAAAGT |
| 2296 | GGATCCCAGAAGGTGAGAAAGTT |
| 2297 | GATCCCAGAAGGTGAGAAAGTTA |
| 2298 | ATCCCAGAAGGTGAGAAAGTTAA |
| 2299 | TCCCAGAAGGTGAGAAAGTTAAA |
| 2300 | CCCAGAAGGTGAGAAAGTTAAAA |
| 2301 | CCAGAAGGTGAGAAAGTTAAAAT |
| 2302 | CAGAAGGTGAGAAAGTTAAAATT |
| 2303 | AGAAGGTGAGAAAGTTAAAATTC |
| 2304 | GAAGGTGAGAAAGTTAAAATTCC |
| 2305 | AAGGTGAGAAAGTTAAAATTCCC |
| 2306 | AGGTGAGAAAGTTAAAATTCCCG |
| 2307 | GGTGAGAAAGTTAAAATTCCCGT |
| 2308 | GTGAGAAAGTTAAAATTCCCGTC |
| 2309 | TGAGAAAGTTAAAATTCCCGTCG |
| 2310 | GAGAAAGTTAAAATTCCCGTCGC |
| 2311 | AGAAAGTTAAAATTCCCGTCGCT |
| 2312 | GAAAGTTAAAATTCCCGTCGCTA |
| 2313 | AAAGTTAAAATTCCCGTCGCTAT |
| 2314 | AAGTTAAAATTCCCGTCGCTATC |
| 2315 | AGTTAAAATTCCCGTCGCTATCA |
| 2316 | GTTAAAATTCCCGTCGCTATCAA |
| 2317 | TTAAAATTCCCGTCGCTATCAAG |
| 2318 | TAAAATTCCCGTCGCTATCAAGG |
| 2319 | AAAATTCCCGTCGCTATCAAGGA |
| 2320 | AAATTCCCGTCGCTATCAAGGAA |

| ID | SEQUENCE |
|---|---|
| 2321 | AATTCCCGTCGCTATCAAGGAAT |
| 2322 | ATTCCCGTCGCTATCAAGGAATT |
| 2323 | TTCCCGTCGCTATCAAGGAATTA |
| 2324 | TCCCGTCGCTATCAAGGAATTAA |
| 2325 | CCCGTCGCTATCAAGGAATTAAG |
| 2326 | CCGTCGCTATCAAGGAATTAAGA |
| 2327 | CGTCGCTATCAAGGAATTAAGAG |
| 2328 | GTCGCTATCAAGGAATTAAGAGA |
| 2329 | TCGCTATCAAGGAATTAAGAGAA |
| 2330 | CGCTATCAAGGAATTAAGAGAAG |
| 2331 | GCTATCAAGGAATTAAGAGAAGC |
| 2332 | CTATCAAGGAATTAAGAGAAGCA |
| 2333 | TATCAAGGAATTAAGAGAAGCAA |
| 2334 | ATCAAGGAATTAAGAGAAGCAAC |
| 2335 | TCAAGGAATTAAGAGAAGCAACA |
| 2336 | CAAGGAATTAAGAGAAGCAACAT |
| 2337 | AAGGAATTAAGAGAAGCAACATC |
| 2338 | AGGAATTAAGAGAAGCAACATCT |
| 2339 | GGAATTAAGAGAAGCAACATCTC |
| 2340 | GAATTAAGAGAAGCAACATCTCC |
| 2341 | AATTAAGAGAAGCAACATCTCCG |
| 2342 | ATTAAGAGAAGCAACATCTCCGA |
| 2343 | TTAAGAGAAGCAACATCTCCGAA |
| 2344 | TAAGAGAAGCAACATCTCCGAAA |
| 2345 | AAGAGAAGCAACATCTCCGAAAG |
| 2346 | AGAGAAGCAACATCTCCGAAAGC |
| 2347 | GAGAAGCAACATCTCCGAAAGCC |
| 2348 | AGAAGCAACATCTCCGAAAGCCA |
| 2349 | GAAGCAACATCTCCGAAAGCCAA |
| 2350 | AAGCAACATCTCCGAAAGCCAAC |
| 2351 | AGCAACATCTCCGAAAGCCAACA |
| 2352 | GCAACATCTCCGAAAGCCAACAA |
| 2353 | CAACATCTCCGAAAGCCAACAAG |
| 2354 | AACATCTCCGAAAGCCAACAAGG |
| 2355 | ACATCTCCGAAAGCCAACAAGGA |
| 2356 | CATCTCCGAAAGCCAACAAGGAA |
| 2357 | ATCTCCGAAAGCCAACAAGGAAA |
| 2358 | TCTCCGAAAGCCAACAAGGAAAT |
| 2359 | CTCCGAAAGCCAACAAGGAAATC |
| 2360 | TCCGAAAGCCAACAAGGAAATCC |
| 2361 | CCGAAAGCCAACAAGGAAATCCT |
| 2362 | CGAAAGCCAACAAGGAAATCCTC |
| 2363 | GAAAGCCAACAAGGAAATCCTCG |
| 2364 | AAAGCCAACAAGGAAATCCTCGA |
| 2365 | AAGCCAACAAGGAAATCCTCGAT |
| 2366 | AGCCAACAAGGAAATCCTCGATG |
| 2367 | GCCAACAAGGAAATCCTCGATGA |
| 2368 | CCAACAAGGAAATCCTCGATGAA |
| 2369 | CAACAAGGAAATCCTCGATGAAG |
| 2370 | AACAAGGAAATCCTCGATGAAGC |
| 2371 | ACAAGGAAATCCTCGATGAAGCC |
| 2372 | CAAGGAAATCCTCGATGAAGCCT |
| 2373 | AAGGAAATCCTCGATGAAGCCTA |
| 2374 | AGGAAATCCTCGATGAAGCCTAC |
| 2375 | GGAAATCCTCGATGAAGCCTACG |
| 2376 | GAAATCCTCGATGAAGCCTACGT |
| 2377 | AAATCCTCGATGAAGCCTACGTG |
| 2378 | AATCCTCGATGAAGCCTACGTGA |

| ID | SEQUENCE |
|---|---|
| 2379 | ATCCTCGATGAAGCCTACGTGAT |
| 2380 | TCCTCGATGAAGCCTACGTGATG |
| 2381 | CCTCGATGAAGCCTACGTGATGG |
| 2382 | CTCGATGAAGCCTACGTGATGGC |
| 2383 | TCGATGAAGCCTACGTGATGGCC |
| 2384 | CGATGAAGCCTACGTGATGGCCA |
| 2385 | GATGAAGCCTACGTGATGGCCAG |
| 2386 | ATGAAGCCTACGTGATGGCCAGC |
| 2387 | TGAAGCCTACGTGATGGCCAGCG |
| 2388 | GAAGCCTACGTGATGGCCAGCGT |
| 2389 | AAGCCTACGTGATGGCCAGCGTG |
| 2390 | AGCCTACGTGATGGCCAGCGTGG |
| 2391 | GCCTACGTGATGGCCAGCGTGGA |
| 2392 | CCTACGTGATGGCCAGCGTGGAC |
| 2393 | CTACGTGATGGCCAGCGTGGACA |
| 2394 | TACGTGATGGCCAGCGTGGACAA |
| 2395 | ACGTGATGGCCAGCGTGGACAAC |
| 2396 | CGTGATGGCCAGCGTGGACAACC |
| 2397 | GTGATGGCCAGCGTGGACAACCC |
| 2398 | TGATGGCCAGCGTGGACAACCCC |
| 2399 | GATGGCCAGCGTGGACAACCCCC |
| 2400 | ATGGCCAGCGTGGACAACCCCCA |
| 2401 | TGGCCAGCGTGGACAACCCCCAC |
| 2402 | GGCCAGCGTGGACAACCCCCACG |
| 2403 | GCCAGCGTGGACAACCCCCACGT |
| 2404 | CCAGCGTGGACAACCCCCACGTG |
| 2405 | CAGCGTGGACAACCCCCACGTGT |
| 2406 | AGCGTGGACAACCCCCACGTGTG |
| 2407 | GCGTGGACAACCCCCACGTGTGC |
| 2408 | CGTGGACAACCCCCACGTGTGCC |
| 2409 | GTGGACAACCCCCACGTGTGCCG |
| 2410 | TGGACAACCCCCACGTGTGCCGC |
| 2411 | GGACAACCCCCACGTGTGCCGCC |
| 2412 | GACAACCCCCACGTGTGCCGCCT |
| 2413 | ACAACCCCCACGTGTGCCGCCTG |
| 2414 | CAACCCCCACGTGTGCCGCCTGC |
| 2415 | AACCCCCACGTGTGCCGCCTGCT |
| 2416 | ACCCCCACGTGTGCCGCCTGCTG |
| 2417 | CCCCCACGTGTGCCGCCTGCTGG |
| 2418 | CCCCACGTGTGCCGCCTGCTGGG |
| 2419 | CCCACGTGTGCCGCCTGCTGGGC |
| 2420 | CCACGTGTGCCGCCTGCTGGGCA |
| 2421 | CACGTGTGCCGCCTGCTGGGCAT |
| 2422 | ACGTGTGCCGCCTGCTGGGCATC |
| 2423 | CGTGTGCCGCCTGCTGGGCATCT |
| 2424 | GTGTGCCGCCTGCTGGGCATCTG |
| 2425 | TGTGCCGCCTGCTGGGCATCTGC |
| 2426 | GTGCCGCCTGCTGGGCATCTGCC |
| 2427 | TGCCGCCTGCTGGGCATCTGCCT |
| 2428 | GCCGCCTGCTGGGCATCTGCCTC |
| 2429 | CCGCCTGCTGGGCATCTGCCTCA |
| 2430 | CGCCTGCTGGGCATCTGCCTCAC |
| 2431 | GCCTGCTGGGCATCTGCCTCACC |
| 2432 | CCTGCTGGGCATCTGCCTCACCT |
| 2433 | CTGCTGGGCATCTGCCTCACCTC |
| 2434 | TGCTGGGCATCTGCCTCACCTCC |
| 2435 | GCTGGGCATCTGCCTCACCTCCA |
| 2436 | CTGGGCATCTGCCTCACCTCCAC |

| ID | SEQUENCE |
|---|---|
| 2437 | TGGGCATCTGCCTCACCTCCACC |
| 2438 | GGGCATCTGCCTCACCTCCACCG |
| 2439 | GGCATCTGCCTCACCTCCACCGT |
| 2440 | GCATCTGCCTCACCTCCACCGTG |
| 2441 | CATCTGCCTCACCTCCACCGTGC |
| 2442 | ATCTGCCTCACCTCCACCGTGCA |
| 2443 | TCTGCCTCACCTCCACCGTGCAG |
| 2444 | CTGCCTCACCTCCACCGTGCAGC |
| 2445 | TGCCTCACCTCCACCGTGCAGCT |
| 2446 | GCCTCACCTCCACCGTGCAGCTC |
| 2447 | CCTCACCTCCACCGTGCAGCTCA |
| 2448 | CTCACCTCCACCGTGCAGCTCAT |
| 2449 | TCACCTCCACCGTGCAGCTCATC |
| 2450 | CACCTCCACCGTGCAGCTCATCA |
| 2451 | ACCTCCACCGTGCAGCTCATCAC |
| 2452 | CCTCCACCGTGCAGCTCATCACG |
| 2453 | CTCCACCGTGCAGCTCATCACGC |
| 2454 | TCCACCGTGCAGCTCATCACGCA |
| 2455 | CCACCGTGCAGCTCATCACGCAG |
| 2456 | CACCGTGCAGCTCATCACGCAGC |
| 2457 | ACCGTGCAGCTCATCACGCAGCT |
| 2458 | CCGTGCAGCTCATCACGCAGCTC |
| 2459 | CGTGCAGCTCATCACGCAGCTCA |
| 2460 | GTGCAGCTCATCACGCAGCTCAT |
| 2461 | TGCAGCTCATCACGCAGCTCATG |
| 2462 | GCAGCTCATCACGCAGCTCATGC |
| 2463 | CAGCTCATCACGCAGCTCATGCC |
| 2464 | AGCTCATCACGCAGCTCATGCCC |
| 2465 | GCTCATCACGCAGCTCATGCCCT |
| 2466 | CTCATCACGCAGCTCATGCCCTT |
| 2467 | TCATCACGCAGCTCATGCCCTTC |
| 2468 | CATCACGCAGCTCATGCCCTTCG |
| 2469 | ATCACGCAGCTCATGCCCTTCGG |
| 2470 | TCACGCAGCTCATGCCCTTCGGC |
| 2471 | CACGCAGCTCATGCCCTTCGGCT |
| 2472 | ACGCAGCTCATGCCCTTCGGCTG |
| 2473 | CGCAGCTCATGCCCTTCGGCTGC |
| 2474 | GCAGCTCATGCCCTTCGGCTGCC |
| 2475 | CAGCTCATGCCCTTCGGCTGCCT |
| 2476 | AGCTCATGCCCTTCGGCTGCCTC |
| 2477 | GCTCATGCCCTTCGGCTGCCTCC |
| 2478 | CTCATGCCCTTCGGCTGCCTCCT |
| 2479 | TCATGCCCTTCGGCTGCCTCCTG |
| 2480 | CATGCCCTTCGGCTGCCTCCTGG |
| 2481 | ATGCCCTTCGGCTGCCTCCTGGA |
| 2482 | TGCCCTTCGGCTGCCTCCTGGAC |
| 2483 | GCCCTTCGGCTGCCTCCTGGACT |
| 2484 | CCCTTCGGCTGCCTCCTGGACTA |
| 2485 | CCTTCGGCTGCCTCCTGGACTAT |
| 2486 | CTTCGGCTGCCTCCTGGACTATG |
| 2487 | TTCGGCTGCCTCCTGGACTATGT |
| 2488 | TCGGCTGCCTCCTGGACTATGTC |
| 2489 | CGGCTGCCTCCTGGACTATGTCC |
| 2490 | GGCTGCCTCCTGGACTATGTCCG |
| 2491 | GCTGCCTCCTGGACTATGTCCGG |
| 2492 | CTGCCTCCTGGACTATGTCCGGG |
| 2493 | TGCCTCCTGGACTATGTCCGGGA |
| 2494 | GCCTCCTGGACTATGTCCGGGAA |

| ID | SEQUENCE |
|---|---|
| 2495 | CCTCCTGGACTATGTCCGGGAAC |
| 2496 | CTCCTGGACTATGTCCGGGAACA |
| 2497 | TCCTGGACTATGTCCGGGAACAC |
| 2498 | CCTGGACTATGTCCGGGAACACA |
| 2499 | CTGGACTATGTCCGGGAACACAA |
| 2500 | TGGACTATGTCCGGGAACACAAA |
| 2501 | GGACTATGTCCGGGAACACAAAG |
| 2502 | GACTATGTCCGGGAACACAAAGA |
| 2503 | ACTATGTCCGGGAACACAAAGAC |
| 2504 | CTATGTCCGGGAACACAAAGACA |
| 2505 | TATGTCCGGGAACACAAAGACAA |
| 2506 | ATGTCCGGGAACACAAAGACAAT |
| 2507 | TGTCCGGGAACACAAAGACAATA |
| 2508 | GTCCGGGAACACAAAGACAATAT |
| 2509 | TCCGGGAACACAAAGACAATATT |
| 2510 | CCGGGAACACAAAGACAATATTG |
| 2511 | CGGGAACACAAAGACAATATTGG |
| 2512 | GGGAACACAAAGACAATATTGGC |
| 2513 | GGAACACAAAGACAATATTGGCT |
| 2514 | GAACACAAAGACAATATTGGCTC |
| 2515 | AACACAAAGACAATATTGGCTCC |
| 2516 | ACACAAAGACAATATTGGCTCCC |
| 2517 | CACAAAGACAATATTGGCTCCCA |
| 2518 | ACAAAGACAATATTGGCTCCCAG |
| 2519 | CAAAGACAATATTGGCTCCCAGT |
| 2520 | AAAGACAATATTGGCTCCCAGTA |
| 2521 | AAGACAATATTGGCTCCCAGTAC |
| 2522 | AGACAATATTGGCTCCCAGTACC |
| 2523 | GACAATATTGGCTCCCAGTACCT |
| 2524 | ACAATATTGGCTCCCAGTACCTG |
| 2525 | CAATATTGGCTCCCAGTACCTGC |
| 2526 | AATATTGGCTCCCAGTACCTGCT |
| 2527 | ATATTGGCTCCCAGTACCTGCTC |
| 2528 | TATTGGCTCCCAGTACCTGCTCA |
| 2529 | ATTGGCTCCCAGTACCTGCTCAA |
| 2530 | TTGGCTCCCAGTACCTGCTCAAC |
| 2531 | TGGCTCCCAGTACCTGCTCAACT |
| 2532 | GGCTCCCAGTACCTGCTCAACTG |
| 2533 | GCTCCCAGTACCTGCTCAACTGG |
| 2534 | CTCCCAGTACCTGCTCAACTGGT |
| 2535 | TCCCAGTACCTGCTCAACTGGTG |
| 2536 | CCCAGTACCTGCTCAACTGGTGT |
| 2537 | CCAGTACCTGCTCAACTGGTGTG |
| 2538 | CAGTACCTGCTCAACTGGTGTGT |
| 2539 | AGTACCTGCTCAACTGGTGTGTG |
| 2540 | GTACCTGCTCAACTGGTGTGTGC |
| 2541 | TACCTGCTCAACTGGTGTGTGCA |
| 2542 | ACCTGCTCAACTGGTGTGTGCAG |
| 2543 | CCTGCTCAACTGGTGTGTGCAGA |
| 2544 | CTGCTCAACTGGTGTGTGCAGAT |
| 2545 | TGCTCAACTGGTGTGTGCAGATC |
| 2546 | GCTCAACTGGTGTGTGCAGATCG |
| 2547 | CTCAACTGGTGTGTGCAGATCGC |
| 2548 | TCAACTGGTGTGTGCAGATCGCA |
| 2549 | CAACTGGTGTGTGCAGATCGCAA |
| 2550 | AACTGGTGTGTGCAGATCGCAAA |
| 2551 | ACTGGTGTGTGCAGATCGCAAAG |
| 2552 | CTGGTGTGTGCAGATCGCAAAGG |

| ID | SEQUENCE |
|---|---|
| 2553 | TGGTGTGTGCAGATCGCAAAGGG |
| 2554 | GGTGTGTGCAGATCGCAAAGGGC |
| 2555 | GTGTGTGCAGATCGCAAAGGGCA |
| 2556 | TGTGTGCAGATCGCAAAGGGCAT |
| 2557 | GTGTGCAGATCGCAAAGGGCATG |
| 2558 | TGTGCAGATCGCAAAGGGCATGA |
| 2559 | GTGCAGATCGCAAAGGGCATGAA |
| 2560 | TGCAGATCGCAAAGGGCATGAAC |
| 2561 | GCAGATCGCAAAGGGCATGAACT |
| 2562 | CAGATCGCAAAGGGCATGAACTA |
| 2563 | AGATCGCAAAGGGCATGAACTAC |
| 2564 | GATCGCAAAGGGCATGAACTACT |
| 2565 | ATCGCAAAGGGCATGAACTACTT |
| 2566 | TCGCAAAGGGCATGAACTACTTG |
| 2567 | CGCAAAGGGCATGAACTACTTGG |
| 2568 | GCAAAGGGCATGAACTACTTGGA |
| 2569 | CAAAGGGCATGAACTACTTGGAG |
| 2570 | AAAGGGCATGAACTACTTGGAGG |
| 2571 | AAGGGCATGAACTACTTGGAGGA |
| 2572 | AGGGCATGAACTACTTGGAGGAC |
| 2573 | GGGCATGAACTACTTGGAGGACC |
| 2574 | GGCATGAACTACTTGGAGGACCG |
| 2575 | GCATGAACTACTTGGAGGACCGT |
| 2576 | CATGAACTACTTGGAGGACCGTC |
| 2577 | ATGAACTACTTGGAGGACCGTCG |
| 2578 | TGAACTACTTGGAGGACCGTCGC |
| 2579 | GAACTACTTGGAGGACCGTCGCT |
| 2580 | AACTACTTGGAGGACCGTCGCTT |
| 2581 | ACTACTTGGAGGACCGTCGCTTG |
| 2582 | CTACTTGGAGGACCGTCGCTTGG |
| 2583 | TACTTGGAGGACCGTCGCTTGGT |
| 2584 | ACTTGGAGGACCGTCGCTTGGTG |
| 2585 | CTTGGAGGACCGTCGCTTGGTGC |
| 2586 | TTGGAGGACCGTCGCTTGGTGCA |
| 2587 | TGGAGGACCGTCGCTTGGTGCAC |
| 2588 | GGAGGACCGTCGCTTGGTGCACC |
| 2589 | GAGGACCGTCGCTTGGTGCACCG |
| 2590 | AGGACCGTCGCTTGGTGCACCGC |
| 2591 | GGACCGTCGCTTGGTGCACCGCG |
| 2592 | GACCGTCGCTTGGTGCACCGCGA |
| 2593 | ACCGTCGCTTGGTGCACCGCGAC |
| 2594 | CCGTCGCTTGGTGCACCGCGACC |
| 2595 | CGTCGCTTGGTGCACCGCGACCT |
| 2596 | GTCGCTTGGTGCACCGCGACCTG |
| 2597 | TCGCTTGGTGCACCGCGACCTGG |
| 2598 | CGCTTGGTGCACCGCGACCTGGC |
| 2599 | GCTTGGTGCACCGCGACCTGGCA |
| 2600 | CTTGGTGCACCGCGACCTGGCAG |
| 2601 | TTGGTGCACCGCGACCTGGCAGC |
| 2602 | TGGTGCACCGCGACCTGGCAGCC |
| 2603 | GGTGCACCGCGACCTGGCAGCCA |
| 2604 | GTGCACCGCGACCTGGCAGCCAG |
| 2605 | TGCACCGCGACCTGGCAGCCAGG |
| 2606 | GCACCGCGACCTGGCAGCCAGGA |
| 2607 | CACCGCGACCTGGCAGCCAGGAA |
| 2608 | ACCGCGACCTGGCAGCCAGGAAC |
| 2609 | CCGCGACCTGGCAGCCAGGAACG |
| 2610 | CGCGACCTGGCAGCCAGGAACGT |

| ID | SEQUENCE |
|---|---|
| 2611 | GCGACCTGGCAGCCAGGAACGTA |
| 2612 | CGACCTGGCAGCCAGGAACGTAC |
| 2613 | GACCTGGCAGCCAGGAACGTACT |
| 2614 | ACCTGGCAGCCAGGAACGTACTG |
| 2615 | CCTGGCAGCCAGGAACGTACTGG |
| 2616 | CTGGCAGCCAGGAACGTACTGGT |
| 2617 | TGGCAGCCAGGAACGTACTGGTG |
| 2618 | GGCAGCCAGGAACGTACTGGTGA |
| 2619 | GCAGCCAGGAACGTACTGGTGAA |
| 2620 | CAGCCAGGAACGTACTGGTGAAA |
| 2621 | AGCCAGGAACGTACTGGTGAAAA |
| 2622 | GCCAGGAACGTACTGGTGAAAAC |
| 2623 | CCAGGAACGTACTGGTGAAAACA |
| 2624 | CAGGAACGTACTGGTGAAAACAC |
| 2625 | AGGAACGTACTGGTGAAAACACC |
| 2626 | GGAACGTACTGGTGAAAACACCG |
| 2627 | GAACGTACTGGTGAAAACACCGC |
| 2628 | AACGTACTGGTGAAAACACCGCA |
| 2629 | ACGTACTGGTGAAAACACCGCAG |
| 2630 | CGTACTGGTGAAAACACCGCAGC |
| 2631 | GTACTGGTGAAAACACCGCAGCA |
| 2632 | TACTGGTGAAAACACCGCAGCAT |
| 2633 | ACTGGTGAAAACACCGCAGCATG |
| 2634 | CTGGTGAAAACACCGCAGCATGT |
| 2635 | TGGTGAAAACACCGCAGCATGTC |
| 2636 | GGTGAAAACACCGCAGCATGTCA |
| 2637 | GTGAAAACACCGCAGCATGTCAA |
| 2638 | TGAAAACACCGCAGCATGTCAAG |
| 2639 | GAAAACACCGCAGCATGTCAAGA |
| 2640 | AAAACACCGCAGCATGTCAAGAT |
| 2641 | AAACACCGCAGCATGTCAAGATC |
| 2642 | AACACCGCAGCATGTCAAGATCA |
| 2643 | ACACCGCAGCATGTCAAGATCAC |
| 2644 | CACCGCAGCATGTCAAGATCACA |
| 2645 | ACCGCAGCATGTCAAGATCACAG |
| 2646 | CCGCAGCATGTCAAGATCACAGA |
| 2647 | CGCAGCATGTCAAGATCACAGAT |
| 2648 | GCAGCATGTCAAGATCACAGATT |
| 2649 | CAGCATGTCAAGATCACAGATTT |
| 2650 | AGCATGTCAAGATCACAGATTTT |
| 2651 | GCATGTCAAGATCACAGATTTTG |
| 2652 | CATGTCAAGATCACAGATTTTGG |
| 2653 | ATGTCAAGATCACAGATTTTGGG |
| 2654 | TGTCAAGATCACAGATTTTGGGC |
| 2655 | GTCAAGATCACAGATTTTGGGCT |
| 2656 | TCAAGATCACAGATTTTGGGCTG |
| 2657 | CAAGATCACAGATTTTGGGCTGG |
| 2658 | AAGATCACAGATTTTGGGCTGGC |
| 2659 | AGATCACAGATTTTGGGCTGGCC |
| 2660 | GATCACAGATTTTGGGCTGGCCA |
| 2661 | ATCACAGATTTTGGGCTGGCCAA |
| 2662 | TCACAGATTTTGGGCTGGCCAAA |
| 2663 | CACAGATTTTGGGCTGGCCAAAC |
| 2664 | ACAGATTTTGGGCTGGCCAAACT |
| 2665 | CAGATTTTGGGCTGGCCAAACTG |
| 2666 | AGATTTTGGGCTGGCCAAACTGC |
| 2667 | GATTTTGGGCTGGCCAAACTGCT |
| 2668 | ATTTTGGGCTGGCCAAACTGCTG |

| ID | SEQUENCE |
|---|---|
| 2669 | TTTTGGGCTGGCCAAACTGCTGG |
| 2670 | TTTGGGCTGGCCAAACTGCTGGG |
| 2671 | TTGGGCTGGCCAAACTGCTGGGT |
| 2672 | TGGGCTGGCCAAACTGCTGGGTG |
| 2673 | GGGCTGGCCAAACTGCTGGGTGC |
| 2674 | GGCTGGCCAAACTGCTGGGTGCG |
| 2675 | GCTGGCCAAACTGCTGGGTGCGG |
| 2676 | CTGGCCAAACTGCTGGGTGCGGA |
| 2677 | TGGCCAAACTGCTGGGTGCGGAA |
| 2678 | GGCCAAACTGCTGGGTGCGGAAG |
| 2679 | GCCAAACTGCTGGGTGCGGAAGA |
| 2680 | CCAAACTGCTGGGTGCGGAAGAG |
| 2681 | CAAACTGCTGGGTGCGGAAGAGA |
| 2682 | AAACTGCTGGGTGCGGAAGAGAA |
| 2683 | AACTGCTGGGTGCGGAAGAGAAA |
| 2684 | ACTGCTGGGTGCGGAAGAGAAAG |
| 2685 | CTGCTGGGTGCGGAAGAGAAAGA |
| 2686 | TGCTGGGTGCGGAAGAGAAAGAA |
| 2687 | GCTGGGTGCGGAAGAGAAAGAAT |
| 2688 | CTGGGTGCGGAAGAGAAAGAATA |
| 2689 | TGGGTGCGGAAGAGAAAGAATAC |
| 2690 | GGGTGCGGAAGAGAAAGAATACC |
| 2691 | GGTGCGGAAGAGAAAGAATACCA |
| 2692 | GTGCGGAAGAGAAAGAATACCAT |
| 2693 | TGCGGAAGAGAAAGAATACCATG |
| 2694 | GCGGAAGAGAAAGAATACCATGC |
| 2695 | CGGAAGAGAAAGAATACCATGCA |
| 2696 | GGAAGAGAAAGAATACCATGCAG |
| 2697 | GAAGAGAAAGAATACCATGCAGA |
| 2698 | AAGAGAAAGAATACCATGCAGAA |
| 2699 | AGAGAAAGAATACCATGCAGAAG |
| 2700 | GAGAAAGAATACCATGCAGAAGG |
| 2701 | AGAAAGAATACCATGCAGAAGGA |
| 2702 | GAAAGAATACCATGCAGAAGGAG |
| 2703 | AAAGAATACCATGCAGAAGGAGG |
| 2704 | AAGAATACCATGCAGAAGGAGGC |
| 2705 | AGAATACCATGCAGAAGGAGGCA |
| 2706 | GAATACCATGCAGAAGGAGGCAA |
| 2707 | AATACCATGCAGAAGGAGGCAAA |
| 2708 | ATACCATGCAGAAGGAGGCAAAG |
| 2709 | TACCATGCAGAAGGAGGCAAAGT |
| 2710 | ACCATGCAGAAGGAGGCAAAGTG |
| 2711 | CCATGCAGAAGGAGGCAAAGTGC |
| 2712 | CATGCAGAAGGAGGCAAAGTGCC |
| 2713 | ATGCAGAAGGAGGCAAAGTGCCT |
| 2714 | TGCAGAAGGAGGCAAAGTGCCTA |
| 2715 | GCAGAAGGAGGCAAAGTGCCTAT |
| 2716 | CAGAAGGAGGCAAAGTGCCTATC |
| 2717 | AGAAGGAGGCAAAGTGCCTATCA |
| 2718 | GAAGGAGGCAAAGTGCCTATCAA |
| 2719 | AAGGAGGCAAAGTGCCTATCAAG |
| 2720 | AGGAGGCAAAGTGCCTATCAAGT |
| 2721 | GGAGGCAAAGTGCCTATCAAGTG |
| 2722 | GAGGCAAAGTGCCTATCAAGTGG |
| 2723 | AGGCAAAGTGCCTATCAAGTGGA |
| 2724 | GGCAAAGTGCCTATCAAGTGGAT |
| 2725 | GCAAAGTGCCTATCAAGTGGATG |
| 2726 | CAAAGTGCCTATCAAGTGGATGG |

| ID | SEQUENCE |
|---|---|
| 2727 | AAAGTGCCTATCAAGTGGATGGC |
| 2728 | AAGTGCCTATCAAGTGGATGGCA |
| 2729 | AGTGCCTATCAAGTGGATGGCAT |
| 2730 | GTGCCTATCAAGTGGATGGCATT |
| 2731 | TGCCTATCAAGTGGATGGCATTG |
| 2732 | GCCTATCAAGTGGATGGCATTGG |
| 2733 | CCTATCAAGTGGATGGCATTGGA |
| 2734 | CTATCAAGTGGATGGCATTGGAA |
| 2735 | TATCAAGTGGATGGCATTGGAAT |
| 2736 | ATCAAGTGGATGGCATTGGAATC |
| 2737 | TCAAGTGGATGGCATTGGAATCA |
| 2738 | CAAGTGGATGGCATTGGAATCAA |
| 2739 | AAGTGGATGGCATTGGAATCAAT |
| 2740 | AGTGGATGGCATTGGAATCAATT |
| 2741 | GTGGATGGCATTGGAATCAATTT |
| 2742 | TGGATGGCATTGGAATCAATTTT |
| 2743 | GGATGGCATTGGAATCAATTTTA |
| 2744 | GATGGCATTGGAATCAATTTTAC |
| 2745 | ATGGCATTGGAATCAATTTTACA |
| 2746 | TGGCATTGGAATCAATTTTACAC |
| 2747 | GGCATTGGAATCAATTTTACACA |
| 2748 | GCATTGGAATCAATTTTACACAG |
| 2749 | CATTGGAATCAATTTTACACAGA |
| 2750 | ATTGGAATCAATTTTACACAGAA |
| 2751 | TTGGAATCAATTTTACACAGAAT |
| 2752 | TGGAATCAATTTTACACAGAATC |
| 2753 | GGAATCAATTTTACACAGAATCT |
| 2754 | GAATCAATTTTACACAGAATCTA |
| 2755 | AATCAATTTTACACAGAATCTAT |
| 2756 | ATCAATTTTACACAGAATCTATA |
| 2757 | TCAATTTTACACAGAATCTATAC |
| 2758 | CAATTTTACACAGAATCTATACC |
| 2759 | AATTTTACACAGAATCTATACCC |
| 2760 | ATTTTACACAGAATCTATACCCA |
| 2761 | TTTTACACAGAATCTATACCCAC |
| 2762 | TTTACACAGAATCTATACCCACC |
| 2763 | TTACACAGAATCTATACCCACCA |
| 2764 | TACACAGAATCTATACCCACCAG |
| 2765 | ACACAGAATCTATACCCACCAGA |
| 2766 | CACAGAATCTATACCCACCAGAG |
| 2767 | ACAGAATCTATACCCACCAGAGT |
| 2768 | CAGAATCTATACCCACCAGAGTG |
| 2769 | AGAATCTATACCCACCAGAGTGA |
| 2770 | GAATCTATACCCACCAGAGTGAT |
| 2771 | AATCTATACCCACCAGAGTGATG |
| 2772 | ATCTATACCCACCAGAGTGATGT |
| 2773 | TCTATACCCACCAGAGTGATGTC |
| 2774 | CTATACCCACCAGAGTGATGTCT |
| 2775 | TATACCCACCAGAGTGATGTCTG |
| 2776 | ATACCCACCAGAGTGATGTCTGG |
| 2777 | TACCCACCAGAGTGATGTCTGGA |
| 2778 | ACCCACCAGAGTGATGTCTGGAG |
| 2779 | CCCACCAGAGTGATGTCTGGAGC |
| 2780 | CCACCAGAGTGATGTCTGGAGCT |
| 2781 | CACCAGAGTGATGTCTGGAGCTA |
| 2782 | ACCAGAGTGATGTCTGGAGCTAC |
| 2783 | CCAGAGTGATGTCTGGAGCTACG |
| 2784 | CAGAGTGATGTCTGGAGCTACGG |

| ID | SEQUENCE |
|---|---|
| 2785 | AGAGTGATGTCTGGAGCTACGGG |
| 2786 | GAGTGATGTCTGGAGCTACGGGG |
| 2787 | AGTGATGTCTGGAGCTACGGGGT |
| 2788 | GTGATGTCTGGAGCTACGGGGTG |
| 2789 | TGATGTCTGGAGCTACGGGGTGA |
| 2790 | GATGTCTGGAGCTACGGGGTGAC |
| 2791 | ATGTCTGGAGCTACGGGGTGACC |
| 2792 | TGTCTGGAGCTACGGGGTGACCG |
| 2793 | GTCTGGAGCTACGGGGTGACCGT |
| 2794 | TCTGGAGCTACGGGGTGACCGTT |
| 2795 | CTGGAGCTACGGGGTGACCGTTT |
| 2796 | TGGAGCTACGGGGTGACCGTTTG |
| 2797 | GGAGCTACGGGGTGACCGTTTGG |
| 2798 | GAGCTACGGGGTGACCGTTTGGG |
| 2799 | AGCTACGGGGTGACCGTTTGGGA |
| 2800 | GCTACGGGGTGACCGTTTGGGAG |
| 2801 | CTACGGGGTGACCGTTTGGGAGT |
| 2802 | TACGGGGTGACCGTTTGGGAGTT |
| 2803 | ACGGGGTGACCGTTTGGGAGTTG |
| 2804 | CGGGGTGACCGTTTGGGAGTTGA |
| 2805 | GGGGTGACCGTTTGGGAGTTGAT |
| 2806 | GGGTGACCGTTTGGGAGTTGATG |
| 2807 | GGTGACCGTTTGGGAGTTGATGA |
| 2808 | GTGACCGTTTGGGAGTTGATGAC |
| 2809 | TGACCGTTTGGGAGTTGATGACC |
| 2810 | GACCGTTTGGGAGTTGATGACCT |
| 2811 | ACCGTTTGGGAGTTGATGACCTT |
| 2812 | CCGTTTGGGAGTTGATGACCTTT |
| 2813 | CGTTTGGGAGTTGATGACCTTTG |
| 2814 | GTTTGGGAGTTGATGACCTTTGG |
| 2815 | TTTGGGAGTTGATGACCTTTGGA |
| 2816 | TTGGGAGTTGATGACCTTTGGAT |
| 2817 | TGGGAGTTGATGACCTTTGGATC |
| 2818 | GGGAGTTGATGACCTTTGGATCC |
| 2819 | GGAGTTGATGACCTTTGGATCCA |
| 2820 | GAGTTGATGACCTTTGGATCCAA |
| 2821 | AGTTGATGACCTTTGGATCCAAG |
| 2822 | GTTGATGACCTTTGGATCCAAGC |
| 2823 | TTGATGACCTTTGGATCCAAGCC |
| 2824 | TGATGACCTTTGGATCCAAGCCA |
| 2825 | GATGACCTTTGGATCCAAGCCAT |
| 2826 | ATGACCTTTGGATCCAAGCCATA |
| 2827 | TGACCTTTGGATCCAAGCCATAT |
| 2828 | GACCTTTGGATCCAAGCCATATG |
| 2829 | ACCTTTGGATCCAAGCCATATGA |
| 2830 | CCTTTGGATCCAAGCCATATGAC |
| 2831 | CTTTGGATCCAAGCCATATGACG |
| 2832 | TTTGGATCCAAGCCATATGACGG |
| 2833 | TTGGATCCAAGCCATATGACGGA |
| 2834 | TGGATCCAAGCCATATGACGGAA |
| 2835 | GGATCCAAGCCATATGACGGAAT |
| 2836 | GATCCAAGCCATATGACGGAATC |
| 2837 | ATCCAAGCCATATGACGGAATCC |
| 2838 | TCCAAGCCATATGACGGAATCCC |
| 2839 | CCAAGCCATATGACGGAATCCCT |
| 2840 | CAAGCCATATGACGGAATCCCTG |
| 2841 | AAGCCATATGACGGAATCCCTGC |
| 2842 | AGCCATATGACGGAATCCCTGCC |

| ID | SEQUENCE |
|---|---|
| 2843 | GCCATATGACGGAATCCCTGCCA |
| 2844 | CCATATGACGGAATCCCTGCCAG |
| 2845 | CATATGACGGAATCCCTGCCAGC |
| 2846 | ATATGACGGAATCCCTGCCAGCG |
| 2847 | TATGACGGAATCCCTGCCAGCGA |
| 2848 | ATGACGGAATCCCTGCCAGCGAG |
| 2849 | TGACGGAATCCCTGCCAGCGAGA |
| 2850 | GACGGAATCCCTGCCAGCGAGAT |
| 2851 | ACGGAATCCCTGCCAGCGAGATC |
| 2852 | CGGAATCCCTGCCAGCGAGATCT |
| 2853 | GGAATCCCTGCCAGCGAGATCTC |
| 2854 | GAATCCCTGCCAGCGAGATCTCC |
| 2855 | AATCCCTGCCAGCGAGATCTCCT |
| 2856 | ATCCCTGCCAGCGAGATCTCCTC |
| 2857 | TCCCTGCCAGCGAGATCTCCTCC |
| 2858 | CCCTGCCAGCGAGATCTCCTCCA |
| 2859 | CCTGCCAGCGAGATCTCCTCCAT |
| 2860 | CTGCCAGCGAGATCTCCTCCATC |
| 2861 | TGCCAGCGAGATCTCCTCCATCC |
| 2862 | GCCAGCGAGATCTCCTCCATCCT |
| 2863 | CCAGCGAGATCTCCTCCATCCTG |
| 2864 | CAGCGAGATCTCCTCCATCCTGG |
| 2865 | AGCGAGATCTCCTCCATCCTGGA |
| 2866 | GCGAGATCTCCTCCATCCTGGAG |
| 2867 | CGAGATCTCCTCCATCCTGGAGA |
| 2868 | GAGATCTCCTCCATCCTGGAGAA |
| 2869 | AGATCTCCTCCATCCTGGAGAAA |
| 2870 | GATCTCCTCCATCCTGGAGAAAG |
| 2871 | ATCTCCTCCATCCTGGAGAAAGG |
| 2872 | TCTCCTCCATCCTGGAGAAAGGA |
| 2873 | CTCCTCCATCCTGGAGAAAGGAG |
| 2874 | TCCTCCATCCTGGAGAAAGGAGA |
| 2875 | CCTCCATCCTGGAGAAAGGAGAA |
| 2876 | CTCCATCCTGGAGAAAGGAGAAC |
| 2877 | TCCATCCTGGAGAAAGGAGAACG |
| 2878 | CCATCCTGGAGAAAGGAGAACGC |
| 2879 | CATCCTGGAGAAAGGAGAACGCC |
| 2880 | ATCCTGGAGAAAGGAGAACGCCT |
| 2881 | TCCTGGAGAAAGGAGAACGCCTC |
| 2882 | CCTGGAGAAAGGAGAACGCCTCC |
| 2883 | CTGGAGAAAGGAGAACGCCTCCC |
| 2884 | TGGAGAAAGGAGAACGCCTCCCT |
| 2885 | GGAGAAAGGAGAACGCCTCCCTC |
| 2886 | GAGAAAGGAGAACGCCTCCCTCA |
| 2887 | AGAAAGGAGAACGCCTCCCTCAG |
| 2888 | GAAAGGAGAACGCCTCCCTCAGC |
| 2889 | AAAGGAGAACGCCTCCCTCAGCC |
| 2890 | AAGGAGAACGCCTCCCTCAGCCA |
| 2891 | AGGAGAACGCCTCCCTCAGCCAC |
| 2892 | GGAGAACGCCTCCCTCAGCCACC |
| 2893 | GAGAACGCCTCCCTCAGCCACCC |
| 2894 | AGAACGCCTCCCTCAGCCACCCA |
| 2895 | GAACGCCTCCCTCAGCCACCCAT |
| 2896 | AACGCCTCCCTCAGCCACCCATA |
| 2897 | ACGCCTCCCTCAGCCACCCATAT |
| 2898 | CGCCTCCCTCAGCCACCCATATG |
| 2899 | GCCTCCCTCAGCCACCCATATGT |
| 2900 | CCTCCCTCAGCCACCCATATGTA |

| ID | SEQUENCE |
|---|---|
| 2901 | CTCCCTCAGCCACCCATATGTAC |
| 2902 | TCCCTCAGCCACCCATATGTACC |
| 2903 | CCCTCAGCCACCCATATGTACCA |
| 2904 | CCTCAGCCACCCATATGTACCAT |
| 2905 | CTCAGCCACCCATATGTACCATC |
| 2906 | TCAGCCACCCATATGTACCATCG |
| 2907 | CAGCCACCCATATGTACCATCGA |
| 2908 | AGCCACCCATATGTACCATCGAT |
| 2909 | GCCACCCATATGTACCATCGATG |
| 2910 | CCACCCATATGTACCATCGATGT |
| 2911 | CACCCATATGTACCATCGATGTC |
| 2912 | ACCCATATGTACCATCGATGTCT |
| 2913 | CCCATATGTACCATCGATGTCTA |
| 2914 | CCATATGTACCATCGATGTCTAC |
| 2915 | CATATGTACCATCGATGTCTACA |
| 2916 | ATATGTACCATCGATGTCTACAT |
| 2917 | TATGTACCATCGATGTCTACATG |
| 2918 | ATGTACCATCGATGTCTACATGA |
| 2919 | TGTACCATCGATGTCTACATGAT |
| 2920 | GTACCATCGATGTCTACATGATC |
| 2921 | TACCATCGATGTCTACATGATCA |
| 2922 | ACCATCGATGTCTACATGATCAT |
| 2923 | CCATCGATGTCTACATGATCATG |
| 2924 | CATCGATGTCTACATGATCATGG |
| 2925 | ATCGATGTCTACATGATCATGGT |
| 2926 | TCGATGTCTACATGATCATGGTC |
| 2927 | CGATGTCTACATGATCATGGTCA |
| 2928 | GATGTCTACATGATCATGGTCAA |
| 2929 | ATGTCTACATGATCATGGTCAAG |
| 2930 | TGTCTACATGATCATGGTCAAGT |
| 2931 | GTCTACATGATCATGGTCAAGTG |
| 2932 | TCTACATGATCATGGTCAAGTGC |
| 2933 | CTACATGATCATGGTCAAGTGCT |
| 2934 | TACATGATCATGGTCAAGTGCTG |
| 2935 | ACATGATCATGGTCAAGTGCTGG |
| 2936 | CATGATCATGGTCAAGTGCTGGA |
| 2937 | ATGATCATGGTCAAGTGCTGGAT |
| 2938 | TGATCATGGTCAAGTGCTGGATG |
| 2939 | GATCATGGTCAAGTGCTGGATGA |
| 2940 | ATCATGGTCAAGTGCTGGATGAT |
| 2941 | TCATGGTCAAGTGCTGGATGATA |
| 2942 | CATGGTCAAGTGCTGGATGATAG |
| 2943 | ATGGTCAAGTGCTGGATGATAGA |
| 2944 | TGGTCAAGTGCTGGATGATAGAC |
| 2945 | GGTCAAGTGCTGGATGATAGACG |
| 2946 | GTCAAGTGCTGGATGATAGACGC |
| 2947 | TCAAGTGCTGGATGATAGACGCA |
| 2948 | CAAGTGCTGGATGATAGACGCAG |
| 2949 | AAGTGCTGGATGATAGACGCAGA |
| 2950 | AGTGCTGGATGATAGACGCAGAT |
| 2951 | GTGCTGGATGATAGACGCAGATA |
| 2952 | TGCTGGATGATAGACGCAGATAG |
| 2953 | GCTGGATGATAGACGCAGATAGT |
| 2954 | CTGGATGATAGACGCAGATAGTC |
| 2955 | TGGATGATAGACGCAGATAGTCG |
| 2956 | GGATGATAGACGCAGATAGTCGC |
| 2957 | GATGATAGACGCAGATAGTCGCC |
| 2958 | ATGATAGACGCAGATAGTCGCCC |

| ID | SEQUENCE |
|---|---|
| 2959 | TGATAGACGCAGATAGTCGCCCA |
| 2960 | GATAGACGCAGATAGTCGCCCAA |
| 2961 | ATAGACGCAGATAGTCGCCCAAA |
| 2962 | TAGACGCAGATAGTCGCCCAAAG |
| 2963 | AGACGCAGATAGTCGCCCAAAGT |
| 2964 | GACGCAGATAGTCGCCCAAAGTT |
| 2965 | ACGCAGATAGTCGCCCAAAGTTC |
| 2966 | CGCAGATAGTCGCCCAAAGTTCC |
| 2967 | GCAGATAGTCGCCCAAAGTTCCG |
| 2968 | CAGATAGTCGCCCAAAGTTCCGT |
| 2969 | AGATAGTCGCCCAAAGTTCCGTG |
| 2970 | GATAGTCGCCCAAAGTTCCGTGA |
| 2971 | ATAGTCGCCCAAAGTTCCGTGAG |
| 2972 | TAGTCGCCCAAAGTTCCGTGAGT |
| 2973 | AGTCGCCCAAAGTTCCGTGAGTT |
| 2974 | GTCGCCCAAAGTTCCGTGAGTTG |
| 2975 | TCGCCCAAAGTTCCGTGAGTTGA |
| 2976 | CGCCCAAAGTTCCGTGAGTTGAT |
| 2977 | GCCCAAAGTTCCGTGAGTTGATC |
| 2978 | CCCAAAGTTCCGTGAGTTGATCA |
| 2979 | CCAAAGTTCCGTGAGTTGATCAT |
| 2980 | CAAAGTTCCGTGAGTTGATCATC |
| 2981 | AAAGTTCCGTGAGTTGATCATCG |
| 2982 | AAGTTCCGTGAGTTGATCATCGA |
| 2983 | AGTTCCGTGAGTTGATCATCGAA |
| 2984 | GTTCCGTGAGTTGATCATCGAAT |
| 2985 | TTCCGTGAGTTGATCATCGAATT |
| 2986 | TCCGTGAGTTGATCATCGAATTC |
| 2987 | CCGTGAGTTGATCATCGAATTCT |
| 2988 | CGTGAGTTGATCATCGAATTCTC |
| 2989 | GTGAGTTGATCATCGAATTCTCC |
| 2990 | TGAGTTGATCATCGAATTCTCCA |
| 2991 | GAGTTGATCATCGAATTCTCCAA |
| 2992 | AGTTGATCATCGAATTCTCCAAA |
| 2993 | GTTGATCATCGAATTCTCCAAAA |
| 2994 | TTGATCATCGAATTCTCCAAAAT |
| 2995 | TGATCATCGAATTCTCCAAAATG |
| 2996 | GATCATCGAATTCTCCAAAATGG |
| 2997 | ATCATCGAATTCTCCAAAATGGC |
| 2998 | TCATCGAATTCTCCAAAATGGCC |
| 2999 | CATCGAATTCTCCAAAATGGCCC |
| 3000 | ATCGAATTCTCCAAAATGGCCCG |
| 3001 | TCGAATTCTCCAAAATGGCCCGA |
| 3002 | CGAATTCTCCAAAATGGCCCGAG |
| 3003 | GAATTCTCCAAAATGGCCCGAGA |
| 3004 | AATTCTCCAAAATGGCCCGAGAC |
| 3005 | ATTCTCCAAAATGGCCCGAGACC |
| 3006 | TTCTCCAAAATGGCCCGAGACCC |
| 3007 | TCTCCAAAATGGCCCGAGACCCC |
| 3008 | CTCCAAAATGGCCCGAGACCCCC |
| 3009 | TCCAAAATGGCCCGAGACCCCCA |
| 3010 | CCAAAATGGCCCGAGACCCCCAG |
| 3011 | CAAAATGGCCCGAGACCCCCAGC |
| 3012 | AAAATGGCCCGAGACCCCCAGCG |
| 3013 | AAATGGCCCGAGACCCCCAGCGC |
| 3014 | AATGGCCCGAGACCCCCAGCGCT |
| 3015 | ATGGCCCGAGACCCCCAGCGCTA |
| 3016 | TGGCCCGAGACCCCCAGCGCTAC |

| ID | SEQUENCE |
|---|---|
| 3017 | GGCCCGAGACCCCCAGCGCTACC |
| 3018 | GCCCGAGACCCCCAGCGCTACCT |
| 3019 | CCCGAGACCCCCAGCGCTACCTT |
| 3020 | CCGAGACCCCCAGCGCTACCTTG |
| 3021 | CGAGACCCCCAGCGCTACCTTGT |
| 3022 | GAGACCCCCAGCGCTACCTTGTC |
| 3023 | AGACCCCCAGCGCTACCTTGTCA |
| 3024 | GACCCCCAGCGCTACCTTGTCAT |
| 3025 | ACCCCCAGCGCTACCTTGTCATT |
| 3026 | CCCCCAGCGCTACCTTGTCATTC |
| 3027 | CCCCAGCGCTACCTTGTCATTCA |
| 3028 | CCCAGCGCTACCTTGTCATTCAG |
| 3029 | CCAGCGCTACCTTGTCATTCAGG |
| 3030 | CAGCGCTACCTTGTCATTCAGGG |
| 3031 | AGCGCTACCTTGTCATTCAGGGG |
| 3032 | GCGCTACCTTGTCATTCAGGGGG |
| 3033 | CGCTACCTTGTCATTCAGGGGGA |
| 3034 | GCTACCTTGTCATTCAGGGGGAT |
| 3035 | CTACCTTGTCATTCAGGGGGATG |
| 3036 | TACCTTGTCATTCAGGGGGATGA |
| 3037 | ACCTTGTCATTCAGGGGGATGAA |
| 3038 | CCTTGTCATTCAGGGGGATGAAA |
| 3039 | CTTGTCATTCAGGGGGATGAAAG |
| 3040 | TTGTCATTCAGGGGGATGAAAGA |
| 3041 | TGTCATTCAGGGGGATGAAAGAA |
| 3042 | GTCATTCAGGGGGATGAAAGAAT |
| 3043 | TCATTCAGGGGGATGAAAGAATG |
| 3044 | CATTCAGGGGGATGAAAGAATGC |
| 3045 | ATTCAGGGGGATGAAAGAATGCA |
| 3046 | TTCAGGGGGATGAAAGAATGCAT |
| 3047 | TCAGGGGGATGAAAGAATGCATT |
| 3048 | CAGGGGGATGAAAGAATGCATTT |
| 3049 | AGGGGGATGAAAGAATGCATTTG |
| 3050 | GGGGGATGAAAGAATGCATTTGC |
| 3051 | GGGGATGAAAGAATGCATTTGCC |
| 3052 | GGGATGAAAGAATGCATTTGCCA |
| 3053 | GGATGAAAGAATGCATTTGCCAA |
| 3054 | GATGAAAGAATGCATTTGCCAAG |
| 3055 | ATGAAAGAATGCATTTGCCAAGT |
| 3056 | TGAAAGAATGCATTTGCCAAGTC |
| 3057 | GAAAGAATGCATTTGCCAAGTCC |
| 3058 | AAAGAATGCATTTGCCAAGTCCT |
| 3059 | AAGAATGCATTTGCCAAGTCCTA |
| 3060 | AGAATGCATTTGCCAAGTCCTAC |
| 3061 | GAATGCATTTGCCAAGTCCTACA |
| 3062 | AATGCATTTGCCAAGTCCTACAG |
| 3063 | ATGCATTTGCCAAGTCCTACAGA |
| 3064 | TGCATTTGCCAAGTCCTACAGAC |
| 3065 | GCATTTGCCAAGTCCTACAGACT |
| 3066 | CATTTGCCAAGTCCTACAGACTC |
| 3067 | ATTTGCCAAGTCCTACAGACTCC |
| 3068 | TTTGCCAAGTCCTACAGACTCCA |
| 3069 | TTGCCAAGTCCTACAGACTCCAA |
| 3070 | TGCCAAGTCCTACAGACTCCAAC |
| 3071 | GCCAAGTCCTACAGACTCCAACT |
| 3072 | CCAAGTCCTACAGACTCCAACTT |
| 3073 | CAAGTCCTACAGACTCCAACTTC |
| 3074 | AAGTCCTACAGACTCCAACTTCT |

| ID | SEQUENCE |
|---|---|
| 3075 | AGTCCTACAGACTCCAACTTCTA |
| 3076 | GTCCTACAGACTCCAACTTCTAC |
| 3077 | TCCTACAGACTCCAACTTCTACC |
| 3078 | CCTACAGACTCCAACTTCTACCG |
| 3079 | CTACAGACTCCAACTTCTACCGT |
| 3080 | TACAGACTCCAACTTCTACCGTG |
| 3081 | ACAGACTCCAACTTCTACCGTGC |
| 3082 | CAGACTCCAACTTCTACCGTGCC |
| 3083 | AGACTCCAACTTCTACCGTGCCC |
| 3084 | GACTCCAACTTCTACCGTGCCCT |
| 3085 | ACTCCAACTTCTACCGTGCCCTG |
| 3086 | CTCCAACTTCTACCGTGCCCTGA |
| 3087 | TCCAACTTCTACCGTGCCCTGAT |
| 3088 | CCAACTTCTACCGTGCCCTGATG |
| 3089 | CAACTTCTACCGTGCCCTGATGG |
| 3090 | AACTTCTACCGTGCCCTGATGGA |
| 3091 | ACTTCTACCGTGCCCTGATGGAT |
| 3092 | CTTCTACCGTGCCCTGATGGATG |
| 3093 | TTCTACCGTGCCCTGATGGATGA |
| 3094 | TCTACCGTGCCCTGATGGATGAA |
| 3095 | CTACCGTGCCCTGATGGATGAAG |
| 3096 | TACCGTGCCCTGATGGATGAAGA |
| 3097 | ACCGTGCCCTGATGGATGAAGAA |
| 3098 | CCGTGCCCTGATGGATGAAGAAG |
| 3099 | CGTGCCCTGATGGATGAAGAAGA |
| 3100 | GTGCCCTGATGGATGAAGAAGAC |
| 3101 | TGCCCTGATGGATGAAGAAGACA |
| 3102 | GCCCTGATGGATGAAGAAGACAT |
| 3103 | CCCTGATGGATGAAGAAGACATG |
| 3104 | CCTGATGGATGAAGAAGACATGG |
| 3105 | CTGATGGATGAAGAAGACATGGA |
| 3106 | TGATGGATGAAGAAGACATGGAC |
| 3107 | GATGGATGAAGAAGACATGGACG |
| 3108 | ATGGATGAAGAAGACATGGACGA |
| 3109 | TGGATGAAGAAGACATGGACGAC |
| 3110 | GGATGAAGAAGACATGGACGACG |
| 3111 | GATGAAGAAGACATGGACGACGT |
| 3112 | ATGAAGAAGACATGGACGACGTG |
| 3113 | TGAAGAAGACATGGACGACGTGG |
| 3114 | GAAGAAGACATGGACGACGTGGT |
| 3115 | AAGAAGACATGGACGACGTGGTG |
| 3116 | AGAAGACATGGACGACGTGGTGG |
| 3117 | GAAGACATGGACGACGTGGTGGA |
| 3118 | AAGACATGGACGACGTGGTGGAT |
| 3119 | AGACATGGACGACGTGGTGGATG |
| 3120 | GACATGGACGACGTGGTGGATGC |
| 3121 | ACATGGACGACGTGGTGGATGCC |
| 3122 | CATGGACGACGTGGTGGATGCCG |
| 3123 | ATGGACGACGTGGTGGATGCCGA |
| 3124 | TGGACGACGTGGTGGATGCCGAC |
| 3125 | GGACGACGTGGTGGATGCCGACG |
| 3126 | GACGACGTGGTGGATGCCGACGA |
| 3127 | ACGACGTGGTGGATGCCGACGAG |
| 3128 | CGACGTGGTGGATGCCGACGAGT |
| 3129 | GACGTGGTGGATGCCGACGAGTA |
| 3130 | ACGTGGTGGATGCCGACGAGTAC |
| 3131 | CGTGGTGGATGCCGACGAGTACC |
| 3132 | GTGGTGGATGCCGACGAGTACCT |

| ID | SEQUENCE |
|---|---|
| 3133 | TGGTGGATGCCGACGAGTACCTC |
| 3134 | GGTGGATGCCGACGAGTACCTCA |
| 3135 | GTGGATGCCGACGAGTACCTCAT |
| 3136 | TGGATGCCGACGAGTACCTCATC |
| 3137 | GGATGCCGACGAGTACCTCATCC |
| 3138 | GATGCCGACGAGTACCTCATCCC |
| 3139 | ATGCCGACGAGTACCTCATCCCA |
| 3140 | TGCCGACGAGTACCTCATCCCAC |
| 3141 | GCCGACGAGTACCTCATCCCACA |
| 3142 | CCGACGAGTACCTCATCCCACAG |
| 3143 | CGACGAGTACCTCATCCCACAGC |
| 3144 | GACGAGTACCTCATCCCACAGCA |
| 3145 | ACGAGTACCTCATCCCACAGCAG |
| 3146 | CGAGTACCTCATCCCACAGCAGG |
| 3147 | GAGTACCTCATCCCACAGCAGGG |
| 3148 | AGTACCTCATCCCACAGCAGGGC |
| 3149 | GTACCTCATCCCACAGCAGGGCT |
| 3150 | TACCTCATCCCACAGCAGGGCTT |
| 3151 | ACCTCATCCCACAGCAGGGCTTC |
| 3152 | CCTCATCCCACAGCAGGGCTTCT |
| 3153 | CTCATCCCACAGCAGGGCTTCTT |
| 3154 | TCATCCCACAGCAGGGCTTCTTC |
| 3155 | CATCCCACAGCAGGGCTTCTTCA |
| 3156 | ATCCCACAGCAGGGCTTCTTCAG |
| 3157 | TCCCACAGCAGGGCTTCTTCAGC |
| 3158 | CCCACAGCAGGGCTTCTTCAGCA |
| 3159 | CCACAGCAGGGCTTCTTCAGCAG |
| 3160 | CACAGCAGGGCTTCTTCAGCAGC |
| 3161 | ACAGCAGGGCTTCTTCAGCAGCC |
| 3162 | CAGCAGGGCTTCTTCAGCAGCCC |
| 3163 | AGCAGGGCTTCTTCAGCAGCCCC |
| 3164 | GCAGGGCTTCTTCAGCAGCCCCT |
| 3165 | CAGGGCTTCTTCAGCAGCCCCTC |
| 3166 | AGGGCTTCTTCAGCAGCCCCTCC |
| 3167 | GGGCTTCTTCAGCAGCCCCTCCA |
| 3168 | GGCTTCTTCAGCAGCCCCTCCAC |
| 3169 | GCTTCTTCAGCAGCCCCTCCACG |
| 3170 | CTTCTTCAGCAGCCCCTCCACGT |
| 3171 | TTCTTCAGCAGCCCCTCCACGTC |
| 3172 | TCTTCAGCAGCCCCTCCACGTCA |
| 3173 | CTTCAGCAGCCCCTCCACGTCAC |
| 3174 | TTCAGCAGCCCCTCCACGTCACG |
| 3175 | TCAGCAGCCCCTCCACGTCACGG |
| 3176 | CAGCAGCCCCTCCACGTCACGGA |
| 3177 | AGCAGCCCCTCCACGTCACGGAC |
| 3178 | GCAGCCCCTCCACGTCACGGACT |
| 3179 | CAGCCCCTCCACGTCACGGACTC |
| 3180 | AGCCCCTCCACGTCACGGACTCC |
| 3181 | GCCCCTCCACGTCACGGACTCCC |
| 3182 | CCCCTCCACGTCACGGACTCCCC |
| 3183 | CCCTCCACGTCACGGACTCCCCT |
| 3184 | CCTCCACGTCACGGACTCCCCTC |
| 3185 | CTCCACGTCACGGACTCCCCTCC |
| 3186 | TCCACGTCACGGACTCCCCTCCT |
| 3187 | CCACGTCACGGACTCCCCTCCTG |
| 3188 | CACGTCACGGACTCCCCTCCTGA |
| 3189 | ACGTCACGGACTCCCCTCCTGAG |
| 3190 | CGTCACGGACTCCCCTCCTGAGC |

| ID | SEQUENCE |
|---|---|
| 3191 | GTCACGGACTCCCCTCCTGAGCT |
| 3192 | TCACGGACTCCCCTCCTGAGCTC |
| 3193 | CACGGACTCCCCTCCTGAGCTCT |
| 3194 | ACGGACTCCCCTCCTGAGCTCTC |
| 3195 | CGGACTCCCCTCCTGAGCTCTCT |
| 3196 | GGACTCCCCTCCTGAGCTCTCTG |
| 3197 | GACTCCCCTCCTGAGCTCTCTGA |
| 3198 | ACTCCCCTCCTGAGCTCTCTGAG |
| 3199 | CTCCCCTCCTGAGCTCTCTGAGT |
| 3200 | TCCCCTCCTGAGCTCTCTGAGTG |
| 3201 | CCCCTCCTGAGCTCTCTGAGTGC |
| 3202 | CCCTCCTGAGCTCTCTGAGTGCA |
| 3203 | CCTCCTGAGCTCTCTGAGTGCAA |
| 3204 | CTCCTGAGCTCTCTGAGTGCAAC |
| 3205 | TCCTGAGCTCTCTGAGTGCAACC |
| 3206 | CCTGAGCTCTCTGAGTGCAACCA |
| 3207 | CTGAGCTCTCTGAGTGCAACCAG |
| 3208 | TGAGCTCTCTGAGTGCAACCAGC |
| 3209 | GAGCTCTCTGAGTGCAACCAGCA |
| 3210 | AGCTCTCTGAGTGCAACCAGCAA |
| 3211 | GCTCTCTGAGTGCAACCAGCAAC |
| 3212 | CTCTCTGAGTGCAACCAGCAACA |
| 3213 | TCTCTGAGTGCAACCAGCAACAA |
| 3214 | CTCTGAGTGCAACCAGCAACAAT |
| 3215 | TCTGAGTGCAACCAGCAACAATT |
| 3216 | CTGAGTGCAACCAGCAACAATTC |
| 3217 | TGAGTGCAACCAGCAACAATTCC |
| 3218 | GAGTGCAACCAGCAACAATTCCA |
| 3219 | AGTGCAACCAGCAACAATTCCAC |
| 3220 | GTGCAACCAGCAACAATTCCACC |
| 3221 | TGCAACCAGCAACAATTCCACCG |
| 3222 | GCAACCAGCAACAATTCCACCGT |
| 3223 | CAACCAGCAACAATTCCACCGTG |
| 3224 | AACCAGCAACAATTCCACCGTGG |
| 3225 | ACCAGCAACAATTCCACCGTGGC |
| 3226 | CCAGCAACAATTCCACCGTGGCT |
| 3227 | CAGCAACAATTCCACCGTGGCTT |
| 3228 | AGCAACAATTCCACCGTGGCTTG |
| 3229 | GCAACAATTCCACCGTGGCTTGC |
| 3230 | CAACAATTCCACCGTGGCTTGCA |
| 3231 | AACAATTCCACCGTGGCTTGCAT |
| 3232 | ACAATTCCACCGTGGCTTGCATT |
| 3233 | CAATTCCACCGTGGCTTGCATTG |
| 3234 | AATTCCACCGTGGCTTGCATTGA |
| 3235 | ATTCCACCGTGGCTTGCATTGAT |
| 3236 | TTCCACCGTGGCTTGCATTGATA |
| 3237 | TCCACCGTGGCTTGCATTGATAG |
| 3238 | CCACCGTGGCTTGCATTGATAGA |
| 3239 | CACCGTGGCTTGCATTGATAGAA |
| 3240 | ACCGTGGCTTGCATTGATAGAAA |
| 3241 | CCGTGGCTTGCATTGATAGAAAT |
| 3242 | CGTGGCTTGCATTGATAGAAATG |
| 3243 | GTGGCTTGCATTGATAGAAATGG |
| 3244 | TGGCTTGCATTGATAGAAATGGG |
| 3245 | GGCTTGCATTGATAGAAATGGGC |
| 3246 | GCTTGCATTGATAGAAATGGGCT |
| 3247 | CTTGCATTGATAGAAATGGGCTG |
| 3248 | TTGCATTGATAGAAATGGGCTGC |

| ID | SEQUENCE |
|---|---|
| 3249 | TGCATTGATAGAAATGGGCTGCA |
| 3250 | GCATTGATAGAAATGGGCTGCAA |
| 3251 | CATTGATAGAAATGGGCTGCAAA |
| 3252 | ATTGATAGAAATGGGCTGCAAAG |
| 3253 | TTGATAGAAATGGGCTGCAAAGC |
| 3254 | TGATAGAAATGGGCTGCAAAGCT |
| 3255 | GATAGAAATGGGCTGCAAAGCTG |
| 3256 | ATAGAAATGGGCTGCAAAGCTGT |
| 3257 | TAGAAATGGGCTGCAAAGCTGTC |
| 3258 | AGAAATGGGCTGCAAAGCTGTCC |
| 3259 | GAAATGGGCTGCAAAGCTGTCCC |
| 3260 | AAATGGGCTGCAAAGCTGTCCCA |
| 3261 | AATGGGCTGCAAAGCTGTCCCAT |
| 3262 | ATGGGCTGCAAAGCTGTCCCATC |
| 3263 | TGGGCTGCAAAGCTGTCCCATCA |
| 3264 | GGGCTGCAAAGCTGTCCCATCAA |
| 3265 | GGCTGCAAAGCTGTCCCATCAAG |
| 3266 | GCTGCAAAGCTGTCCCATCAAGG |
| 3267 | CTGCAAAGCTGTCCCATCAAGGA |
| 3268 | TGCAAAGCTGTCCCATCAAGGAA |
| 3269 | GCAAAGCTGTCCCATCAAGGAAG |
| 3270 | CAAAGCTGTCCCATCAAGGAAGA |
| 3271 | AAAGCTGTCCCATCAAGGAAGAC |
| 3272 | AAGCTGTCCCATCAAGGAAGACA |
| 3273 | AGCTGTCCCATCAAGGAAGACAG |
| 3274 | GCTGTCCCATCAAGGAAGACAGC |
| 3275 | CTGTCCCATCAAGGAAGACAGCT |
| 3276 | TGTCCCATCAAGGAAGACAGCTT |
| 3277 | GTCCCATCAAGGAAGACAGCTTC |
| 3278 | TCCCATCAAGGAAGACAGCTTCT |
| 3279 | CCCATCAAGGAAGACAGCTTCTT |
| 3280 | CCATCAAGGAAGACAGCTTCTTG |
| 3281 | CATCAAGGAAGACAGCTTCTTGC |
| 3282 | ATCAAGGAAGACAGCTTCTTGCA |
| 3283 | TCAAGGAAGACAGCTTCTTGCAG |
| 3284 | CAAGGAAGACAGCTTCTTGCAGC |
| 3285 | AAGGAAGACAGCTTCTTGCAGCG |
| 3286 | AGGAAGACAGCTTCTTGCAGCGA |
| 3287 | GGAAGACAGCTTCTTGCAGCGAT |
| 3288 | GAAGACAGCTTCTTGCAGCGATA |
| 3289 | AAGACAGCTTCTTGCAGCGATAC |
| 3290 | AGACAGCTTCTTGCAGCGATACA |
| 3291 | GACAGCTTCTTGCAGCGATACAG |
| 3292 | ACAGCTTCTTGCAGCGATACAGC |
| 3293 | CAGCTTCTTGCAGCGATACAGCT |
| 3294 | AGCTTCTTGCAGCGATACAGCTC |
| 3295 | GCTTCTTGCAGCGATACAGCTCA |
| 3296 | CTTCTTGCAGCGATACAGCTCAG |
| 3297 | TTCTTGCAGCGATACAGCTCAGA |
| 3298 | TCTTGCAGCGATACAGCTCAGAC |
| 3299 | CTTGCAGCGATACAGCTCAGACC |
| 3300 | TTGCAGCGATACAGCTCAGACCC |
| 3301 | TGCAGCGATACAGCTCAGACCCC |
| 3302 | GCAGCGATACAGCTCAGACCCCA |
| 3303 | CAGCGATACAGCTCAGACCCCAC |
| 3304 | AGCGATACAGCTCAGACCCCACA |
| 3305 | GCGATACAGCTCAGACCCCACAG |
| 3306 | CGATACAGCTCAGACCCCACAGG |

| ID | SEQUENCE |
|---|---|
| 3307 | GATACAGCTCAGACCCCACAGGC |
| 3308 | ATACAGCTCAGACCCCACAGGCG |
| 3309 | TACAGCTCAGACCCCACAGGCGC |
| 3310 | ACAGCTCAGACCCCACAGGCGCC |
| 3311 | CAGCTCAGACCCCACAGGCGCCT |
| 3312 | AGCTCAGACCCCACAGGCGCCTT |
| 3313 | GCTCAGACCCCACAGGCGCCTTG |
| 3314 | CTCAGACCCCACAGGCGCCTTGA |
| 3315 | TCAGACCCCACAGGCGCCTTGAC |
| 3316 | CAGACCCCACAGGCGCCTTGACT |
| 3317 | AGACCCCACAGGCGCCTTGACTG |
| 3318 | GACCCCACAGGCGCCTTGACTGA |
| 3319 | ACCCCACAGGCGCCTTGACTGAG |
| 3320 | CCCCACAGGCGCCTTGACTGAGG |
| 3321 | CCCACAGGCGCCTTGACTGAGGA |
| 3322 | CCACAGGCGCCTTGACTGAGGAC |
| 3323 | CACAGGCGCCTTGACTGAGGACA |
| 3324 | ACAGGCGCCTTGACTGAGGACAG |
| 3325 | CAGGCGCCTTGACTGAGGACAGC |
| 3326 | AGGCGCCTTGACTGAGGACAGCA |
| 3327 | GGCGCCTTGACTGAGGACAGCAT |
| 3328 | GCGCCTTGACTGAGGACAGCATA |
| 3329 | CGCCTTGACTGAGGACAGCATAG |
| 3330 | GCCTTGACTGAGGACAGCATAGA |
| 3331 | CCTTGACTGAGGACAGCATAGAC |
| 3332 | CTTGACTGAGGACAGCATAGACG |
| 3333 | TTGACTGAGGACAGCATAGACGA |
| 3334 | TGACTGAGGACAGCATAGACGAC |
| 3335 | GACTGAGGACAGCATAGACGACA |
| 3336 | ACTGAGGACAGCATAGACGACAC |
| 3337 | CTGAGGACAGCATAGACGACACC |
| 3338 | TGAGGACAGCATAGACGACACCT |
| 3339 | GAGGACAGCATAGACGACACCTT |
| 3340 | AGGACAGCATAGACGACACCTTC |
| 3341 | GGACAGCATAGACGACACCTTCC |
| 3342 | GACAGCATAGACGACACCTTCCT |
| 3343 | ACAGCATAGACGACACCTTCCTC |
| 3344 | CAGCATAGACGACACCTTCCTCC |
| 3345 | AGCATAGACGACACCTTCCTCCC |
| 3346 | GCATAGACGACACCTTCCTCCCA |
| 3347 | CATAGACGACACCTTCCTCCCAG |
| 3348 | ATAGACGACACCTTCCTCCCAGT |
| 3349 | TAGACGACACCTTCCTCCCAGTG |
| 3350 | AGACGACACCTTCCTCCCAGTGC |
| 3351 | GACGACACCTTCCTCCCAGTGCC |
| 3352 | ACGACACCTTCCTCCCAGTGCCT |
| 3353 | CGACACCTTCCTCCCAGTGCCTG |
| 3354 | GACACCTTCCTCCCAGTGCCTGA |
| 3355 | ACACCTTCCTCCCAGTGCCTGAA |
| 3356 | CACCTTCCTCCCAGTGCCTGAAT |
| 3357 | ACCTTCCTCCCAGTGCCTGAATA |
| 3358 | CCTTCCTCCCAGTGCCTGAATAC |
| 3359 | CTTCCTCCCAGTGCCTGAATACA |
| 3360 | TTCCTCCCAGTGCCTGAATACAT |
| 3361 | TCCTCCCAGTGCCTGAATACATA |
| 3362 | CCTCCCAGTGCCTGAATACATAA |
| 3363 | CTCCCAGTGCCTGAATACATAAA |
| 3364 | TCCCAGTGCCTGAATACATAAAC |

| ID | SEQUENCE |
|---|---|
| 3365 | CCCAGTGCCTGAATACATAAACC |
| 3366 | CCAGTGCCTGAATACATAAACCA |
| 3367 | CAGTGCCTGAATACATAAACCAG |
| 3368 | AGTGCCTGAATACATAAACCAGT |
| 3369 | GTGCCTGAATACATAAACCAGTC |
| 3370 | TGCCTGAATACATAAACCAGTCC |
| 3371 | GCCTGAATACATAAACCAGTCCG |
| 3372 | CCTGAATACATAAACCAGTCCGT |
| 3373 | CTGAATACATAAACCAGTCCGTT |
| 3374 | TGAATACATAAACCAGTCCGTTC |
| 3375 | GAATACATAAACCAGTCCGTTCC |
| 3376 | AATACATAAACCAGTCCGTTCCC |
| 3377 | ATACATAAACCAGTCCGTTCCCA |
| 3378 | TACATAAACCAGTCCGTTCCCAA |
| 3379 | ACATAAACCAGTCCGTTCCCAAA |
| 3380 | CATAAACCAGTCCGTTCCCAAAA |
| 3381 | ATAAACCAGTCCGTTCCCAAAAG |
| 3382 | TAAACCAGTCCGTTCCCAAAAGG |
| 3383 | AAACCAGTCCGTTCCCAAAAGGC |
| 3384 | AACCAGTCCGTTCCCAAAAGGCC |
| 3385 | ACCAGTCCGTTCCCAAAAGGCCC |
| 3386 | CCAGTCCGTTCCCAAAAGGCCCG |
| 3387 | CAGTCCGTTCCCAAAAGGCCCGC |
| 3388 | AGTCCGTTCCCAAAAGGCCCGCT |
| 3389 | GTCCGTTCCCAAAAGGCCCGCTG |
| 3390 | TCCGTTCCCAAAAGGCCCGCTGG |
| 3391 | CCGTTCCCAAAAGGCCCGCTGGC |
| 3392 | CGTTCCCAAAAGGCCCGCTGGCT |
| 3393 | GTTCCCAAAAGGCCCGCTGGCTC |
| 3394 | TTCCCAAAAGGCCCGCTGGCTCT |
| 3395 | TCCCAAAAGGCCCGCTGGCTCTG |
| 3396 | CCCAAAAGGCCCGCTGGCTCTGT |
| 3397 | CCAAAAGGCCCGCTGGCTCTGTG |
| 3398 | CAAAAGGCCCGCTGGCTCTGTGC |
| 3399 | AAAAGGCCCGCTGGCTCTGTGCA |
| 3400 | AAAGGCCCGCTGGCTCTGTGCAG |
| 3401 | AAGGCCCGCTGGCTCTGTGCAGA |
| 3402 | AGGCCCGCTGGCTCTGTGCAGAA |
| 3403 | GGCCCGCTGGCTCTGTGCAGAAT |
| 3404 | GCCCGCTGGCTCTGTGCAGAATC |
| 3405 | CCCGCTGGCTCTGTGCAGAATCC |
| 3406 | CCGCTGGCTCTGTGCAGAATCCT |
| 3407 | CGCTGGCTCTGTGCAGAATCCTG |
| 3408 | GCTGGCTCTGTGCAGAATCCTGT |
| 3409 | CTGGCTCTGTGCAGAATCCTGTC |
| 3410 | TGGCTCTGTGCAGAATCCTGTCT |
| 3411 | GGCTCTGTGCAGAATCCTGTCTA |
| 3412 | GCTCTGTGCAGAATCCTGTCTAT |
| 3413 | CTCTGTGCAGAATCCTGTCTATC |
| 3414 | TCTGTGCAGAATCCTGTCTATCA |
| 3415 | CTGTGCAGAATCCTGTCTATCAC |
| 3416 | TGTGCAGAATCCTGTCTATCACA |
| 3417 | GTGCAGAATCCTGTCTATCACAA |
| 3418 | TGCAGAATCCTGTCTATCACAAT |
| 3419 | GCAGAATCCTGTCTATCACAATC |
| 3420 | CAGAATCCTGTCTATCACAATCA |
| 3421 | AGAATCCTGTCTATCACAATCAG |
| 3422 | GAATCCTGTCTATCACAATCAGC |

| ID | SEQUENCE |
|---|---|
| 3423 | AATCCTGTCTATCACAATCAGCC |
| 3424 | ATCCTGTCTATCACAATCAGCCT |
| 3425 | TCCTGTCTATCACAATCAGCCTC |
| 3426 | CCTGTCTATCACAATCAGCCTCT |
| 3427 | CTGTCTATCACAATCAGCCTCTG |
| 3428 | TGTCTATCACAATCAGCCTCTGA |
| 3429 | GTCTATCACAATCAGCCTCTGAA |
| 3430 | TCTATCACAATCAGCCTCTGAAC |
| 3431 | CTATCACAATCAGCCTCTGAACC |
| 3432 | TATCACAATCAGCCTCTGAACCC |
| 3433 | ATCACAATCAGCCTCTGAACCCC |
| 3434 | TCACAATCAGCCTCTGAACCCCG |
| 3435 | CACAATCAGCCTCTGAACCCCGC |
| 3436 | ACAATCAGCCTCTGAACCCCGCG |
| 3437 | CAATCAGCCTCTGAACCCCGCGC |
| 3438 | CCGCGCCCAGCAGAGACCCACAC |
| 3439 | CGCGCCCAGCAGAGACCCACACT |
| 3440 | GCGCCCAGCAGAGACCCACACTA |
| 3441 | CGCCCAGCAGAGACCCACACTAC |
| 3442 | GCCCAGCAGAGACCCACACTACC |
| 3443 | CCCAGCAGAGACCCACACTACCA |
| 3444 | CCAGCAGAGACCCACACTACCAG |
| 3445 | CAGCAGAGACCCACACTACCAGG |
| 3446 | AGCAGAGACCCACACTACCAGGA |
| 3447 | GCAGAGACCCACACTACCAGGAC |
| 3448 | CAGAGACCCACACTACCAGGACC |
| 3449 | AGAGACCCACACTACCAGGACCC |
| 3450 | GAGACCCACACTACCAGGACCCC |
| 3451 | AGACCCACACTACCAGGACCCCC |
| 3452 | GACCCACACTACCAGGACCCCCA |
| 3453 | ACCCACACTACCAGGACCCCCAC |
| 3454 | CCCACACTACCAGGACCCCCACA |
| 3455 | CCACACTACCAGGACCCCCACAG |
| 3456 | CACACTACCAGGACCCCCACAGC |
| 3457 | ACACTACCAGGACCCCCACAGCA |
| 3458 | CACTACCAGGACCCCCACAGCAC |
| 3459 | ACTACCAGGACCCCCACAGCACT |
| 3460 | CTACCAGGACCCCCACAGCACTG |
| 3461 | TACCAGGACCCCCACAGCACTGC |
| 3462 | ACCAGGACCCCCACAGCACTGCA |
| 3463 | CCAGGACCCCCACAGCACTGCAG |
| 3464 | CAGGACCCCCACAGCACTGCAGT |
| 3465 | AGGACCCCCACAGCACTGCAGTG |
| 3466 | GGACCCCCACAGCACTGCAGTGG |
| 3467 | GACCCCCACAGCACTGCAGTGGG |
| 3468 | ACCCCCACAGCACTGCAGTGGGC |
| 3469 | CCCCCACAGCACTGCAGTGGGCA |
| 3470 | CCCCACAGCACTGCAGTGGGCAA |
| 3471 | CCCACAGCACTGCAGTGGGCAAC |
| 3472 | CCACAGCACTGCAGTGGGCAACC |
| 3473 | CACAGCACTGCAGTGGGCAACCC |
| 3474 | ACAGCACTGCAGTGGGCAACCCC |
| 3475 | CAGCACTGCAGTGGGCAACCCCG |
| 3476 | AGCACTGCAGTGGGCAACCCCGA |
| 3477 | GCACTGCAGTGGGCAACCCCGAG |
| 3478 | CACTGCAGTGGGCAACCCCGAGT |
| 3479 | ACTGCAGTGGGCAACCCCGAGTA |
| 3480 | CTGCAGTGGGCAACCCCGAGTAT |

| ID | SEQUENCE |
|---|---|
| 3481 | TGCAGTGGGCAACCCCGAGTATC |
| 3482 | GCAGTGGGCAACCCCGAGTATCT |
| 3483 | CAGTGGGCAACCCCGAGTATCTC |
| 3484 | AGTGGGCAACCCCGAGTATCTCA |
| 3485 | GTGGGCAACCCCGAGTATCTCAA |
| 3486 | TGGGCAACCCCGAGTATCTCAAC |
| 3487 | GGGCAACCCCGAGTATCTCAACA |
| 3488 | GGCAACCCCGAGTATCTCAACAC |
| 3489 | GCAACCCCGAGTATCTCAACACT |
| 3490 | CAACCCCGAGTATCTCAACACTG |
| 3491 | AACCCCGAGTATCTCAACACTGT |
| 3492 | ACCCCGAGTATCTCAACACTGTC |
| 3493 | CCCCGAGTATCTCAACACTGTCC |
| 3494 | CCCGAGTATCTCAACACTGTCCA |
| 3495 | CCGAGTATCTCAACACTGTCCAG |
| 3496 | CGAGTATCTCAACACTGTCCAGC |
| 3497 | GAGTATCTCAACACTGTCCAGCC |
| 3498 | AGTATCTCAACACTGTCCAGCCC |
| 3499 | GTATCTCAACACTGTCCAGCCCA |
| 3500 | TATCTCAACACTGTCCAGCCCAC |
| 3501 | ATCTCAACACTGTCCAGCCCACC |
| 3502 | TCTCAACACTGTCCAGCCCACCT |
| 3503 | CTCAACACTGTCCAGCCCACCTG |
| 3504 | TCAACACTGTCCAGCCCACCTGT |
| 3505 | CAACACTGTCCAGCCCACCTGTG |
| 3506 | AACACTGTCCAGCCCACCTGTGT |
| 3507 | ACACTGTCCAGCCCACCTGTGTC |
| 3508 | CACTGTCCAGCCCACCTGTGTCA |
| 3509 | ACTGTCCAGCCCACCTGTGTCAA |
| 3510 | CTGTCCAGCCCACCTGTGTCAAC |
| 3511 | TGTCCAGCCCACCTGTGTCAACA |
| 3512 | GTCCAGCCCACCTGTGTCAACAG |
| 3513 | TCCAGCCCACCTGTGTCAACAGC |
| 3514 | CCAGCCCACCTGTGTCAACAGCA |
| 3515 | CAGCCCACCTGTGTCAACAGCAC |
| 3516 | AGCCCACCTGTGTCAACAGCACA |
| 3517 | GCCCACCTGTGTCAACAGCACAT |
| 3518 | CCCACCTGTGTCAACAGCACATT |
| 3519 | CCACCTGTGTCAACAGCACATTC |
| 3520 | CACCTGTGTCAACAGCACATTCG |
| 3521 | ACCTGTGTCAACAGCACATTCGA |
| 3522 | CCTGTGTCAACAGCACATTCGAC |
| 3523 | CTGTGTCAACAGCACATTCGACA |
| 3524 | TGTGTCAACAGCACATTCGACAG |
| 3525 | GTGTCAACAGCACATTCGACAGC |
| 3526 | TGTCAACAGCACATTCGACAGCC |
| 3527 | GTCAACAGCACATTCGACAGCCC |
| 3528 | TCAACAGCACATTCGACAGCCCT |
| 3529 | CAACAGCACATTCGACAGCCCTG |
| 3530 | AACAGCACATTCGACAGCCCTGC |
| 3531 | ACAGCACATTCGACAGCCCTGCC |
| 3532 | CAGCACATTCGACAGCCCTGCCC |
| 3533 | AGCACATTCGACAGCCCTGCCCA |
| 3534 | GCACATTCGACAGCCCTGCCCAC |
| 3535 | CACATTCGACAGCCCTGCCCACT |
| 3536 | ACATTCGACAGCCCTGCCCACTG |
| 3537 | CATTCGACAGCCCTGCCCACTGG |
| 3538 | ATTCGACAGCCCTGCCCACTGGG |

| ID | SEQUENCE |
|---|---|
| 3539 | TTCGACAGCCCTGCCCACTGGGC |
| 3540 | TCGACAGCCCTGCCCACTGGGCC |
| 3541 | CGACAGCCCTGCCCACTGGGCCC |
| 3542 | GACAGCCCTGCCCACTGGGCCCA |
| 3543 | ACAGCCCTGCCCACTGGGCCCAG |
| 3544 | CAGCCCTGCCCACTGGGCCCAGA |
| 3545 | AGCCCTGCCCACTGGGCCCAGAA |
| 3546 | GCCCTGCCCACTGGGCCCAGAAA |
| 3547 | CCCTGCCCACTGGGCCCAGAAAG |
| 3548 | CCTGCCCACTGGGCCCAGAAAGG |
| 3549 | CTGCCCACTGGGCCCAGAAAGGC |
| 3550 | TGCCCACTGGGCCCAGAAAGGCA |
| 3551 | GCCCACTGGGCCCAGAAAGGCAG |
| 3552 | CCCACTGGGCCCAGAAAGGCAGC |
| 3553 | CCACTGGGCCCAGAAAGGCAGCC |
| 3554 | CACTGGGCCCAGAAAGGCAGCCA |
| 3555 | ACTGGGCCCAGAAAGGCAGCCAC |
| 3556 | CTGGGCCCAGAAAGGCAGCCACC |
| 3557 | TGGGCCCAGAAAGGCAGCCACCA |
| 3558 | GGGCCCAGAAAGGCAGCCACCAA |
| 3559 | GGCCCAGAAAGGCAGCCACCAAA |
| 3560 | GCCCAGAAAGGCAGCCACCAAAT |
| 3561 | CCCAGAAAGGCAGCCACCAAATT |
| 3562 | CCAGAAAGGCAGCCACCAAATTA |
| 3563 | CAGAAAGGCAGCCACCAAATTAG |
| 3564 | AGAAAGGCAGCCACCAAATTAGC |
| 3565 | GAAAGGCAGCCACCAAATTAGCC |
| 3566 | AAAGGCAGCCACCAAATTAGCCT |
| 3567 | AAGGCAGCCACCAAATTAGCCTG |
| 3568 | AGGCAGCCACCAAATTAGCCTGG |
| 3569 | GGCAGCCACCAAATTAGCCTGGA |
| 3570 | GCAGCCACCAAATTAGCCTGGAC |
| 3571 | CAGCCACCAAATTAGCCTGGACA |
| 3572 | AGCCACCAAATTAGCCTGGACAA |
| 3573 | GCCACCAAATTAGCCTGGACAAC |
| 3574 | CCACCAAATTAGCCTGGACAACC |
| 3575 | CACCAAATTAGCCTGGACAACCC |
| 3576 | ACCAAATTAGCCTGGACAACCCT |
| 3577 | CCAAATTAGCCTGGACAACCCTG |
| 3578 | CAAATTAGCCTGGACAACCCTGA |
| 3579 | AAATTAGCCTGGACAACCCTGAC |
| 3580 | AATTAGCCTGGACAACCCTGACT |
| 3581 | ATTAGCCTGGACAACCCTGACTA |
| 3582 | TTAGCCTGGACAACCCTGACTAC |
| 3583 | TAGCCTGGACAACCCTGACTACC |
| 3584 | AGCCTGGACAACCCTGACTACCA |
| 3585 | GCCTGGACAACCCTGACTACCAG |
| 3586 | CCTGGACAACCCTGACTACCAGC |
| 3587 | CTGGACAACCCTGACTACCAGCA |
| 3588 | TGGACAACCCTGACTACCAGCAG |
| 3589 | GGACAACCCTGACTACCAGCAGG |
| 3590 | GACAACCCTGACTACCAGCAGGA |
| 3591 | ACAACCCTGACTACCAGCAGGAC |
| 3592 | CAACCCTGACTACCAGCAGGACT |
| 3593 | AACCCTGACTACCAGCAGGACTT |
| 3594 | ACCCTGACTACCAGCAGGACTTC |
| 3595 | CCCTGACTACCAGCAGGACTTCT |
| 3596 | CCTGACTACCAGCAGGACTTCTT |

| ID | SEQUENCE |
|---|---|
| 3597 | CTGACTACCAGCAGGACTTCTTT |
| 3598 | TGACTACCAGCAGGACTTCTTTC |
| 3599 | GACTACCAGCAGGACTTCTTTCC |
| 3600 | ACTACCAGCAGGACTTCTTTCCC |
| 3601 | CTACCAGCAGGACTTCTTTCCCA |
| 3602 | TACCAGCAGGACTTCTTTCCCAA |
| 3603 | ACCAGCAGGACTTCTTTCCCAAG |
| 3604 | CCAGCAGGACTTCTTTCCCAAGG |
| 3605 | CAGCAGGACTTCTTTCCCAAGGA |
| 3606 | AGCAGGACTTCTTTCCCAAGGAA |
| 3607 | GCAGGACTTCTTTCCCAAGGAAG |
| 3608 | CAGGACTTCTTTCCCAAGGAAGC |
| 3609 | AGGACTTCTTTCCCAAGGAAGCC |
| 3610 | GGACTTCTTTCCCAAGGAAGCCA |
| 3611 | GACTTCTTTCCCAAGGAAGCCAA |
| 3612 | ACTTCTTTCCCAAGGAAGCCAAG |
| 3613 | CTTCTTTCCCAAGGAAGCCAAGC |
| 3614 | TTCTTTCCCAAGGAAGCCAAGCC |
| 3615 | TCTTTCCCAAGGAAGCCAAGCCA |
| 3616 | CTTTCCCAAGGAAGCCAAGCCAA |
| 3617 | TTTCCCAAGGAAGCCAAGCCAAA |
| 3618 | TTCCCAAGGAAGCCAAGCCAAAT |
| 3619 | TCCCAAGGAAGCCAAGCCAAATG |
| 3620 | CCCAAGGAAGCCAAGCCAAATGG |
| 3621 | CCAAGGAAGCCAAGCCAAATGGC |
| 3622 | CAAGGAAGCCAAGCCAAATGGCA |
| 3623 | AAGGAAGCCAAGCCAAATGGCAT |
| 3624 | AGGAAGCCAAGCCAAATGGCATC |
| 3625 | GGAAGCCAAGCCAAATGGCATCT |
| 3626 | GAAGCCAAGCCAAATGGCATCTT |
| 3627 | AAGCCAAGCCAAATGGCATCTTT |
| 3628 | AGCCAAGCCAAATGGCATCTTTA |
| 3629 | GCCAAGCCAAATGGCATCTTTAA |
| 3630 | CCAAGCCAAATGGCATCTTTAAG |
| 3631 | CAAGCCAAATGGCATCTTTAAGG |
| 3632 | AAGCCAAATGGCATCTTTAAGGG |
| 3633 | AGCCAAATGGCATCTTTAAGGGC |
| 3634 | GCCAAATGGCATCTTTAAGGGCT |
| 3635 | CCAAATGGCATCTTTAAGGGCTC |
| 3636 | CAAATGGCATCTTTAAGGGCTCC |
| 3637 | AAATGGCATCTTTAAGGGCTCCA |
| 3638 | AATGGCATCTTTAAGGGCTCCAC |
| 3639 | ATGGCATCTTTAAGGGCTCCACA |
| 3640 | TGGCATCTTTAAGGGCTCCACAG |
| 3641 | GGCATCTTTAAGGGCTCCACAGC |
| 3642 | GCATCTTTAAGGGCTCCACAGCT |
| 3643 | CATCTTTAAGGGCTCCACAGCTG |
| 3644 | ATCTTTAAGGGCTCCACAGCTGA |
| 3645 | TCTTTAAGGGCTCCACAGCTGAA |
| 3646 | CTTTAAGGGCTCCACAGCTGAAA |
| 3647 | TTTAAGGGCTCCACAGCTGAAAA |
| 3648 | TTAAGGGCTCCACAGCTGAAAAT |
| 3649 | TAAGGGCTCCACAGCTGAAAATG |
| 3650 | AAGGGCTCCACAGCTGAAAATGC |
| 3651 | AGGGCTCCACAGCTGAAAATGCA |
| 3652 | GGGCTCCACAGCTGAAAATGCAG |
| 3653 | GGCTCCACAGCTGAAAATGCAGA |
| 3654 | GCTCCACAGCTGAAAATGCAGAA |

| ID | SEQUENCE |
|---|---|
| 3655 | CTCCACAGCTGAAAATGCAGAAT |
| 3656 | TCCACAGCTGAAAATGCAGAATA |
| 3657 | CCACAGCTGAAAATGCAGAATAC |
| 3658 | CACAGCTGAAAATGCAGAATACC |
| 3659 | ACAGCTGAAAATGCAGAATACCT |
| 3660 | CAGCTGAAAATGCAGAATACCTA |
| 3661 | AGCTGAAAATGCAGAATACCTAA |
| 3662 | GCTGAAAATGCAGAATACCTAAG |
| 3663 | CTGAAAATGCAGAATACCTAAGG |
| 3664 | TGAAAATGCAGAATACCTAAGGG |
| 3665 | GAAAATGCAGAATACCTAAGGGT |
| 3666 | AAAATGCAGAATACCTAAGGGTC |
| 3667 | AAATGCAGAATACCTAAGGGTCG |
| 3668 | AATGCAGAATACCTAAGGGTCGC |
| 3669 | ATGCAGAATACCTAAGGGTCGCG |
| 3670 | TGCAGAATACCTAAGGGTCGCGC |
| 3671 | GCAGAATACCTAAGGGTCGCGCC |
| 3672 | CAGAATACCTAAGGGTCGCGCCA |
| 3673 | AGAATACCTAAGGGTCGCGCCAC |
| 3674 | GAATACCTAAGGGTCGCGCCACA |
| 3675 | AATACCTAAGGGTCGCGCCACAA |
| 3676 | ATACCTAAGGGTCGCGCCACAAA |
| 3677 | TACCTAAGGGTCGCGCCACAAAG |
| 3678 | ACCTAAGGGTCGCGCCACAAAGC |
| 3679 | CCTAAGGGTCGCGCCACAAAGCA |
| 3680 | CTAAGGGTCGCGCCACAAAGCAG |
| 3681 | TAAGGGTCGCGCCACAAAGCAGT |
| 3682 | AAGGGTCGCGCCACAAAGCAGTG |
| 3683 | AGGGTCGCGCCACAAAGCAGTGA |
| 3684 | GGGTCGCGCCACAAAGCAGTGAA |
| 3685 | GGTCGCGCCACAAAGCAGTGAAT |
| 3686 | GTCGCGCCACAAAGCAGTGAATT |
| 3687 | TCGCGCCACAAAGCAGTGAATTT |
| 3688 | CGCGCCACAAAGCAGTGAATTTA |
| 3689 | GCGCCACAAAGCAGTGAATTTAT |
| 3690 | CGCCACAAAGCAGTGAATTTATT |
| 3691 | GCCACAAAGCAGTGAATTTATTG |
| 3692 | CCACAAAGCAGTGAATTTATTGG |
| 3693 | CACAAAGCAGTGAATTTATTGGA |
| 3694 | ACAAAGCAGTGAATTTATTGGAG |
| 3695 | CAAAGCAGTGAATTTATTGGAGC |
| 3696 | AAAGCAGTGAATTTATTGGAGCA |
| 3697 | AAGCAGTGAATTTATTGGAGCAT |
| 3698 | AGCAGTGAATTTATTGGAGCATG |
| 3699 | CCACGGAGGATAGTATGAGCCCT |
| 3700 | CACGGAGGATAGTATGAGCCCTA |
| 3701 | ACGGAGGATAGTATGAGCCCTAA |
| 3702 | CGGAGGATAGTATGAGCCCTAAA |
| 3703 | GGAGGATAGTATGAGCCCTAAAA |
| 3704 | GAGGATAGTATGAGCCCTAAAAA |
| 3705 | AGGATAGTATGAGCCCTAAAAAT |
| 3706 | GGATAGTATGAGCCCTAAAAATC |
| 3707 | GATAGTATGAGCCCTAAAAATCC |
| 3708 | ATAGTATGAGCCCTAAAAATCCA |
| 3709 | TAGTATGAGCCCTAAAAATCCAG |
| 3710 | AGTATGAGCCCTAAAAATCCAGA |
| 3711 | GTATGAGCCCTAAAAATCCAGAC |
| 3712 | TATGAGCCCTAAAAATCCAGACT |

| ID | SEQUENCE |
|---|---|
| 3713 | ATGAGCCCTAAAAATCCAGACTC |
| 3714 | TGAGCCCTAAAAATCCAGACTCT |
| 3715 | GAGCCCTAAAAATCCAGACTCTT |
| 3716 | AGCCCTAAAAATCCAGACTCTTT |
| 3717 | GCCCTAAAAATCCAGACTCTTTC |
| 3718 | CCCTAAAAATCCAGACTCTTTCG |
| 3719 | CCTAAAAATCCAGACTCTTTCGA |
| 3720 | CTAAAAATCCAGACTCTTTCGAT |
| 3721 | TAAAAATCCAGACTCTTTCGATA |
| 3722 | AAAAATCCAGACTCTTTCGATAC |
| 3723 | AAAATCCAGACTCTTTCGATACC |
| 3724 | AAATCCAGACTCTTTCGATACCC |
| 3725 | AATCCAGACTCTTTCGATACCCA |
| 3726 | ATCCAGACTCTTTCGATACCCAG |
| 3727 | TCCAGACTCTTTCGATACCCAGG |
| 3728 | CCAGACTCTTTCGATACCCAGGA |
| 3729 | CAGACTCTTTCGATACCCAGGAC |
| 3730 | AGACTCTTTCGATACCCAGGACC |
| 3731 | GACTCTTTCGATACCCAGGACCA |
| 3732 | ACTCTTTCGATACCCAGGACCAA |
| 3733 | CTCTTTCGATACCCAGGACCAAG |
| 3734 | TCTTTCGATACCCAGGACCAAGC |
| 3735 | CTTTCGATACCCAGGACCAAGCC |
| 3736 | TTTCGATACCCAGGACCAAGCCA |
| 3737 | TTCGATACCCAGGACCAAGCCAC |
| 3738 | TCGATACCCAGGACCAAGCCACA |
| 3739 | CGATACCCAGGACCAAGCCACAG |
| 3740 | GATACCCAGGACCAAGCCACAGC |
| 3741 | ATACCCAGGACCAAGCCACAGCA |
| 3742 | TACCCAGGACCAAGCCACAGCAG |
| 3743 | ACCCAGGACCAAGCCACAGCAGG |
| 3744 | CCCAGGACCAAGCCACAGCAGGT |
| 3745 | CCAGGACCAAGCCACAGCAGGTC |
| 3746 | CAGGACCAAGCCACAGCAGGTCC |
| 3747 | AGGACCAAGCCACAGCAGGTCCT |
| 3748 | GGACCAAGCCACAGCAGGTCCTC |
| 3749 | GACCAAGCCACAGCAGGTCCTCC |
| 3750 | ACCAAGCCACAGCAGGTCCTCCA |
| 3751 | CCAAGCCACAGCAGGTCCTCCAT |
| 3752 | CAAGCCACAGCAGGTCCTCCATC |
| 3753 | AAGCCACAGCAGGTCCTCCATCC |
| 3754 | AGCCACAGCAGGTCCTCCATCCC |
| 3755 | GCCACAGCAGGTCCTCCATCCCA |
| 3756 | CCACAGCAGGTCCTCCATCCCAA |
| 3757 | CACAGCAGGTCCTCCATCCCAAC |
| 3758 | ACAGCAGGTCCTCCATCCCAACA |
| 3759 | CAGCAGGTCCTCCATCCCAACAG |
| 3760 | AGCAGGTCCTCCATCCCAACAGC |
| 3761 | GCAGGTCCTCCATCCCAACAGCC |
| 3762 | CAGGTCCTCCATCCCAACAGCCA |
| 3763 | AGGTCCTCCATCCCAACAGCCAT |
| 3764 | GGTCCTCCATCCCAACAGCCATG |
| 3765 | GTCCTCCATCCCAACAGCCATGC |
| 3766 | TCCTCCATCCCAACAGCCATGCC |
| 3767 | CCTCCATCCCAACAGCCATGCCC |
| 3768 | CTCCATCCCAACAGCCATGCCCG |
| 3769 | TCCATCCCAACAGCCATGCCCGC |
| 3770 | CCATCCCAACAGCCATGCCCGCA |

| ID | SEQUENCE |
|---|---|
| 3771 | CATCCCAACAGCCATGCCCGCAT |
| 3772 | ATCCCAACAGCCATGCCCGCATT |
| 3773 | TCCCAACAGCCATGCCCGCATTA |
| 3774 | CCCAACAGCCATGCCCGCATTAG |
| 3775 | CCAACAGCCATGCCCGCATTAGC |
| 3776 | CAACAGCCATGCCCGCATTAGCT |
| 3777 | AACAGCCATGCCCGCATTAGCTC |
| 3778 | ACAGCCATGCCCGCATTAGCTCT |
| 3779 | CAGCCATGCCCGCATTAGCTCTT |
| 3780 | AGCCATGCCCGCATTAGCTCTTA |
| 3781 | GCCATGCCCGCATTAGCTCTTAG |
| 3782 | CCATGCCCGCATTAGCTCTTAGA |
| 3783 | CATGCCCGCATTAGCTCTTAGAC |
| 3784 | ATGCCCGCATTAGCTCTTAGACC |
| 3785 | TGCCCGCATTAGCTCTTAGACCC |
| 3786 | GCCCGCATTAGCTCTTAGACCCA |
| 3787 | CCCGCATTAGCTCTTAGACCCAC |
| 3788 | CCGCATTAGCTCTTAGACCCACA |
| 3789 | CGCATTAGCTCTTAGACCCACAG |
| 3790 | GCATTAGCTCTTAGACCCACAGA |
| 3791 | CATTAGCTCTTAGACCCACAGAC |
| 3792 | ATTAGCTCTTAGACCCACAGACT |
| 3793 | TTAGCTCTTAGACCCACAGACTG |
| 3794 | TAGCTCTTAGACCCACAGACTGG |
| 3795 | AGCTCTTAGACCCACAGACTGGT |
| 3796 | GCTCTTAGACCCACAGACTGGTT |
| 3797 | CTCTTAGACCCACAGACTGGTTT |
| 3798 | TCTTAGACCCACAGACTGGTTTT |
| 3799 | CTTAGACCCACAGACTGGTTTTG |
| 3800 | TTAGACCCACAGACTGGTTTTGC |
| 3801 | TAGACCCACAGACTGGTTTTGCA |
| 3802 | AGACCCACAGACTGGTTTTGCAA |
| 3803 | GACCCACAGACTGGTTTTGCAAC |
| 3804 | ACCCACAGACTGGTTTTGCAACG |
| 3805 | CCCACAGACTGGTTTTGCAACGT |
| 3806 | CCACAGACTGGTTTTGCAACGTT |
| 3807 | CACAGACTGGTTTTGCAACGTTT |
| 3808 | ACAGACTGGTTTTGCAACGTTTA |
| 3809 | CAGACTGGTTTTGCAACGTTTAC |
| 3810 | AGACTGGTTTTGCAACGTTTACA |
| 3811 | GACTGGTTTTGCAACGTTTACAC |
| 3812 | ACTGGTTTTGCAACGTTTACACC |
| 3813 | CTGGTTTTGCAACGTTTACACCG |
| 3814 | TGGTTTTGCAACGTTTACACCGA |
| 3815 | GGTTTTGCAACGTTTACACCGAC |
| 3816 | GTTTTGCAACGTTTACACCGACT |
| 3817 | TTTTGCAACGTTTACACCGACTA |
| 3818 | TTTGCAACGTTTACACCGACTAG |
| 3819 | TTGCAACGTTTACACCGACTAGC |
| 3820 | TGCAACGTTTACACCGACTAGCC |
| 3821 | GCAACGTTTACACCGACTAGCCA |
| 3822 | CAACGTTTACACCGACTAGCCAG |
| 3823 | AACGTTTACACCGACTAGCCAGG |
| 3824 | ACGTTTACACCGACTAGCCAGGA |
| 3825 | CGTTTACACCGACTAGCCAGGAA |
| 3826 | GTTTACACCGACTAGCCAGGAAG |
| 3827 | TTTACACCGACTAGCCAGGAAGT |
| 3828 | TTACACCGACTAGCCAGGAAGTA |

| ID | SEQUENCE |
|---|---|
| 3829 | TACACCGACTAGCCAGGAAGTAC |
| 3830 | ACACCGACTAGCCAGGAAGTACT |
| 3831 | CACCGACTAGCCAGGAAGTACTT |
| 3832 | ACCGACTAGCCAGGAAGTACTTC |
| 3833 | CCGACTAGCCAGGAAGTACTTCC |
| 3834 | CGACTAGCCAGGAAGTACTTCCA |
| 3835 | GACTAGCCAGGAAGTACTTCCAC |
| 3836 | ACTAGCCAGGAAGTACTTCCACC |
| 3837 | CTAGCCAGGAAGTACTTCCACCT |
| 3838 | TAGCCAGGAAGTACTTCCACCTC |
| 3839 | AGCCAGGAAGTACTTCCACCTCG |
| 3840 | GCCAGGAAGTACTTCCACCTCGG |
| 3841 | CCAGGAAGTACTTCCACCTCGGG |
| 3842 | CAGGAAGTACTTCCACCTCGGGC |
| 3843 | AGGAAGTACTTCCACCTCGGGCA |
| 3844 | GGAAGTACTTCCACCTCGGGCAC |
| 3845 | GAAGTACTTCCACCTCGGGCACA |
| 3846 | AAGTACTTCCACCTCGGGCACAT |
| 3847 | AGTACTTCCACCTCGGGCACATT |
| 3848 | GTACTTCCACCTCGGGCACATTT |
| 3849 | TACTTCCACCTCGGGCACATTTT |
| 3850 | ACTTCCACCTCGGGCACATTTTG |
| 3851 | CTTCCACCTCGGGCACATTTTGG |
| 3852 | TTCCACCTCGGGCACATTTTGGG |
| 3853 | TCCACCTCGGGCACATTTTGGGA |
| 3854 | CCACCTCGGGCACATTTTGGGAA |
| 3855 | CACCTCGGGCACATTTTGGGAAG |
| 3856 | ACCTCGGGCACATTTTGGGAAGT |
| 3857 | CCTCGGGCACATTTTGGGAAGTT |
| 3858 | CTCGGGCACATTTTGGGAAGTTG |
| 3859 | TCGGGCACATTTTGGGAAGTTGC |
| 3860 | CGGGCACATTTTGGGAAGTTGCA |
| 3861 | GGGCACATTTTGGGAAGTTGCAT |
| 3862 | GGCACATTTTGGGAAGTTGCATT |
| 3863 | GCACATTTTGGGAAGTTGCATTC |
| 3864 | CACATTTTGGGAAGTTGCATTCC |
| 3865 | ACATTTTGGGAAGTTGCATTCCT |
| 3866 | CATTTTGGGAAGTTGCATTCCTT |
| 3867 | ATTTTGGGAAGTTGCATTCCTTT |
| 3868 | TTTTGGGAAGTTGCATTCCTTTG |
| 3869 | TTTGGGAAGTTGCATTCCTTTGT |
| 3870 | TTGGGAAGTTGCATTCCTTTGTC |
| 3871 | TGGGAAGTTGCATTCCTTTGTCT |
| 3872 | GGGAAGTTGCATTCCTTTGTCTT |
| 3873 | GGAAGTTGCATTCCTTTGTCTTC |
| 3874 | GAAGTTGCATTCCTTTGTCTTCA |
| 3875 | AAGTTGCATTCCTTTGTCTTCAA |
| 3876 | AGTTGCATTCCTTTGTCTTCAAA |
| 3877 | GTTGCATTCCTTTGTCTTCAAAC |
| 3878 | TTGCATTCCTTTGTCTTCAAACT |
| 3879 | TGCATTCCTTTGTCTTCAAACTG |
| 3880 | GCATTCCTTTGTCTTCAAACTGT |
| 3881 | CATTCCTTTGTCTTCAAACTGTG |
| 3882 | ATTCCTTTGTCTTCAAACTGTGA |
| 3883 | TTCCTTTGTCTTCAAACTGTGAA |
| 3884 | TCCTTTGTCTTCAAACTGTGAAG |
| 3885 | CCTTTGTCTTCAAACTGTGAAGC |
| 3886 | CTTTGTCTTCAAACTGTGAAGCA |

| ID | SEQUENCE |
|---|---|
| 3887 | TTTGTCTTCAAACTGTGAAGCAT |
| 3888 | TTGTCTTCAAACTGTGAAGCATT |
| 3889 | TGTCTTCAAACTGTGAAGCATTT |
| 3890 | GTCTTCAAACTGTGAAGCATTTA |
| 3891 | TCTTCAAACTGTGAAGCATTTAC |
| 3892 | CTTCAAACTGTGAAGCATTTACA |
| 3893 | TTCAAACTGTGAAGCATTTACAG |
| 3894 | TCAAACTGTGAAGCATTTACAGA |
| 3895 | CAAACTGTGAAGCATTTACAGAA |
| 3896 | AAACTGTGAAGCATTTACAGAAA |
| 3897 | AACTGTGAAGCATTTACAGAAAC |
| 3898 | ACTGTGAAGCATTTACAGAAACG |
| 3899 | CTGTGAAGCATTTACAGAAACGC |
| 3900 | TGTGAAGCATTTACAGAAACGCA |
| 3901 | GTGAAGCATTTACAGAAACGCAT |
| 3902 | TGAAGCATTTACAGAAACGCATC |
| 3903 | GAAGCATTTACAGAAACGCATCC |
| 3904 | AAGCATTTACAGAAACGCATCCA |
| 3905 | AGCATTTACAGAAACGCATCCAG |
| 3906 | GCATTTACAGAAACGCATCCAGC |
| 3907 | CATTTACAGAAACGCATCCAGCA |
| 3908 | ATTTACAGAAACGCATCCAGCAA |
| 3909 | TTTACAGAAACGCATCCAGCAAG |
| 3910 | TTACAGAAACGCATCCAGCAAGA |
| 3911 | TACAGAAACGCATCCAGCAAGAA |
| 3912 | ACAGAAACGCATCCAGCAAGAAT |
| 3913 | CAGAAACGCATCCAGCAAGAATA |
| 3914 | AGAAACGCATCCAGCAAGAATAT |
| 3915 | GAAACGCATCCAGCAAGAATATT |
| 3916 | AAACGCATCCAGCAAGAATATTG |
| 3917 | AACGCATCCAGCAAGAATATTGT |
| 3918 | ACGCATCCAGCAAGAATATTGTC |
| 3919 | CGCATCCAGCAAGAATATTGTCC |
| 3920 | GCATCCAGCAAGAATATTGTCCC |
| 3921 | CATCCAGCAAGAATATTGTCCCT |
| 3922 | ATCCAGCAAGAATATTGTCCCTT |
| 3923 | TCCAGCAAGAATATTGTCCCTTT |
| 3924 | CCAGCAAGAATATTGTCCCTTTG |
| 3925 | CAGCAAGAATATTGTCCCTTTGA |
| 3926 | AGCAAGAATATTGTCCCTTTGAG |
| 3927 | GCAAGAATATTGTCCCTTTGAGC |
| 3928 | CAAGAATATTGTCCCTTTGAGCA |
| 3929 | AAGAATATTGTCCCTTTGAGCAG |
| 3930 | AGAATATTGTCCCTTTGAGCAGA |
| 3931 | GAATATTGTCCCTTTGAGCAGAA |
| 3932 | AATATTGTCCCTTTGAGCAGAAA |
| 3933 | ATATTGTCCCTTTGAGCAGAAAT |
| 3934 | TATTGTCCCTTTGAGCAGAAATT |
| 3935 | ATTGTCCCTTTGAGCAGAAATTT |
| 3936 | TTGTCCCTTTGAGCAGAAATTTA |
| 3937 | TGTCCCTTTGAGCAGAAATTTAT |
| 3938 | GTCCCTTTGAGCAGAAATTTATC |
| 3939 | TCCCTTTGAGCAGAAATTTATCT |
| 3940 | CCCTTTGAGCAGAAATTTATCTT |
| 3941 | CCTTTGAGCAGAAATTTATCTTT |
| 3942 | CTTTGAGCAGAAATTTATCTTTC |
| 3943 | TTTGAGCAGAAATTTATCTTTCA |
| 3944 | TTGAGCAGAAATTTATCTTTCAA |

| ID | SEQUENCE |
|---|---|
| 3945 | TGAGCAGAAATTTATCTTTCAAA |
| 3946 | GAGCAGAAATTTATCTTTCAAAG |
| 3947 | AGCAGAAATTTATCTTTCAAAGA |
| 3948 | GCAGAAATTTATCTTTCAAAGAG |
| 3949 | CAGAAATTTATCTTTCAAAGAGG |
| 3950 | AGAAATTTATCTTTCAAAGAGGT |
| 3951 | GAAATTTATCTTTCAAAGAGGTA |
| 3952 | AAATTTATCTTTCAAAGAGGTAT |
| 3953 | AATTTATCTTTCAAAGAGGTATA |
| 3954 | ATTTATCTTTCAAAGAGGTATAT |
| 3955 | TTTATCTTTCAAAGAGGTATATT |
| 3956 | TTATCTTTCAAAGAGGTATATTT |
| 3957 | TATCTTTCAAAGAGGTATATTTG |
| 3958 | ATCTTTCAAAGAGGTATATTTGA |
| 3959 | TCTTTCAAAGAGGTATATTTGAA |
| 3960 | CTTTCAAAGAGGTATATTTGAAA |
| 3961 | TTTCAAAGAGGTATATTTGAAAA |
| 3962 | TTCAAAGAGGTATATTTGAAAAA |
| 3963 | TCAAAGAGGTATATTTGAAAAAA |
| 3964 | CAAAGAGGTATATTTGAAAAAAA |
| 3965 | AAAGAGGTATATTTGAAAAAAAA |
| 3966 | AAAAAAAAGTATATGTGAGGATT |
| 3967 | AAAAAAAGTATATGTGAGGATTT |
| 3968 | AAAAAAGTATATGTGAGGATTTT |
| 3969 | AAAAAGTATATGTGAGGATTTTT |
| 3970 | AAAAGTATATGTGAGGATTTTTA |
| 3971 | AAAGTATATGTGAGGATTTTTAT |
| 3972 | AAGTATATGTGAGGATTTTTATT |
| 3973 | AGTATATGTGAGGATTTTTATTG |
| 3974 | GTATATGTGAGGATTTTTATTGA |
| 3975 | TATATGTGAGGATTTTTATTGAT |
| 3976 | ATATGTGAGGATTTTTATTGATT |
| 3977 | TATGTGAGGATTTTTATTGATTG |
| 3978 | ATGTGAGGATTTTTATTGATTGG |
| 3979 | TGTGAGGATTTTTATTGATTGGG |
| 3980 | GTGAGGATTTTTATTGATTGGGG |
| 3981 | TGAGGATTTTTATTGATTGGGGA |
| 3982 | GAGGATTTTTATTGATTGGGGAT |
| 3983 | AGGATTTTTATTGATTGGGGATC |
| 3984 | GGATTTTTATTGATTGGGGATCT |
| 3985 | GATTTTTATTGATTGGGGATCTT |
| 3986 | ATTTTTATTGATTGGGGATCTTG |
| 3987 | TTTTTATTGATTGGGGATCTTGG |
| 3988 | TTTTATTGATTGGGGATCTTGGA |
| 3989 | TTTATTGATTGGGGATCTTGGAG |
| 3990 | TTATTGATTGGGGATCTTGGAGT |
| 3991 | TATTGATTGGGGATCTTGGAGTT |
| 3992 | ATTGATTGGGGATCTTGGAGTTT |
| 3993 | TTGATTGGGGATCTTGGAGTTTT |
| 3994 | TGATTGGGGATCTTGGAGTTTTT |
| 3995 | GATTGGGGATCTTGGAGTTTTTC |
| 3996 | ATTGGGGATCTTGGAGTTTTTCA |
| 3997 | TTGGGGATCTTGGAGTTTTTCAT |
| 3998 | TGGGGATCTTGGAGTTTTTCATT |
| 3999 | GGGGATCTTGGAGTTTTTCATTG |
| 4000 | GGGATCTTGGAGTTTTTCATTGT |
| 4001 | GGATCTTGGAGTTTTTCATTGTC |
| 4002 | GATCTTGGAGTTTTTCATTGTCG |

| ID | SEQUENCE |
|---|---|
| 4003 | ATCTTGGAGTTTTTCATTGTCGC |
| 4004 | TCTTGGAGTTTTTCATTGTCGCT |
| 4005 | CTTGGAGTTTTTCATTGTCGCTA |
| 4006 | TTGGAGTTTTTCATTGTCGCTAT |
| 4007 | TGGAGTTTTTCATTGTCGCTATT |
| 4008 | GGAGTTTTTCATTGTCGCTATTG |
| 4009 | GAGTTTTTCATTGTCGCTATTGA |
| 4010 | AGTTTTTCATTGTCGCTATTGAT |
| 4011 | GTTTTTCATTGTCGCTATTGATT |
| 4012 | TTTTTCATTGTCGCTATTGATTT |
| 4013 | TTTTCATTGTCGCTATTGATTTT |
| 4014 | TTTCATTGTCGCTATTGATTTTT |
| 4015 | TTCATTGTCGCTATTGATTTTTA |
| 4016 | TCATTGTCGCTATTGATTTTTAC |
| 4017 | CATTGTCGCTATTGATTTTTACT |
| 4018 | ATTGTCGCTATTGATTTTTACTT |
| 4019 | TTGTCGCTATTGATTTTTACTTC |
| 4020 | TGTCGCTATTGATTTTTACTTCA |
| 4021 | GTCGCTATTGATTTTTACTTCAA |
| 4022 | TCGCTATTGATTTTTACTTCAAT |
| 4023 | CGCTATTGATTTTTACTTCAATG |
| 4024 | GCTATTGATTTTTACTTCAATGG |
| 4025 | CTATTGATTTTTACTTCAATGGG |
| 4026 | TATTGATTTTTACTTCAATGGGC |
| 4027 | ATTGATTTTTACTTCAATGGGCT |
| 4028 | TTGATTTTTACTTCAATGGGCTC |
| 4029 | TGATTTTTACTTCAATGGGCTCT |
| 4030 | GATTTTTACTTCAATGGGCTCTT |
| 4031 | ATTTTTACTTCAATGGGCTCTTC |
| 4032 | TTTTTACTTCAATGGGCTCTTCC |
| 4033 | TTTTACTTCAATGGGCTCTTCCA |
| 4034 | TTTACTTCAATGGGCTCTTCCAA |
| 4035 | TTACTTCAATGGGCTCTTCCAAC |
| 4036 | TACTTCAATGGGCTCTTCCAACA |
| 4037 | ACTTCAATGGGCTCTTCCAACAA |
| 4038 | CTTCAATGGGCTCTTCCAACAAG |
| 4039 | TTCAATGGGCTCTTCCAACAAGG |
| 4040 | TCAATGGGCTCTTCCAACAAGGA |
| 4041 | CAATGGGCTCTTCCAACAAGGAA |
| 4042 | AATGGGCTCTTCCAACAAGGAAG |
| 4043 | ATGGGCTCTTCCAACAAGGAAGA |
| 4044 | TGGGCTCTTCCAACAAGGAAGAA |
| 4045 | GGGCTCTTCCAACAAGGAAGAAG |
| 4046 | GGCTCTTCCAACAAGGAAGAAGC |
| 4047 | GCTCTTCCAACAAGGAAGAAGCT |
| 4048 | CTCTTCCAACAAGGAAGAAGCTT |
| 4049 | TCTTCCAACAAGGAAGAAGCTTG |
| 4050 | CTTCCAACAAGGAAGAAGCTTGC |
| 4051 | TTCCAACAAGGAAGAAGCTTGCT |
| 4052 | TCCAACAAGGAAGAAGCTTGCTG |
| 4053 | CCAACAAGGAAGAAGCTTGCTGG |
| 4054 | CAACAAGGAAGAAGCTTGCTGGT |
| 4055 | AACAAGGAAGAAGCTTGCTGGTA |
| 4056 | ACAAGGAAGAAGCTTGCTGGTAG |
| 4057 | CAAGGAAGAAGCTTGCTGGTAGC |
| 4058 | AAGGAAGAAGCTTGCTGGTAGCA |
| 4059 | AGGAAGAAGCTTGCTGGTAGCAC |
| 4060 | GGAAGAAGCTTGCTGGTAGCACT |

| ID | SEQUENCE |
|---|---|
| 4061 | GAAGAAGCTTGCTGGTAGCACTT |
| 4062 | AAGAAGCTTGCTGGTAGCACTTG |
| 4063 | AGAAGCTTGCTGGTAGCACTTGC |
| 4064 | GAAGCTTGCTGGTAGCACTTGCT |
| 4065 | AAGCTTGCTGGTAGCACTTGCTA |
| 4066 | AGCTTGCTGGTAGCACTTGCTAC |
| 4067 | GCTTGCTGGTAGCACTTGCTACC |
| 4068 | CTTGCTGGTAGCACTTGCTACCC |
| 4069 | TTGCTGGTAGCACTTGCTACCCT |
| 4070 | TGCTGGTAGCACTTGCTACCCTG |
| 4071 | GCTGGTAGCACTTGCTACCCTGA |
| 4072 | CTGGTAGCACTTGCTACCCTGAG |
| 4073 | TGGTAGCACTTGCTACCCTGAGT |
| 4074 | GGTAGCACTTGCTACCCTGAGTT |
| 4075 | GTAGCACTTGCTACCCTGAGTTC |
| 4076 | TAGCACTTGCTACCCTGAGTTCA |
| 4077 | AGCACTTGCTACCCTGAGTTCAT |
| 4078 | GCACTTGCTACCCTGAGTTCATC |
| 4079 | CACTTGCTACCCTGAGTTCATCC |
| 4080 | ACTTGCTACCCTGAGTTCATCCA |
| 4081 | CTTGCTACCCTGAGTTCATCCAG |
| 4082 | TTGCTACCCTGAGTTCATCCAGG |
| 4083 | TGCTACCCTGAGTTCATCCAGGC |
| 4084 | GCTACCCTGAGTTCATCCAGGCC |
| 4085 | CTACCCTGAGTTCATCCAGGCCC |
| 4086 | TACCCTGAGTTCATCCAGGCCCA |
| 4087 | ACCCTGAGTTCATCCAGGCCCAA |
| 4088 | CCCTGAGTTCATCCAGGCCCAAC |
| 4089 | CCTGAGTTCATCCAGGCCCAACT |
| 4090 | CTGAGTTCATCCAGGCCCAACTG |
| 4091 | TGAGTTCATCCAGGCCCAACTGT |
| 4092 | GAGTTCATCCAGGCCCAACTGTG |
| 4093 | AGTTCATCCAGGCCCAACTGTGA |
| 4094 | GTTCATCCAGGCCCAACTGTGAG |
| 4095 | TTCATCCAGGCCCAACTGTGAGC |
| 4096 | TCATCCAGGCCCAACTGTGAGCA |
| 4097 | CATCCAGGCCCAACTGTGAGCAA |
| 4098 | ATCCAGGCCCAACTGTGAGCAAG |
| 4099 | TCCAGGCCCAACTGTGAGCAAGG |
| 4100 | CCAGGCCCAACTGTGAGCAAGGA |
| 4101 | CAGGCCCAACTGTGAGCAAGGAG |
| 4102 | AGGCCCAACTGTGAGCAAGGAGC |
| 4103 | GGCCCAACTGTGAGCAAGGAGCA |
| 4104 | GCCCAACTGTGAGCAAGGAGCAC |
| 4105 | CCCAACTGTGAGCAAGGAGCACA |
| 4106 | CCAACTGTGAGCAAGGAGCACAA |
| 4107 | CAACTGTGAGCAAGGAGCACAAG |
| 4108 | AACTGTGAGCAAGGAGCACAAGC |
| 4109 | ACTGTGAGCAAGGAGCACAAGCC |
| 4110 | CTGTGAGCAAGGAGCACAAGCCA |
| 4111 | TGTGAGCAAGGAGCACAAGCCAC |
| 4112 | GTGAGCAAGGAGCACAAGCCACA |
| 4113 | TGAGCAAGGAGCACAAGCCACAA |
| 4114 | GAGCAAGGAGCACAAGCCACAAG |
| 4115 | AGCAAGGAGCACAAGCCACAAGT |
| 4116 | GCAAGGAGCACAAGCCACAAGTC |
| 4117 | CAAGGAGCACAAGCCACAAGTCT |
| 4118 | AAGGAGCACAAGCCACAAGTCTT |

| ID | SEQUENCE |
|---|---|
| 4119 | AGGAGCACAAGCCACAAGTCTTC |
| 4120 | GGAGCACAAGCCACAAGTCTTCC |
| 4121 | GAGCACAAGCCACAAGTCTTCCA |
| 4122 | AGCACAAGCCACAAGTCTTCCAG |
| 4123 | GCACAAGCCACAAGTCTTCCAGA |
| 4124 | CACAAGCCACAAGTCTTCCAGAG |
| 4125 | ACAAGCCACAAGTCTTCCAGAGG |
| 4126 | CAAGCCACAAGTCTTCCAGAGGA |
| 4127 | AAGCCACAAGTCTTCCAGAGGAT |
| 4128 | AGCCACAAGTCTTCCAGAGGATG |
| 4129 | GCCACAAGTCTTCCAGAGGATGC |
| 4130 | CCACAAGTCTTCCAGAGGATGCT |
| 4131 | CACAAGTCTTCCAGAGGATGCTT |
| 4132 | ACAAGTCTTCCAGAGGATGCTTG |
| 4133 | CAAGTCTTCCAGAGGATGCTTGA |
| 4134 | AAGTCTTCCAGAGGATGCTTGAT |
| 4135 | AGTCTTCCAGAGGATGCTTGATT |
| 4136 | GTCTTCCAGAGGATGCTTGATTC |
| 4137 | TCTTCCAGAGGATGCTTGATTCC |
| 4138 | CTTCCAGAGGATGCTTGATTCCA |
| 4139 | TTCCAGAGGATGCTTGATTCCAG |
| 4140 | TCCAGAGGATGCTTGATTCCAGT |
| 4141 | CCAGAGGATGCTTGATTCCAGTG |
| 4142 | CAGAGGATGCTTGATTCCAGTGG |
| 4143 | AGAGGATGCTTGATTCCAGTGGT |
| 4144 | GAGGATGCTTGATTCCAGTGGTT |
| 4145 | AGGATGCTTGATTCCAGTGGTTC |
| 4146 | GGATGCTTGATTCCAGTGGTTCT |
| 4147 | GATGCTTGATTCCAGTGGTTCTG |
| 4148 | ATGCTTGATTCCAGTGGTTCTGC |
| 4149 | TGCTTGATTCCAGTGGTTCTGCT |
| 4150 | GCTTGATTCCAGTGGTTCTGCTT |
| 4151 | CTTGATTCCAGTGGTTCTGCTTC |
| 4152 | TTGATTCCAGTGGTTCTGCTTCA |
| 4153 | TGATTCCAGTGGTTCTGCTTCAA |
| 4154 | GATTCCAGTGGTTCTGCTTCAAG |
| 4155 | ATTCCAGTGGTTCTGCTTCAAGG |
| 4156 | TTCCAGTGGTTCTGCTTCAAGGC |
| 4157 | TCCAGTGGTTCTGCTTCAAGGCT |
| 4158 | CCAGTGGTTCTGCTTCAAGGCTT |
| 4159 | CAGTGGTTCTGCTTCAAGGCTTC |
| 4160 | AGTGGTTCTGCTTCAAGGCTTCC |
| 4161 | GTGGTTCTGCTTCAAGGCTTCCA |
| 4162 | TGGTTCTGCTTCAAGGCTTCCAC |
| 4163 | GGTTCTGCTTCAAGGCTTCCACT |
| 4164 | GTTCTGCTTCAAGGCTTCCACTG |
| 4165 | TTCTGCTTCAAGGCTTCCACTGC |
| 4166 | TCTGCTTCAAGGCTTCCACTGCA |
| 4167 | CTGCTTCAAGGCTTCCACTGCAA |
| 4168 | TGCTTCAAGGCTTCCACTGCAAA |
| 4169 | GCTTCAAGGCTTCCACTGCAAAA |
| 4170 | CTTCAAGGCTTCCACTGCAAAAC |
| 4171 | TTCAAGGCTTCCACTGCAAAACA |
| 4172 | TCAAGGCTTCCACTGCAAAACAC |
| 4173 | CAAGGCTTCCACTGCAAAACACT |
| 4174 | AAGGCTTCCACTGCAAAACACTA |
| 4175 | AGGCTTCCACTGCAAAACACTAA |
| 4176 | GGCTTCCACTGCAAAACACTAAA |

| ID | SEQUENCE |
|---|---|
| 4177 | GCTTCCACTGCAAAACACTAAAG |
| 4178 | CTTCCACTGCAAAACACTAAAGA |
| 4179 | TTCCACTGCAAAACACTAAAGAT |
| 4180 | TCCACTGCAAAACACTAAAGATC |
| 4181 | CCACTGCAAAACACTAAAGATCC |
| 4182 | CACTGCAAAACACTAAAGATCCA |
| 4183 | ACTGCAAAACACTAAAGATCCAA |
| 4184 | CTGCAAAACACTAAAGATCCAAG |
| 4185 | TGCAAAACACTAAAGATCCAAGA |
| 4186 | GCAAAACACTAAAGATCCAAGAA |
| 4187 | CAAAACACTAAAGATCCAAGAAG |
| 4188 | AAAACACTAAAGATCCAAGAAGG |
| 4189 | AAACACTAAAGATCCAAGAAGGC |
| 4190 | AACACTAAAGATCCAAGAAGGCC |
| 4191 | ACACTAAAGATCCAAGAAGGCCT |
| 4192 | CACTAAAGATCCAAGAAGGCCTT |
| 4193 | ACTAAAGATCCAAGAAGGCCTTC |
| 4194 | CTAAAGATCCAAGAAGGCCTTCA |
| 4195 | TAAAGATCCAAGAAGGCCTTCAT |
| 4196 | AAAGATCCAAGAAGGCCTTCATG |
| 4197 | AAGATCCAAGAAGGCCTTCATGG |
| 4198 | AGATCCAAGAAGGCCTTCATGGC |
| 4199 | GATCCAAGAAGGCCTTCATGGCC |
| 4200 | ATCCAAGAAGGCCTTCATGGCCC |
| 4201 | TCCAAGAAGGCCTTCATGGCCCC |
| 4202 | CCAAGAAGGCCTTCATGGCCCCA |
| 4203 | CAAGAAGGCCTTCATGGCCCCAG |
| 4204 | AAGAAGGCCTTCATGGCCCCAGC |
| 4205 | AGAAGGCCTTCATGGCCCCAGCA |
| 4206 | GAAGGCCTTCATGGCCCCAGCAG |
| 4207 | AAGGCCTTCATGGCCCCAGCAGG |
| 4208 | AGGCCTTCATGGCCCCAGCAGGC |
| 4209 | GGCCTTCATGGCCCCAGCAGGCC |
| 4210 | GCCTTCATGGCCCCAGCAGGCCG |
| 4211 | CCTTCATGGCCCCAGCAGGCCGG |
| 4212 | CTTCATGGCCCCAGCAGGCCGGA |
| 4213 | TTCATGGCCCCAGCAGGCCGGAT |
| 4214 | TCATGGCCCCAGCAGGCCGGATC |
| 4215 | CATGGCCCCAGCAGGCCGGATCG |
| 4216 | ATGGCCCCAGCAGGCCGGATCGG |
| 4217 | TGGCCCCAGCAGGCCGGATCGGT |
| 4218 | GGCCCCAGCAGGCCGGATCGGTA |
| 4219 | GCCCCAGCAGGCCGGATCGGTAC |
| 4220 | CCCCAGCAGGCCGGATCGGTACT |
| 4221 | CCCAGCAGGCCGGATCGGTACTG |
| 4222 | CCAGCAGGCCGGATCGGTACTGT |
| 4223 | CAGCAGGCCGGATCGGTACTGTA |
| 4224 | AGCAGGCCGGATCGGTACTGTAT |
| 4225 | GCAGGCCGGATCGGTACTGTATC |
| 4226 | CAGGCCGGATCGGTACTGTATCA |
| 4227 | AGGCCGGATCGGTACTGTATCAA |
| 4228 | GGCCGGATCGGTACTGTATCAAG |
| 4229 | GCCGGATCGGTACTGTATCAAGT |
| 4230 | CCGGATCGGTACTGTATCAAGTC |
| 4231 | CGGATCGGTACTGTATCAAGTCA |
| 4232 | GGATCGGTACTGTATCAAGTCAT |
| 4233 | GATCGGTACTGTATCAAGTCATG |
| 4234 | ATCGGTACTGTATCAAGTCATGG |

| ID | SEQUENCE |
|---|---|
| 4235 | TCGGTACTGTATCAAGTCATGGC |
| 4236 | CGGTACTGTATCAAGTCATGGCA |
| 4237 | GGTACTGTATCAAGTCATGGCAG |
| 4238 | GTACTGTATCAAGTCATGGCAGG |
| 4239 | TACTGTATCAAGTCATGGCAGGT |
| 4240 | ACTGTATCAAGTCATGGCAGGTA |
| 4241 | CTGTATCAAGTCATGGCAGGTAC |
| 4242 | TGTATCAAGTCATGGCAGGTACA |
| 4243 | GTATCAAGTCATGGCAGGTACAG |
| 4244 | TATCAAGTCATGGCAGGTACAGT |
| 4245 | ATCAAGTCATGGCAGGTACAGTA |
| 4246 | TCAAGTCATGGCAGGTACAGTAG |
| 4247 | CAAGTCATGGCAGGTACAGTAGG |
| 4248 | AAGTCATGGCAGGTACAGTAGGA |
| 4249 | AGTCATGGCAGGTACAGTAGGAT |
| 4250 | GTCATGGCAGGTACAGTAGGATA |
| 4251 | TCATGGCAGGTACAGTAGGATAA |
| 4252 | CATGGCAGGTACAGTAGGATAAG |
| 4253 | ATGGCAGGTACAGTAGGATAAGC |
| 4254 | TGGCAGGTACAGTAGGATAAGCC |
| 4255 | GGCAGGTACAGTAGGATAAGCCA |
| 4256 | GCAGGTACAGTAGGATAAGCCAC |
| 4257 | CAGGTACAGTAGGATAAGCCACT |
| 4258 | AGGTACAGTAGGATAAGCCACTC |
| 4259 | GGTACAGTAGGATAAGCCACTCT |
| 4260 | GTACAGTAGGATAAGCCACTCTG |
| 4261 | TACAGTAGGATAAGCCACTCTGT |
| 4262 | ACAGTAGGATAAGCCACTCTGTC |
| 4263 | CAGTAGGATAAGCCACTCTGTCC |
| 4264 | AGTAGGATAAGCCACTCTGTCCC |
| 4265 | GTAGGATAAGCCACTCTGTCCCT |
| 4266 | TAGGATAAGCCACTCTGTCCCTT |
| 4267 | AGGATAAGCCACTCTGTCCCTTC |
| 4268 | GGATAAGCCACTCTGTCCCTTCC |
| 4269 | GATAAGCCACTCTGTCCCTTCCT |
| 4270 | ATAAGCCACTCTGTCCCTTCCTG |
| 4271 | TAAGCCACTCTGTCCCTTCCTGG |
| 4272 | AAGCCACTCTGTCCCTTCCTGGG |
| 4273 | AGCCACTCTGTCCCTTCCTGGGC |
| 4274 | GCCACTCTGTCCCTTCCTGGGCA |
| 4275 | CCACTCTGTCCCTTCCTGGGCAA |
| 4276 | CACTCTGTCCCTTCCTGGGCAAA |
| 4277 | ACTCTGTCCCTTCCTGGGCAAAG |
| 4278 | CTCTGTCCCTTCCTGGGCAAAGA |
| 4279 | TCTGTCCCTTCCTGGGCAAAGAA |
| 4280 | CTGTCCCTTCCTGGGCAAAGAAG |
| 4281 | TGTCCCTTCCTGGGCAAAGAAGA |
| 4282 | GTCCCTTCCTGGGCAAAGAAGAA |
| 4283 | TCCCTTCCTGGGCAAAGAAGAAA |
| 4284 | CCCTTCCTGGGCAAAGAAGAAAC |
| 4285 | CCTTCCTGGGCAAAGAAGAAACG |
| 4286 | CTTCCTGGGCAAAGAAGAAACGG |
| 4287 | TTCCTGGGCAAAGAAGAAACGGA |
| 4288 | TCCTGGGCAAAGAAGAAACGGAG |
| 4289 | CCTGGGCAAAGAAGAAACGGAGG |
| 4290 | CTGGGCAAAGAAGAAACGGAGGG |
| 4291 | TGGGCAAAGAAGAAACGGAGGGG |
| 4292 | GGGCAAAGAAGAAACGGAGGGGA |

| ID | SEQUENCE |
|---|---|
| 4293 | GGCAAAGAAGAAACGGAGGGGAT |
| 4294 | GCAAAGAAGAAACGGAGGGGATG |
| 4295 | CAAAGAAGAAACGGAGGGGATGG |
| 4296 | AAAGAAGAAACGGAGGGGATGGA |
| 4297 | AAGAAGAAACGGAGGGGATGGAA |
| 4298 | AGAAGAAACGGAGGGGATGGAAT |
| 4299 | GAAGAAACGGAGGGGATGGAATT |
| 4300 | AAGAAACGGAGGGGATGGAATTC |
| 4301 | AGAAACGGAGGGGATGGAATTCT |
| 4302 | GAAACGGAGGGGATGGAATTCTT |
| 4303 | AAACGGAGGGGATGGAATTCTTC |
| 4304 | AACGGAGGGGATGGAATTCTTCC |
| 4305 | ACGGAGGGGATGGAATTCTTCCT |
| 4306 | CGGAGGGGATGGAATTCTTCCTT |
| 4307 | GGAGGGGATGGAATTCTTCCTTA |
| 4308 | GAGGGGATGGAATTCTTCCTTAG |
| 4309 | AGGGGATGGAATTCTTCCTTAGA |
| 4310 | GGGGATGGAATTCTTCCTTAGAC |
| 4311 | GGGATGGAATTCTTCCTTAGACT |
| 4312 | GGATGGAATTCTTCCTTAGACTT |
| 4313 | GATGGAATTCTTCCTTAGACTTA |
| 4314 | ATGGAATTCTTCCTTAGACTTAC |
| 4315 | TGGAATTCTTCCTTAGACTTACT |
| 4316 | GGAATTCTTCCTTAGACTTACTT |
| 4317 | GAATTCTTCCTTAGACTTACTTT |
| 4318 | AATTCTTCCTTAGACTTACTTTT |
| 4319 | ATTCTTCCTTAGACTTACTTTTG |
| 4320 | TTCTTCCTTAGACTTACTTTTGT |
| 4321 | TCTTCCTTAGACTTACTTTTGTA |
| 4322 | CTTCCTTAGACTTACTTTTGTAA |
| 4323 | TTCCTTAGACTTACTTTTGTAAA |
| 4324 | TCCTTAGACTTACTTTTGTAAAA |
| 4325 | CCTTAGACTTACTTTTGTAAAAA |
| 4326 | CTTAGACTTACTTTTGTAAAAAT |
| 4327 | TTAGACTTACTTTTGTAAAAATG |
| 4328 | TAGACTTACTTTTGTAAAAATGT |
| 4329 | AGACTTACTTTTGTAAAAATGTC |
| 4330 | GACTTACTTTTGTAAAAATGTCC |
| 4331 | ACTTACTTTTGTAAAAATGTCCC |
| 4332 | CTTACTTTTGTAAAAATGTCCCC |
| 4333 | TTACTTTTGTAAAAATGTCCCCA |
| 4334 | TACTTTTGTAAAAATGTCCCCAC |
| 4335 | ACTTTTGTAAAAATGTCCCCACG |
| 4336 | CTTTTGTAAAAATGTCCCCACGG |
| 4337 | TTTTGTAAAAATGTCCCCACGGT |
| 4338 | TTTGTAAAAATGTCCCCACGGTA |
| 4339 | TTGTAAAAATGTCCCCACGGTAC |
| 4340 | TGTAAAAATGTCCCCACGGTACT |
| 4341 | GTAAAAATGTCCCCACGGTACTT |
| 4342 | TAAAAATGTCCCCACGGTACTTA |
| 4343 | AAAAATGTCCCCACGGTACTTAC |
| 4344 | AAAATGTCCCCACGGTACTTACT |
| 4345 | AAATGTCCCCACGGTACTTACTC |
| 4346 | AATGTCCCCACGGTACTTACTCC |
| 4347 | ATGTCCCCACGGTACTTACTCCC |
| 4348 | TGTCCCCACGGTACTTACTCCCC |
| 4349 | GTCCCCACGGTACTTACTCCCCA |
| 4350 | TCCCCACGGTACTTACTCCCCAC |

| ID | SEQUENCE |
|---|---|
| 4351 | CCCCACGGTACTTACTCCCCACT |
| 4352 | CCCACGGTACTTACTCCCCACTG |
| 4353 | CCACGGTACTTACTCCCCACTGA |
| 4354 | CACGGTACTTACTCCCCACTGAT |
| 4355 | ACGGTACTTACTCCCCACTGATG |
| 4356 | CGGTACTTACTCCCCACTGATGG |
| 4357 | GGTACTTACTCCCCACTGATGGA |
| 4358 | GTACTTACTCCCCACTGATGGAC |
| 4359 | TACTTACTCCCCACTGATGGACC |
| 4360 | ACTTACTCCCCACTGATGGACCA |
| 4361 | CTTACTCCCCACTGATGGACCAG |
| 4362 | TTACTCCCCACTGATGGACCAGT |
| 4363 | TACTCCCCACTGATGGACCAGTG |
| 4364 | ACTCCCCACTGATGGACCAGTGG |
| 4365 | CTCCCCACTGATGGACCAGTGGT |
| 4366 | TCCCCACTGATGGACCAGTGGTT |
| 4367 | CCCCACTGATGGACCAGTGGTTT |
| 4368 | CCCACTGATGGACCAGTGGTTTC |
| 4369 | CCACTGATGGACCAGTGGTTTCC |
| 4370 | CACTGATGGACCAGTGGTTTCCA |
| 4371 | ACTGATGGACCAGTGGTTTCCAG |
| 4372 | CTGATGGACCAGTGGTTTCCAGT |
| 4373 | TGATGGACCAGTGGTTTCCAGTC |
| 4374 | GATGGACCAGTGGTTTCCAGTCA |
| 4375 | ATGGACCAGTGGTTTCCAGTCAT |
| 4376 | TGGACCAGTGGTTTCCAGTCATG |
| 4377 | GGACCAGTGGTTTCCAGTCATGA |
| 4378 | GACCAGTGGTTTCCAGTCATGAG |
| 4379 | ACCAGTGGTTTCCAGTCATGAGC |
| 4380 | CCAGTGGTTTCCAGTCATGAGCG |
| 4381 | CAGTGGTTTCCAGTCATGAGCGT |
| 4382 | AGTGGTTTCCAGTCATGAGCGTT |
| 4383 | GTGGTTTCCAGTCATGAGCGTTA |
| 4384 | TGGTTTCCAGTCATGAGCGTTAG |
| 4385 | GGTTTCCAGTCATGAGCGTTAGA |
| 4386 | GTTTCCAGTCATGAGCGTTAGAC |
| 4387 | TTTCCAGTCATGAGCGTTAGACT |
| 4388 | TTCCAGTCATGAGCGTTAGACTG |
| 4389 | TCCAGTCATGAGCGTTAGACTGA |
| 4390 | CCAGTCATGAGCGTTAGACTGAC |
| 4391 | CAGTCATGAGCGTTAGACTGACT |
| 4392 | AGTCATGAGCGTTAGACTGACTT |
| 4393 | GTCATGAGCGTTAGACTGACTTG |
| 4394 | TCATGAGCGTTAGACTGACTTGT |
| 4395 | CATGAGCGTTAGACTGACTTGTT |
| 4396 | ATGAGCGTTAGACTGACTTGTTT |
| 4397 | TGAGCGTTAGACTGACTTGTTTG |
| 4398 | GAGCGTTAGACTGACTTGTTTGT |
| 4399 | AGCGTTAGACTGACTTGTTTGTC |
| 4400 | GCGTTAGACTGACTTGTTTGTCT |
| 4401 | CGTTAGACTGACTTGTTTGTCTT |
| 4402 | GTTAGACTGACTTGTTTGTCTTC |
| 4403 | TTAGACTGACTTGTTTGTCTTCC |
| 4404 | TAGACTGACTTGTTTGTCTTCCA |
| 4405 | AGACTGACTTGTTTGTCTTCCAT |
| 4406 | GACTGACTTGTTTGTCTTCCATT |
| 4407 | ACTGACTTGTTTGTCTTCCATTC |
| 4408 | CTGACTTGTTTGTCTTCCATTCC |

| ID | SEQUENCE |
|---|---|
| 4409 | TGACTTGTTTGTCTTCCATTCCA |
| 4410 | GACTTGTTTGTCTTCCATTCCAT |
| 4411 | ACTTGTTTGTCTTCCATTCCATT |
| 4412 | CTTGTTTGTCTTCCATTCCATTG |
| 4413 | TTGTTTGTCTTCCATTCCATTGT |
| 4414 | TGTTTGTCTTCCATTCCATTGTT |
| 4415 | GTTTGTCTTCCATTCCATTGTTT |
| 4416 | TTTGTCTTCCATTCCATTGTTTT |
| 4417 | TTGTCTTCCATTCCATTGTTTTG |
| 4418 | TGTCTTCCATTCCATTGTTTTGA |
| 4419 | GTCTTCCATTCCATTGTTTTGAA |
| 4420 | TCTTCCATTCCATTGTTTTGAAA |
| 4421 | CTTCCATTCCATTGTTTTGAAAC |
| 4422 | TTCCATTCCATTGTTTTGAAACT |
| 4423 | TCCATTCCATTGTTTTGAAACTC |
| 4424 | CCATTCCATTGTTTTGAAACTCA |
| 4425 | CATTCCATTGTTTTGAAACTCAG |
| 4426 | ATTCCATTGTTTTGAAACTCAGT |
| 4427 | TTCCATTGTTTTGAAACTCAGTA |
| 4428 | TCCATTGTTTTGAAACTCAGTAT |
| 4429 | CCATTGTTTTGAAACTCAGTATG |
| 4430 | CATTGTTTTGAAACTCAGTATGC |
| 4431 | ATTGTTTTGAAACTCAGTATGCT |
| 4432 | TTGTTTTGAAACTCAGTATGCTG |
| 4433 | TGTTTTGAAACTCAGTATGCTGC |
| 4434 | GTTTTGAAACTCAGTATGCTGCC |
| 4435 | TTTTGAAACTCAGTATGCTGCCC |
| 4436 | TTTGAAACTCAGTATGCTGCCCC |
| 4437 | TTGAAACTCAGTATGCTGCCCCT |
| 4438 | TGAAACTCAGTATGCTGCCCCTG |
| 4439 | GAAACTCAGTATGCTGCCCCTGT |
| 4440 | AAACTCAGTATGCTGCCCCTGTC |
| 4441 | AACTCAGTATGCTGCCCCTGTCT |
| 4442 | ACTCAGTATGCTGCCCCTGTCTT |
| 4443 | CTCAGTATGCTGCCCCTGTCTTG |
| 4444 | TCAGTATGCTGCCCCTGTCTTGC |
| 4445 | CAGTATGCTGCCCCTGTCTTGCT |
| 4446 | AGTATGCTGCCCCTGTCTTGCTG |
| 4447 | GTATGCTGCCCCTGTCTTGCTGT |
| 4448 | TATGCTGCCCCTGTCTTGCTGTC |
| 4449 | ATGCTGCCCCTGTCTTGCTGTCA |
| 4450 | TGCTGCCCCTGTCTTGCTGTCAT |
| 4451 | GCTGCCCCTGTCTTGCTGTCATG |
| 4452 | CTGCCCCTGTCTTGCTGTCATGA |
| 4453 | TGCCCCTGTCTTGCTGTCATGAA |
| 4454 | GCCCCTGTCTTGCTGTCATGAAA |
| 4455 | CCCCTGTCTTGCTGTCATGAAAT |
| 4456 | CCCTGTCTTGCTGTCATGAAATC |
| 4457 | CCTGTCTTGCTGTCATGAAATCA |
| 4458 | CTGTCTTGCTGTCATGAAATCAG |
| 4459 | TGTCTTGCTGTCATGAAATCAGC |
| 4460 | GTCTTGCTGTCATGAAATCAGCA |
| 4461 | TCTTGCTGTCATGAAATCAGCAA |
| 4462 | CTTGCTGTCATGAAATCAGCAAG |
| 4463 | TTGCTGTCATGAAATCAGCAAGA |
| 4464 | TGCTGTCATGAAATCAGCAAGAG |
| 4465 | GCTGTCATGAAATCAGCAAGAGA |
| 4466 | CTGTCATGAAATCAGCAAGAGAG |

| ID | SEQUENCE |
|---|---|
| 4467 | TGTCATGAAATCAGCAAGAGAGG |
| 4468 | GTCATGAAATCAGCAAGAGAGGA |
| 4469 | TCATGAAATCAGCAAGAGAGGAT |
| 4470 | CATGAAATCAGCAAGAGAGGATG |
| 4471 | ATGAAATCAGCAAGAGAGGATGA |
| 4472 | TGAAATCAGCAAGAGAGGATGAC |
| 4473 | GAAATCAGCAAGAGAGGATGACA |
| 4474 | AAATCAGCAAGAGAGGATGACAC |
| 4475 | AATCAGCAAGAGAGGATGACACA |
| 4476 | ATCAGCAAGAGAGGATGACACAT |
| 4477 | TCAGCAAGAGAGGATGACACATC |
| 4478 | CAGCAAGAGAGGATGACACATCA |
| 4479 | AGCAAGAGAGGATGACACATCAA |
| 4480 | GCAAGAGAGGATGACACATCAAA |
| 4481 | CAAGAGAGGATGACACATCAAAT |
| 4482 | AAGAGAGGATGACACATCAAATA |
| 4483 | AGAGAGGATGACACATCAAATAA |
| 4484 | GAGAGGATGACACATCAAATAAT |
| 4485 | AGAGGATGACACATCAAATAATA |
| 4486 | GAGGATGACACATCAAATAATAA |
| 4487 | AGGATGACACATCAAATAATAAC |
| 4488 | GGATGACACATCAAATAATAACT |
| 4489 | GATGACACATCAAATAATAACTC |
| 4490 | ATGACACATCAAATAATAACTCG |
| 4491 | TGACACATCAAATAATAACTCGG |
| 4492 | GACACATCAAATAATAACTCGGA |
| 4493 | ACACATCAAATAATAACTCGGAT |
| 4494 | CACATCAAATAATAACTCGGATT |
| 4495 | ACATCAAATAATAACTCGGATTC |
| 4496 | CATCAAATAATAACTCGGATTCC |
| 4497 | ATCAAATAATAACTCGGATTCCA |
| 4498 | TCAAATAATAACTCGGATTCCAG |
| 4499 | CAAATAATAACTCGGATTCCAGC |
| 4500 | AAATAATAACTCGGATTCCAGCC |
| 4501 | AATAATAACTCGGATTCCAGCCC |
| 4502 | ATAATAACTCGGATTCCAGCCCA |
| 4503 | TAATAACTCGGATTCCAGCCCAC |
| 4504 | AATAACTCGGATTCCAGCCCACA |
| 4505 | ATAACTCGGATTCCAGCCCACAT |
| 4506 | TAACTCGGATTCCAGCCCACATT |
| 4507 | AACTCGGATTCCAGCCCACATTG |
| 4508 | ACTCGGATTCCAGCCCACATTGG |
| 4509 | CTCGGATTCCAGCCCACATTGGA |
| 4510 | TCGGATTCCAGCCCACATTGGAT |
| 4511 | CGGATTCCAGCCCACATTGGATT |
| 4512 | GGATTCCAGCCCACATTGGATTC |
| 4513 | GATTCCAGCCCACATTGGATTCA |
| 4514 | ATTCCAGCCCACATTGGATTCAT |
| 4515 | TTCCAGCCCACATTGGATTCATC |
| 4516 | TCCAGCCCACATTGGATTCATCA |
| 4517 | CCAGCCCACATTGGATTCATCAG |
| 4518 | CAGCCCACATTGGATTCATCAGC |
| 4519 | AGCCCACATTGGATTCATCAGCA |
| 4520 | GCCCACATTGGATTCATCAGCAT |
| 4521 | CCCACATTGGATTCATCAGCATT |
| 4522 | CCACATTGGATTCATCAGCATTT |
| 4523 | CACATTGGATTCATCAGCATTTG |
| 4524 | ACATTGGATTCATCAGCATTTGG |

| ID | SEQUENCE |
|---|---|
| 4525 | CATTGGATTCATCAGCATTTGGA |
| 4526 | ATTGGATTCATCAGCATTTGGAC |
| 4527 | TTGGATTCATCAGCATTTGGACC |
| 4528 | TGGATTCATCAGCATTTGGACCA |
| 4529 | GGATTCATCAGCATTTGGACCAA |
| 4530 | GATTCATCAGCATTTGGACCAAT |
| 4531 | ATTCATCAGCATTTGGACCAATA |
| 4532 | TTCATCAGCATTTGGACCAATAG |
| 4533 | TCATCAGCATTTGGACCAATAGC |
| 4534 | CATCAGCATTTGGACCAATAGCC |
| 4535 | ATCAGCATTTGGACCAATAGCCC |
| 4536 | TCAGCATTTGGACCAATAGCCCA |
| 4537 | CAGCATTTGGACCAATAGCCCAC |
| 4538 | AGCATTTGGACCAATAGCCCACA |
| 4539 | GCATTTGGACCAATAGCCCACAG |
| 4540 | CATTTGGACCAATAGCCCACAGC |
| 4541 | ATTTGGACCAATAGCCCACAGCT |
| 4542 | TTTGGACCAATAGCCCACAGCTG |
| 4543 | TTGGACCAATAGCCCACAGCTGA |
| 4544 | TGGACCAATAGCCCACAGCTGAG |
| 4545 | GGACCAATAGCCCACAGCTGAGA |
| 4546 | GACCAATAGCCCACAGCTGAGAA |
| 4547 | ACCAATAGCCCACAGCTGAGAAT |
| 4548 | CCAATAGCCCACAGCTGAGAATG |
| 4549 | CAATAGCCCACAGCTGAGAATGT |
| 4550 | AATAGCCCACAGCTGAGAATGTG |
| 4551 | ATAGCCCACAGCTGAGAATGTGG |
| 4552 | TAGCCCACAGCTGAGAATGTGGA |
| 4553 | AGCCCACAGCTGAGAATGTGGAA |
| 4554 | GCCCACAGCTGAGAATGTGGAAT |
| 4555 | CCCACAGCTGAGAATGTGGAATA |
| 4556 | CCACAGCTGAGAATGTGGAATAC |
| 4557 | CACAGCTGAGAATGTGGAATACC |
| 4558 | ACAGCTGAGAATGTGGAATACCT |
| 4559 | CAGCTGAGAATGTGGAATACCTA |
| 4560 | AGCTGAGAATGTGGAATACCTAA |
| 4561 | GCTGAGAATGTGGAATACCTAAG |
| 4562 | CTGAGAATGTGGAATACCTAAGG |
| 4563 | TGAGAATGTGGAATACCTAAGGA |
| 4564 | GAGAATGTGGAATACCTAAGGAT |
| 4565 | AGAATGTGGAATACCTAAGGATA |
| 4566 | GAATGTGGAATACCTAAGGATAG |
| 4567 | AATGTGGAATACCTAAGGATAGC |
| 4568 | ATGTGGAATACCTAAGGATAGCA |
| 4569 | TGTGGAATACCTAAGGATAGCAC |
| 4570 | GTGGAATACCTAAGGATAGCACC |
| 4571 | TGGAATACCTAAGGATAGCACCG |
| 4572 | GGAATACCTAAGGATAGCACCGC |
| 4573 | GAATACCTAAGGATAGCACCGCT |
| 4574 | AATACCTAAGGATAGCACCGCTT |
| 4575 | ATACCTAAGGATAGCACCGCTTT |
| 4576 | TACCTAAGGATAGCACCGCTTTT |
| 4577 | ACCTAAGGATAGCACCGCTTTTG |
| 4578 | CCTAAGGATAGCACCGCTTTTGT |
| 4579 | CTAAGGATAGCACCGCTTTTGTT |
| 4580 | TAAGGATAGCACCGCTTTTGTTC |
| 4581 | AAGGATAGCACCGCTTTTGTTCT |
| 4582 | AGGATAGCACCGCTTTTGTTCTC |

| ID | SEQUENCE |
|---|---|
| 4583 | GGATAGCACCGCTTTTGTTCTCG |
| 4584 | GATAGCACCGCTTTTGTTCTCGC |
| 4585 | ATAGCACCGCTTTTGTTCTCGCA |
| 4586 | TAGCACCGCTTTTGTTCTCGCAA |
| 4587 | AGCACCGCTTTTGTTCTCGCAAA |
| 4588 | GCACCGCTTTTGTTCTCGCAAAA |
| 4589 | CACCGCTTTTGTTCTCGCAAAAA |
| 4590 | ACCGCTTTTGTTCTCGCAAAAAC |
| 4591 | CCGCTTTTGTTCTCGCAAAAACG |
| 4592 | CGCTTTTGTTCTCGCAAAAACGT |
| 4593 | GCTTTTGTTCTCGCAAAAACGTA |
| 4594 | CTTTTGTTCTCGCAAAAACGTAT |
| 4595 | TTTTGTTCTCGCAAAAACGTATC |
| 4596 | TTTGTTCTCGCAAAAACGTATCT |
| 4597 | TTGTTCTCGCAAAAACGTATCTC |
| 4598 | TGTTCTCGCAAAAACGTATCTCC |
| 4599 | GTTCTCGCAAAAACGTATCTCCT |
| 4600 | TTCTCGCAAAAACGTATCTCCTA |
| 4601 | TCTCGCAAAAACGTATCTCCTAA |
| 4602 | CTCGCAAAAACGTATCTCCTAAT |
| 4603 | TCGCAAAAACGTATCTCCTAATT |
| 4604 | CGCAAAAACGTATCTCCTAATTT |
| 4605 | GCAAAAACGTATCTCCTAATTTG |
| 4606 | CAAAAACGTATCTCCTAATTTGA |
| 4607 | AAAAACGTATCTCCTAATTTGAG |
| 4608 | AAAACGTATCTCCTAATTTGAGG |
| 4609 | AAACGTATCTCCTAATTTGAGGC |
| 4610 | AACGTATCTCCTAATTTGAGGCT |
| 4611 | ACGTATCTCCTAATTTGAGGCTC |
| 4612 | CGTATCTCCTAATTTGAGGCTCA |
| 4613 | GTATCTCCTAATTTGAGGCTCAG |
| 4614 | TATCTCCTAATTTGAGGCTCAGA |
| 4615 | ATCTCCTAATTTGAGGCTCAGAT |
| 4616 | TCTCCTAATTTGAGGCTCAGATG |
| 4617 | CTCCTAATTTGAGGCTCAGATGA |
| 4618 | TCCTAATTTGAGGCTCAGATGAA |
| 4619 | CCTAATTTGAGGCTCAGATGAAA |
| 4620 | CTAATTTGAGGCTCAGATGAAAT |
| 4621 | TAATTTGAGGCTCAGATGAAATG |
| 4622 | AATTTGAGGCTCAGATGAAATGC |
| 4623 | ATTTGAGGCTCAGATGAAATGCA |
| 4624 | TTTGAGGCTCAGATGAAATGCAT |
| 4625 | TTGAGGCTCAGATGAAATGCATC |
| 4626 | TGAGGCTCAGATGAAATGCATCA |
| 4627 | GAGGCTCAGATGAAATGCATCAG |
| 4628 | AGGCTCAGATGAAATGCATCAGG |
| 4629 | GGCTCAGATGAAATGCATCAGGT |
| 4630 | GCTCAGATGAAATGCATCAGGTC |
| 4631 | CTCAGATGAAATGCATCAGGTCC |
| 4632 | TCAGATGAAATGCATCAGGTCCT |
| 4633 | CAGATGAAATGCATCAGGTCCTT |
| 4634 | AGATGAAATGCATCAGGTCCTTT |
| 4635 | GATGAAATGCATCAGGTCCTTTG |
| 4636 | ATGAAATGCATCAGGTCCTTTGG |
| 4637 | TGAAATGCATCAGGTCCTTTGGG |
| 4638 | GAAATGCATCAGGTCCTTTGGGG |
| 4639 | AAATGCATCAGGTCCTTTGGGGC |
| 4640 | AATGCATCAGGTCCTTTGGGGCA |

| ID | SEQUENCE |
|---|---|
| 4641 | ATGCATCAGGTCCTTTGGGGCAT |
| 4642 | TGCATCAGGTCCTTTGGGGCATA |
| 4643 | GCATCAGGTCCTTTGGGGCATAG |
| 4644 | CATCAGGTCCTTTGGGGCATAGA |
| 4645 | ATCAGGTCCTTTGGGGCATAGAT |
| 4646 | TCAGGTCCTTTGGGGCATAGATC |
| 4647 | CAGGTCCTTTGGGGCATAGATCA |
| 4648 | AGGTCCTTTGGGGCATAGATCAG |
| 4649 | GGTCCTTTGGGGCATAGATCAGA |
| 4650 | GTCCTTTGGGGCATAGATCAGAA |
| 4651 | TCCTTTGGGGCATAGATCAGAAG |
| 4652 | CCTTTGGGGCATAGATCAGAAGA |
| 4653 | CTTTGGGGCATAGATCAGAAGAC |
| 4654 | TTTGGGGCATAGATCAGAAGACT |
| 4655 | TTGGGGCATAGATCAGAAGACTA |
| 4656 | TGGGGCATAGATCAGAAGACTAC |
| 4657 | GGGGCATAGATCAGAAGACTACA |
| 4658 | GGGCATAGATCAGAAGACTACAA |
| 4659 | GGCATAGATCAGAAGACTACAAA |
| 4660 | GCATAGATCAGAAGACTACAAAA |
| 4661 | CATAGATCAGAAGACTACAAAAA |
| 4662 | ATAGATCAGAAGACTACAAAAAT |
| 4663 | TAGATCAGAAGACTACAAAAATG |
| 4664 | AGATCAGAAGACTACAAAAATGA |
| 4665 | GATCAGAAGACTACAAAAATGAA |
| 4666 | ATCAGAAGACTACAAAAATGAAG |
| 4667 | TCAGAAGACTACAAAAATGAAGC |
| 4668 | CAGAAGACTACAAAAATGAAGCT |
| 4669 | AGAAGACTACAAAAATGAAGCTG |
| 4670 | GAAGACTACAAAAATGAAGCTGC |
| 4671 | AAGACTACAAAAATGAAGCTGCT |
| 4672 | AGACTACAAAAATGAAGCTGCTC |
| 4673 | GACTACAAAAATGAAGCTGCTCT |
| 4674 | ACTACAAAAATGAAGCTGCTCTG |
| 4675 | CTACAAAAATGAAGCTGCTCTGA |
| 4676 | TACAAAAATGAAGCTGCTCTGAA |
| 4677 | ACAAAAATGAAGCTGCTCTGAAA |
| 4678 | CAAAAATGAAGCTGCTCTGAAAT |
| 4679 | AAAAATGAAGCTGCTCTGAAATC |
| 4680 | AAAATGAAGCTGCTCTGAAATCT |
| 4681 | AAATGAAGCTGCTCTGAAATCTC |
| 4682 | AATGAAGCTGCTCTGAAATCTCC |
| 4683 | ATGAAGCTGCTCTGAAATCTCCT |
| 4684 | TGAAGCTGCTCTGAAATCTCCTT |
| 4685 | GAAGCTGCTCTGAAATCTCCTTT |
| 4686 | AAGCTGCTCTGAAATCTCCTTTA |
| 4687 | AGCTGCTCTGAAATCTCCTTTAG |
| 4688 | GCTGCTCTGAAATCTCCTTTAGC |
| 4689 | CTGCTCTGAAATCTCCTTTAGCC |
| 4690 | TGCTCTGAAATCTCCTTTAGCCA |
| 4691 | GCTCTGAAATCTCCTTTAGCCAT |
| 4692 | CTCTGAAATCTCCTTTAGCCATC |
| 4693 | TCTGAAATCTCCTTTAGCCATCA |
| 4694 | CTGAAATCTCCTTTAGCCATCAC |
| 4695 | TGAAATCTCCTTTAGCCATCACC |
| 4696 | GAAATCTCCTTTAGCCATCACCC |
| 4697 | AAATCTCCTTTAGCCATCACCCC |
| 4698 | AATCTCCTTTAGCCATCACCCCA |

| ID | SEQUENCE |
|---|---|
| 4699 | ATCTCCTTTAGCCATCACCCCAA |
| 4700 | TCTCCTTTAGCCATCACCCCAAC |
| 4701 | CTCCTTTAGCCATCACCCCAACC |
| 4702 | TCCTTTAGCCATCACCCCAACCC |
| 4703 | CCTTTAGCCATCACCCCAACCCC |
| 4704 | CTTTAGCCATCACCCCAACCCCC |
| 4705 | TTTAGCCATCACCCCAACCCCCC |
| 4706 | TTAGCCATCACCCCAACCCCCCA |
| 4707 | TAGCCATCACCCCAACCCCCCAA |
| 4708 | AGCCATCACCCCAACCCCCCAAA |
| 4709 | GCCATCACCCCAACCCCCCAAAA |
| 4710 | CCATCACCCCAACCCCCCAAAAT |
| 4711 | CATCACCCCAACCCCCCAAAATT |
| 4712 | ATCACCCCAACCCCCCAAAATTA |
| 4713 | TCACCCCAACCCCCCAAAATTAG |
| 4714 | CACCCCAACCCCCCAAAATTAGT |
| 4715 | ACCCCAACCCCCCAAAATTAGTT |
| 4716 | CCCCAACCCCCCAAAATTAGTTT |
| 4717 | CCCAACCCCCCAAAATTAGTTTG |
| 4718 | CCAACCCCCCAAAATTAGTTTGT |
| 4719 | CAACCCCCCAAAATTAGTTTGTG |
| 4720 | AACCCCCCAAAATTAGTTTGTGT |
| 4721 | ACCCCCCAAAATTAGTTTGTGTT |
| 4722 | CCCCCCAAAATTAGTTTGTGTTA |
| 4723 | CCCCCAAAATTAGTTTGTGTTAC |
| 4724 | CCCCAAAATTAGTTTGTGTTACT |
| 4725 | CCCAAAATTAGTTTGTGTTACTT |
| 4726 | CCAAAATTAGTTTGTGTTACTTA |
| 4727 | CAAAATTAGTTTGTGTTACTTAT |
| 4728 | AAAATTAGTTTGTGTTACTTATG |
| 4729 | AAATTAGTTTGTGTTACTTATGG |
| 4730 | AATTAGTTTGTGTTACTTATGGA |
| 4731 | ATTAGTTTGTGTTACTTATGGAA |
| 4732 | TTAGTTTGTGTTACTTATGGAAG |
| 4733 | TAGTTTGTGTTACTTATGGAAGA |
| 4734 | AGTTTGTGTTACTTATGGAAGAT |
| 4735 | GTTTGTGTTACTTATGGAAGATA |
| 4736 | TTTGTGTTACTTATGGAAGATAG |
| 4737 | TTGTGTTACTTATGGAAGATAGT |
| 4738 | TGTGTTACTTATGGAAGATAGTT |
| 4739 | GTGTTACTTATGGAAGATAGTTT |
| 4740 | TGTTACTTATGGAAGATAGTTTT |
| 4741 | GTTACTTATGGAAGATAGTTTTC |
| 4742 | TTACTTATGGAAGATAGTTTTCT |
| 4743 | TACTTATGGAAGATAGTTTTCTC |
| 4744 | ACTTATGGAAGATAGTTTTCTCC |
| 4745 | CTTATGGAAGATAGTTTTCTCCT |
| 4746 | TTATGGAAGATAGTTTTCTCCTT |
| 4747 | TATGGAAGATAGTTTTCTCCTTT |
| 4748 | ATGGAAGATAGTTTTCTCCTTTT |
| 4749 | TGGAAGATAGTTTTCTCCTTTTA |
| 4750 | GGAAGATAGTTTTCTCCTTTTAC |
| 4751 | GAAGATAGTTTTCTCCTTTTACT |
| 4752 | AAGATAGTTTTCTCCTTTTACTT |
| 4753 | AGATAGTTTTCTCCTTTTACTTC |
| 4754 | GATAGTTTTCTCCTTTTACTTCA |
| 4755 | ATAGTTTTCTCCTTTTACTTCAC |
| 4756 | TAGTTTTCTCCTTTTACTTCACT |

| ID | SEQUENCE |
|---|---|
| 4757 | AGTTTTCTCCTTTTACTTCACTT |
| 4758 | GTTTTCTCCTTTTACTTCACTTC |
| 4759 | TTTTCTCCTTTTACTTCACTTCA |
| 4760 | TTTCTCCTTTTACTTCACTTCAA |
| 4761 | TTCTCCTTTTACTTCACTTCAAA |
| 4762 | TCTCCTTTTACTTCACTTCAAAA |
| 4763 | CTCCTTTTACTTCACTTCAAAAG |
| 4764 | TCCTTTTACTTCACTTCAAAAGC |
| 4765 | CCTTTTACTTCACTTCAAAAGCT |
| 4766 | CTTTTACTTCACTTCAAAAGCTT |
| 4767 | TTTTACTTCACTTCAAAAGCTTT |
| 4768 | TTTACTTCACTTCAAAAGCTTTT |
| 4769 | TTACTTCACTTCAAAAGCTTTTT |
| 4770 | TACTTCACTTCAAAAGCTTTTTA |
| 4771 | ACTTCACTTCAAAAGCTTTTTAC |
| 4772 | CTTCACTTCAAAAGCTTTTTACT |
| 4773 | TTCACTTCAAAAGCTTTTTACTC |
| 4774 | TCACTTCAAAAGCTTTTTACTCA |
| 4775 | CACTTCAAAAGCTTTTTACTCAA |
| 4776 | ACTTCAAAAGCTTTTTACTCAAA |
| 4777 | CTTCAAAAGCTTTTTACTCAAAG |
| 4778 | TTCAAAAGCTTTTTACTCAAAGA |
| 4779 | TCAAAAGCTTTTTACTCAAAGAG |
| 4780 | CAAAAGCTTTTTACTCAAAGAGT |
| 4781 | AAAAGCTTTTTACTCAAAGAGTA |
| 4782 | AAAGCTTTTTACTCAAAGAGTAT |
| 4783 | AAGCTTTTTACTCAAAGAGTATA |
| 4784 | AGCTTTTTACTCAAAGAGTATAT |
| 4785 | GCTTTTTACTCAAAGAGTATATG |
| 4786 | CTTTTTACTCAAAGAGTATATGT |
| 4787 | TTTTTACTCAAAGAGTATATGTT |
| 4788 | TTTTACTCAAAGAGTATATGTTC |
| 4789 | TTTACTCAAAGAGTATATGTTCC |
| 4790 | TTACTCAAAGAGTATATGTTCCC |
| 4791 | TACTCAAAGAGTATATGTTCCCT |
| 4792 | ACTCAAAGAGTATATGTTCCCTC |
| 4793 | CTCAAAGAGTATATGTTCCCTCC |
| 4794 | TCAAAGAGTATATGTTCCCTCCA |
| 4795 | CAAAGAGTATATGTTCCCTCCAG |
| 4796 | AAAGAGTATATGTTCCCTCCAGG |
| 4797 | AAGAGTATATGTTCCCTCCAGGT |
| 4798 | AGAGTATATGTTCCCTCCAGGTC |
| 4799 | GAGTATATGTTCCCTCCAGGTCA |
| 4800 | AGTATATGTTCCCTCCAGGTCAG |
| 4801 | GTATATGTTCCCTCCAGGTCAGC |
| 4802 | TATATGTTCCCTCCAGGTCAGCT |
| 4803 | ATATGTTCCCTCCAGGTCAGCTG |
| 4804 | TATGTTCCCTCCAGGTCAGCTGC |
| 4805 | ATGTTCCCTCCAGGTCAGCTGCC |
| 4806 | TGTTCCCTCCAGGTCAGCTGCCC |
| 4807 | GTTCCCTCCAGGTCAGCTGCCCC |
| 4808 | TTCCCTCCAGGTCAGCTGCCCCC |
| 4809 | TCCCTCCAGGTCAGCTGCCCCCA |
| 4810 | CCCTCCAGGTCAGCTGCCCCCAA |
| 4811 | CCTCCAGGTCAGCTGCCCCCAAA |
| 4812 | CTCCAGGTCAGCTGCCCCCAAAC |
| 4813 | TCCAGGTCAGCTGCCCCCAAACC |
| 4814 | CCAGGTCAGCTGCCCCCAAACCC |

| ID | SEQUENCE |
|---|---|
| 4815 | CAGGTCAGCTGCCCCCAAACCCC |
| 4816 | AGGTCAGCTGCCCCCAAACCCCC |
| 4817 | GGTCAGCTGCCCCCAAACCCCCT |
| 4818 | GTCAGCTGCCCCCAAACCCCCTC |
| 4819 | TCAGCTGCCCCCAAACCCCCTCC |
| 4820 | CAGCTGCCCCCAAACCCCCTCCT |
| 4821 | AGCTGCCCCCAAACCCCCTCCTT |
| 4822 | GCTGCCCCCAAACCCCCTCCTTA |
| 4823 | CTGCCCCCAAACCCCCTCCTTAC |
| 4824 | TGCCCCCAAACCCCCTCCTTACG |
| 4825 | GCCCCCAAACCCCCTCCTTACGC |
| 4826 | CCCCCAAACCCCCTCCTTACGCT |
| 4827 | CCCCAAACCCCCTCCTTACGCTT |
| 4828 | CCCAAACCCCCTCCTTACGCTTT |
| 4829 | CCAAACCCCCTCCTTACGCTTTG |
| 4830 | CAAACCCCCTCCTTACGCTTTGT |
| 4831 | AAACCCCCTCCTTACGCTTTGTC |
| 4832 | AACCCCCTCCTTACGCTTTGTCA |
| 4833 | ACCCCCTCCTTACGCTTTGTCAC |
| 4834 | CCCCCTCCTTACGCTTTGTCACA |
| 4835 | CCCCTCCTTACGCTTTGTCACAC |
| 4836 | CCCTCCTTACGCTTTGTCACACA |
| 4837 | CCTCCTTACGCTTTGTCACACAA |
| 4838 | CTCCTTACGCTTTGTCACACAAA |
| 4839 | TCCTTACGCTTTGTCACACAAAA |
| 4840 | CCTTACGCTTTGTCACACAAAAA |
| 4841 | CTTACGCTTTGTCACACAAAAAG |
| 4842 | TTACGCTTTGTCACACAAAAAGT |
| 4843 | TACGCTTTGTCACACAAAAAGTG |
| 4844 | ACGCTTTGTCACACAAAAAGTGT |
| 4845 | CGCTTTGTCACACAAAAAGTGTC |
| 4846 | GCTTTGTCACACAAAAAGTGTCT |
| 4847 | CTTTGTCACACAAAAAGTGTCTC |
| 4848 | TTTGTCACACAAAAAGTGTCTCT |
| 4849 | TTGTCACACAAAAAGTGTCTCTG |
| 4850 | TGTCACACAAAAAGTGTCTCTGC |
| 4851 | GTCACACAAAAAGTGTCTCTGCC |
| 4852 | TCACACAAAAAGTGTCTCTGCCT |
| 4853 | CACACAAAAAGTGTCTCTGCCTT |
| 4854 | ACACAAAAAGTGTCTCTGCCTTG |
| 4855 | CACAAAAAGTGTCTCTGCCTTGA |
| 4856 | ACAAAAAGTGTCTCTGCCTTGAG |
| 4857 | CAAAAAGTGTCTCTGCCTTGAGT |
| 4858 | AAAAAGTGTCTCTGCCTTGAGTC |
| 4859 | AAAAGTGTCTCTGCCTTGAGTCA |
| 4860 | AAAGTGTCTCTGCCTTGAGTCAT |
| 4861 | AAGTGTCTCTGCCTTGAGTCATC |
| 4862 | AGTGTCTCTGCCTTGAGTCATCT |
| 4863 | GTGTCTCTGCCTTGAGTCATCTA |
| 4864 | TGTCTCTGCCTTGAGTCATCTAT |
| 4865 | GTCTCTGCCTTGAGTCATCTATT |
| 4866 | TCTCTGCCTTGAGTCATCTATTC |
| 4867 | CTCTGCCTTGAGTCATCTATTCA |
| 4868 | TCTGCCTTGAGTCATCTATTCAA |
| 4869 | CTGCCTTGAGTCATCTATTCAAG |
| 4870 | TGCCTTGAGTCATCTATTCAAGC |
| 4871 | GCCTTGAGTCATCTATTCAAGCA |
| 4872 | CCTTGAGTCATCTATTCAAGCAC |

| ID | SEQUENCE |
|---|---|
| 4873 | CTTGAGTCATCTATTCAAGCACT |
| 4874 | TTGAGTCATCTATTCAAGCACTT |
| 4875 | TGAGTCATCTATTCAAGCACTTA |
| 4876 | GAGTCATCTATTCAAGCACTTAC |
| 4877 | AGTCATCTATTCAAGCACTTACA |
| 4878 | GTCATCTATTCAAGCACTTACAG |
| 4879 | TCATCTATTCAAGCACTTACAGC |
| 4880 | CATCTATTCAAGCACTTACAGCT |
| 4881 | ATCTATTCAAGCACTTACAGCTC |
| 4882 | TCTATTCAAGCACTTACAGCTCT |
| 4883 | CTATTCAAGCACTTACAGCTCTG |
| 4884 | TATTCAAGCACTTACAGCTCTGG |
| 4885 | ATTCAAGCACTTACAGCTCTGGC |
| 4886 | TTCAAGCACTTACAGCTCTGGCC |
| 4887 | TCAAGCACTTACAGCTCTGGCCA |
| 4888 | CAAGCACTTACAGCTCTGGCCAC |
| 4889 | AAGCACTTACAGCTCTGGCCACA |
| 4890 | AGCACTTACAGCTCTGGCCACAA |
| 4891 | GCACTTACAGCTCTGGCCACAAC |
| 4892 | CACTTACAGCTCTGGCCACAACA |
| 4893 | ACTTACAGCTCTGGCCACAACAG |
| 4894 | CTTACAGCTCTGGCCACAACAGG |
| 4895 | TTACAGCTCTGGCCACAACAGGG |
| 4896 | TACAGCTCTGGCCACAACAGGGC |
| 4897 | ACAGCTCTGGCCACAACAGGGCA |
| 4898 | CAGCTCTGGCCACAACAGGGCAT |
| 4899 | AGCTCTGGCCACAACAGGGCATT |
| 4900 | GCTCTGGCCACAACAGGGCATTT |
| 4901 | CTCTGGCCACAACAGGGCATTTT |
| 4902 | TCTGGCCACAACAGGGCATTTTA |
| 4903 | CTGGCCACAACAGGGCATTTTAC |
| 4904 | TGGCCACAACAGGGCATTTTACA |
| 4905 | GGCCACAACAGGGCATTTTACAG |
| 4906 | GCCACAACAGGGCATTTTACAGG |
| 4907 | CCACAACAGGGCATTTTACAGGT |
| 4908 | CACAACAGGGCATTTTACAGGTG |
| 4909 | ACAACAGGGCATTTTACAGGTGC |
| 4910 | CAACAGGGCATTTTACAGGTGCG |
| 4911 | AACAGGGCATTTTACAGGTGCGA |
| 4912 | ACAGGGCATTTTACAGGTGCGAA |
| 4913 | CAGGGCATTTTACAGGTGCGAAT |
| 4914 | AGGGCATTTTACAGGTGCGAATG |
| 4915 | GGGCATTTTACAGGTGCGAATGA |
| 4916 | GGCATTTTACAGGTGCGAATGAC |
| 4917 | GCATTTTACAGGTGCGAATGACA |
| 4918 | CATTTTACAGGTGCGAATGACAG |
| 4919 | ATTTTACAGGTGCGAATGACAGT |
| 4920 | TTTTACAGGTGCGAATGACAGTA |
| 4921 | TTTACAGGTGCGAATGACAGTAG |
| 4922 | TTACAGGTGCGAATGACAGTAGC |
| 4923 | TACAGGTGCGAATGACAGTAGCA |
| 4924 | ACAGGTGCGAATGACAGTAGCAT |
| 4925 | CAGGTGCGAATGACAGTAGCATT |
| 4926 | AGGTGCGAATGACAGTAGCATTA |
| 4927 | GGTGCGAATGACAGTAGCATTAT |
| 4928 | GTGCGAATGACAGTAGCATTATG |
| 4929 | TGCGAATGACAGTAGCATTATGA |
| 4930 | GCGAATGACAGTAGCATTATGAG |

| ID | SEQUENCE |
|---|---|
| 4931 | CGAATGACAGTAGCATTATGAGT |
| 4932 | GAATGACAGTAGCATTATGAGTA |
| 4933 | AATGACAGTAGCATTATGAGTAG |
| 4934 | ATGACAGTAGCATTATGAGTAGT |
| 4935 | TGACAGTAGCATTATGAGTAGTG |
| 4936 | GACAGTAGCATTATGAGTAGTGT |
| 4937 | ACAGTAGCATTATGAGTAGTGTG |
| 4938 | CAGTAGCATTATGAGTAGTGTGG |
| 4939 | AGTAGCATTATGAGTAGTGTGGA |
| 4940 | GTAGCATTATGAGTAGTGTGGAA |
| 4941 | TAGCATTATGAGTAGTGTGGAAT |
| 4942 | AGCATTATGAGTAGTGTGGAATT |
| 4943 | GCATTATGAGTAGTGTGGAATTC |
| 4944 | CATTATGAGTAGTGTGGAATTCA |
| 4945 | ATTATGAGTAGTGTGGAATTCAG |
| 4946 | TTATGAGTAGTGTGGAATTCAGG |
| 4947 | TATGAGTAGTGTGGAATTCAGGT |
| 4948 | ATGAGTAGTGTGGAATTCAGGTA |
| 4949 | TGAGTAGTGTGGAATTCAGGTAG |
| 4950 | GAGTAGTGTGGAATTCAGGTAGT |
| 4951 | AGTAGTGTGGAATTCAGGTAGTA |
| 4952 | GTAGTGTGGAATTCAGGTAGTAA |
| 4953 | TAGTGTGGAATTCAGGTAGTAAA |
| 4954 | AGTGTGGAATTCAGGTAGTAAAT |
| 4955 | GTGTGGAATTCAGGTAGTAAATA |
| 4956 | TGTGGAATTCAGGTAGTAAATAT |
| 4957 | GTGGAATTCAGGTAGTAAATATG |
| 4958 | TGGAATTCAGGTAGTAAATATGA |
| 4959 | GGAATTCAGGTAGTAAATATGAA |
| 4960 | GAATTCAGGTAGTAAATATGAAA |
| 4961 | AATTCAGGTAGTAAATATGAAAC |
| 4962 | ATTCAGGTAGTAAATATGAAACT |
| 4963 | TTCAGGTAGTAAATATGAAACTA |
| 4964 | TCAGGTAGTAAATATGAAACTAG |
| 4965 | CAGGTAGTAAATATGAAACTAGG |
| 4966 | AGGTAGTAAATATGAAACTAGGG |
| 4967 | GGTAGTAAATATGAAACTAGGGT |
| 4968 | GTAGTAAATATGAAACTAGGGTT |
| 4969 | TAGTAAATATGAAACTAGGGTTT |
| 4970 | AGTAAATATGAAACTAGGGTTTG |
| 4971 | GTAAATATGAAACTAGGGTTTGA |
| 4972 | TAAATATGAAACTAGGGTTTGAA |
| 4973 | AAATATGAAACTAGGGTTTGAAA |
| 4974 | AATATGAAACTAGGGTTTGAAAT |
| 4975 | ATATGAAACTAGGGTTTGAAATT |
| 4976 | TATGAAACTAGGGTTTGAAATTG |
| 4977 | ATGAAACTAGGGTTTGAAATTGA |
| 4978 | TGAAACTAGGGTTTGAAATTGAT |
| 4979 | GAAACTAGGGTTTGAAATTGATA |
| 4980 | AAACTAGGGTTTGAAATTGATAA |
| 4981 | AACTAGGGTTTGAAATTGATAAT |
| 4982 | ACTAGGGTTTGAAATTGATAATG |
| 4983 | CTAGGGTTTGAAATTGATAATGC |
| 4984 | TAGGGTTTGAAATTGATAATGCT |
| 4985 | AGGGTTTGAAATTGATAATGCTT |
| 4986 | GGGTTTGAAATTGATAATGCTTT |
| 4987 | GGTTTGAAATTGATAATGCTTTC |
| 4988 | GTTTGAAATTGATAATGCTTTCA |

| ID | SEQUENCE |
|---|---|
| 4989 | TTTGAAATTGATAATGCTTTCAC |
| 4990 | TTGAAATTGATAATGCTTTCACA |
| 4991 | TGAAATTGATAATGCTTTCACAA |
| 4992 | GAAATTGATAATGCTTTCACAAC |
| 4993 | AAATTGATAATGCTTTCACAACA |
| 4994 | AATTGATAATGCTTTCACAACAT |
| 4995 | ATTGATAATGCTTTCACAACATT |
| 4996 | TTGATAATGCTTTCACAACATTT |
| 4997 | TGATAATGCTTTCACAACATTTG |
| 4998 | GATAATGCTTTCACAACATTTGC |
| 4999 | ATAATGCTTTCACAACATTTGCA |
| 5000 | TAATGCTTTCACAACATTTGCAG |
| 5001 | AATGCTTTCACAACATTTGCAGA |
| 5002 | ATGCTTTCACAACATTTGCAGAT |
| 5003 | TGCTTTCACAACATTTGCAGATG |
| 5004 | GCTTTCACAACATTTGCAGATGT |
| 5005 | CTTTCACAACATTTGCAGATGTT |
| 5006 | TTTCACAACATTTGCAGATGTTT |
| 5007 | TTCACAACATTTGCAGATGTTTT |
| 5008 | TCACAACATTTGCAGATGTTTTA |
| 5009 | CACAACATTTGCAGATGTTTTAG |
| 5010 | ACAACATTTGCAGATGTTTTAGA |
| 5011 | CAACATTTGCAGATGTTTTAGAA |
| 5012 | AACATTTGCAGATGTTTTAGAAG |
| 5013 | ACATTTGCAGATGTTTTAGAAGG |
| 5014 | CATTTGCAGATGTTTTAGAAGGA |
| 5015 | ATTTGCAGATGTTTTAGAAGGAA |
| 5016 | TTTGCAGATGTTTTAGAAGGAAA |
| 5017 | TTGCAGATGTTTTAGAAGGAAAA |
| 5018 | TGCAGATGTTTTAGAAGGAAAAA |
| 5019 | GCAGATGTTTTAGAAGGAAAAAA |
| 5020 | CAGATGTTTTAGAAGGAAAAAAG |
| 5021 | AGATGTTTTAGAAGGAAAAAAGT |
| 5022 | GATGTTTTAGAAGGAAAAAAGTT |
| 5023 | ATGTTTTAGAAGGAAAAAAGTTC |
| 5024 | TGTTTTAGAAGGAAAAAAGTTCC |
| 5025 | GTTTTAGAAGGAAAAAAGTTCCT |
| 5026 | TTTTAGAAGGAAAAAAGTTCCTT |
| 5027 | TTTAGAAGGAAAAAAGTTCCTTC |
| 5028 | TTAGAAGGAAAAAAGTTCCTTCC |
| 5029 | TAGAAGGAAAAAAGTTCCTTCCT |
| 5030 | AGAAGGAAAAAAGTTCCTTCCTA |
| 5031 | GAAGGAAAAAAGTTCCTTCCTAA |
| 5032 | AAGGAAAAAAGTTCCTTCCTAAA |
| 5033 | AGGAAAAAAGTTCCTTCCTAAAA |
| 5034 | GGAAAAAAGTTCCTTCCTAAAAT |
| 5035 | GAAAAAAGTTCCTTCCTAAAATA |
| 5036 | AAAAAAGTTCCTTCCTAAAATAA |
| 5037 | AAAAAGTTCCTTCCTAAAATAAT |
| 5038 | AAAAGTTCCTTCCTAAAATAATT |
| 5039 | AAAGTTCCTTCCTAAAATAATTT |
| 5040 | AAGTTCCTTCCTAAAATAATTTC |
| 5041 | AGTTCCTTCCTAAAATAATTTCT |
| 5042 | GTTCCTTCCTAAAATAATTTCTC |
| 5043 | TTCCTTCCTAAAATAATTTCTCT |
| 5044 | TCCTTCCTAAAATAATTTCTCTA |
| 5045 | CCTTCCTAAAATAATTTCTCTAC |
| 5046 | CTTCCTAAAATAATTTCTCTACA |

| ID | SEQUENCE |
|---|---|
| 5047 | TTCCTAAAATAATTTCTCTACAA |
| 5048 | TCCTAAAATAATTTCTCTACAAT |
| 5049 | CCTAAAATAATTTCTCTACAATT |
| 5050 | CTAAAATAATTTCTCTACAATTG |
| 5051 | TAAAATAATTTCTCTACAATTGG |
| 5052 | AAAATAATTTCTCTACAATTGGA |
| 5053 | AAATAATTTCTCTACAATTGGAA |
| 5054 | AATAATTTCTCTACAATTGGAAG |
| 5055 | ATAATTTCTCTACAATTGGAAGA |
| 5056 | TAATTTCTCTACAATTGGAAGAT |
| 5057 | AATTTCTCTACAATTGGAAGATT |
| 5058 | ATTTCTCTACAATTGGAAGATTG |
| 5059 | TTTCTCTACAATTGGAAGATTGG |
| 5060 | TTCTCTACAATTGGAAGATTGGA |
| 5061 | TCTCTACAATTGGAAGATTGGAA |
| 5062 | CTCTACAATTGGAAGATTGGAAG |
| 5063 | TCTACAATTGGAAGATTGGAAGA |
| 5064 | CTACAATTGGAAGATTGGAAGAT |
| 5065 | TACAATTGGAAGATTGGAAGATT |
| 5066 | ACAATTGGAAGATTGGAAGATTC |
| 5067 | CAATTGGAAGATTGGAAGATTCA |
| 5068 | AATTGGAAGATTGGAAGATTCAG |
| 5069 | ATTGGAAGATTGGAAGATTCAGC |
| 5070 | TTGGAAGATTGGAAGATTCAGCT |
| 5071 | TGGAAGATTGGAAGATTCAGCTA |
| 5072 | GGAAGATTGGAAGATTCAGCTAG |
| 5073 | GAAGATTGGAAGATTCAGCTAGT |
| 5074 | AAGATTGGAAGATTCAGCTAGTT |
| 5075 | AGATTGGAAGATTCAGCTAGTTA |
| 5076 | GATTGGAAGATTCAGCTAGTTAG |
| 5077 | ATTGGAAGATTCAGCTAGTTAGG |
| 5078 | TTGGAAGATTCAGCTAGTTAGGA |
| 5079 | TGGAAGATTCAGCTAGTTAGGAG |
| 5080 | GGAAGATTCAGCTAGTTAGGAGC |
| 5081 | GAAGATTCAGCTAGTTAGGAGCC |
| 5082 | AAGATTCAGCTAGTTAGGAGCCC |
| 5083 | AGATTCAGCTAGTTAGGAGCCCA |
| 5084 | GATTCAGCTAGTTAGGAGCCCAC |
| 5085 | ATTCAGCTAGTTAGGAGCCCACC |
| 5086 | TTCAGCTAGTTAGGAGCCCACCT |
| 5087 | TCAGCTAGTTAGGAGCCCACCTT |
| 5088 | CAGCTAGTTAGGAGCCCACCTTT |
| 5089 | AGCTAGTTAGGAGCCCACCTTTT |
| 5090 | GCTAGTTAGGAGCCCACCTTTTT |
| 5091 | CTAGTTAGGAGCCCACCTTTTTT |
| 5092 | TAGTTAGGAGCCCACCTTTTTTC |
| 5093 | AGTTAGGAGCCCACCTTTTTTCC |
| 5094 | GTTAGGAGCCCACCTTTTTTCCT |
| 5095 | TTAGGAGCCCACCTTTTTTCCTA |
| 5096 | TAGGAGCCCACCTTTTTTCCTAA |
| 5097 | AGGAGCCCACCTTTTTTCCTAAT |
| 5098 | GGAGCCCACCTTTTTTCCTAATC |
| 5099 | GAGCCCACCTTTTTTCCTAATCT |
| 5100 | AGCCCACCTTTTTTCCTAATCTG |
| 5101 | GCCCACCTTTTTTCCTAATCTGT |
| 5102 | CCCACCTTTTTTCCTAATCTGTG |
| 5103 | CCACCTTTTTTCCTAATCTGTGT |
| 5104 | CACCTTTTTTCCTAATCTGTGTG |

| ID | SEQUENCE |
|---|---|
| 5105 | ACCTTTTTCCTAATCTGTGTGT |
| 5106 | CCTTTTTCCTAATCTGTGTGTG |
| 5107 | CTTTTTTCCTAATCTGTGTGTGC |
| 5108 | TTTTTTCCTAATCTGTGTGTGCC |
| 5109 | TTTTTCCTAATCTGTGTGTGCCC |
| 5110 | TTTTCCTAATCTGTGTGTGCCCT |
| 5111 | TTTCCTAATCTGTGTGTGCCCTG |
| 5112 | TTCCTAATCTGTGTGTGCCCTGT |
| 5113 | TCCTAATCTGTGTGTGCCCTGTA |
| 5114 | CCTAATCTGTGTGTGCCCTGTAA |
| 5115 | CTAATCTGTGTGTGCCCTGTAAC |
| 5116 | TAATCTGTGTGTGCCCTGTAACC |
| 5117 | AATCTGTGTGTGCCCTGTAACCT |
| 5118 | ATCTGTGTGTGCCCTGTAACCTG |
| 5119 | TCTGTGTGTGCCCTGTAACCTGA |
| 5120 | CTGTGTGTGCCCTGTAACCTGAC |
| 5121 | TGTGTGTGCCCTGTAACCTGACT |
| 5122 | GTGTGTGCCCTGTAACCTGACTG |
| 5123 | TGTGTGCCCTGTAACCTGACTGG |
| 5124 | GTGTGCCCTGTAACCTGACTGGT |
| 5125 | TGTGCCCTGTAACCTGACTGGTT |
| 5126 | GTGCCCTGTAACCTGACTGGTTA |
| 5127 | TGCCCTGTAACCTGACTGGTTAA |
| 5128 | GCCCTGTAACCTGACTGGTTAAC |
| 5129 | CCCTGTAACCTGACTGGTTAACA |
| 5130 | CCTGTAACCTGACTGGTTAACAG |
| 5131 | CTGTAACCTGACTGGTTAACAGC |
| 5132 | TGTAACCTGACTGGTTAACAGCA |
| 5133 | GTAACCTGACTGGTTAACAGCAG |
| 5134 | TAACCTGACTGGTTAACAGCAGT |
| 5135 | AACCTGACTGGTTAACAGCAGTC |
| 5136 | ACCTGACTGGTTAACAGCAGTCC |
| 5137 | CCTGACTGGTTAACAGCAGTCCT |
| 5138 | CTGACTGGTTAACAGCAGTCCTT |
| 5139 | TGACTGGTTAACAGCAGTCCTTT |
| 5140 | GACTGGTTAACAGCAGTCCTTTG |
| 5141 | ACTGGTTAACAGCAGTCCTTTGT |
| 5142 | CTGGTTAACAGCAGTCCTTTGTA |
| 5143 | TGGTTAACAGCAGTCCTTTGTAA |
| 5144 | GGTTAACAGCAGTCCTTTGTAAA |
| 5145 | GTTAACAGCAGTCCTTTGTAAAC |
| 5146 | TTAACAGCAGTCCTTTGTAAACA |
| 5147 | TAACAGCAGTCCTTTGTAAACAG |
| 5148 | AACAGCAGTCCTTTGTAAACAGT |
| 5149 | ACAGCAGTCCTTTGTAAACAGTG |
| 5150 | CAGCAGTCCTTTGTAAACAGTGT |
| 5151 | AGCAGTCCTTTGTAAACAGTGTT |
| 5152 | GCAGTCCTTTGTAAACAGTGTTT |
| 5153 | CAGTCCTTTGTAAACAGTGTTTT |
| 5154 | AGTCCTTTGTAAACAGTGTTTTA |
| 5155 | GTCCTTTGTAAACAGTGTTTTAA |
| 5156 | TCCTTTGTAAACAGTGTTTTAAA |
| 5157 | CCTTTGTAAACAGTGTTTTAAAC |
| 5158 | CTTTGTAAACAGTGTTTTAAACT |
| 5159 | TTTGTAAACAGTGTTTTAAACTC |
| 5160 | TTGTAAACAGTGTTTTAAACTCT |
| 5161 | TGTAAACAGTGTTTTAAACTCTC |
| 5162 | GTAAACAGTGTTTTAAACTCTCC |

| ID | SEQUENCE |
|---|---|
| 5163 | TAAACAGTGTTTTAAACTCTCCT |
| 5164 | AAACAGTGTTTTAAACTCTCCTA |
| 5165 | AACAGTGTTTTAAACTCTCCTAG |
| 5166 | ACAGTGTTTTAAACTCTCCTAGT |
| 5167 | CAGTGTTTTAAACTCTCCTAGTC |
| 5168 | AGTGTTTTAAACTCTCCTAGTCA |
| 5169 | GTGTTTTAAACTCTCCTAGTCAA |
| 5170 | TGTTTTAAACTCTCCTAGTCAAT |
| 5171 | GTTTTAAACTCTCCTAGTCAATA |
| 5172 | TTTTAAACTCTCCTAGTCAATAT |
| 5173 | TTTAAACTCTCCTAGTCAATATC |
| 5174 | TTAAACTCTCCTAGTCAATATCC |
| 5175 | TAAACTCTCCTAGTCAATATCCA |
| 5176 | AAACTCTCCTAGTCAATATCCAC |
| 5177 | AACTCTCCTAGTCAATATCCACC |
| 5178 | ACTCTCCTAGTCAATATCCACCC |
| 5179 | CTCTCCTAGTCAATATCCACCCC |
| 5180 | TCTCCTAGTCAATATCCACCCCA |
| 5181 | CTCCTAGTCAATATCCACCCCAT |
| 5182 | TCCTAGTCAATATCCACCCCATC |
| 5183 | CCTAGTCAATATCCACCCCATCC |
| 5184 | CTAGTCAATATCCACCCCATCCA |
| 5185 | TAGTCAATATCCACCCCATCCAA |
| 5186 | AGTCAATATCCACCCCATCCAAT |
| 5187 | GTCAATATCCACCCCATCCAATT |
| 5188 | TCAATATCCACCCCATCCAATTT |
| 5189 | CAATATCCACCCCATCCAATTTA |
| 5190 | AATATCCACCCCATCCAATTTAT |
| 5191 | ATATCCACCCCATCCAATTTATC |
| 5192 | TATCCACCCCATCCAATTTATCA |
| 5193 | ATCCACCCCATCCAATTTATCAA |
| 5194 | TCCACCCCATCCAATTTATCAAG |
| 5195 | CCACCCCATCCAATTTATCAAGG |
| 5196 | CACCCCATCCAATTTATCAAGGA |
| 5197 | ACCCCATCCAATTTATCAAGGAA |
| 5198 | CCCCATCCAATTTATCAAGGAAG |
| 5199 | CCCATCCAATTTATCAAGGAAGA |
| 5200 | CCATCCAATTTATCAAGGAAGAA |
| 5201 | CATCCAATTTATCAAGGAAGAAA |
| 5202 | ATCCAATTTATCAAGGAAGAAAT |
| 5203 | TCCAATTTATCAAGGAAGAAATG |
| 5204 | CCAATTTATCAAGGAAGAAATGG |
| 5205 | CAATTTATCAAGGAAGAAATGGT |
| 5206 | AATTTATCAAGGAAGAAATGGTT |
| 5207 | ATTTATCAAGGAAGAAATGGTTC |
| 5208 | TTTATCAAGGAAGAAATGGTTCA |
| 5209 | TTATCAAGGAAGAAATGGTTCAG |
| 5210 | TATCAAGGAAGAAATGGTTCAGA |
| 5211 | ATCAAGGAAGAAATGGTTCAGAA |
| 5212 | TCAAGGAAGAAATGGTTCAGAAA |
| 5213 | CAAGGAAGAAATGGTTCAGAAAA |
| 5214 | AAGGAAGAAATGGTTCAGAAAAT |
| 5215 | AGGAAGAAATGGTTCAGAAAATA |
| 5216 | GGAAGAAATGGTTCAGAAAATAT |
| 5217 | GAAGAAATGGTTCAGAAAATATT |
| 5218 | AAGAAATGGTTCAGAAAATATTT |
| 5219 | AGAAATGGTTCAGAAAATATTTT |
| 5220 | GAAATGGTTCAGAAAATATTTTC |

| ID | SEQUENCE |
|---|---|
| 5221 | AAATGGTTCAGAAAATATTTTCA |
| 5222 | AATGGTTCAGAAAATATTTTCAG |
| 5223 | ATGGTTCAGAAAATATTTTCAGC |
| 5224 | TGGTTCAGAAAATATTTTCAGCC |
| 5225 | GGTTCAGAAAATATTTTCAGCCT |
| 5226 | GTTCAGAAAATATTTTCAGCCTA |
| 5227 | TTCAGAAAATATTTTCAGCCTAC |
| 5228 | TCAGAAAATATTTTCAGCCTACA |
| 5229 | CAGAAAATATTTTCAGCCTACAG |
| 5230 | AGAAAATATTTTCAGCCTACAGT |
| 5231 | GAAAATATTTTCAGCCTACAGTT |
| 5232 | AAAATATTTTCAGCCTACAGTTA |
| 5233 | AAATATTTTCAGCCTACAGTTAT |
| 5234 | AATATTTTCAGCCTACAGTTATG |
| 5235 | ATATTTTCAGCCTACAGTTATGT |
| 5236 | TATTTTCAGCCTACAGTTATGTT |
| 5237 | ATTTTCAGCCTACAGTTATGTTC |
| 5238 | TTTTCAGCCTACAGTTATGTTCA |
| 5239 | TTTCAGCCTACAGTTATGTTCAG |
| 5240 | TTCAGCCTACAGTTATGTTCAGT |
| 5241 | TCAGCCTACAGTTATGTTCAGTC |
| 5242 | CAGCCTACAGTTATGTTCAGTCA |
| 5243 | AGCCTACAGTTATGTTCAGTCAC |
| 5244 | GCCTACAGTTATGTTCAGTCACA |
| 5245 | CCTACAGTTATGTTCAGTCACAC |
| 5246 | CTACAGTTATGTTCAGTCACACA |
| 5247 | TACAGTTATGTTCAGTCACACAC |
| 5248 | ACAGTTATGTTCAGTCACACACA |
| 5249 | CAGTTATGTTCAGTCACACACAC |
| 5250 | AGTTATGTTCAGTCACACACACA |
| 5251 | GTTATGTTCAGTCACACACACAT |
| 5252 | TTATGTTCAGTCACACACACATA |
| 5253 | TATGTTCAGTCACACACACATAC |
| 5254 | ATGTTCAGTCACACACACATACA |
| 5255 | TGTTCAGTCACACACACATACAA |
| 5256 | GTTCAGTCACACACACATACAAA |
| 5257 | TTCAGTCACACACACATACAAAA |
| 5258 | TCAGTCACACACACATACAAAAT |
| 5259 | CAGTCACACACACATACAAAATG |
| 5260 | AGTCACACACACATACAAAATGT |
| 5261 | GTCACACACACATACAAAATGTT |
| 5262 | TCACACACACATACAAAATGTTC |
| 5263 | CACACACACATACAAAATGTTCC |
| 5264 | ACACACACATACAAAATGTTCCT |
| 5265 | CACACACATACAAAATGTTCCTT |
| 5266 | ACACACATACAAAATGTTCCTTT |
| 5267 | CACACATACAAAATGTTCCTTTT |
| 5268 | ACACATACAAAATGTTCCTTTTG |
| 5269 | CACATACAAAATGTTCCTTTTGC |
| 5270 | ACATACAAAATGTTCCTTTTGCT |
| 5271 | CATACAAAATGTTCCTTTTGCTT |
| 5272 | ATACAAAATGTTCCTTTTGCTTT |
| 5273 | TACAAAATGTTCCTTTTGCTTTT |
| 5274 | ACAAAATGTTCCTTTTGCTTTTA |
| 5275 | CAAAATGTTCCTTTTGCTTTTAA |
| 5276 | AAAATGTTCCTTTTGCTTTTAAA |
| 5277 | AAATGTTCCTTTTGCTTTTAAAG |
| 5278 | AATGTTCCTTTTGCTTTTAAAGT |

| ID | SEQUENCE |
|---|---|
| 5279 | ATGTTCCTTTTGCTTTTAAAGTA |
| 5280 | TGTTCCTTTTGCTTTTAAAGTAA |
| 5281 | GTTCCTTTTGCTTTTAAAGTAAT |
| 5282 | TTCCTTTTGCTTTTAAAGTAATT |
| 5283 | TCCTTTTGCTTTTAAAGTAATTT |
| 5284 | CCTTTTGCTTTTAAAGTAATTTT |
| 5285 | CTTTTGCTTTTAAAGTAATTTTT |
| 5286 | TTTTGCTTTTAAAGTAATTTTTG |
| 5287 | TTTGCTTTTAAAGTAATTTTTGA |
| 5288 | TTGCTTTTAAAGTAATTTTTGAC |
| 5289 | TGCTTTTAAAGTAATTTTTGACT |
| 5290 | GCTTTTAAAGTAATTTTTGACTC |
| 5291 | CTTTTAAAGTAATTTTTGACTCC |
| 5292 | TTTTAAAGTAATTTTTGACTCCC |
| 5293 | TTTAAAGTAATTTTTGACTCCCA |
| 5294 | TTAAAGTAATTTTTGACTCCCAG |
| 5295 | TAAAGTAATTTTTGACTCCCAGA |
| 5296 | AAAGTAATTTTTGACTCCCAGAT |
| 5297 | AAGTAATTTTTGACTCCCAGATC |
| 5298 | AGTAATTTTTGACTCCCAGATCA |
| 5299 | GTAATTTTTGACTCCCAGATCAG |
| 5300 | TAATTTTTGACTCCCAGATCAGT |
| 5301 | AATTTTTGACTCCCAGATCAGTC |
| 5302 | ATTTTTGACTCCCAGATCAGTCA |
| 5303 | TTTTTGACTCCCAGATCAGTCAG |
| 5304 | TTTTGACTCCCAGATCAGTCAGA |
| 5305 | TTTGACTCCCAGATCAGTCAGAG |
| 5306 | TTGACTCCCAGATCAGTCAGAGC |
| 5307 | TGACTCCCAGATCAGTCAGAGCC |
| 5308 | GACTCCCAGATCAGTCAGAGCCC |
| 5309 | ACTCCCAGATCAGTCAGAGCCCC |
| 5310 | CTCCCAGATCAGTCAGAGCCCCT |
| 5311 | TCCCAGATCAGTCAGAGCCCCTA |
| 5312 | CCCAGATCAGTCAGAGCCCCTAC |
| 5313 | CCAGATCAGTCAGAGCCCCTACA |
| 5314 | CAGATCAGTCAGAGCCCCTACAG |
| 5315 | AGATCAGTCAGAGCCCCTACAGC |
| 5316 | GATCAGTCAGAGCCCCTACAGCA |
| 5317 | ATCAGTCAGAGCCCCTACAGCAT |
| 5318 | TCAGTCAGAGCCCCTACAGCATT |
| 5319 | CAGTCAGAGCCCCTACAGCATTG |
| 5320 | AGTCAGAGCCCCTACAGCATTGT |
| 5321 | GTCAGAGCCCCTACAGCATTGTT |
| 5322 | TCAGAGCCCCTACAGCATTGTTA |
| 5323 | CAGAGCCCCTACAGCATTGTTAA |
| 5324 | AGAGCCCCTACAGCATTGTTAAG |
| 5325 | GAGCCCCTACAGCATTGTTAAGA |
| 5326 | AGCCCCTACAGCATTGTTAAGAA |
| 5327 | GCCCCTACAGCATTGTTAAGAAA |
| 5328 | CCCCTACAGCATTGTTAAGAAAG |
| 5329 | CCCTACAGCATTGTTAAGAAAGT |
| 5330 | CCTACAGCATTGTTAAGAAAGTA |
| 5331 | CTACAGCATTGTTAAGAAAGTAT |
| 5332 | TACAGCATTGTTAAGAAAGTATT |
| 5333 | ACAGCATTGTTAAGAAAGTATTT |
| 5334 | CAGCATTGTTAAGAAAGTATTTG |
| 5335 | AGCATTGTTAAGAAAGTATTTGA |
| 5336 | GCATTGTTAAGAAAGTATTTGAT |

| ID | SEQUENCE |
|---|---|
| 5337 | CATTGTTAAGAAAGTATTTGATT |
| 5338 | ATTGTTAAGAAAGTATTTGATTT |
| 5339 | TTGTTAAGAAAGTATTTGATTTT |
| 5340 | TGTTAAGAAAGTATTTGATTTTT |
| 5341 | GTTAAGAAAGTATTTGATTTTTG |
| 5342 | TTAAGAAAGTATTTGATTTTTGT |
| 5343 | TAAGAAAGTATTTGATTTTTGTC |
| 5344 | AAGAAAGTATTTGATTTTTGTCT |
| 5345 | AGAAAGTATTTGATTTTTGTCTC |
| 5346 | GAAAGTATTTGATTTTTGTCTCA |
| 5347 | AAAGTATTTGATTTTTGTCTCAA |
| 5348 | AAGTATTTGATTTTTGTCTCAAT |
| 5349 | AGTATTTGATTTTTGTCTCAATG |
| 5350 | GTATTTGATTTTTGTCTCAATGA |
| 5351 | TATTTGATTTTTGTCTCAATGAA |
| 5352 | ATTTGATTTTTGTCTCAATGAAA |
| 5353 | TTTGATTTTTGTCTCAATGAAAA |
| 5354 | TTGATTTTTGTCTCAATGAAAAT |
| 5355 | TGATTTTTGTCTCAATGAAAATA |
| 5356 | GATTTTTGTCTCAATGAAAATAA |
| 5357 | ATTTTTGTCTCAATGAAAATAAA |
| 5358 | TTTTTGTCTCAATGAAAATAAAA |
| 5359 | TTTTGTCTCAATGAAAATAAAAC |
| 5360 | TTTGTCTCAATGAAAATAAAACT |
| 5361 | TTGTCTCAATGAAAATAAAACTA |
| 5362 | TGTCTCAATGAAAATAAAACTAT |
| 5363 | GTCTCAATGAAAATAAAACTATA |
| 5364 | TCTCAATGAAAATAAAACTATAT |
| 5365 | CTCAATGAAAATAAAACTATATT |
| 5366 | TCAATGAAAATAAAACTATATTC |
| 5367 | CAATGAAAATAAAACTATATTCA |
| 5368 | AATGAAAATAAAACTATATTCAT |
| 5369 | ATGAAAATAAAACTATATTCATT |
| 5370 | TGAAAATAAAACTATATTCATTT |
| 5371 | GAAAATAAAACTATATTCATTTC |
| 5372 | AAAATAAAACTATATTCATTTCC |
| 5373 | AAATAAAACTATATTCATTTCCA |
| 5374 | AATAAAACTATATTCATTTCCAC |
| 5375 | ATAAAACTATATTCATTTCCACT |
| 5376 | TAAAACTATATTCATTTCCACTC |
| 5377 | AAAACTATATTCATTTCCACTCT |
| 5378 | AAACTATATTCATTTCCACTCTA |
| 5379 | AACTATATTCATTTCCACTCTAA |
| 5380 | ACTATATTCATTTCCACTCTAAA |
| 5381 | CTATATTCATTTCCACTCTAAAA |
| 5382 | TATATTCATTTCCACTCTAAAAA |
| 5383 | ATATTCATTTCCACTCTAAAAAA |
| 5384 | TATTCATTTCCACTCTAAAAAAA |
| 5385 | ATTCATTTCCACTCTAAAAAAAA |

| ID | SEQUENCE |
|---|---|
| 1 | TTTCCAGATTGGGGCTCGGGCCG |
| 2 | TTCCAGATTGGGGCTCGGGCCGC |
| 3 | GCCGCGCCTCCTCCGGGACCCTC |
| 4 | CCGCGCCTCCTCCGGGACCCTCC |
| 5 | CGCGCCTCCTCCGGGACCCTCCC |
| 6 | GCGCCTCCTCCGGGACCCTCCCC |
| 7 | CGCCTCCTCCGGGACCCTCCCCT |
| 8 | GCCTCCTCCGGGACCCTCCCCTT |
| 9 | CCTCCTCCGGGACCCTCCCCTTG |
| 10 | CTCCTCCGGGACCCTCCCCTTGG |
| 11 | TCCTCCGGGACCCTCCCCTTGGA |
| 12 | CCTCCGGGACCCTCCCCTTGGAC |
| 13 | CTCCGGGACCCTCCCCTTGGACC |
| 14 | TCCGGGACCCTCCCCTTGGACCG |
| 15 | CCGGGACCCTCCCCTTGGACCGA |
| 16 | CGGGACCCTCCCCTTGGACCGAG |
| 17 | GGGACCCTCCCCTTGGACCGAGC |
| 18 | GGACCCTCCCCTTGGACCGAGCC |
| 19 | GACCCTCCCCTTGGACCGAGCCG |
| 20 | ACCCTCCCCTTGGACCGAGCCGA |
| 21 | CCCTCCCCTTGGACCGAGCCGAT |
| 22 | CCTCCCCTTGGACCGAGCCGATC |
| 23 | CTCCCCTTGGACCGAGCCGATCG |
| 24 | TCCCCTTGGACCGAGCCGATCGC |
| 25 | CCCCTTGGACCGAGCCGATCGCC |
| 26 | CCCTTGGACCGAGCCGATCGCCG |
| 27 | CCTTGGACCGAGCCGATCGCCGC |
| 28 | CTTGGACCGAGCCGATCGCCGCG |
| 29 | TTGGACCGAGCCGATCGCCGCGG |
| 30 | GGGCCGGCTGTCCTGGCGCGAAA |
| 31 | GGCCGGCTGTCCTGGCGCGAAAA |
| 32 | GCCGGCTGTCCTGGCGCGAAAAG |
| 33 | CCGGCTGTCCTGGCGCGAAAAGG |
| 34 | CGGCTGTCCTGGCGCGAAAAGGT |
| 35 | GGCTGTCCTGGCGCGAAAAGGTG |
| 36 | GCTGTCCTGGCGCGAAAAGGTGG |
| 37 | CTGTCCTGGCGCGAAAAGGTGGA |
| 38 | TGTCCTGGCGCGAAAAGGTGGAC |
| 39 | GTCCTGGCGCGAAAAGGTGGACA |
| 40 | TCCTGGCGCGAAAAGGTGGACAA |
| 41 | CCTGGCGCGAAAAGGTGGACAAG |
| 42 | CTGGCGCGAAAAGGTGGACAAGT |
| 43 | TGGCGCGAAAAGGTGGACAAGTC |
| 44 | GGCGCGAAAAGGTGGACAAGTCC |
| 45 | GCGCGAAAAGGTGGACAAGTCCT |
| 46 | CGCGAAAAGGTGGACAAGTCCTA |
| 47 | GCGAAAAGGTGGACAAGTCCTAT |
| 48 | CGAAAAGGTGGACAAGTCCTATT |

| ID | SEQUENCE |
|---|---|
| 49 | GAAAAGGTGGACAAGTCCTATTT |
| 50 | AAAAGGTGGACAAGTCCTATTTT |
| 51 | AAAGGTGGACAAGTCCTATTTTC |
| 52 | AAGGTGGACAAGTCCTATTTTCA |
| 53 | AGGTGGACAAGTCCTATTTTCAA |
| 54 | GGTGGACAAGTCCTATTTTCAAG |
| 55 | GTGGACAAGTCCTATTTTCAAGA |
| 56 | TGGACAAGTCCTATTTTCAAGAG |
| 57 | GGACAAGTCCTATTTTCAAGAGA |
| 58 | GACAAGTCCTATTTTCAAGAGAA |
| 59 | ATGACTTTTAACAGTTTTGAAGG |
| 60 | TGACTTTTAACAGTTTTGAAGGA |
| 61 | GACTTTTAACAGTTTTGAAGGAT |
| 62 | ACTTTTAACAGTTTTGAAGGATC |
| 63 | CTTTTAACAGTTTTGAAGGATCT |
| 64 | TTTTAACAGTTTTGAAGGATCTA |
| 65 | TTTAACAGTTTTGAAGGATCTAA |
| 66 | TTAACAGTTTTGAAGGATCTAAA |
| 67 | TAACAGTTTTGAAGGATCTAAAA |
| 68 | AACAGTTTTGAAGGATCTAAAAC |
| 69 | ACAGTTTTGAAGGATCTAAAACT |
| 70 | CAGTTTTGAAGGATCTAAAACTT |
| 71 | AGTTTTGAAGGATCTAAAACTTG |
| 72 | GTTTTGAAGGATCTAAAACTTGT |
| 73 | TTTTGAAGGATCTAAAACTTGTG |
| 74 | TTTGAAGGATCTAAAACTTGTGT |
| 75 | TTGAAGGATCTAAAACTTGTGTA |
| 76 | TGAAGGATCTAAAACTTGTGTAC |
| 77 | GAAGGATCTAAAACTTGTGTACC |
| 78 | AAGGATCTAAAACTTGTGTACCT |
| 79 | AGGATCTAAAACTTGTGTACCTG |
| 80 | GGATCTAAAACTTGTGTACCTGC |
| 81 | GATCTAAAACTTGTGTACCTGCA |
| 82 | ATCTAAAACTTGTGTACCTGCAG |
| 83 | TCTAAAACTTGTGTACCTGCAGA |
| 84 | CTAAAACTTGTGTACCTGCAGAC |
| 85 | TAAAACTTGTGTACCTGCAGACA |
| 86 | AAAACTTGTGTACCTGCAGACAT |
| 87 | AAACTTGTGTACCTGCAGACATC |
| 88 | AACTTGTGTACCTGCAGACATCA |
| 89 | ACTTGTGTACCTGCAGACATCAA |
| 90 | CTTGTGTACCTGCAGACATCAAT |
| 91 | TTGTGTACCTGCAGACATCAATA |
| 92 | TGTGTACCTGCAGACATCAATAA |
| 93 | GTGTACCTGCAGACATCAATAAG |
| 94 | TGTACCTGCAGACATCAATAAGG |
| 95 | GTACCTGCAGACATCAATAAGGA |
| 96 | TACCTGCAGACATCAATAAGGAA |

| ID | SEQUENCE |
|---|---|
| 97 | ACCTGCAGACATCAATAAGGAAG |
| 98 | CCTGCAGACATCAATAAGGAAGA |
| 99 | CTGCAGACATCAATAAGGAAGAA |
| 100 | TGCAGACATCAATAAGGAAGAAG |
| 101 | GCAGACATCAATAAGGAAGAAGA |
| 102 | CAGACATCAATAAGGAAGAAGAA |
| 103 | AGACATCAATAAGGAAGAAGAAT |
| 104 | GACATCAATAAGGAAGAAGAATT |
| 105 | ACATCAATAAGGAAGAAGAATTT |
| 106 | CATCAATAAGGAAGAAGAATTTG |
| 107 | ATCAATAAGGAAGAAGAATTTGT |
| 108 | TCAATAAGGAAGAAGAATTTGTA |
| 109 | CAATAAGGAAGAAGAATTTGTAG |
| 110 | AATAAGGAAGAAGAATTTGTAGA |
| 111 | ATAAGGAAGAAGAATTTGTAGAA |
| 112 | TAAGGAAGAAGAATTTGTAGAAG |
| 113 | AAGGAAGAAGAATTTGTAGAAGA |
| 114 | AGGAAGAAGAATTTGTAGAAGAG |
| 115 | GGAAGAAGAATTTGTAGAAGAGT |
| 116 | GAAGAAGAATTTGTAGAAGAGTT |
| 117 | AAGAAGAATTTGTAGAAGAGTTT |
| 118 | AGAAGAATTTGTAGAAGAGTTTA |
| 119 | GAAGAATTTGTAGAAGAGTTTAA |
| 120 | AAGAATTTGTAGAAGAGTTTAAT |
| 121 | AGAATTTGTAGAAGAGTTTAATA |
| 122 | GAATTTGTAGAAGAGTTTAATAG |
| 123 | AATTTGTAGAAGAGTTTAATAGA |
| 124 | ATTTGTAGAAGAGTTTAATAGAT |
| 125 | TTTGTAGAAGAGTTTAATAGATT |
| 126 | TTGTAGAAGAGTTTAATAGATTA |
| 127 | TGTAGAAGAGTTTAATAGATTAA |
| 128 | GTAGAAGAGTTTAATAGATTAAA |
| 129 | TAGAAGAGTTTAATAGATTAAAA |
| 130 | AGAAGAGTTTAATAGATTAAAAA |
| 131 | GAAGAGTTTAATAGATTAAAAAC |
| 132 | AAGAGTTTAATAGATTAAAAACT |
| 133 | AGAGTTTAATAGATTAAAAACTT |
| 134 | GAGTTTAATAGATTAAAAACTTT |
| 135 | AGTTTAATAGATTAAAAACTTTT |
| 136 | GTTTAATAGATTAAAAACTTTTG |
| 137 | TTTAATAGATTAAAAACTTTTGC |
| 138 | TTAATAGATTAAAAACTTTTGCT |
| 139 | TAATAGATTAAAAACTTTTGCTA |
| 140 | AATAGATTAAAAACTTTTGCTAA |
| 141 | ATAGATTAAAAACTTTTGCTAAT |
| 142 | TAGATTAAAAACTTTTGCTAATT |
| 143 | AGATTAAAAACTTTTGCTAATTT |
| 144 | GATTAAAAACTTTTGCTAATTTT |

| ID | SEQUENCE |
|---|---|
| 145 | ATTAAAAACTTTTGCTAATTTTC |
| 146 | TTAAAAACTTTTGCTAATTTTCC |
| 147 | TAAAAACTTTTGCTAATTTTCCA |
| 148 | AAAAACTTTTGCTAATTTTCCAA |
| 149 | AAAACTTTTGCTAATTTTCCAAG |
| 150 | AAACTTTTGCTAATTTTCCAAGT |
| 151 | AACTTTTGCTAATTTTCCAAGTG |
| 152 | ACTTTTGCTAATTTTCCAAGTGG |
| 153 | CTTTTGCTAATTTTCCAAGTGGT |
| 154 | TTTTGCTAATTTTCCAAGTGGTA |
| 155 | TTTGCTAATTTTCCAAGTGGTAG |
| 156 | TTGCTAATTTTCCAAGTGGTAGT |
| 157 | TGCTAATTTTCCAAGTGGTAGTC |
| 158 | GCTAATTTTCCAAGTGGTAGTCC |
| 159 | CTAATTTTCCAAGTGGTAGTCCT |
| 160 | TAATTTTCCAAGTGGTAGTCCTG |
| 161 | AATTTTCCAAGTGGTAGTCCTGT |
| 162 | ATTTTCCAAGTGGTAGTCCTGTT |
| 163 | TTTTCCAAGTGGTAGTCCTGTTT |
| 164 | TTTCCAAGTGGTAGTCCTGTTTC |
| 165 | TTCCAAGTGGTAGTCCTGTTTCA |
| 166 | TCCAAGTGGTAGTCCTGTTTCAG |
| 167 | CCAAGTGGTAGTCCTGTTTCAGC |
| 168 | CAAGTGGTAGTCCTGTTTCAGCA |
| 169 | AAGTGGTAGTCCTGTTTCAGCAT |
| 170 | AGTGGTAGTCCTGTTTCAGCATC |
| 171 | GTGGTAGTCCTGTTTCAGCATCA |
| 172 | TGGTAGTCCTGTTTCAGCATCAA |
| 173 | GGTAGTCCTGTTTCAGCATCAAC |
| 174 | GTAGTCCTGTTTCAGCATCAACA |
| 175 | TAGTCCTGTTTCAGCATCAACAC |
| 176 | AGTCCTGTTTCAGCATCAACACT |
| 177 | GTCCTGTTTCAGCATCAACACTG |
| 178 | TCCTGTTTCAGCATCAACACTGG |
| 179 | CCTGTTTCAGCATCAACACTGGC |
| 180 | CTGTTTCAGCATCAACACTGGCA |
| 181 | TGTTTCAGCATCAACACTGGCAC |
| 182 | GTTTCAGCATCAACACTGGCACG |
| 183 | TTTCAGCATCAACACTGGCACGA |
| 184 | TTCAGCATCAACACTGGCACGAG |
| 185 | TCAGCATCAACACTGGCACGAGC |
| 186 | CAGCATCAACACTGGCACGAGCA |
| 187 | AGCATCAACACTGGCACGAGCAG |
| 188 | GCATCAACACTGGCACGAGCAGG |
| 189 | CATCAACACTGGCACGAGCAGGG |
| 190 | ATCAACACTGGCACGAGCAGGGT |
| 191 | TCAACACTGGCACGAGCAGGGTT |
| 192 | CAACACTGGCACGAGCAGGGTTT |

| ID | SEQUENCE |
|---|---|
| 193 | AACACTGGCACGAGCAGGGTTTC |
| 194 | ACACTGGCACGAGCAGGGTTTCT |
| 195 | CACTGGCACGAGCAGGGTTTCTT |
| 196 | ACTGGCACGAGCAGGGTTTCTTT |
| 197 | CTGGCACGAGCAGGGTTTCTTTA |
| 198 | TGGCACGAGCAGGGTTTCTTTAT |
| 199 | GGCACGAGCAGGGTTTCTTTATA |
| 200 | GCACGAGCAGGGTTTCTTTATAC |
| 201 | CACGAGCAGGGTTTCTTTATACT |
| 202 | ACGAGCAGGGTTTCTTTATACTG |
| 203 | CGAGCAGGGTTTCTTTATACTGG |
| 204 | GAGCAGGGTTTCTTTATACTGGT |
| 205 | AGCAGGGTTTCTTTATACTGGTG |
| 206 | GCAGGGTTTCTTTATACTGGTGA |
| 207 | CAGGGTTTCTTTATACTGGTGAA |
| 208 | AGGGTTTCTTTATACTGGTGAAG |
| 209 | GGGTTTCTTTATACTGGTGAAGG |
| 210 | GGTTTCTTTATACTGGTGAAGGA |
| 211 | GTTTCTTTATACTGGTGAAGGAG |
| 212 | TTTCTTTATACTGGTGAAGGAGA |
| 213 | TTCTTTATACTGGTGAAGGAGAT |
| 214 | TCTTTATACTGGTGAAGGAGATA |
| 215 | CTTTATACTGGTGAAGGAGATAC |
| 216 | TTTATACTGGTGAAGGAGATACC |
| 217 | TTATACTGGTGAAGGAGATACCG |
| 218 | TATACTGGTGAAGGAGATACCGT |
| 219 | ATACTGGTGAAGGAGATACCGTG |
| 220 | TACTGGTGAAGGAGATACCGTGC |
| 221 | ACTGGTGAAGGAGATACCGTGCG |
| 222 | CTGGTGAAGGAGATACCGTGCGG |
| 223 | TGGTGAAGGAGATACCGTGCGGT |
| 224 | GGTGAAGGAGATACCGTGCGGTG |
| 225 | GTGAAGGAGATACCGTGCGGTGC |
| 226 | TGAAGGAGATACCGTGCGGTGCT |
| 227 | GAAGGAGATACCGTGCGGTGCTT |
| 228 | AAGGAGATACCGTGCGGTGCTTT |
| 229 | AGGAGATACCGTGCGGTGCTTTA |
| 230 | GGAGATACCGTGCGGTGCTTTAG |
| 231 | GAGATACCGTGCGGTGCTTTAGT |
| 232 | AGATACCGTGCGGTGCTTTAGTT |
| 233 | GATACCGTGCGGTGCTTTAGTTG |
| 234 | ATACCGTGCGGTGCTTTAGTTGT |
| 235 | TACCGTGCGGTGCTTTAGTTGTC |
| 236 | ACCGTGCGGTGCTTTAGTTGTCA |
| 237 | CCGTGCGGTGCTTTAGTTGTCAT |
| 238 | CGTGCGGTGCTTTAGTTGTCATG |
| 239 | GTGCGGTGCTTTAGTTGTCATGC |
| 240 | TGCGGTGCTTTAGTTGTCATGCA |

| ID | SEQUENCE |
|---|---|
| 241 | GCGGTGCTTTAGTTGTCATGCAG |
| 242 | CGGTGCTTTAGTTGTCATGCAGC |
| 243 | GGTGCTTTAGTTGTCATGCAGCT |
| 244 | GTGCTTTAGTTGTCATGCAGCTG |
| 245 | TGCTTTAGTTGTCATGCAGCTGT |
| 246 | GCTTTAGTTGTCATGCAGCTGTA |
| 247 | CTTTAGTTGTCATGCAGCTGTAG |
| 248 | TTTAGTTGTCATGCAGCTGTAGA |
| 249 | TTAGTTGTCATGCAGCTGTAGAT |
| 250 | TAGTTGTCATGCAGCTGTAGATA |
| 251 | AGTTGTCATGCAGCTGTAGATAG |
| 252 | GTTGTCATGCAGCTGTAGATAGA |
| 253 | TTGTCATGCAGCTGTAGATAGAT |
| 254 | TGTCATGCAGCTGTAGATAGATG |
| 255 | GTCATGCAGCTGTAGATAGATGG |
| 256 | TCATGCAGCTGTAGATAGATGGC |
| 257 | CATGCAGCTGTAGATAGATGGCA |
| 258 | ATGCAGCTGTAGATAGATGGCAA |
| 259 | TGCAGCTGTAGATAGATGGCAAT |
| 260 | GCAGCTGTAGATAGATGGCAATA |
| 261 | CAGCTGTAGATAGATGGCAATAT |
| 262 | AGCTGTAGATAGATGGCAATATG |
| 263 | GCTGTAGATAGATGGCAATATGG |
| 264 | CTGTAGATAGATGGCAATATGGA |
| 265 | TGTAGATAGATGGCAATATGGAG |
| 266 | GTAGATAGATGGCAATATGGAGA |
| 267 | TAGATAGATGGCAATATGGAGAC |
| 268 | AGATAGATGGCAATATGGAGACT |
| 269 | GATAGATGGCAATATGGAGACTC |
| 270 | ATAGATGGCAATATGGAGACTCA |
| 271 | TAGATGGCAATATGGAGACTCAG |
| 272 | AGATGGCAATATGGAGACTCAGC |
| 273 | GATGGCAATATGGAGACTCAGCA |
| 274 | ATGGCAATATGGAGACTCAGCAG |
| 275 | TGGCAATATGGAGACTCAGCAGT |
| 276 | GGCAATATGGAGACTCAGCAGTT |
| 277 | GCAATATGGAGACTCAGCAGTTG |
| 278 | CAATATGGAGACTCAGCAGTTGG |
| 279 | AATATGGAGACTCAGCAGTTGGA |
| 280 | ATATGGAGACTCAGCAGTTGGAA |
| 281 | TATGGAGACTCAGCAGTTGGAAG |
| 282 | ATGGAGACTCAGCAGTTGGAAGA |
| 283 | TGGAGACTCAGCAGTTGGAAGAC |
| 284 | GGAGACTCAGCAGTTGGAAGACA |
| 285 | GAGACTCAGCAGTTGGAAGACAC |
| 286 | AGACTCAGCAGTTGGAAGACACA |
| 287 | GACTCAGCAGTTGGAAGACACAG |
| 288 | ACTCAGCAGTTGGAAGACACAGG |

| ID | SEQUENCE |
|---|---|
| 289 | CTCAGCAGTTGGAAGACACAGGA |
| 290 | TCAGCAGTTGGAAGACACAGGAA |
| 291 | CAGCAGTTGGAAGACACAGGAAA |
| 292 | AGCAGTTGGAAGACACAGGAAAG |
| 293 | GCAGTTGGAAGACACAGGAAAGT |
| 294 | CAGTTGGAAGACACAGGAAAGTA |
| 295 | AGTTGGAAGACACAGGAAAGTAT |
| 296 | GTTGGAAGACACAGGAAAGTATC |
| 297 | TTGGAAGACACAGGAAAGTATCC |
| 298 | TGGAAGACACAGGAAAGTATCCC |
| 299 | GGAAGACACAGGAAAGTATCCCC |
| 300 | GAAGACACAGGAAAGTATCCCCA |
| 301 | AAGACACAGGAAAGTATCCCCAA |
| 302 | AGACACAGGAAAGTATCCCCAAA |
| 303 | GACACAGGAAAGTATCCCCAAAT |
| 304 | ACACAGGAAAGTATCCCCAAATT |
| 305 | CACAGGAAAGTATCCCCAAATTG |
| 306 | ACAGGAAAGTATCCCCAAATTGC |
| 307 | CAGGAAAGTATCCCCAAATTGCA |
| 308 | AGGAAAGTATCCCCAAATTGCAG |
| 309 | GGAAAGTATCCCCAAATTGCAGA |
| 310 | GAAAGTATCCCCAAATTGCAGAT |
| 311 | AAAGTATCCCCAAATTGCAGATT |
| 312 | AAGTATCCCCAAATTGCAGATTT |
| 313 | AGTATCCCCAAATTGCAGATTTA |
| 314 | GTATCCCCAAATTGCAGATTTAT |
| 315 | TATCCCCAAATTGCAGATTTATC |
| 316 | ATCCCCAAATTGCAGATTTATCA |
| 317 | TCCCCAAATTGCAGATTTATCAA |
| 318 | CCCCAAATTGCAGATTTATCAAC |
| 319 | CCCAAATTGCAGATTTATCAACG |
| 320 | CCAAATTGCAGATTTATCAACGG |
| 321 | CAAATTGCAGATTTATCAACGGC |
| 322 | AAATTGCAGATTTATCAACGGCT |
| 323 | AATTGCAGATTTATCAACGGCTT |
| 324 | ATTGCAGATTTATCAACGGCTTT |
| 325 | TTGCAGATTTATCAACGGCTTTT |
| 326 | TGCAGATTTATCAACGGCTTTTA |
| 327 | GCAGATTTATCAACGGCTTTTAT |
| 328 | CAGATTTATCAACGGCTTTTATC |
| 329 | AGATTTATCAACGGCTTTTATCT |
| 330 | GATTTATCAACGGCTTTTATCTT |
| 331 | ATTTATCAACGGCTTTTATCTTG |
| 332 | TTTATCAACGGCTTTTATCTTGA |
| 333 | TTATCAACGGCTTTTATCTTGAA |
| 334 | TATCAACGGCTTTTATCTTGAAA |
| 335 | ATCAACGGCTTTTATCTTGAAAA |
| 336 | TCAACGGCTTTTATCTTGAAAAT |

| ID | SEQUENCE |
|---|---|
| 337 | CAACGGCTTTTATCTTGAAAATA |
| 338 | AACGGCTTTTATCTTGAAAATAG |
| 339 | ACGGCTTTTATCTTGAAAATAGT |
| 340 | CGGCTTTTATCTTGAAAATAGTG |
| 341 | GGCTTTTATCTTGAAAATAGTGC |
| 342 | GCTTTTATCTTGAAAATAGTGCC |
| 343 | CTTTTATCTTGAAAATAGTGCCA |
| 344 | TTTTATCTTGAAAATAGTGCCAC |
| 345 | TTTATCTTGAAAATAGTGCCACG |
| 346 | TTATCTTGAAAATAGTGCCACGC |
| 347 | TATCTTGAAAATAGTGCCACGCA |
| 348 | ATCTTGAAAATAGTGCCACGCAG |
| 349 | TCTTGAAAATAGTGCCACGCAGT |
| 350 | CTTGAAAATAGTGCCACGCAGTC |
| 351 | TTGAAAATAGTGCCACGCAGTCT |
| 352 | TGAAAATAGTGCCACGCAGTCTA |
| 353 | GAAAATAGTGCCACGCAGTCTAC |
| 354 | AAAATAGTGCCACGCAGTCTACA |
| 355 | AAATAGTGCCACGCAGTCTACAA |
| 356 | AATAGTGCCACGCAGTCTACAAA |
| 357 | ATAGTGCCACGCAGTCTACAAAT |
| 358 | TAGTGCCACGCAGTCTACAAATT |
| 359 | AGTGCCACGCAGTCTACAAATTC |
| 360 | GTGCCACGCAGTCTACAAATTCT |
| 361 | TGCCACGCAGTCTACAAATTCTG |
| 362 | GCCACGCAGTCTACAAATTCTGG |
| 363 | CCACGCAGTCTACAAATTCTGGT |
| 364 | CACGCAGTCTACAAATTCTGGTA |
| 365 | ACGCAGTCTACAAATTCTGGTAT |
| 366 | CGCAGTCTACAAATTCTGGTATC |
| 367 | GCAGTCTACAAATTCTGGTATCC |
| 368 | CAGTCTACAAATTCTGGTATCCA |
| 369 | AGTCTACAAATTCTGGTATCCAG |
| 370 | GTCTACAAATTCTGGTATCCAGA |
| 371 | TCTACAAATTCTGGTATCCAGAA |
| 372 | CTACAAATTCTGGTATCCAGAAT |
| 373 | TACAAATTCTGGTATCCAGAATG |
| 374 | ACAAATTCTGGTATCCAGAATGG |
| 375 | CAAATTCTGGTATCCAGAATGGT |
| 376 | AAATTCTGGTATCCAGAATGGTC |
| 377 | AATTCTGGTATCCAGAATGGTCA |
| 378 | ATTCTGGTATCCAGAATGGTCAG |
| 379 | TTCTGGTATCCAGAATGGTCAGT |
| 380 | TCTGGTATCCAGAATGGTCAGTA |
| 381 | CTGGTATCCAGAATGGTCAGTAC |
| 382 | TGGTATCCAGAATGGTCAGTACA |
| 383 | GGTATCCAGAATGGTCAGTACAA |
| 384 | GTATCCAGAATGGTCAGTACAAA |

| ID | SEQUENCE |
|---|---|
| 385 | TATCCAGAATGGTCAGTACAAAG |
| 386 | ATCCAGAATGGTCAGTACAAAGT |
| 387 | TCCAGAATGGTCAGTACAAAGTT |
| 388 | CCAGAATGGTCAGTACAAAGTTG |
| 389 | CAGAATGGTCAGTACAAAGTTGA |
| 390 | AGAATGGTCAGTACAAAGTTGAA |
| 391 | GAATGGTCAGTACAAAGTTGAAA |
| 392 | AATGGTCAGTACAAAGTTGAAAA |
| 393 | ATGGTCAGTACAAAGTTGAAAAC |
| 394 | TGGTCAGTACAAAGTTGAAAACT |
| 395 | GGTCAGTACAAAGTTGAAAACTA |
| 396 | GTCAGTACAAAGTTGAAAACTAT |
| 397 | TCAGTACAAAGTTGAAAACTATC |
| 398 | CAGTACAAAGTTGAAAACTATCT |
| 399 | AGTACAAAGTTGAAAACTATCTG |
| 400 | GTACAAAGTTGAAAACTATCTGG |
| 401 | TACAAAGTTGAAAACTATCTGGG |
| 402 | ACAAAGTTGAAAACTATCTGGGA |
| 403 | CAAAGTTGAAAACTATCTGGGAA |
| 404 | AAAGTTGAAAACTATCTGGGAAG |
| 405 | AAGTTGAAAACTATCTGGGAAGC |
| 406 | AGTTGAAAACTATCTGGGAAGCA |
| 407 | GTTGAAAACTATCTGGGAAGCAG |
| 408 | TTGAAAACTATCTGGGAAGCAGA |
| 409 | TGAAAACTATCTGGGAAGCAGAG |
| 410 | GAAAACTATCTGGGAAGCAGAGA |
| 411 | AAAACTATCTGGGAAGCAGAGAT |
| 412 | AAACTATCTGGGAAGCAGAGATC |
| 413 | AACTATCTGGGAAGCAGAGATCA |
| 414 | ACTATCTGGGAAGCAGAGATCAT |
| 415 | CTATCTGGGAAGCAGAGATCATT |
| 416 | TATCTGGGAAGCAGAGATCATTT |
| 417 | ATCTGGGAAGCAGAGATCATTTT |
| 418 | TCTGGGAAGCAGAGATCATTTTG |
| 419 | CTGGGAAGCAGAGATCATTTTGC |
| 420 | TGGGAAGCAGAGATCATTTTGCC |
| 421 | GGGAAGCAGAGATCATTTTGCCT |
| 422 | GGAAGCAGAGATCATTTTGCCTT |
| 423 | GAAGCAGAGATCATTTTGCCTTA |
| 424 | AAGCAGAGATCATTTTGCCTTAG |
| 425 | AGCAGAGATCATTTTGCCTTAGA |
| 426 | GCAGAGATCATTTTGCCTTAGAC |
| 427 | CAGAGATCATTTTGCCTTAGACA |
| 428 | AGAGATCATTTTGCCTTAGACAG |
| 429 | GAGATCATTTTGCCTTAGACAGG |
| 430 | AGATCATTTTGCCTTAGACAGGC |
| 431 | GATCATTTTGCCTTAGACAGGCC |
| 432 | ATCATTTTGCCTTAGACAGGCCA |

| ID | SEQUENCE |
|---|---|
| 433 | TCATTTTGCCTTAGACAGGCCAT |
| 434 | CATTTTGCCTTAGACAGGCCATC |
| 435 | ATTTTGCCTTAGACAGGCCATCT |
| 436 | TTTTGCCTTAGACAGGCCATCTG |
| 437 | TTTGCCTTAGACAGGCCATCTGA |
| 438 | TTGCCTTAGACAGGCCATCTGAG |
| 439 | TGCCTTAGACAGGCCATCTGAGA |
| 440 | GCCTTAGACAGGCCATCTGAGAC |
| 441 | CCTTAGACAGGCCATCTGAGACA |
| 442 | CTTAGACAGGCCATCTGAGACAC |
| 443 | TTAGACAGGCCATCTGAGACACA |
| 444 | TAGACAGGCCATCTGAGACACAT |
| 445 | AGACAGGCCATCTGAGACACATG |
| 446 | GACAGGCCATCTGAGACACATGC |
| 447 | ACAGGCCATCTGAGACACATGCA |
| 448 | CAGGCCATCTGAGACACATGCAG |
| 449 | AGGCCATCTGAGACACATGCAGA |
| 450 | GGCCATCTGAGACACATGCAGAC |
| 451 | GCCATCTGAGACACATGCAGACT |
| 452 | CCATCTGAGACACATGCAGACTA |
| 453 | CATCTGAGACACATGCAGACTAT |
| 454 | ATCTGAGACACATGCAGACTATC |
| 455 | TCTGAGACACATGCAGACTATCT |
| 456 | CTGAGACACATGCAGACTATCTT |
| 457 | TGAGACACATGCAGACTATCTTT |
| 458 | GAGACACATGCAGACTATCTTTT |
| 459 | AGACACATGCAGACTATCTTTTG |
| 460 | GACACATGCAGACTATCTTTTGA |
| 461 | ACACATGCAGACTATCTTTTGAG |
| 462 | CACATGCAGACTATCTTTTGAGA |
| 463 | ACATGCAGACTATCTTTTGAGAA |
| 464 | CATGCAGACTATCTTTTGAGAAC |
| 465 | ATGCAGACTATCTTTTGAGAACT |
| 466 | TGCAGACTATCTTTTGAGAACTG |
| 467 | GCAGACTATCTTTTGAGAACTGG |
| 468 | CAGACTATCTTTTGAGAACTGGG |
| 469 | AGACTATCTTTTGAGAACTGGGC |
| 470 | GACTATCTTTTGAGAACTGGGCA |
| 471 | ACTATCTTTTGAGAACTGGGCAG |
| 472 | CTATCTTTTGAGAACTGGGCAGG |
| 473 | TATCTTTTGAGAACTGGGCAGGT |
| 474 | ATCTTTTGAGAACTGGGCAGGTT |
| 475 | TCTTTTGAGAACTGGGCAGGTTG |
| 476 | CTTTTGAGAACTGGGCAGGTTGT |
| 477 | TTTTGAGAACTGGGCAGGTTGTA |
| 478 | TTTGAGAACTGGGCAGGTTGTAG |
| 479 | TTGAGAACTGGGCAGGTTGTAGA |
| 480 | TGAGAACTGGGCAGGTTGTAGAT |

| ID | SEQUENCE |
|---|---|
| 481 | GAGAACTGGGCAGGTTGTAGATA |
| 482 | AGAACTGGGCAGGTTGTAGATAT |
| 483 | GAACTGGGCAGGTTGTAGATATA |
| 484 | AACTGGGCAGGTTGTAGATATAT |
| 485 | ACTGGGCAGGTTGTAGATATATC |
| 486 | CTGGGCAGGTTGTAGATATATCA |
| 487 | TGGGCAGGTTGTAGATATATCAG |
| 488 | GGGCAGGTTGTAGATATATCAGA |
| 489 | GGCAGGTTGTAGATATATCAGAC |
| 490 | GCAGGTTGTAGATATATCAGACA |
| 491 | CAGGTTGTAGATATATCAGACAC |
| 492 | AGGTTGTAGATATATCAGACACC |
| 493 | GGTTGTAGATATATCAGACACCA |
| 494 | GTTGTAGATATATCAGACACCAT |
| 495 | TTGTAGATATATCAGACACCATA |
| 496 | TGTAGATATATCAGACACCATAT |
| 497 | GTAGATATATCAGACACCATATA |
| 498 | TAGATATATCAGACACCATATAC |
| 499 | AGATATATCAGACACCATATACC |
| 500 | GATATATCAGACACCATATACCC |
| 501 | ATATATCAGACACCATATACCCG |
| 502 | TATATCAGACACCATATACCCGA |
| 503 | ATATCAGACACCATATACCCGAG |
| 504 | TATCAGACACCATATACCCGAGG |
| 505 | ATCAGACACCATATACCCGAGGA |
| 506 | TCAGACACCATATACCCGAGGAA |
| 507 | CAGACACCATATACCCGAGGAAC |
| 508 | AGACACCATATACCCGAGGAACC |
| 509 | GACACCATATACCCGAGGAACCC |
| 510 | ACACCATATACCCGAGGAACCCT |
| 511 | CACCATATACCCGAGGAACCCTG |
| 512 | ACCATATACCCGAGGAACCCTGC |
| 513 | CCATATACCCGAGGAACCCTGCC |
| 514 | CATATACCCGAGGAACCCTGCCA |
| 515 | ATATACCCGAGGAACCCTGCCAT |
| 516 | TATACCCGAGGAACCCTGCCATG |
| 517 | ATACCCGAGGAACCCTGCCATGT |
| 518 | TACCCGAGGAACCCTGCCATGTA |
| 519 | ACCCGAGGAACCCTGCCATGTAT |
| 520 | CCCGAGGAACCCTGCCATGTATA |
| 521 | CCGAGGAACCCTGCCATGTATAG |
| 522 | CGAGGAACCCTGCCATGTATAGT |
| 523 | GAGGAACCCTGCCATGTATAGTG |
| 524 | AGGAACCCTGCCATGTATAGTGA |
| 525 | GGAACCCTGCCATGTATAGTGAA |
| 526 | GAACCCTGCCATGTATAGTGAAG |
| 527 | AACCCTGCCATGTATAGTGAAGA |
| 528 | ACCCTGCCATGTATAGTGAAGAA |

| ID | SEQUENCE |
|---|---|
| 529 | CCCTGCCATGTATAGTGAAGAAG |
| 530 | CCTGCCATGTATAGTGAAGAAGC |
| 531 | CTGCCATGTATAGTGAAGAAGCT |
| 532 | TGCCATGTATAGTGAAGAAGCTA |
| 533 | GCCATGTATAGTGAAGAAGCTAG |
| 534 | CCATGTATAGTGAAGAAGCTAGA |
| 535 | CATGTATAGTGAAGAAGCTAGAT |
| 536 | ATGTATAGTGAAGAAGCTAGATT |
| 537 | TGTATAGTGAAGAAGCTAGATTA |
| 538 | GTATAGTGAAGAAGCTAGATTAA |
| 539 | TATAGTGAAGAAGCTAGATTAAA |
| 540 | ATAGTGAAGAAGCTAGATTAAAG |
| 541 | TAGTGAAGAAGCTAGATTAAAGT |
| 542 | AGTGAAGAAGCTAGATTAAAGTC |
| 543 | GTGAAGAAGCTAGATTAAAGTCC |
| 544 | TGAAGAAGCTAGATTAAAGTCCT |
| 545 | GAAGAAGCTAGATTAAAGTCCTT |
| 546 | AAGAAGCTAGATTAAAGTCCTTT |
| 547 | AGAAGCTAGATTAAAGTCCTTTC |
| 548 | GAAGCTAGATTAAAGTCCTTTCA |
| 549 | AAGCTAGATTAAAGTCCTTTCAG |
| 550 | AGCTAGATTAAAGTCCTTTCAGA |
| 551 | GCTAGATTAAAGTCCTTTCAGAA |
| 552 | CTAGATTAAAGTCCTTTCAGAAC |
| 553 | TAGATTAAAGTCCTTTCAGAACT |
| 554 | AGATTAAAGTCCTTTCAGAACTG |
| 555 | GATTAAAGTCCTTTCAGAACTGG |
| 556 | ATTAAAGTCCTTTCAGAACTGGC |
| 557 | TTAAAGTCCTTTCAGAACTGGCC |
| 558 | TAAAGTCCTTTCAGAACTGGCCA |
| 559 | AAAGTCCTTTCAGAACTGGCCAG |
| 560 | AAGTCCTTTCAGAACTGGCCAGA |
| 561 | AGTCCTTTCAGAACTGGCCAGAC |
| 562 | GTCCTTTCAGAACTGGCCAGACT |
| 563 | TCCTTTCAGAACTGGCCAGACTA |
| 564 | CCTTTCAGAACTGGCCAGACTAT |
| 565 | CTTTCAGAACTGGCCAGACTATG |
| 566 | TTTCAGAACTGGCCAGACTATGC |
| 567 | TTCAGAACTGGCCAGACTATGCT |
| 568 | TCAGAACTGGCCAGACTATGCTC |
| 569 | CAGAACTGGCCAGACTATGCTCA |
| 570 | AGAACTGGCCAGACTATGCTCAC |
| 571 | GAACTGGCCAGACTATGCTCACC |
| 572 | AACTGGCCAGACTATGCTCACCT |
| 573 | ACTGGCCAGACTATGCTCACCTA |
| 574 | CTGGCCAGACTATGCTCACCTAA |
| 575 | TGGCCAGACTATGCTCACCTAAC |
| 576 | GGCCAGACTATGCTCACCTAACC |

| ID | SEQUENCE |
|---|---|
| 577 | GCCAGACTATGCTCACCTAACCC |
| 578 | CCAGACTATGCTCACCTAACCCC |
| 579 | CAGACTATGCTCACCTAACCCCA |
| 580 | AGACTATGCTCACCTAACCCCAA |
| 581 | GACTATGCTCACCTAACCCCAAG |
| 582 | ACTATGCTCACCTAACCCCAAGA |
| 583 | CTATGCTCACCTAACCCCAAGAG |
| 584 | TATGCTCACCTAACCCCAAGAGA |
| 585 | ATGCTCACCTAACCCCAAGAGAG |
| 586 | TGCTCACCTAACCCCAAGAGAGT |
| 587 | GCTCACCTAACCCCAAGAGAGTT |
| 588 | CTCACCTAACCCCAAGAGAGTTA |
| 589 | TCACCTAACCCCAAGAGAGTTAG |
| 590 | CACCTAACCCCAAGAGAGTTAGC |
| 591 | ACCTAACCCCAAGAGAGTTAGCA |
| 592 | CCTAACCCCAAGAGAGTTAGCAA |
| 593 | CTAACCCCAAGAGAGTTAGCAAG |
| 594 | TAACCCCAAGAGAGTTAGCAAGT |
| 595 | AACCCCAAGAGAGTTAGCAAGTG |
| 596 | ACCCCAAGAGAGTTAGCAAGTGC |
| 597 | CCCCAAGAGAGTTAGCAAGTGCT |
| 598 | CCCAAGAGAGTTAGCAAGTGCTG |
| 599 | CCAAGAGAGTTAGCAAGTGCTGG |
| 600 | CAAGAGAGTTAGCAAGTGCTGGA |
| 601 | AAGAGAGTTAGCAAGTGCTGGAC |
| 602 | AGAGAGTTAGCAAGTGCTGGACT |
| 603 | GAGAGTTAGCAAGTGCTGGACTC |
| 604 | AGAGTTAGCAAGTGCTGGACTCT |
| 605 | GAGTTAGCAAGTGCTGGACTCTA |
| 606 | AGTTAGCAAGTGCTGGACTCTAC |
| 607 | GTTAGCAAGTGCTGGACTCTACT |
| 608 | TTAGCAAGTGCTGGACTCTACTA |
| 609 | TAGCAAGTGCTGGACTCTACTAC |
| 610 | AGCAAGTGCTGGACTCTACTACA |
| 611 | GCAAGTGCTGGACTCTACTACAC |
| 612 | CAAGTGCTGGACTCTACTACACA |
| 613 | AAGTGCTGGACTCTACTACACAG |
| 614 | AGTGCTGGACTCTACTACACAGG |
| 615 | GTGCTGGACTCTACTACACAGGT |
| 616 | TGCTGGACTCTACTACACAGGTA |
| 617 | GCTGGACTCTACTACACAGGTAT |
| 618 | CTGGACTCTACTACACAGGTATT |
| 619 | TGGACTCTACTACACAGGTATTG |
| 620 | GGACTCTACTACACAGGTATTGG |
| 621 | GACTCTACTACACAGGTATTGGT |
| 622 | ACTCTACTACACAGGTATTGGTG |
| 623 | CTCTACTACACAGGTATTGGTGA |
| 624 | TCTACTACACAGGTATTGGTGAC |

| ID | SEQUENCE |
|---|---|
| 625 | CTACTACACAGGTATTGGTGACC |
| 626 | TACTACACAGGTATTGGTGACCA |
| 627 | ACTACACAGGTATTGGTGACCAA |
| 628 | CTACACAGGTATTGGTGACCAAG |
| 629 | TACACAGGTATTGGTGACCAAGT |
| 630 | ACACAGGTATTGGTGACCAAGTG |
| 631 | CACAGGTATTGGTGACCAAGTGC |
| 632 | ACAGGTATTGGTGACCAAGTGCA |
| 633 | CAGGTATTGGTGACCAAGTGCAG |
| 634 | AGGTATTGGTGACCAAGTGCAGT |
| 635 | GGTATTGGTGACCAAGTGCAGTG |
| 636 | GTATTGGTGACCAAGTGCAGTGC |
| 637 | TATTGGTGACCAAGTGCAGTGCT |
| 638 | ATTGGTGACCAAGTGCAGTGCTT |
| 639 | TTGGTGACCAAGTGCAGTGCTTT |
| 640 | TGGTGACCAAGTGCAGTGCTTTT |
| 641 | GGTGACCAAGTGCAGTGCTTTTG |
| 642 | GTGACCAAGTGCAGTGCTTTTGT |
| 643 | TGACCAAGTGCAGTGCTTTTGTT |
| 644 | GACCAAGTGCAGTGCTTTTGTTG |
| 645 | ACCAAGTGCAGTGCTTTTGTTGT |
| 646 | CCAAGTGCAGTGCTTTTGTTGTG |
| 647 | CAAGTGCAGTGCTTTTGTTGTGG |
| 648 | AAGTGCAGTGCTTTTGTTGTGGT |
| 649 | AGTGCAGTGCTTTTGTTGTGGTG |
| 650 | GTGCAGTGCTTTTGTTGTGGTGG |
| 651 | TGCAGTGCTTTTGTTGTGGTGGA |
| 652 | GCAGTGCTTTTGTTGTGGTGGAA |
| 653 | CAGTGCTTTTGTTGTGGTGGAAA |
| 654 | AGTGCTTTTGTTGTGGTGGAAAA |
| 655 | GTGCTTTTGTTGTGGTGGAAAAC |
| 656 | TGCTTTTGTTGTGGTGGAAAACT |
| 657 | GCTTTTGTTGTGGTGGAAAACTG |
| 658 | CTTTTGTTGTGGTGGAAAACTGA |
| 659 | TTTTGTTGTGGTGGAAAACTGAA |
| 660 | TTTGTTGTGGTGGAAAACTGAAA |
| 661 | TTGTTGTGGTGGAAAACTGAAAA |
| 662 | TGTTGTGGTGGAAAACTGAAAAA |
| 663 | GTTGTGGTGGAAAACTGAAAAAT |
| 664 | TTGTGGTGGAAAACTGAAAAATT |
| 665 | TGTGGTGGAAAACTGAAAAATTG |
| 666 | GTGGTGGAAAACTGAAAAATTGG |
| 667 | TGGTGGAAAACTGAAAAATTGGG |
| 668 | GGTGGAAAACTGAAAAATTGGGA |
| 669 | GTGGAAAACTGAAAAATTGGGAA |
| 670 | TGGAAAACTGAAAAATTGGGAAC |
| 671 | GGAAAACTGAAAAATTGGGAACC |
| 672 | GAAAACTGAAAAATTGGGAACCT |

| ID | SEQUENCE |
|---|---|
| 673 | AAAACTGAAAAATTGGGAACCTT |
| 674 | AAACTGAAAAATTGGGAACCTTG |
| 675 | AACTGAAAAATTGGGAACCTTGT |
| 676 | ACTGAAAAATTGGGAACCTTGTG |
| 677 | CTGAAAAATTGGGAACCTTGTGA |
| 678 | TGAAAAATTGGGAACCTTGTGAT |
| 679 | GAAAAATTGGGAACCTTGTGATC |
| 680 | AAAAATTGGGAACCTTGTGATCG |
| 681 | AAAATTGGGAACCTTGTGATCGT |
| 682 | AAATTGGGAACCTTGTGATCGTG |
| 683 | AATTGGGAACCTTGTGATCGTGC |
| 684 | ATTGGGAACCTTGTGATCGTGCC |
| 685 | TTGGGAACCTTGTGATCGTGCCT |
| 686 | TGGGAACCTTGTGATCGTGCCTG |
| 687 | GGGAACCTTGTGATCGTGCCTGG |
| 688 | GGAACCTTGTGATCGTGCCTGGT |
| 689 | GAACCTTGTGATCGTGCCTGGTC |
| 690 | AACCTTGTGATCGTGCCTGGTCA |
| 691 | ACCTTGTGATCGTGCCTGGTCAG |
| 692 | CCTTGTGATCGTGCCTGGTCAGA |
| 693 | CTTGTGATCGTGCCTGGTCAGAA |
| 694 | TTGTGATCGTGCCTGGTCAGAAC |
| 695 | TGTGATCGTGCCTGGTCAGAACA |
| 696 | GTGATCGTGCCTGGTCAGAACAC |
| 697 | TGATCGTGCCTGGTCAGAACACA |
| 698 | GATCGTGCCTGGTCAGAACACAG |
| 699 | ATCGTGCCTGGTCAGAACACAGG |
| 700 | TCGTGCCTGGTCAGAACACAGGC |
| 701 | CGTGCCTGGTCAGAACACAGGCG |
| 702 | GTGCCTGGTCAGAACACAGGCGA |
| 703 | TGCCTGGTCAGAACACAGGCGAC |
| 704 | GCCTGGTCAGAACACAGGCGACA |
| 705 | CCTGGTCAGAACACAGGCGACAC |
| 706 | CTGGTCAGAACACAGGCGACACT |
| 707 | TGGTCAGAACACAGGCGACACTT |
| 708 | GGTCAGAACACAGGCGACACTTT |
| 709 | GTCAGAACACAGGCGACACTTTC |
| 710 | TCAGAACACAGGCGACACTTTCC |
| 711 | CAGAACACAGGCGACACTTTCCT |
| 712 | AGAACACAGGCGACACTTTCCTA |
| 713 | GAACACAGGCGACACTTTCCTAA |
| 714 | AACACAGGCGACACTTTCCTAAT |
| 715 | ACACAGGCGACACTTTCCTAATT |
| 716 | CACAGGCGACACTTTCCTAATTG |
| 717 | ACAGGCGACACTTTCCTAATTGC |
| 718 | CAGGCGACACTTTCCTAATTGCT |
| 719 | AGGCGACACTTTCCTAATTGCTT |
| 720 | GGCGACACTTTCCTAATTGCTTC |

| ID | SEQUENCE |
|---|---|
| 721 | GCGACACTTTCCTAATTGCTTCT |
| 722 | CGACACTTTCCTAATTGCTTCTT |
| 723 | GACACTTTCCTAATTGCTTCTTT |
| 724 | ACACTTTCCTAATTGCTTCTTTG |
| 725 | CACTTTCCTAATTGCTTCTTTGT |
| 726 | ACTTTCCTAATTGCTTCTTTGTT |
| 727 | CTTTCCTAATTGCTTCTTTGTTT |
| 728 | TTTCCTAATTGCTTCTTTGTTTT |
| 729 | TTCCTAATTGCTTCTTTGTTTTG |
| 730 | TCCTAATTGCTTCTTTGTTTTGG |
| 731 | CCTAATTGCTTCTTTGTTTTGGG |
| 732 | CTAATTGCTTCTTTGTTTTGGGC |
| 733 | TAATTGCTTCTTTGTTTTGGGCC |
| 734 | AATTGCTTCTTTGTTTTGGGCCG |
| 735 | ATTGCTTCTTTGTTTTGGGCCGG |
| 736 | TTGCTTCTTTGTTTTGGGCCGGA |
| 737 | TGCTTCTTTGTTTTGGGCCGGAA |
| 738 | GCTTCTTTGTTTTGGGCCGGAAT |
| 739 | CTTCTTTGTTTTGGGCCGGAATC |
| 740 | TTCTTTGTTTTGGGCCGGAATCT |
| 741 | TCTTTGTTTTGGGCCGGAATCTT |
| 742 | CTTTGTTTTGGGCCGGAATCTTA |
| 743 | TTTGTTTTGGGCCGGAATCTTAA |
| 744 | TTGTTTTGGGCCGGAATCTTAAT |
| 745 | TGTTTTGGGCCGGAATCTTAATA |
| 746 | GTTTTGGGCCGGAATCTTAATAT |
| 747 | TTTTGGGCCGGAATCTTAATATT |
| 748 | TTTGGGCCGGAATCTTAATATTC |
| 749 | TTGGGCCGGAATCTTAATATTCG |
| 750 | TGGGCCGGAATCTTAATATTCGA |
| 751 | GGGCCGGAATCTTAATATTCGAA |
| 752 | GGCCGGAATCTTAATATTCGAAG |
| 753 | GCCGGAATCTTAATATTCGAAGT |
| 754 | CCGGAATCTTAATATTCGAAGTG |
| 755 | CGGAATCTTAATATTCGAAGTGA |
| 756 | GGAATCTTAATATTCGAAGTGAA |
| 757 | GAATCTTAATATTCGAAGTGAAT |
| 758 | AATCTTAATATTCGAAGTGAATC |
| 759 | ATCTTAATATTCGAAGTGAATCT |
| 760 | TCTTAATATTCGAAGTGAATCTG |
| 761 | CTTAATATTCGAAGTGAATCTGA |
| 762 | TTAATATTCGAAGTGAATCTGAT |
| 763 | TAATATTCGAAGTGAATCTGATG |
| 764 | AATATTCGAAGTGAATCTGATGC |
| 765 | ATATTCGAAGTGAATCTGATGCT |
| 766 | TATTCGAAGTGAATCTGATGCTG |
| 767 | ATTCGAAGTGAATCTGATGCTGT |
| 768 | TTCGAAGTGAATCTGATGCTGTG |

| ID | SEQUENCE |
|---|---|
| 769 | TCGAAGTGAATCTGATGCTGTGA |
| 770 | CGAAGTGAATCTGATGCTGTGAG |
| 771 | GAAGTGAATCTGATGCTGTGAGT |
| 772 | AAGTGAATCTGATGCTGTGAGTT |
| 773 | AGTGAATCTGATGCTGTGAGTTC |
| 774 | GTGAATCTGATGCTGTGAGTTCT |
| 775 | TGAATCTGATGCTGTGAGTTCTG |
| 776 | GAATCTGATGCTGTGAGTTCTGA |
| 777 | AATCTGATGCTGTGAGTTCTGAT |
| 778 | ATCTGATGCTGTGAGTTCTGATA |
| 779 | TCTGATGCTGTGAGTTCTGATAG |
| 780 | CTGATGCTGTGAGTTCTGATAGG |
| 781 | TGATGCTGTGAGTTCTGATAGGA |
| 782 | GATGCTGTGAGTTCTGATAGGAA |
| 783 | ATGCTGTGAGTTCTGATAGGAAT |
| 784 | TGCTGTGAGTTCTGATAGGAATT |
| 785 | GCTGTGAGTTCTGATAGGAATTT |
| 786 | CTGTGAGTTCTGATAGGAATTTC |
| 787 | TGTGAGTTCTGATAGGAATTTCC |
| 788 | GTGAGTTCTGATAGGAATTTCCC |
| 789 | TGAGTTCTGATAGGAATTTCCCA |
| 790 | GAGTTCTGATAGGAATTTCCCAA |
| 791 | AGTTCTGATAGGAATTTCCCAAA |
| 792 | GTTCTGATAGGAATTTCCCAAAT |
| 793 | TTCTGATAGGAATTTCCCAAATT |
| 794 | TCTGATAGGAATTTCCCAAATTC |
| 795 | CTGATAGGAATTTCCCAAATTCA |
| 796 | TGATAGGAATTTCCCAAATTCAA |
| 797 | GATAGGAATTTCCCAAATTCAAC |
| 798 | ATAGGAATTTCCCAAATTCAACA |
| 799 | TAGGAATTTCCCAAATTCAACAA |
| 800 | AGGAATTTCCCAAATTCAACAAA |
| 801 | GGAATTTCCCAAATTCAACAAAT |
| 802 | GAATTTCCCAAATTCAACAAATC |
| 803 | AATTTCCCAAATTCAACAAATCT |
| 804 | ATTTCCCAAATTCAACAAATCTT |
| 805 | TTTCCCAAATTCAACAAATCTTC |
| 806 | TTCCCAAATTCAACAAATCTTCC |
| 807 | TCCCAAATTCAACAAATCTTCCA |
| 808 | CCCAAATTCAACAAATCTTCCAA |
| 809 | CCAAATTCAACAAATCTTCCAAG |
| 810 | CAAATTCAACAAATCTTCCAAGA |
| 811 | AAATTCAACAAATCTTCCAAGAA |
| 812 | AATTCAACAAATCTTCCAAGAAA |
| 813 | ATTCAACAAATCTTCCAAGAAAT |
| 814 | TTCAACAAATCTTCCAAGAAATC |
| 815 | TCAACAAATCTTCCAAGAAATCC |
| 816 | CAACAAATCTTCCAAGAAATCCA |

| ID | SEQUENCE |
|---|---|
| 817 | AACAAATCTTCCAAGAAATCCAT |
| 818 | ACAAATCTTCCAAGAAATCCATC |
| 819 | CAAATCTTCCAAGAAATCCATCC |
| 820 | AAATCTTCCAAGAAATCCATCCA |
| 821 | AATCTTCCAAGAAATCCATCCAT |
| 822 | ATCTTCCAAGAAATCCATCCATG |
| 823 | TCTTCCAAGAAATCCATCCATGG |
| 824 | CTTCCAAGAAATCCATCCATGGC |
| 825 | TTCCAAGAAATCCATCCATGGCA |
| 826 | TCCAAGAAATCCATCCATGGCAG |
| 827 | CCAAGAAATCCATCCATGGCAGA |
| 828 | CAAGAAATCCATCCATGGCAGAT |
| 829 | AAGAAATCCATCCATGGCAGATT |
| 830 | AGAAATCCATCCATGGCAGATTA |
| 831 | GAAATCCATCCATGGCAGATTAT |
| 832 | AAATCCATCCATGGCAGATTATG |
| 833 | AATCCATCCATGGCAGATTATGA |
| 834 | ATCCATCCATGGCAGATTATGAA |
| 835 | TCCATCCATGGCAGATTATGAAG |
| 836 | CCATCCATGGCAGATTATGAAGC |
| 837 | CATCCATGGCAGATTATGAAGCA |
| 838 | ATCCATGGCAGATTATGAAGCAC |
| 839 | TCCATGGCAGATTATGAAGCACG |
| 840 | CCATGGCAGATTATGAAGCACGG |
| 841 | CATGGCAGATTATGAAGCACGGA |
| 842 | ATGGCAGATTATGAAGCACGGAT |
| 843 | TGGCAGATTATGAAGCACGGATC |
| 844 | GGCAGATTATGAAGCACGGATCT |
| 845 | GCAGATTATGAAGCACGGATCTT |
| 846 | CAGATTATGAAGCACGGATCTTT |
| 847 | AGATTATGAAGCACGGATCTTTA |
| 848 | GATTATGAAGCACGGATCTTTAC |
| 849 | ATTATGAAGCACGGATCTTTACT |
| 850 | TTATGAAGCACGGATCTTTACTT |
| 851 | TATGAAGCACGGATCTTTACTTT |
| 852 | ATGAAGCACGGATCTTTACTTTT |
| 853 | TGAAGCACGGATCTTTACTTTTG |
| 854 | GAAGCACGGATCTTTACTTTTGG |
| 855 | AAGCACGGATCTTTACTTTTGGG |
| 856 | AGCACGGATCTTTACTTTTGGGA |
| 857 | GCACGGATCTTTACTTTTGGGAC |
| 858 | CACGGATCTTTACTTTTGGGACA |
| 859 | ACGGATCTTTACTTTTGGGACAT |
| 860 | CGGATCTTTACTTTTGGGACATG |
| 861 | GGATCTTTACTTTTGGGACATGG |
| 862 | GATCTTTACTTTTGGGACATGGA |
| 863 | ATCTTTACTTTTGGGACATGGAT |
| 864 | TCTTTACTTTTGGGACATGGATA |

| ID | SEQUENCE |
|---|---|
| 865 | CTTTACTTTTGGGACATGGATAT |
| 866 | TTTACTTTTGGGACATGGATATA |
| 867 | TTACTTTTGGGACATGGATATAC |
| 868 | TACTTTTGGGACATGGATATACT |
| 869 | ACTTTTGGGACATGGATATACTC |
| 870 | CTTTTGGGACATGGATATACTCA |
| 871 | TTTTGGGACATGGATATACTCAG |
| 872 | TTTGGGACATGGATATACTCAGT |
| 873 | TTGGGACATGGATATACTCAGTT |
| 874 | TGGGACATGGATATACTCAGTTA |
| 875 | GGGACATGGATATACTCAGTTAA |
| 876 | GGACATGGATATACTCAGTTAAC |
| 877 | GACATGGATATACTCAGTTAACA |
| 878 | ACATGGATATACTCAGTTAACAA |
| 879 | CATGGATATACTCAGTTAACAAG |
| 880 | ATGGATATACTCAGTTAACAAGG |
| 881 | TGGATATACTCAGTTAACAAGGA |
| 882 | GGATATACTCAGTTAACAAGGAG |
| 883 | GATATACTCAGTTAACAAGGAGC |
| 884 | ATATACTCAGTTAACAAGGAGCA |
| 885 | TATACTCAGTTAACAAGGAGCAG |
| 886 | ATACTCAGTTAACAAGGAGCAGC |
| 887 | TACTCAGTTAACAAGGAGCAGCT |
| 888 | ACTCAGTTAACAAGGAGCAGCTT |
| 889 | CTCAGTTAACAAGGAGCAGCTTG |
| 890 | TCAGTTAACAAGGAGCAGCTTGC |
| 891 | CAGTTAACAAGGAGCAGCTTGCA |
| 892 | AGTTAACAAGGAGCAGCTTGCAA |
| 893 | GTTAACAAGGAGCAGCTTGCAAG |
| 894 | TTAACAAGGAGCAGCTTGCAAGA |
| 895 | TAACAAGGAGCAGCTTGCAAGAG |
| 896 | AACAAGGAGCAGCTTGCAAGAGC |
| 897 | ACAAGGAGCAGCTTGCAAGAGCT |
| 898 | CAAGGAGCAGCTTGCAAGAGCTG |
| 899 | AAGGAGCAGCTTGCAAGAGCTGG |
| 900 | AGGAGCAGCTTGCAAGAGCTGGA |
| 901 | GGAGCAGCTTGCAAGAGCTGGAT |
| 902 | GAGCAGCTTGCAAGAGCTGGATT |
| 903 | AGCAGCTTGCAAGAGCTGGATTT |
| 904 | GCAGCTTGCAAGAGCTGGATTTT |
| 905 | CAGCTTGCAAGAGCTGGATTTTA |
| 906 | AGCTTGCAAGAGCTGGATTTTAT |
| 907 | GCTTGCAAGAGCTGGATTTTATG |
| 908 | CTTGCAAGAGCTGGATTTTATGC |
| 909 | TTGCAAGAGCTGGATTTTATGCT |
| 910 | TGCAAGAGCTGGATTTTATGCTT |
| 911 | GCAAGAGCTGGATTTTATGCTTT |
| 912 | CAAGAGCTGGATTTTATGCTTTA |

| ID | SEQUENCE |
|---|---|
| 913 | AAGAGCTGGATTTTATGCTTTAG |
| 914 | AGAGCTGGATTTTATGCTTTAGG |
| 915 | GAGCTGGATTTTATGCTTTAGGT |
| 916 | AGCTGGATTTTATGCTTTAGGTG |
| 917 | GCTGGATTTTATGCTTTAGGTGA |
| 918 | CTGGATTTTATGCTTTAGGTGAA |
| 919 | TGGATTTTATGCTTTAGGTGAAG |
| 920 | GGATTTTATGCTTTAGGTGAAGG |
| 921 | GATTTTATGCTTTAGGTGAAGGT |
| 922 | ATTTTATGCTTTAGGTGAAGGTG |
| 923 | TTTTATGCTTTAGGTGAAGGTGA |
| 924 | TTTATGCTTTAGGTGAAGGTGAT |
| 925 | TTATGCTTTAGGTGAAGGTGATA |
| 926 | TATGCTTTAGGTGAAGGTGATAA |
| 927 | ATGCTTTAGGTGAAGGTGATAAA |
| 928 | TGCTTTAGGTGAAGGTGATAAAG |
| 929 | GCTTTAGGTGAAGGTGATAAAGT |
| 930 | CTTTAGGTGAAGGTGATAAAGTA |
| 931 | TTTAGGTGAAGGTGATAAAGTAA |
| 932 | TTAGGTGAAGGTGATAAAGTAAA |
| 933 | TAGGTGAAGGTGATAAAGTAAAG |
| 934 | AGGTGAAGGTGATAAAGTAAAGT |
| 935 | GGTGAAGGTGATAAAGTAAAGTG |
| 936 | GTGAAGGTGATAAAGTAAAGTGC |
| 937 | TGAAGGTGATAAAGTAAAGTGCT |
| 938 | GAAGGTGATAAAGTAAAGTGCTT |
| 939 | AAGGTGATAAAGTAAAGTGCTTT |
| 940 | AGGTGATAAAGTAAAGTGCTTTC |
| 941 | GGTGATAAAGTAAAGTGCTTTCA |
| 942 | GTGATAAAGTAAAGTGCTTTCAC |
| 943 | TGATAAAGTAAAGTGCTTTCACT |
| 944 | GATAAAGTAAAGTGCTTTCACTG |
| 945 | ATAAAGTAAAGTGCTTTCACTGT |
| 946 | TAAAGTAAAGTGCTTTCACTGTG |
| 947 | AAAGTAAAGTGCTTTCACTGTGG |
| 948 | AAGTAAAGTGCTTTCACTGTGGA |
| 949 | AGTAAAGTGCTTTCACTGTGGAG |
| 950 | GTAAAGTGCTTTCACTGTGGAGG |
| 951 | TAAAGTGCTTTCACTGTGGAGGA |
| 952 | AAAGTGCTTTCACTGTGGAGGAG |
| 953 | AAGTGCTTTCACTGTGGAGGAGG |
| 954 | AGTGCTTTCACTGTGGAGGAGGG |
| 955 | GTGCTTTCACTGTGGAGGAGGGC |
| 956 | TGCTTTCACTGTGGAGGAGGGCT |
| 957 | GCTTTCACTGTGGAGGAGGGCTA |
| 958 | CTTTCACTGTGGAGGAGGGCTAA |
| 959 | TTTCACTGTGGAGGAGGGCTAAC |
| 960 | TTCACTGTGGAGGAGGGCTAACT |

| ID | SEQUENCE |
|---|---|
| 961 | TCACTGTGGAGGAGGGCTAACTG |
| 962 | CACTGTGGAGGAGGGCTAACTGA |
| 963 | ACTGTGGAGGAGGGCTAACTGAT |
| 964 | CTGTGGAGGAGGGCTAACTGATT |
| 965 | TGTGGAGGAGGGCTAACTGATTG |
| 966 | GTGGAGGAGGGCTAACTGATTGG |
| 967 | TGGAGGAGGGCTAACTGATTGGA |
| 968 | GGAGGAGGGCTAACTGATTGGAA |
| 969 | GAGGAGGGCTAACTGATTGGAAG |
| 970 | AGGAGGGCTAACTGATTGGAAGC |
| 971 | GGAGGGCTAACTGATTGGAAGCC |
| 972 | GAGGGCTAACTGATTGGAAGCCC |
| 973 | AGGGCTAACTGATTGGAAGCCCA |
| 974 | GGGCTAACTGATTGGAAGCCCAG |
| 975 | GGCTAACTGATTGGAAGCCCAGT |
| 976 | GCTAACTGATTGGAAGCCCAGTG |
| 977 | CTAACTGATTGGAAGCCCAGTGA |
| 978 | TAACTGATTGGAAGCCCAGTGAA |
| 979 | AACTGATTGGAAGCCCAGTGAAG |
| 980 | ACTGATTGGAAGCCCAGTGAAGA |
| 981 | CTGATTGGAAGCCCAGTGAAGAC |
| 982 | TGATTGGAAGCCCAGTGAAGACC |
| 983 | GATTGGAAGCCCAGTGAAGACCC |
| 984 | ATTGGAAGCCCAGTGAAGACCCT |
| 985 | TTGGAAGCCCAGTGAAGACCCTT |
| 986 | TGGAAGCCCAGTGAAGACCCTTG |
| 987 | GGAAGCCCAGTGAAGACCCTTGG |
| 988 | GAAGCCCAGTGAAGACCCTTGGG |
| 989 | AAGCCCAGTGAAGACCCTTGGGA |
| 990 | AGCCCAGTGAAGACCCTTGGGAA |
| 991 | GCCCAGTGAAGACCCTTGGGAAC |
| 992 | CCCAGTGAAGACCCTTGGGAACA |
| 993 | CCAGTGAAGACCCTTGGGAACAA |
| 994 | CAGTGAAGACCCTTGGGAACAAC |
| 995 | AGTGAAGACCCTTGGGAACAACA |
| 996 | GTGAAGACCCTTGGGAACAACAT |
| 997 | TGAAGACCCTTGGGAACAACATG |
| 998 | GAAGACCCTTGGGAACAACATGC |
| 999 | AAGACCCTTGGGAACAACATGCT |
| 1000 | AGACCCTTGGGAACAACATGCTA |
| 1001 | GACCCTTGGGAACAACATGCTAA |
| 1002 | ACCCTTGGGAACAACATGCTAAA |
| 1003 | CCCTTGGGAACAACATGCTAAAT |
| 1004 | CCTTGGGAACAACATGCTAAATG |
| 1005 | CTTGGGAACAACATGCTAAATGG |
| 1006 | TTGGGAACAACATGCTAAATGGT |
| 1007 | TGGGAACAACATGCTAAATGGTA |
| 1008 | GGGAACAACATGCTAAATGGTAT |

| ID | SEQUENCE |
|---|---|
| 1009 | GGAACAACATGCTAAATGGTATC |
| 1010 | GAACAACATGCTAAATGGTATCC |
| 1011 | AACAACATGCTAAATGGTATCCA |
| 1012 | ACAACATGCTAAATGGTATCCAG |
| 1013 | CAACATGCTAAATGGTATCCAGG |
| 1014 | AACATGCTAAATGGTATCCAGGG |
| 1015 | ACATGCTAAATGGTATCCAGGGT |
| 1016 | CATGCTAAATGGTATCCAGGGTG |
| 1017 | ATGCTAAATGGTATCCAGGGTGC |
| 1018 | TGCTAAATGGTATCCAGGGTGCA |
| 1019 | GCTAAATGGTATCCAGGGTGCAA |
| 1020 | CTAAATGGTATCCAGGGTGCAAA |
| 1021 | TAAATGGTATCCAGGGTGCAAAT |
| 1022 | AAATGGTATCCAGGGTGCAAATA |
| 1023 | AATGGTATCCAGGGTGCAAATAT |
| 1024 | ATGGTATCCAGGGTGCAAATATC |
| 1025 | TGGTATCCAGGGTGCAAATATCT |
| 1026 | GGTATCCAGGGTGCAAATATCTG |
| 1027 | GTATCCAGGGTGCAAATATCTGT |
| 1028 | TATCCAGGGTGCAAATATCTGTT |
| 1029 | ATCCAGGGTGCAAATATCTGTTA |
| 1030 | TCCAGGGTGCAAATATCTGTTAG |
| 1031 | CCAGGGTGCAAATATCTGTTAGA |
| 1032 | CAGGGTGCAAATATCTGTTAGAA |
| 1033 | AGGGTGCAAATATCTGTTAGAAC |
| 1034 | GGGTGCAAATATCTGTTAGAACA |
| 1035 | GGTGCAAATATCTGTTAGAACAG |
| 1036 | GTGCAAATATCTGTTAGAACAGA |
| 1037 | TGCAAATATCTGTTAGAACAGAA |
| 1038 | GCAAATATCTGTTAGAACAGAAG |
| 1039 | CAAATATCTGTTAGAACAGAAGG |
| 1040 | AAATATCTGTTAGAACAGAAGGG |
| 1041 | AATATCTGTTAGAACAGAAGGGA |
| 1042 | ATATCTGTTAGAACAGAAGGGAC |
| 1043 | TATCTGTTAGAACAGAAGGGACA |
| 1044 | ATCTGTTAGAACAGAAGGGACAA |
| 1045 | TCTGTTAGAACAGAAGGGACAAG |
| 1046 | CTGTTAGAACAGAAGGGACAAGA |
| 1047 | TGTTAGAACAGAAGGGACAAGAA |
| 1048 | GTTAGAACAGAAGGGACAAGAAT |
| 1049 | TTAGAACAGAAGGGACAAGAATA |
| 1050 | TAGAACAGAAGGGACAAGAATAT |
| 1051 | AGAACAGAAGGGACAAGAATATA |
| 1052 | GAACAGAAGGGACAAGAATATAT |
| 1053 | AACAGAAGGGACAAGAATATATA |
| 1054 | ACAGAAGGGACAAGAATATATAA |
| 1055 | CAGAAGGGACAAGAATATATAAA |
| 1056 | AGAAGGGACAAGAATATATAAAC |

| ID | SEQUENCE |
|---|---|
| 1057 | GAAGGGACAAGAATATATAAACA |
| 1058 | AAGGGACAAGAATATATAAACAA |
| 1059 | AGGGACAAGAATATATAAACAAT |
| 1060 | GGGACAAGAATATATAAACAATA |
| 1061 | GGACAAGAATATATAAACAATAT |
| 1062 | GACAAGAATATATAAACAATATT |
| 1063 | ACAAGAATATATAAACAATATTC |
| 1064 | CAAGAATATATAAACAATATTCA |
| 1065 | AAGAATATATAAACAATATTCAT |
| 1066 | AGAATATATAAACAATATTCATT |
| 1067 | GAATATATAAACAATATTCATTT |
| 1068 | AATATATAAACAATATTCATTTA |
| 1069 | ATATATAAACAATATTCATTTAA |
| 1070 | TATATAAACAATATTCATTTAAC |
| 1071 | ATATAAACAATATTCATTTAACT |
| 1072 | TATAAACAATATTCATTTAACTC |
| 1073 | ATAAACAATATTCATTTAACTCA |
| 1074 | TAAACAATATTCATTTAACTCAT |
| 1075 | AAACAATATTCATTTAACTCATT |
| 1076 | AACAATATTCATTTAACTCATTC |
| 1077 | ACAATATTCATTTAACTCATTCA |
| 1078 | CAATATTCATTTAACTCATTCAC |
| 1079 | AATATTCATTTAACTCATTCACT |
| 1080 | ATATTCATTTAACTCATTCACTT |
| 1081 | TATTCATTTAACTCATTCACTTG |
| 1082 | ATTCATTTAACTCATTCACTTGA |
| 1083 | TTCATTTAACTCATTCACTTGAG |
| 1084 | TCATTTAACTCATTCACTTGAGG |
| 1085 | CATTTAACTCATTCACTTGAGGA |
| 1086 | ATTTAACTCATTCACTTGAGGAG |
| 1087 | TTTAACTCATTCACTTGAGGAGT |
| 1088 | TTAACTCATTCACTTGAGGAGTG |
| 1089 | TAACTCATTCACTTGAGGAGTGT |
| 1090 | AACTCATTCACTTGAGGAGTGTC |
| 1091 | ACTCATTCACTTGAGGAGTGTCT |
| 1092 | CTCATTCACTTGAGGAGTGTCTG |
| 1093 | TCATTCACTTGAGGAGTGTCTGG |
| 1094 | CATTCACTTGAGGAGTGTCTGGT |
| 1095 | ATTCACTTGAGGAGTGTCTGGTA |
| 1096 | TTCACTTGAGGAGTGTCTGGTAA |
| 1097 | TCACTTGAGGAGTGTCTGGTAAG |
| 1098 | CACTTGAGGAGTGTCTGGTAAGA |
| 1099 | ACTTGAGGAGTGTCTGGTAAGAA |
| 1100 | CTTGAGGAGTGTCTGGTAAGAAC |
| 1101 | TTGAGGAGTGTCTGGTAAGAACT |
| 1102 | TGAGGAGTGTCTGGTAAGAACTA |
| 1103 | GAGGAGTGTCTGGTAAGAACTAC |
| 1104 | AGGAGTGTCTGGTAAGAACTACT |

| ID | SEQUENCE |
|---|---|
| 1105 | GGAGTGTCTGGTAAGAACTACTG |
| 1106 | GAGTGTCTGGTAAGAACTACTGA |
| 1107 | AGTGTCTGGTAAGAACTACTGAG |
| 1108 | GTGTCTGGTAAGAACTACTGAGA |
| 1109 | TGTCTGGTAAGAACTACTGAGAA |
| 1110 | GTCTGGTAAGAACTACTGAGAAA |
| 1111 | TCTGGTAAGAACTACTGAGAAAA |
| 1112 | CTGGTAAGAACTACTGAGAAAAC |
| 1113 | TGGTAAGAACTACTGAGAAAACA |
| 1114 | GGTAAGAACTACTGAGAAAACAC |
| 1115 | GTAAGAACTACTGAGAAAACACC |
| 1116 | TAAGAACTACTGAGAAAACACCA |
| 1117 | AAGAACTACTGAGAAAACACCAT |
| 1118 | AGAACTACTGAGAAAACACCATC |
| 1119 | GAACTACTGAGAAAACACCATCA |
| 1120 | AACTACTGAGAAAACACCATCAC |
| 1121 | ACTACTGAGAAAACACCATCACT |
| 1122 | CTACTGAGAAAACACCATCACTA |
| 1123 | TACTGAGAAAACACCATCACTAA |
| 1124 | ACTGAGAAAACACCATCACTAAC |
| 1125 | CTGAGAAAACACCATCACTAACT |
| 1126 | TGAGAAAACACCATCACTAACTA |
| 1127 | GAGAAAACACCATCACTAACTAG |
| 1128 | AGAAAACACCATCACTAACTAGA |
| 1129 | GAAAACACCATCACTAACTAGAA |
| 1130 | AAAACACCATCACTAACTAGAAG |
| 1131 | AAACACCATCACTAACTAGAAGA |
| 1132 | AACACCATCACTAACTAGAAGAA |
| 1133 | ACACCATCACTAACTAGAAGAAT |
| 1134 | CACCATCACTAACTAGAAGAATT |
| 1135 | ACCATCACTAACTAGAAGAATTG |
| 1136 | CCATCACTAACTAGAAGAATTGA |
| 1137 | CATCACTAACTAGAAGAATTGAT |
| 1138 | ATCACTAACTAGAAGAATTGATG |
| 1139 | TCACTAACTAGAAGAATTGATGA |
| 1140 | CACTAACTAGAAGAATTGATGAT |
| 1141 | ACTAACTAGAAGAATTGATGATA |
| 1142 | CTAACTAGAAGAATTGATGATAC |
| 1143 | TAACTAGAAGAATTGATGATACC |
| 1144 | AACTAGAAGAATTGATGATACCA |
| 1145 | ACTAGAAGAATTGATGATACCAT |
| 1146 | CTAGAAGAATTGATGATACCATC |
| 1147 | TAGAAGAATTGATGATACCATCT |
| 1148 | AGAAGAATTGATGATACCATCTT |
| 1149 | GAAGAATTGATGATACCATCTTC |
| 1150 | AAGAATTGATGATACCATCTTCC |
| 1151 | AGAATTGATGATACCATCTTCCA |
| 1152 | GAATTGATGATACCATCTTCCAA |

| ID | SEQUENCE |
|---|---|
| 1153 | AATTGATGATACCATCTTCCAAA |
| 1154 | ATTGATGATACCATCTTCCAAAA |
| 1155 | TTGATGATACCATCTTCCAAAAT |
| 1156 | TGATGATACCATCTTCCAAAATC |
| 1157 | GATGATACCATCTTCCAAAATCC |
| 1158 | ATGATACCATCTTCCAAAATCCT |
| 1159 | TGATACCATCTTCCAAAATCCTA |
| 1160 | GATACCATCTTCCAAAATCCTAT |
| 1161 | ATACCATCTTCCAAAATCCTATG |
| 1162 | TACCATCTTCCAAAATCCTATGG |
| 1163 | ACCATCTTCCAAAATCCTATGGT |
| 1164 | CCATCTTCCAAAATCCTATGGTA |
| 1165 | CATCTTCCAAAATCCTATGGTAC |
| 1166 | ATCTTCCAAAATCCTATGGTACA |
| 1167 | TCTTCCAAAATCCTATGGTACAA |
| 1168 | CTTCCAAAATCCTATGGTACAAG |
| 1169 | TTCCAAAATCCTATGGTACAAGA |
| 1170 | TCCAAAATCCTATGGTACAAGAA |
| 1171 | CCAAAATCCTATGGTACAAGAAG |
| 1172 | CAAAATCCTATGGTACAAGAAGC |
| 1173 | AAAATCCTATGGTACAAGAAGCT |
| 1174 | AAATCCTATGGTACAAGAAGCTA |
| 1175 | AATCCTATGGTACAAGAAGCTAT |
| 1176 | ATCCTATGGTACAAGAAGCTATA |
| 1177 | TCCTATGGTACAAGAAGCTATAC |
| 1178 | CCTATGGTACAAGAAGCTATACG |
| 1179 | CTATGGTACAAGAAGCTATACGA |
| 1180 | TATGGTACAAGAAGCTATACGAA |
| 1181 | ATGGTACAAGAAGCTATACGAAT |
| 1182 | TGGTACAAGAAGCTATACGAATG |
| 1183 | GGTACAAGAAGCTATACGAATGG |
| 1184 | GTACAAGAAGCTATACGAATGGG |
| 1185 | TACAAGAAGCTATACGAATGGGG |
| 1186 | ACAAGAAGCTATACGAATGGGGT |
| 1187 | CAAGAAGCTATACGAATGGGGTT |
| 1188 | AAGAAGCTATACGAATGGGGTTC |
| 1189 | AGAAGCTATACGAATGGGGTTCA |
| 1190 | GAAGCTATACGAATGGGGTTCAG |
| 1191 | AAGCTATACGAATGGGGTTCAGT |
| 1192 | AGCTATACGAATGGGGTTCAGTT |
| 1193 | GCTATACGAATGGGGTTCAGTTT |
| 1194 | CTATACGAATGGGGTTCAGTTTC |
| 1195 | TATACGAATGGGGTTCAGTTTCA |
| 1196 | ATACGAATGGGGTTCAGTTTCAA |
| 1197 | TACGAATGGGGTTCAGTTTCAAG |
| 1198 | ACGAATGGGGTTCAGTTTCAAGG |
| 1199 | CGAATGGGGTTCAGTTTCAAGGA |
| 1200 | GAATGGGGTTCAGTTTCAAGGAC |

| ID | SEQUENCE |
|---|---|
| 1201 | AATGGGGTTCAGTTTCAAGGACA |
| 1202 | ATGGGGTTCAGTTTCAAGGACAT |
| 1203 | TGGGGTTCAGTTTCAAGGACATT |
| 1204 | GGGGTTCAGTTTCAAGGACATTA |
| 1205 | GGGTTCAGTTTCAAGGACATTAA |
| 1206 | GGTTCAGTTTCAAGGACATTAAG |
| 1207 | GTTCAGTTTCAAGGACATTAAGA |
| 1208 | TTCAGTTTCAAGGACATTAAGAA |
| 1209 | TCAGTTTCAAGGACATTAAGAAA |
| 1210 | CAGTTTCAAGGACATTAAGAAAA |
| 1211 | AGTTTCAAGGACATTAAGAAAAT |
| 1212 | GTTTCAAGGACATTAAGAAAATA |
| 1213 | TTTCAAGGACATTAAGAAAATAA |
| 1214 | TTCAAGGACATTAAGAAAATAAT |
| 1215 | TCAAGGACATTAAGAAAATAATG |
| 1216 | CAAGGACATTAAGAAAATAATGG |
| 1217 | AAGGACATTAAGAAAATAATGGA |
| 1218 | AGGACATTAAGAAAATAATGGAG |
| 1219 | GGACATTAAGAAAATAATGGAGG |
| 1220 | GACATTAAGAAAATAATGGAGGA |
| 1221 | ACATTAAGAAAATAATGGAGGAA |
| 1222 | CATTAAGAAAATAATGGAGGAAA |
| 1223 | ATTAAGAAAATAATGGAGGAAAA |
| 1224 | TTAAGAAAATAATGGAGGAAAAA |
| 1225 | TAAGAAAATAATGGAGGAAAAAA |
| 1226 | AAGAAAATAATGGAGGAAAAAAT |
| 1227 | AGAAAATAATGGAGGAAAAAATT |
| 1228 | GAAAATAATGGAGGAAAAAATTC |
| 1229 | AAAATAATGGAGGAAAAAATTCA |
| 1230 | AAATAATGGAGGAAAAAATTCAG |
| 1231 | AATAATGGAGGAAAAAATTCAGA |
| 1232 | ATAATGGAGGAAAAAATTCAGAT |
| 1233 | TAATGGAGGAAAAAATTCAGATA |
| 1234 | AATGGAGGAAAAAATTCAGATAT |
| 1235 | ATGGAGGAAAAAATTCAGATATC |
| 1236 | TGGAGGAAAAAATTCAGATATCT |
| 1237 | GGAGGAAAAAATTCAGATATCTG |
| 1238 | GAGGAAAAAATTCAGATATCTGG |
| 1239 | AGGAAAAAATTCAGATATCTGGG |
| 1240 | GGAAAAAATTCAGATATCTGGGA |
| 1241 | GAAAAAATTCAGATATCTGGGAG |
| 1242 | AAAAAATTCAGATATCTGGGAGC |
| 1243 | AAAAATTCAGATATCTGGGAGCA |
| 1244 | AAAATTCAGATATCTGGGAGCAA |
| 1245 | AAATTCAGATATCTGGGAGCAAC |
| 1246 | AATTCAGATATCTGGGAGCAACT |
| 1247 | ATTCAGATATCTGGGAGCAACTA |
| 1248 | TTCAGATATCTGGGAGCAACTAT |

| ID | SEQUENCE |
|---|---|
| 1249 | TCAGATATCTGGGAGCAACTATA |
| 1250 | CAGATATCTGGGAGCAACTATAA |
| 1251 | AGATATCTGGGAGCAACTATAAA |
| 1252 | GATATCTGGGAGCAACTATAAAT |
| 1253 | ATATCTGGGAGCAACTATAAATC |
| 1254 | TATCTGGGAGCAACTATAAATCA |
| 1255 | ATCTGGGAGCAACTATAAATCAC |
| 1256 | TCTGGGAGCAACTATAAATCACT |
| 1257 | CTGGGAGCAACTATAAATCACTT |
| 1258 | TGGGAGCAACTATAAATCACTTG |
| 1259 | GGGAGCAACTATAAATCACTTGA |
| 1260 | GGAGCAACTATAAATCACTTGAG |
| 1261 | GAGCAACTATAAATCACTTGAGG |
| 1262 | AGCAACTATAAATCACTTGAGGT |
| 1263 | GCAACTATAAATCACTTGAGGTT |
| 1264 | CAACTATAAATCACTTGAGGTTC |
| 1265 | AACTATAAATCACTTGAGGTTCT |
| 1266 | ACTATAAATCACTTGAGGTTCTG |
| 1267 | CTATAAATCACTTGAGGTTCTGG |
| 1268 | TATAAATCACTTGAGGTTCTGGT |
| 1269 | ATAAATCACTTGAGGTTCTGGTT |
| 1270 | TAAATCACTTGAGGTTCTGGTTG |
| 1271 | AAATCACTTGAGGTTCTGGTTGC |
| 1272 | AATCACTTGAGGTTCTGGTTGCA |
| 1273 | ATCACTTGAGGTTCTGGTTGCAG |
| 1274 | TCACTTGAGGTTCTGGTTGCAGA |
| 1275 | CACTTGAGGTTCTGGTTGCAGAT |
| 1276 | ACTTGAGGTTCTGGTTGCAGATC |
| 1277 | CTTGAGGTTCTGGTTGCAGATCT |
| 1278 | TTGAGGTTCTGGTTGCAGATCTA |
| 1279 | TGAGGTTCTGGTTGCAGATCTAG |
| 1280 | GAGGTTCTGGTTGCAGATCTAGT |
| 1281 | AGGTTCTGGTTGCAGATCTAGTG |
| 1282 | GGTTCTGGTTGCAGATCTAGTGA |
| 1283 | GTTCTGGTTGCAGATCTAGTGAA |
| 1284 | TTCTGGTTGCAGATCTAGTGAAT |
| 1285 | TCTGGTTGCAGATCTAGTGAATG |
| 1286 | CTGGTTGCAGATCTAGTGAATGC |
| 1287 | TGGTTGCAGATCTAGTGAATGCT |
| 1288 | GGTTGCAGATCTAGTGAATGCTC |
| 1289 | GTTGCAGATCTAGTGAATGCTCA |
| 1290 | TTGCAGATCTAGTGAATGCTCAG |
| 1291 | TGCAGATCTAGTGAATGCTCAGA |
| 1292 | GCAGATCTAGTGAATGCTCAGAA |
| 1293 | CAGATCTAGTGAATGCTCAGAAA |
| 1294 | AGATCTAGTGAATGCTCAGAAAG |
| 1295 | GATCTAGTGAATGCTCAGAAAGA |
| 1296 | ATCTAGTGAATGCTCAGAAAGAC |

| ID | SEQUENCE |
|---|---|
| 1297 | TCTAGTGAATGCTCAGAAAGACA |
| 1298 | CTAGTGAATGCTCAGAAAGACAG |
| 1299 | TAGTGAATGCTCAGAAAGACAGT |
| 1300 | AGTGAATGCTCAGAAAGACAGTA |
| 1301 | GTGAATGCTCAGAAAGACAGTAT |
| 1302 | TGAATGCTCAGAAAGACAGTATG |
| 1303 | GAATGCTCAGAAAGACAGTATGC |
| 1304 | AATGCTCAGAAAGACAGTATGCA |
| 1305 | ATGCTCAGAAAGACAGTATGCAA |
| 1306 | TGCTCAGAAAGACAGTATGCAAG |
| 1307 | GCTCAGAAAGACAGTATGCAAGA |
| 1308 | CTCAGAAAGACAGTATGCAAGAT |
| 1309 | TCAGAAAGACAGTATGCAAGATG |
| 1310 | CAGAAAGACAGTATGCAAGATGA |
| 1311 | AGAAAGACAGTATGCAAGATGAG |
| 1312 | GAAAGACAGTATGCAAGATGAGT |
| 1313 | AAAGACAGTATGCAAGATGAGTC |
| 1314 | AAGACAGTATGCAAGATGAGTCA |
| 1315 | AGACAGTATGCAAGATGAGTCAA |
| 1316 | GACAGTATGCAAGATGAGTCAAG |
| 1317 | ACAGTATGCAAGATGAGTCAAGT |
| 1318 | CAGTATGCAAGATGAGTCAAGTC |
| 1319 | AGTATGCAAGATGAGTCAAGTCA |
| 1320 | GTATGCAAGATGAGTCAAGTCAG |
| 1321 | TATGCAAGATGAGTCAAGTCAGA |
| 1322 | ATGCAAGATGAGTCAAGTCAGAC |
| 1323 | TGCAAGATGAGTCAAGTCAGACT |
| 1324 | GCAAGATGAGTCAAGTCAGACTT |
| 1325 | CAAGATGAGTCAAGTCAGACTTC |
| 1326 | AAGATGAGTCAAGTCAGACTTCA |
| 1327 | AGATGAGTCAAGTCAGACTTCAT |
| 1328 | GATGAGTCAAGTCAGACTTCATT |
| 1329 | ATGAGTCAAGTCAGACTTCATTA |
| 1330 | TGAGTCAAGTCAGACTTCATTAC |
| 1331 | GAGTCAAGTCAGACTTCATTACA |
| 1332 | AGTCAAGTCAGACTTCATTACAG |
| 1333 | GTCAAGTCAGACTTCATTACAGA |
| 1334 | TCAAGTCAGACTTCATTACAGAA |
| 1335 | CAAGTCAGACTTCATTACAGAAA |
| 1336 | AAGTCAGACTTCATTACAGAAAG |
| 1337 | AGTCAGACTTCATTACAGAAAGA |
| 1338 | GTCAGACTTCATTACAGAAAGAG |
| 1339 | TCAGACTTCATTACAGAAAGAGA |
| 1340 | CAGACTTCATTACAGAAAGAGAT |
| 1341 | AGACTTCATTACAGAAAGAGATT |
| 1342 | GACTTCATTACAGAAAGAGATTA |
| 1343 | ACTTCATTACAGAAAGAGATTAG |
| 1344 | CTTCATTACAGAAAGAGATTAGT |

| ID | SEQUENCE |
|---|---|
| 1345 | TTCATTACAGAAAGAGATTAGTA |
| 1346 | TCATTACAGAAAGAGATTAGTAC |
| 1347 | CATTACAGAAAGAGATTAGTACT |
| 1348 | ATTACAGAAAGAGATTAGTACTG |
| 1349 | TTACAGAAAGAGATTAGTACTGA |
| 1350 | TACAGAAAGAGATTAGTACTGAA |
| 1351 | ACAGAAAGAGATTAGTACTGAAG |
| 1352 | CAGAAAGAGATTAGTACTGAAGA |
| 1353 | AGAAAGAGATTAGTACTGAAGAG |
| 1354 | GAAAGAGATTAGTACTGAAGAGC |
| 1355 | AAAGAGATTAGTACTGAAGAGCA |
| 1356 | AAGAGATTAGTACTGAAGAGCAG |
| 1357 | AGAGATTAGTACTGAAGAGCAGC |
| 1358 | GAGATTAGTACTGAAGAGCAGCT |
| 1359 | AGATTAGTACTGAAGAGCAGCTA |
| 1360 | GATTAGTACTGAAGAGCAGCTAA |
| 1361 | ATTAGTACTGAAGAGCAGCTAAG |
| 1362 | TTAGTACTGAAGAGCAGCTAAGG |
| 1363 | TAGTACTGAAGAGCAGCTAAGGC |
| 1364 | AGTACTGAAGAGCAGCTAAGGCG |
| 1365 | GTACTGAAGAGCAGCTAAGGCGC |
| 1366 | TACTGAAGAGCAGCTAAGGCGCC |
| 1367 | ACTGAAGAGCAGCTAAGGCGCCT |
| 1368 | CTGAAGAGCAGCTAAGGCGCCTG |
| 1369 | TGAAGAGCAGCTAAGGCGCCTGC |
| 1370 | GAAGAGCAGCTAAGGCGCCTGCA |
| 1371 | AAGAGCAGCTAAGGCGCCTGCAA |
| 1372 | AGAGCAGCTAAGGCGCCTGCAAG |
| 1373 | GAGCAGCTAAGGCGCCTGCAAGA |
| 1374 | AGCAGCTAAGGCGCCTGCAAGAG |
| 1375 | GCAGCTAAGGCGCCTGCAAGAGG |
| 1376 | CAGCTAAGGCGCCTGCAAGAGGA |
| 1377 | AGCTAAGGCGCCTGCAAGAGGAG |
| 1378 | GCTAAGGCGCCTGCAAGAGGAGA |
| 1379 | CTAAGGCGCCTGCAAGAGGAGAA |
| 1380 | TAAGGCGCCTGCAAGAGGAGAAG |
| 1381 | AAGGCGCCTGCAAGAGGAGAAGC |
| 1382 | AGGCGCCTGCAAGAGGAGAAGCT |
| 1383 | GGCGCCTGCAAGAGGAGAAGCTT |
| 1384 | GCGCCTGCAAGAGGAGAAGCTTT |
| 1385 | CGCCTGCAAGAGGAGAAGCTTTG |
| 1386 | GCCTGCAAGAGGAGAAGCTTTGC |
| 1387 | CCTGCAAGAGGAGAAGCTTTGCA |
| 1388 | CTGCAAGAGGAGAAGCTTTGCAA |
| 1389 | TGCAAGAGGAGAAGCTTTGCAAA |
| 1390 | GCAAGAGGAGAAGCTTTGCAAAA |
| 1391 | CAAGAGGAGAAGCTTTGCAAAAT |
| 1392 | AAGAGGAGAAGCTTTGCAAAATC |

| ID | SEQUENCE |
|---|---|
| 1393 | AGAGGAGAAGCTTTGCAAAATCT |
| 1394 | GAGGAGAAGCTTTGCAAAATCTG |
| 1395 | AGGAGAAGCTTTGCAAAATCTGT |
| 1396 | GGAGAAGCTTTGCAAAATCTGTA |
| 1397 | GAGAAGCTTTGCAAAATCTGTAT |
| 1398 | AGAAGCTTTGCAAAATCTGTATG |
| 1399 | GAAGCTTTGCAAAATCTGTATGG |
| 1400 | AAGCTTTGCAAAATCTGTATGGA |
| 1401 | AGCTTTGCAAAATCTGTATGGAT |
| 1402 | GCTTTGCAAAATCTGTATGGATA |
| 1403 | CTTTGCAAAATCTGTATGGATAG |
| 1404 | TTTGCAAAATCTGTATGGATAGA |
| 1405 | TTGCAAAATCTGTATGGATAGAA |
| 1406 | TGCAAAATCTGTATGGATAGAAA |
| 1407 | GCAAAATCTGTATGGATAGAAAT |
| 1408 | CAAAATCTGTATGGATAGAAATA |
| 1409 | AAAATCTGTATGGATAGAAATAT |
| 1410 | AAATCTGTATGGATAGAAATATT |
| 1411 | AATCTGTATGGATAGAAATATTG |
| 1412 | ATCTGTATGGATAGAAATATTGC |
| 1413 | TCTGTATGGATAGAAATATTGCT |
| 1414 | CTGTATGGATAGAAATATTGCTA |
| 1415 | TGTATGGATAGAAATATTGCTAT |
| 1416 | GTATGGATAGAAATATTGCTATC |
| 1417 | TATGGATAGAAATATTGCTATCG |
| 1418 | ATGGATAGAAATATTGCTATCGT |
| 1419 | TGGATAGAAATATTGCTATCGTT |
| 1420 | GGATAGAAATATTGCTATCGTTT |
| 1421 | GATAGAAATATTGCTATCGTTTT |
| 1422 | ATAGAAATATTGCTATCGTTTTT |
| 1423 | TAGAAATATTGCTATCGTTTTTG |
| 1424 | AGAAATATTGCTATCGTTTTTGT |
| 1425 | GAAATATTGCTATCGTTTTTGTT |
| 1426 | AAATATTGCTATCGTTTTTGTTC |
| 1427 | AATATTGCTATCGTTTTTGTTCC |
| 1428 | ATATTGCTATCGTTTTTGTTCCT |
| 1429 | TATTGCTATCGTTTTTGTTCCTT |
| 1430 | ATTGCTATCGTTTTTGTTCCTTG |
| 1431 | TTGCTATCGTTTTTGTTCCTTGT |
| 1432 | TGCTATCGTTTTTGTTCCTTGTG |
| 1433 | GCTATCGTTTTTGTTCCTTGTGG |
| 1434 | CTATCGTTTTTGTTCCTTGTGGA |
| 1435 | TATCGTTTTTGTTCCTTGTGGAC |
| 1436 | ATCGTTTTTGTTCCTTGTGGACA |
| 1437 | TCGTTTTTGTTCCTTGTGGACAT |
| 1438 | CGTTTTTGTTCCTTGTGGACATC |
| 1439 | GTTTTTGTTCCTTGTGGACATCT |
| 1440 | TTTTTGTTCCTTGTGGACATCTA |

| ID | SEQUENCE |
|---|---|
| 1441 | TTTTGTTCCTTGTGGACATCTAG |
| 1442 | TTTGTTCCTTGTGGACATCTAGT |
| 1443 | TTGTTCCTTGTGGACATCTAGTC |
| 1444 | TGTTCCTTGTGGACATCTAGTCA |
| 1445 | GTTCCTTGTGGACATCTAGTCAC |
| 1446 | TTCCTTGTGGACATCTAGTCACT |
| 1447 | TCCTTGTGGACATCTAGTCACTT |
| 1448 | CCTTGTGGACATCTAGTCACTTG |
| 1449 | CTTGTGGACATCTAGTCACTTGT |
| 1450 | TTGTGGACATCTAGTCACTTGTA |
| 1451 | TGTGGACATCTAGTCACTTGTAA |
| 1452 | GTGGACATCTAGTCACTTGTAAA |
| 1453 | TGGACATCTAGTCACTTGTAAAC |
| 1454 | GGACATCTAGTCACTTGTAAACA |
| 1455 | GACATCTAGTCACTTGTAAACAA |
| 1456 | ACATCTAGTCACTTGTAAACAAT |
| 1457 | CATCTAGTCACTTGTAAACAATG |
| 1458 | ATCTAGTCACTTGTAAACAATGT |
| 1459 | TCTAGTCACTTGTAAACAATGTG |
| 1460 | CTAGTCACTTGTAAACAATGTGC |
| 1461 | TAGTCACTTGTAAACAATGTGCT |
| 1462 | AGTCACTTGTAAACAATGTGCTG |
| 1463 | GTCACTTGTAAACAATGTGCTGA |
| 1464 | TCACTTGTAAACAATGTGCTGAA |
| 1465 | CACTTGTAAACAATGTGCTGAAG |
| 1466 | ACTTGTAAACAATGTGCTGAAGC |
| 1467 | CTTGTAAACAATGTGCTGAAGCA |
| 1468 | TTGTAAACAATGTGCTGAAGCAG |
| 1469 | TGTAAACAATGTGCTGAAGCAGT |
| 1470 | GTAAACAATGTGCTGAAGCAGTT |
| 1471 | TAAACAATGTGCTGAAGCAGTTG |
| 1472 | AAACAATGTGCTGAAGCAGTTGA |
| 1473 | AACAATGTGCTGAAGCAGTTGAC |
| 1474 | ACAATGTGCTGAAGCAGTTGACA |
| 1475 | CAATGTGCTGAAGCAGTTGACAA |
| 1476 | AATGTGCTGAAGCAGTTGACAAG |
| 1477 | ATGTGCTGAAGCAGTTGACAAGT |
| 1478 | TGTGCTGAAGCAGTTGACAAGTG |
| 1479 | GTGCTGAAGCAGTTGACAAGTGT |
| 1480 | TGCTGAAGCAGTTGACAAGTGTC |
| 1481 | GCTGAAGCAGTTGACAAGTGTCC |
| 1482 | CTGAAGCAGTTGACAAGTGTCCC |
| 1483 | TGAAGCAGTTGACAAGTGTCCCA |
| 1484 | GAAGCAGTTGACAAGTGTCCCAT |
| 1485 | AAGCAGTTGACAAGTGTCCCATG |
| 1486 | AGCAGTTGACAAGTGTCCCATGT |
| 1487 | GCAGTTGACAAGTGTCCCATGTG |
| 1488 | CAGTTGACAAGTGTCCCATGTGC |

| ID | SEQUENCE |
|---|---|
| 1489 | AGTTGACAAGTGTCCCATGTGCT |
| 1490 | GTTGACAAGTGTCCCATGTGCTA |
| 1491 | TTGACAAGTGTCCCATGTGCTAC |
| 1492 | TGACAAGTGTCCCATGTGCTACA |
| 1493 | GACAAGTGTCCCATGTGCTACAC |
| 1494 | ACAAGTGTCCCATGTGCTACACA |
| 1495 | CAAGTGTCCCATGTGCTACACAG |
| 1496 | AAGTGTCCCATGTGCTACACAGT |
| 1497 | AGTGTCCCATGTGCTACACAGTC |
| 1498 | GTGTCCCATGTGCTACACAGTCA |
| 1499 | TGTCCCATGTGCTACACAGTCAT |
| 1500 | GTCCCATGTGCTACACAGTCATT |
| 1501 | TCCCATGTGCTACACAGTCATTA |
| 1502 | CCCATGTGCTACACAGTCATTAC |
| 1503 | CCATGTGCTACACAGTCATTACT |
| 1504 | CATGTGCTACACAGTCATTACTT |
| 1505 | ATGTGCTACACAGTCATTACTTT |
| 1506 | TGTGCTACACAGTCATTACTTTC |
| 1507 | GTGCTACACAGTCATTACTTTCA |
| 1508 | TGCTACACAGTCATTACTTTCAA |
| 1509 | GCTACACAGTCATTACTTTCAAG |
| 1510 | CTACACAGTCATTACTTTCAAGC |
| 1511 | TACACAGTCATTACTTTCAAGCA |
| 1512 | ACACAGTCATTACTTTCAAGCAA |
| 1513 | CACAGTCATTACTTTCAAGCAAA |
| 1514 | ACAGTCATTACTTTCAAGCAAAA |
| 1515 | CAGTCATTACTTTCAAGCAAAAA |
| 1516 | AGTCATTACTTTCAAGCAAAAAA |
| 1517 | GTCATTACTTTCAAGCAAAAAAT |
| 1518 | TCATTACTTTCAAGCAAAAAATT |
| 1519 | CATTACTTTCAAGCAAAAAATTT |
| 1520 | ATTACTTTCAAGCAAAAAATTTT |
| 1521 | TTACTTTCAAGCAAAAAATTTTT |
| 1522 | TACTTTCAAGCAAAAAATTTTTA |
| 1523 | ACTTTCAAGCAAAAAATTTTTAT |
| 1524 | CTTTCAAGCAAAAAATTTTTATG |
| 1525 | TTTCAAGCAAAAAATTTTTATGT |
| 1526 | TTCAAGCAAAAAATTTTTATGTC |
| 1527 | TCAAGCAAAAAATTTTTATGTCT |
| 1528 | CAAGCAAAAAATTTTTATGTCTT |
| 1529 | AAGCAAAAAATTTTTATGTCTTA |
| 1530 | TCTAACTCTATAGTAGGCATGTT |
| 1531 | CTAACTCTATAGTAGGCATGTTA |
| 1532 | TAACTCTATAGTAGGCATGTTAT |
| 1533 | AACTCTATAGTAGGCATGTTATG |
| 1534 | ACTCTATAGTAGGCATGTTATGT |
| 1535 | CTCTATAGTAGGCATGTTATGTT |
| 1536 | TCTATAGTAGGCATGTTATGTTG |

| ID | SEQUENCE |
|---|---|
| 1537 | CTATAGTAGGCATGTTATGTTGT |
| 1538 | TATAGTAGGCATGTTATGTTGTT |
| 1539 | ATAGTAGGCATGTTATGTTGTTC |
| 1540 | TAGTAGGCATGTTATGTTGTTCT |
| 1541 | AGTAGGCATGTTATGTTGTTCTT |
| 1542 | GTAGGCATGTTATGTTGTTCTTA |
| 1543 | TAGGCATGTTATGTTGTTCTTAT |
| 1544 | AGGCATGTTATGTTGTTCTTATT |
| 1545 | GGCATGTTATGTTGTTCTTATTA |
| 1546 | GCATGTTATGTTGTTCTTATTAC |
| 1547 | CATGTTATGTTGTTCTTATTACC |
| 1548 | ATGTTATGTTGTTCTTATTACCC |
| 1549 | TGTTATGTTGTTCTTATTACCCT |
| 1550 | GTTATGTTGTTCTTATTACCCTG |
| 1551 | TTATGTTGTTCTTATTACCCTGA |
| 1552 | TATGTTGTTCTTATTACCCTGAT |
| 1553 | ATGTTGTTCTTATTACCCTGATT |
| 1554 | TGTTGTTCTTATTACCCTGATTG |
| 1555 | GTTGTTCTTATTACCCTGATTGA |
| 1556 | TTGTTCTTATTACCCTGATTGAA |
| 1557 | TGTTCTTATTACCCTGATTGAAT |
| 1558 | GTTCTTATTACCCTGATTGAATG |
| 1559 | TTCTTATTACCCTGATTGAATGT |
| 1560 | TCTTATTACCCTGATTGAATGTG |
| 1561 | CTTATTACCCTGATTGAATGTGT |
| 1562 | TTATTACCCTGATTGAATGTGTG |
| 1563 | TATTACCCTGATTGAATGTGTGA |
| 1564 | ATTACCCTGATTGAATGTGTGAT |
| 1565 | TTACCCTGATTGAATGTGTGATG |
| 1566 | TACCCTGATTGAATGTGTGATGT |
| 1567 | ACCCTGATTGAATGTGTGATGTG |
| 1568 | CCCTGATTGAATGTGTGATGTGA |
| 1569 | CCTGATTGAATGTGTGATGTGAA |
| 1570 | CTGATTGAATGTGTGATGTGAAC |
| 1571 | TGATTGAATGTGTGATGTGAACT |
| 1572 | GATTGAATGTGTGATGTGAACTG |
| 1573 | ATTGAATGTGTGATGTGAACTGA |
| 1574 | TTGAATGTGTGATGTGAACTGAC |
| 1575 | TGAATGTGTGATGTGAACTGACT |
| 1576 | GAATGTGTGATGTGAACTGACTT |
| 1577 | AATGTGTGATGTGAACTGACTTT |
| 1578 | ATGTGTGATGTGAACTGACTTTA |
| 1579 | TGTGTGATGTGAACTGACTTTAA |
| 1580 | GTGTGATGTGAACTGACTTTAAG |
| 1581 | TGTGATGTGAACTGACTTTAAGT |
| 1582 | GTGATGTGAACTGACTTTAAGTA |
| 1583 | TGATGTGAACTGACTTTAAGTAA |
| 1584 | GATGTGAACTGACTTTAAGTAAT |

| ID | SEQUENCE |
|---|---|
| 1585 | ATGTGAACTGACTTTAAGTAATC |
| 1586 | TGTGAACTGACTTTAAGTAATCA |
| 1587 | GTGAACTGACTTTAAGTAATCAG |
| 1588 | TGAACTGACTTTAAGTAATCAGG |
| 1589 | GAACTGACTTTAAGTAATCAGGA |
| 1590 | AACTGACTTTAAGTAATCAGGAT |
| 1591 | ACTGACTTTAAGTAATCAGGATT |
| 1592 | CTGACTTTAAGTAATCAGGATTG |
| 1593 | TGACTTTAAGTAATCAGGATTGA |
| 1594 | GACTTTAAGTAATCAGGATTGAA |
| 1595 | ACTTTAAGTAATCAGGATTGAAT |
| 1596 | CTTTAAGTAATCAGGATTGAATT |
| 1597 | TTTAAGTAATCAGGATTGAATTC |
| 1598 | TTAAGTAATCAGGATTGAATTCC |
| 1599 | TAAGTAATCAGGATTGAATTCCA |
| 1600 | AAGTAATCAGGATTGAATTCCAT |
| 1601 | AGTAATCAGGATTGAATTCCATT |
| 1602 | GTAATCAGGATTGAATTCCATTA |
| 1603 | TAATCAGGATTGAATTCCATTAG |
| 1604 | AATCAGGATTGAATTCCATTAGC |
| 1605 | ATCAGGATTGAATTCCATTAGCA |
| 1606 | TCAGGATTGAATTCCATTAGCAT |
| 1607 | CAGGATTGAATTCCATTAGCATT |
| 1608 | AGGATTGAATTCCATTAGCATTT |
| 1609 | GGATTGAATTCCATTAGCATTTG |
| 1610 | GATTGAATTCCATTAGCATTTGC |
| 1611 | ATTGAATTCCATTAGCATTTGCT |
| 1612 | TTGAATTCCATTAGCATTTGCTA |
| 1613 | TGAATTCCATTAGCATTTGCTAC |
| 1614 | GAATTCCATTAGCATTTGCTACC |
| 1615 | AATTCCATTAGCATTTGCTACCA |
| 1616 | ATTCCATTAGCATTTGCTACCAA |
| 1617 | TTCCATTAGCATTTGCTACCAAG |
| 1618 | TCCATTAGCATTTGCTACCAAGT |
| 1619 | CCATTAGCATTTGCTACCAAGTA |
| 1620 | CATTAGCATTTGCTACCAAGTAG |
| 1621 | ATTAGCATTTGCTACCAAGTAGG |
| 1622 | TTAGCATTTGCTACCAAGTAGGA |
| 1623 | TAGCATTTGCTACCAAGTAGGAA |
| 1624 | AGCATTTGCTACCAAGTAGGAAA |
| 1625 | GCATTTGCTACCAAGTAGGAAAA |
| 1626 | CATTTGCTACCAAGTAGGAAAAA |
| 1627 | ATTTGCTACCAAGTAGGAAAAAA |
| 1628 | TTTGCTACCAAGTAGGAAAAAAA |
| 1629 | TTGCTACCAAGTAGGAAAAAAAA |
| 1630 | TGCTACCAAGTAGGAAAAAAAAT |
| 1631 | GCTACCAAGTAGGAAAAAAAATG |
| 1632 | CTACCAAGTAGGAAAAAAAATGT |

| ID | SEQUENCE |
|---|---|
| 1633 | TACCAAGTAGGAAAAAAAATGTA |
| 1634 | ACCAAGTAGGAAAAAAATGTAC |
| 1635 | CCAAGTAGGAAAAAAATGTACA |
| 1636 | CAAGTAGGAAAAAAATGTACAT |
| 1637 | AAGTAGGAAAAAAATGTACATG |
| 1638 | AGTAGGAAAAAAATGTACATGG |
| 1639 | GTAGGAAAAAAATGTACATGGC |
| 1640 | TAGGAAAAAAATGTACATGGCA |
| 1641 | AGGAAAAAAATGTACATGGCAG |
| 1642 | GGAAAAAAATGTACATGGCAGT |
| 1643 | GAAAAAAATGTACATGGCAGTG |
| 1644 | AAAAAAATGTACATGGCAGTGT |
| 1645 | AAAAAATGTACATGGCAGTGTT |
| 1646 | AAAAATGTACATGGCAGTGTTT |
| 1647 | AAAATGTACATGGCAGTGTTTT |
| 1648 | AAATGTACATGGCAGTGTTTTA |
| 1649 | AATGTACATGGCAGTGTTTTAG |
| 1650 | ATGTACATGGCAGTGTTTTAGT |
| 1651 | ATGTACATGGCAGTGTTTTAGTT |
| 1652 | TGTACATGGCAGTGTTTTAGTTG |
| 1653 | GTACATGGCAGTGTTTTAGTTGG |
| 1654 | TACATGGCAGTGTTTTAGTTGGC |
| 1655 | ACATGGCAGTGTTTTAGTTGGCA |
| 1656 | CATGGCAGTGTTTTAGTTGGCAA |
| 1657 | ATGGCAGTGTTTTAGTTGGCAAT |
| 1658 | TGGCAGTGTTTTAGTTGGCAATA |
| 1659 | GGCAGTGTTTTAGTTGGCAATAT |
| 1660 | GCAGTGTTTTAGTTGGCAATATA |
| 1661 | CAGTGTTTTAGTTGGCAATATAA |
| 1662 | AGTGTTTTAGTTGGCAATATAAT |
| 1663 | GTGTTTTAGTTGGCAATATAATC |
| 1664 | TGTTTTAGTTGGCAATATAATCT |
| 1665 | GTTTTAGTTGGCAATATAATCTT |
| 1666 | TTTTAGTTGGCAATATAATCTTT |
| 1667 | TTTAGTTGGCAATATAATCTTTG |
| 1668 | TTAGTTGGCAATATAATCTTTGA |
| 1669 | TAGTTGGCAATATAATCTTTGAA |
| 1670 | AGTTGGCAATATAATCTTTGAAT |
| 1671 | GTTGGCAATATAATCTTTGAATT |
| 1672 | TTGGCAATATAATCTTTGAATTT |
| 1673 | TGGCAATATAATCTTTGAATTTC |
| 1674 | GGCAATATAATCTTTGAATTTCT |
| 1675 | GCAATATAATCTTTGAATTTCTT |
| 1676 | CAATATAATCTTTGAATTTCTTG |
| 1677 | AATATAATCTTTGAATTTCTTGA |
| 1678 | ATATAATCTTTGAATTTCTTGAT |
| 1679 | TATAATCTTTGAATTTCTTGATT |
| 1680 | ATAATCTTTGAATTTCTTGATTT |

| ID | SEQUENCE |
|---|---|
| 1681 | TAATCTTTGAATTTCTTGATTTT |
| 1682 | AATCTTTGAATTTCTTGATTTTT |
| 1683 | ATCTTTGAATTTCTTGATTTTTC |
| 1684 | TCTTTGAATTTCTTGATTTTTCA |
| 1685 | CTTTGAATTTCTTGATTTTTCAG |
| 1686 | TTTGAATTTCTTGATTTTTCAGG |
| 1687 | TTGAATTTCTTGATTTTTCAGGG |
| 1688 | TGAATTTCTTGATTTTTCAGGGT |
| 1689 | GAATTTCTTGATTTTTCAGGGTA |
| 1690 | AATTTCTTGATTTTTCAGGGTAT |
| 1691 | ATTTCTTGATTTTTCAGGGTATT |
| 1692 | TTTCTTGATTTTTCAGGGTATTA |
| 1693 | TTCTTGATTTTTCAGGGTATTAG |
| 1694 | TCTTGATTTTTCAGGGTATTAGC |
| 1695 | CTTGATTTTTCAGGGTATTAGCT |
| 1696 | TTGATTTTTCAGGGTATTAGCTG |
| 1697 | TGATTTTTCAGGGTATTAGCTGT |
| 1698 | GATTTTTCAGGGTATTAGCTGTA |
| 1699 | ATTTTTCAGGGTATTAGCTGTAT |
| 1700 | TTTTTCAGGGTATTAGCTGTATT |
| 1701 | TTTTCAGGGTATTAGCTGTATTA |
| 1702 | TTTCAGGGTATTAGCTGTATTAT |
| 1703 | TTCAGGGTATTAGCTGTATTATC |
| 1704 | TCAGGGTATTAGCTGTATTATCC |
| 1705 | CAGGGTATTAGCTGTATTATCCA |
| 1706 | AGGGTATTAGCTGTATTATCCAT |
| 1707 | GGGTATTAGCTGTATTATCCATT |
| 1708 | GGTATTAGCTGTATTATCCATTT |
| 1709 | GTATTAGCTGTATTATCCATTTT |
| 1710 | TATTAGCTGTATTATCCATTTTT |
| 1711 | ATTAGCTGTATTATCCATTTTTT |
| 1712 | TTAGCTGTATTATCCATTTTTTT |
| 1713 | TAGCTGTATTATCCATTTTTTTA |
| 1714 | AGCTGTATTATCCATTTTTTTAC |
| 1715 | GCTGTATTATCCATTTTTTTACT |
| 1716 | CTGTATTATCCATTTTTTTACTG |
| 1717 | TGTATTATCCATTTTTTTACTGT |
| 1718 | GTATTATCCATTTTTTTACTGTT |
| 1719 | TATTATCCATTTTTTTACTGTTA |
| 1720 | ATTATCCATTTTTTTACTGTTAT |
| 1721 | TTATCCATTTTTTTACTGTTATT |
| 1722 | TATCCATTTTTTTACTGTTATTT |
| 1723 | ATCCATTTTTTTACTGTTATTTA |
| 1724 | TCCATTTTTTTACTGTTATTTAA |
| 1725 | CCATTTTTTTACTGTTATTTAAT |
| 1726 | CATTTTTTTACTGTTATTTAATT |
| 1727 | ATTTTTTTACTGTTATTTAATTG |
| 1728 | TTTTTTTACTGTTATTTAATTG |

| ID | SEQUENCE |
|---|---|
| 1729 | TTTTTTTACTGTTATTTAATTGA |
| 1730 | TTTTTTACTGTTATTTAATTGAA |
| 1731 | TTTTTACTGTTATTTAATTGAAA |
| 1732 | TTTTACTGTTATTTAATTGAAAC |
| 1733 | TTTACTGTTATTTAATTGAAACC |
| 1734 | TTACTGTTATTTAATTGAAACCA |
| 1735 | TACTGTTATTTAATTGAAACCAT |
| 1736 | ACTGTTATTTAATTGAAACCATA |
| 1737 | CTGTTATTTAATTGAAACCATAG |
| 1738 | TGTTATTTAATTGAAACCATAGA |
| 1739 | GTTATTTAATTGAAACCATAGAC |
| 1740 | TTATTTAATTGAAACCATAGACT |
| 1741 | TATTTAATTGAAACCATAGACTA |
| 1742 | ATTTAATTGAAACCATAGACTAA |
| 1743 | TTTAATTGAAACCATAGACTAAG |
| 1744 | TTAATTGAAACCATAGACTAAGA |
| 1745 | TAATTGAAACCATAGACTAAGAA |
| 1746 | AATTGAAACCATAGACTAAGAAT |
| 1747 | ATTGAAACCATAGACTAAGAATA |
| 1748 | TTGAAACCATAGACTAAGAATAA |
| 1749 | TGAAACCATAGACTAAGAATAAG |
| 1750 | GAAACCATAGACTAAGAATAAGA |
| 1751 | AAACCATAGACTAAGAATAAGAA |
| 1752 | AACCATAGACTAAGAATAAGAAG |
| 1753 | ACCATAGACTAAGAATAAGAAGC |
| 1754 | CCATAGACTAAGAATAAGAAGCA |
| 1755 | CATAGACTAAGAATAAGAAGCAT |
| 1756 | ATAGACTAAGAATAAGAAGCATC |
| 1757 | TAGACTAAGAATAAGAAGCATCA |
| 1758 | AGACTAAGAATAAGAAGCATCAT |
| 1759 | GACTAAGAATAAGAAGCATCATA |
| 1760 | ACTAAGAATAAGAAGCATCATAC |
| 1761 | CTAAGAATAAGAAGCATCATACT |
| 1762 | TAAGAATAAGAAGCATCATACTA |
| 1763 | AAGAATAAGAAGCATCATACTAT |
| 1764 | AGAATAAGAAGCATCATACTATA |
| 1765 | GAATAAGAAGCATCATACTATAA |
| 1766 | AATAAGAAGCATCATACTATAAC |
| 1767 | ATAAGAAGCATCATACTATAACT |
| 1768 | TAAGAAGCATCATACTATAACTG |
| 1769 | AAGAAGCATCATACTATAACTGA |
| 1770 | AGAAGCATCATACTATAACTGAA |
| 1771 | GAAGCATCATACTATAACTGAAC |
| 1772 | AAGCATCATACTATAACTGAACA |
| 1773 | AGCATCATACTATAACTGAACAC |
| 1774 | GCATCATACTATAACTGAACACA |
| 1775 | CATCATACTATAACTGAACACAA |
| 1776 | ATCATACTATAACTGAACACAAT |

| ID | SEQUENCE |
|---|---|
| 1777 | TCATACTATAACTGAACACAATG |
| 1778 | CATACTATAACTGAACACAATGT |
| 1779 | ATACTATAACTGAACACAATGTG |
| 1780 | TACTATAACTGAACACAATGTGT |
| 1781 | ACTATAACTGAACACAATGTGTA |
| 1782 | CTATAACTGAACACAATGTGTAT |
| 1783 | TATAACTGAACACAATGTGTATT |
| 1784 | ATAACTGAACACAATGTGTATTC |
| 1785 | TAACTGAACACAATGTGTATTCA |
| 1786 | AACTGAACACAATGTGTATTCAT |
| 1787 | ACTGAACACAATGTGTATTCATA |
| 1788 | CTGAACACAATGTGTATTCATAG |
| 1789 | TGAACACAATGTGTATTCATAGT |
| 1790 | GAACACAATGTGTATTCATAGTA |
| 1791 | AACACAATGTGTATTCATAGTAT |
| 1792 | ACACAATGTGTATTCATAGTATA |
| 1793 | CACAATGTGTATTCATAGTATAC |
| 1794 | ACAATGTGTATTCATAGTATACT |
| 1795 | CAATGTGTATTCATAGTATACTG |
| 1796 | AATGTGTATTCATAGTATACTGA |
| 1797 | ATGTGTATTCATAGTATACTGAT |
| 1798 | TGTGTATTCATAGTATACTGATT |
| 1799 | GTGTATTCATAGTATACTGATTT |
| 1800 | TGTATTCATAGTATACTGATTTA |
| 1801 | GTATTCATAGTATACTGATTTAA |
| 1802 | TATTCATAGTATACTGATTTAAT |
| 1803 | ATTCATAGTATACTGATTTAATT |
| 1804 | TTCATAGTATACTGATTTAATTT |
| 1805 | TCATAGTATACTGATTTAATTTC |
| 1806 | CATAGTATACTGATTTAATTTCT |
| 1807 | ATAGTATACTGATTTAATTTCTA |
| 1808 | TAGTATACTGATTTAATTTCTAA |
| 1809 | AGTATACTGATTTAATTTCTAAG |
| 1810 | GTATACTGATTTAATTTCTAAGT |
| 1811 | TATACTGATTTAATTTCTAAGTG |
| 1812 | ATACTGATTTAATTTCTAAGTGT |
| 1813 | TACTGATTTAATTTCTAAGTGTA |
| 1814 | ACTGATTTAATTTCTAAGTGTAA |
| 1815 | CTGATTTAATTTCTAAGTGTAAG |
| 1816 | TGATTTAATTTCTAAGTGTAAGT |
| 1817 | GATTTAATTTCTAAGTGTAAGTG |
| 1818 | ATTTAATTTCTAAGTGTAAGTGA |
| 1819 | TTTAATTTCTAAGTGTAAGTGAA |
| 1820 | TTAATTTCTAAGTGTAAGTGAAT |
| 1821 | TAATTTCTAAGTGTAAGTGAATT |
| 1822 | AATTTCTAAGTGTAAGTGAATTA |
| 1823 | ATTTCTAAGTGTAAGTGAATTAA |
| 1824 | TTTCTAAGTGTAAGTGAATTAAT |

| ID | SEQUENCE |
|---|---|
| 1825 | TTCTAAGTGTAAGTGAATTAATC |
| 1826 | TCTAAGTGTAAGTGAATTAATCA |
| 1827 | CTAAGTGTAAGTGAATTAATCAT |
| 1828 | TAAGTGTAAGTGAATTAATCATC |
| 1829 | AAGTGTAAGTGAATTAATCATCT |
| 1830 | AGTGTAAGTGAATTAATCATCTG |
| 1831 | GTGTAAGTGAATTAATCATCTGG |
| 1832 | TGTAAGTGAATTAATCATCTGGA |
| 1833 | GTAAGTGAATTAATCATCTGGAT |
| 1834 | TAAGTGAATTAATCATCTGGATT |
| 1835 | AAGTGAATTAATCATCTGGATTT |
| 1836 | AGTGAATTAATCATCTGGATTTT |
| 1837 | GTGAATTAATCATCTGGATTTTT |
| 1838 | TGAATTAATCATCTGGATTTTTT |
| 1839 | GAATTAATCATCTGGATTTTTTA |
| 1840 | AATTAATCATCTGGATTTTTTAT |
| 1841 | ATTAATCATCTGGATTTTTTATT |
| 1842 | TTAATCATCTGGATTTTTTATTC |
| 1843 | TAATCATCTGGATTTTTTATTCT |
| 1844 | AATCATCTGGATTTTTTATTCTT |
| 1845 | ATCATCTGGATTTTTTATTCTTT |
| 1846 | TCATCTGGATTTTTTATTCTTTT |
| 1847 | CATCTGGATTTTTTATTCTTTTC |
| 1848 | ATCTGGATTTTTTATTCTTTTCA |
| 1849 | TCTGGATTTTTTATTCTTTTCAG |
| 1850 | CTGGATTTTTTATTCTTTTCAGA |
| 1851 | TGGATTTTTTATTCTTTTCAGAT |
| 1852 | GGATTTTTTATTCTTTTCAGATA |
| 1853 | GATTTTTTATTCTTTTCAGATAG |
| 1854 | ATTTTTTATTCTTTTCAGATAGG |
| 1855 | TTTTTTATTCTTTTCAGATAGGC |
| 1856 | TTTTTATTCTTTTCAGATAGGCT |
| 1857 | TTTTATTCTTTTCAGATAGGCTT |
| 1858 | TTTATTCTTTTCAGATAGGCTTA |
| 1859 | TTATTCTTTTCAGATAGGCTTAA |
| 1860 | TATTCTTTTCAGATAGGCTTAAC |
| 1861 | ATTCTTTTCAGATAGGCTTAACA |
| 1862 | TTCTTTTCAGATAGGCTTAACAA |
| 1863 | TCTTTTCAGATAGGCTTAACAAA |
| 1864 | CTTTTCAGATAGGCTTAACAAAT |
| 1865 | TTTTCAGATAGGCTTAACAAATG |
| 1866 | TTTCAGATAGGCTTAACAAATGG |
| 1867 | TTCAGATAGGCTTAACAAATGGA |
| 1868 | TCAGATAGGCTTAACAAATGGAG |
| 1869 | CAGATAGGCTTAACAAATGGAGC |
| 1870 | AGATAGGCTTAACAAATGGAGCT |
| 1871 | GATAGGCTTAACAAATGGAGCTT |
| 1872 | ATAGGCTTAACAAATGGAGCTTT |

| ID | SEQUENCE |
|---|---|
| 1873 | TAGGCTTAACAAATGGAGCTTTC |
| 1874 | AGGCTTAACAAATGGAGCTTTCT |
| 1875 | GGCTTAACAAATGGAGCTTTCTG |
| 1876 | GCTTAACAAATGGAGCTTTCTGT |
| 1877 | CTTAACAAATGGAGCTTTCTGTA |
| 1878 | TTAACAAATGGAGCTTTCTGTAT |
| 1879 | TAACAAATGGAGCTTTCTGTATA |
| 1880 | AACAAATGGAGCTTTCTGTATAT |
| 1881 | ACAAATGGAGCTTTCTGTATATA |
| 1882 | CAAATGGAGCTTTCTGTATATAA |
| 1883 | AAATGGAGCTTTCTGTATATAAA |
| 1884 | AATGGAGCTTTCTGTATATAAAT |
| 1885 | ATGGAGCTTTCTGTATATAAATG |
| 1886 | TGGAGCTTTCTGTATATAAATGT |
| 1887 | GGAGCTTTCTGTATATAAATGTG |
| 1888 | GAGCTTTCTGTATATAAATGTGG |
| 1889 | AGCTTTCTGTATATAAATGTGGA |
| 1890 | GCTTTCTGTATATAAATGTGGAG |
| 1891 | CTTTCTGTATATAAATGTGGAGA |
| 1892 | TTTCTGTATATAAATGTGGAGAT |
| 1893 | TTCTGTATATAAATGTGGAGATT |
| 1894 | TCTGTATATAAATGTGGAGATTA |
| 1895 | CTGTATATAAATGTGGAGATTAG |
| 1896 | TGTATATAAATGTGGAGATTAGA |
| 1897 | GTATATAAATGTGGAGATTAGAG |
| 1898 | TATATAAATGTGGAGATTAGAGT |
| 1899 | ATATAAATGTGGAGATTAGAGTT |
| 1900 | TATAAATGTGGAGATTAGAGTTA |
| 1901 | ATAAATGTGGAGATTAGAGTTAA |
| 1902 | TAAATGTGGAGATTAGAGTTAAT |
| 1903 | AAATGTGGAGATTAGAGTTAATC |
| 1904 | AATGTGGAGATTAGAGTTAATCT |
| 1905 | ATGTGGAGATTAGAGTTAATCTC |
| 1906 | TGTGGAGATTAGAGTTAATCTCC |
| 1907 | GTGGAGATTAGAGTTAATCTCCC |
| 1908 | TGGAGATTAGAGTTAATCTCCCC |
| 1909 | GGAGATTAGAGTTAATCTCCCCA |
| 1910 | GAGATTAGAGTTAATCTCCCCAA |
| 1911 | AGATTAGAGTTAATCTCCCCAAT |
| 1912 | GATTAGAGTTAATCTCCCCAATC |
| 1913 | ATTAGAGTTAATCTCCCCAATCA |
| 1914 | TTAGAGTTAATCTCCCCAATCAC |
| 1915 | TAGAGTTAATCTCCCCAATCACA |
| 1916 | AGAGTTAATCTCCCCAATCACAT |
| 1917 | GAGTTAATCTCCCCAATCACATA |
| 1918 | AGTTAATCTCCCCAATCACATAA |
| 1919 | GTTAATCTCCCCAATCACATAAT |
| 1920 | TTAATCTCCCCAATCACATAATT |

| ID | SEQUENCE |
|---|---|
| 1921 | TAATCTCCCCAATCACATAATTT |
| 1922 | AATCTCCCCAATCACATAATTTG |
| 1923 | ATCTCCCCAATCACATAATTTGT |
| 1924 | TCTCCCCAATCACATAATTTGTT |
| 1925 | CTCCCCAATCACATAATTTGTTT |
| 1926 | TCCCCAATCACATAATTTGTTTT |
| 1927 | CCCCAATCACATAATTTGTTTTG |
| 1928 | CCCAATCACATAATTTGTTTTGT |
| 1929 | CCAATCACATAATTTGTTTTGTG |
| 1930 | CAATCACATAATTTGTTTTGTGT |
| 1931 | AATCACATAATTTGTTTTGTGTG |
| 1932 | ATCACATAATTTGTTTTGTGTGA |
| 1933 | TCACATAATTTGTTTTGTGTGAA |
| 1934 | CACATAATTTGTTTTGTGTGAAA |
| 1935 | ACATAATTTGTTTTGTGTGAAAA |
| 1936 | CATAATTTGTTTTGTGTGAAAAA |
| 1937 | ATAATTTGTTTTGTGTGAAAAAG |
| 1938 | TAATTTGTTTTGTGTGAAAAAGG |
| 1939 | AATTTGTTTTGTGTGAAAAAGGA |
| 1940 | ATTTGTTTTGTGTGAAAAAGGAA |
| 1941 | TTTGTTTTGTGTGAAAAAGGAAT |
| 1942 | TTGTTTTGTGTGAAAAAGGAATA |
| 1943 | TGTTTTGTGTGAAAAAGGAATAA |
| 1944 | GTTTTGTGTGAAAAAGGAATAAA |
| 1945 | TTTTGTGTGAAAAAGGAATAAAT |
| 1946 | TTTGTGTGAAAAAGGAATAAATT |
| 1947 | TTGTGTGAAAAAGGAATAAATTG |
| 1948 | TGTGTGAAAAAGGAATAAATTGT |
| 1949 | GTGTGAAAAAGGAATAAATTGTT |
| 1950 | TGTGAAAAAGGAATAAATTGTTC |
| 1951 | GTGAAAAAGGAATAAATTGTTCC |
| 1952 | TGAAAAAGGAATAAATTGTTCCA |
| 1953 | GAAAAAGGAATAAATTGTTCCAT |
| 1954 | AAAAAGGAATAAATTGTTCCATG |
| 1955 | AAAAGGAATAAATTGTTCCATGC |
| 1956 | AAAGGAATAAATTGTTCCATGCT |
| 1957 | AAGGAATAAATTGTTCCATGCTG |
| 1958 | AGGAATAAATTGTTCCATGCTGG |
| 1959 | GGAATAAATTGTTCCATGCTGGT |
| 1960 | GAATAAATTGTTCCATGCTGGTG |
| 1961 | AATAAATTGTTCCATGCTGGTGG |
| 1962 | ATAAATTGTTCCATGCTGGTGGA |
| 1963 | TAAATTGTTCCATGCTGGTGGAA |
| 1964 | AAATTGTTCCATGCTGGTGGAAA |
| 1965 | AATTGTTCCATGCTGGTGGAAAG |
| 1966 | ATTGTTCCATGCTGGTGGAAAGA |
| 1967 | TTGTTCCATGCTGGTGGAAAGAT |
| 1968 | TGTTCCATGCTGGTGGAAAGATA |

| ID | SEQUENCE |
|---|---|
| 1969 | GTTCCATGCTGGTGGAAAGATAG |
| 1970 | TTCCATGCTGGTGGAAAGATAGA |
| 1971 | TCCATGCTGGTGGAAAGATAGAG |
| 1972 | CCATGCTGGTGGAAAGATAGAGA |
| 1973 | CATGCTGGTGGAAAGATAGAGAT |
| 1974 | ATGCTGGTGGAAAGATAGAGATT |
| 1975 | TGCTGGTGGAAAGATAGAGATTG |
| 1976 | GCTGGTGGAAAGATAGAGATTGT |
| 1977 | CTGGTGGAAAGATAGAGATTGTT |
| 1978 | TGGTGGAAAGATAGAGATTGTTT |
| 1979 | GGTGGAAAGATAGAGATTGTTTT |
| 1980 | GTGGAAAGATAGAGATTGTTTTT |
| 1981 | TGGAAAGATAGAGATTGTTTTTA |
| 1982 | GGAAAGATAGAGATTGTTTTTAG |
| 1983 | GAAAGATAGAGATTGTTTTTAGA |
| 1984 | AAAGATAGAGATTGTTTTTAGAG |
| 1985 | AAGATAGAGATTGTTTTTAGAGG |
| 1986 | AGATAGAGATTGTTTTTAGAGGT |
| 1987 | GATAGAGATTGTTTTTAGAGGTT |
| 1988 | ATAGAGATTGTTTTTAGAGGTTG |
| 1989 | TAGAGATTGTTTTTAGAGGTTGG |
| 1990 | AGAGATTGTTTTTAGAGGTTGGT |
| 1991 | GAGATTGTTTTTAGAGGTTGGTT |
| 1992 | AGATTGTTTTTAGAGGTTGGTTG |
| 1993 | GATTGTTTTTAGAGGTTGGTTGT |
| 1994 | ATTGTTTTTAGAGGTTGGTTGTT |
| 1995 | TTGTTTTTAGAGGTTGGTTGTTG |
| 1996 | TGTTTTTAGAGGTTGGTTGTTGT |
| 1997 | GTTTTTAGAGGTTGGTTGTTGTG |
| 1998 | TTTTTAGAGGTTGGTTGTTGTGT |
| 1999 | TTTTAGAGGTTGGTTGTTGTGTT |
| 2000 | TTTAGAGGTTGGTTGTTGTGTTT |
| 2001 | TTAGAGGTTGGTTGTTGTGTTTT |
| 2002 | TAGAGGTTGGTTGTTGTGTTTTA |
| 2003 | AGAGGTTGGTTGTTGTGTTTTAG |
| 2004 | GAGGTTGGTTGTTGTGTTTTAGG |
| 2005 | AGGTTGGTTGTTGTGTTTTAGGA |
| 2006 | GGTTGGTTGTTGTGTTTTAGGAT |
| 2007 | GTTGGTTGTTGTGTTTTAGGATT |
| 2008 | TTGGTTGTTGTGTTTTAGGATTC |
| 2009 | TGGTTGTTGTGTTTTAGGATTCT |
| 2010 | GGTTGTTGTGTTTTAGGATTCTG |
| 2011 | GTTGTTGTGTTTTAGGATTCTGT |
| 2012 | TTGTTGTGTTTTAGGATTCTGTC |
| 2013 | TGTTGTGTTTTAGGATTCTGTCC |
| 2014 | GTTGTGTTTTAGGATTCTGTCCA |
| 2015 | TTGTGTTTTAGGATTCTGTCCAT |
| 2016 | TGTGTTTTAGGATTCTGTCCATT |

| ID | SEQUENCE |
|---|---|
| 2017 | GTGTTTTAGGATTCTGTCCATTT |
| 2018 | TGTTTTAGGATTCTGTCCATTTT |
| 2019 | GTTTTAGGATTCTGTCCATTTTC |
| 2020 | TTTTAGGATTCTGTCCATTTTCT |
| 2021 | TTTAGGATTCTGTCCATTTTCTT |
| 2022 | TTAGGATTCTGTCCATTTTCTTT |
| 2023 | TAGGATTCTGTCCATTTTCTTTT |
| 2024 | AGGATTCTGTCCATTTTCTTTTA |
| 2025 | GGATTCTGTCCATTTTCTTTTAA |
| 2026 | GATTCTGTCCATTTTCTTTTAAA |
| 2027 | ATTCTGTCCATTTTCTTTTAAAG |
| 2028 | TTCTGTCCATTTTCTTTTAAAGT |
| 2029 | TCTGTCCATTTTCTTTTAAAGTT |
| 2030 | CTGTCCATTTTCTTTTAAAGTTA |
| 2031 | TGTCCATTTTCTTTTAAAGTTAT |
| 2032 | GTCCATTTTCTTTTAAAGTTATA |
| 2033 | TCCATTTTCTTTTAAAGTTATAA |
| 2034 | CCATTTTCTTTTAAAGTTATAAA |
| 2035 | CATTTTCTTTTAAAGTTATAAAC |
| 2036 | ATTTTCTTTTAAAGTTATAAACA |
| 2037 | TTTTCTTTTAAAGTTATAAACAC |
| 2038 | TTTCTTTTAAAGTTATAAACACG |
| 2039 | TTCTTTTAAAGTTATAAACACGT |
| 2040 | TCTTTTAAAGTTATAAACACGTA |
| 2041 | CTTTTAAAGTTATAAACACGTAC |
| 2042 | TTTTAAAGTTATAAACACGTACT |
| 2043 | TTTAAAGTTATAAACACGTACTT |
| 2044 | TTAAAGTTATAAACACGTACTTG |
| 2045 | TAAAGTTATAAACACGTACTTGT |
| 2046 | AAAGTTATAAACACGTACTTGTG |
| 2047 | AAGTTATAAACACGTACTTGTGC |
| 2048 | AGTTATAAACACGTACTTGTGCG |
| 2049 | GTTATAAACACGTACTTGTGCGA |
| 2050 | TTATAAACACGTACTTGTGCGAA |
| 2051 | TATAAACACGTACTTGTGCGAAT |
| 2052 | ATAAACACGTACTTGTGCGAATT |
| 2053 | TAAACACGTACTTGTGCGAATTA |
| 2054 | AAACACGTACTTGTGCGAATTAT |
| 2055 | AACACGTACTTGTGCGAATTATT |
| 2056 | ACACGTACTTGTGCGAATTATTT |
| 2057 | CACGTACTTGTGCGAATTATTTT |
| 2058 | ACGTACTTGTGCGAATTATTTTT |
| 2059 | CGTACTTGTGCGAATTATTTTTT |
| 2060 | GTACTTGTGCGAATTATTTTTTT |
| 2061 | TACTTGTGCGAATTATTTTTTTA |
| 2062 | ACTTGTGCGAATTATTTTTTTAA |
| 2063 | CTTGTGCGAATTATTTTTTTAAA |
| 2064 | TTGTGCGAATTATTTTTTTAAAG |

| ID | SEQUENCE |
|---|---|
| 2065 | TGTGCGAATTATTTTTTAAAGT |
| 2066 | GTGCGAATTATTTTTTAAAGTG |
| 2067 | TGCGAATTATTTTTTAAAGTGA |
| 2068 | GCGAATTATTTTTTAAAGTGAT |
| 2069 | CGAATTATTTTTTAAAGTGATT |
| 2070 | GAATTATTTTTTAAAGTGATTT |
| 2071 | AATTATTTTTTAAAGTGATTTG |
| 2072 | ATTATTTTTTAAAGTGATTTGC |
| 2073 | TTATTTTTTAAAGTGATTTGCC |
| 2074 | TATTTTTTAAAGTGATTTGCCA |
| 2075 | ATTTTTTAAAGTGATTTGCCAT |
| 2076 | TTTTTTAAAGTGATTTGCCATT |
| 2077 | TTTTTAAAGTGATTTGCCATTT |
| 2078 | TTTTAAAGTGATTTGCCATTTT |
| 2079 | TTTAAAGTGATTTGCCATTTTT |
| 2080 | TTAAAGTGATTTGCCATTTTTG |
| 2081 | TAAAGTGATTTGCCATTTTTGA |
| 2082 | AAAGTGATTTGCCATTTTTGAA |
| 2083 | AAGTGATTTGCCATTTTTGAAA |
| 2084 | AGTGATTTGCCATTTTTGAAAG |
| 2085 | GTGATTTGCCATTTTTGAAAGC |
| 2086 | TGATTTGCCATTTTTGAAAGCG |
| 2087 | GATTTGCCATTTTTGAAAGCGT |
| 2088 | ATTTGCCATTTTTGAAAGCGTA |
| 2089 | TTTGCCATTTTTGAAAGCGTAT |
| 2090 | TTGCCATTTTTGAAAGCGTATT |
| 2091 | TGCCATTTTTGAAAGCGTATTT |
| 2092 | GCCATTTTTGAAAGCGTATTTA |
| 2093 | CCATTTTTGAAAGCGTATTTAA |
| 2094 | CATTTTTGAAAGCGTATTTAAT |
| 2095 | ATTTTTGAAAGCGTATTTAATG |
| 2096 | TTTTTGAAAGCGTATTTAATGA |
| 2097 | TTTTGAAAGCGTATTTAATGAT |
| 2098 | TTTGAAAGCGTATTTAATGATA |
| 2099 | TTGAAAGCGTATTTAATGATAG |
| 2100 | TGAAAGCGTATTTAATGATAGA |
| 2101 | GAAAGCGTATTTAATGATAGAA |
| 2102 | AAAGCGTATTTAATGATAGAAT |
| 2103 | AAGCGTATTTAATGATAGAATA |
| 2104 | AGCGTATTTAATGATAGAATAC |
| 2105 | GCGTATTTAATGATAGAATACT |
| 2106 | CGTATTTAATGATAGAATACTA |
| 2107 | GTATTTAATGATAGAATACTAT |
| 2108 | TATTTAATGATAGAATACTATC |
| 2109 | ATTTAATGATAGAATACTATCG |
| 2110 | TTTAATGATAGAATACTATCGA |
| 2111 | TTAATGATAGAATACTATCGAG |
| 2112 | TAATGATAGAATACTATCGAGC |

| ID | SEQUENCE |
|---|---|
| 2113 | TAATGATAGAATACTATCGAGCC |
| 2114 | AATGATAGAATACTATCGAGCCA |
| 2115 | ATGATAGAATACTATCGAGCCAA |
| 2116 | TGATAGAATACTATCGAGCCAAC |
| 2117 | GATAGAATACTATCGAGCCAACA |
| 2118 | ATAGAATACTATCGAGCCAACAT |
| 2119 | TAGAATACTATCGAGCCAACATG |
| 2120 | AGAATACTATCGAGCCAACATGT |
| 2121 | GAATACTATCGAGCCAACATGTA |
| 2122 | AATACTATCGAGCCAACATGTAC |
| 2123 | ATACTATCGAGCCAACATGTACT |
| 2124 | TACTATCGAGCCAACATGTACTG |
| 2125 | ACTATCGAGCCAACATGTACTGA |
| 2126 | CTATCGAGCCAACATGTACTGAC |
| 2127 | TATCGAGCCAACATGTACTGACA |
| 2128 | ATCGAGCCAACATGTACTGACAT |
| 2129 | TCGAGCCAACATGTACTGACATG |
| 2130 | CGAGCCAACATGTACTGACATGG |
| 2131 | GAGCCAACATGTACTGACATGGA |
| 2132 | AGCCAACATGTACTGACATGGAA |
| 2133 | GCCAACATGTACTGACATGGAAA |
| 2134 | CCAACATGTACTGACATGGAAAG |
| 2135 | CAACATGTACTGACATGGAAAGA |
| 2136 | AACATGTACTGACATGGAAAGAT |
| 2137 | ACATGTACTGACATGGAAAGATG |
| 2138 | CATGTACTGACATGGAAAGATGT |
| 2139 | ATGTACTGACATGGAAAGATGTC |
| 2140 | TGTACTGACATGGAAAGATGTCA |
| 2141 | GTACTGACATGGAAAGATGTCAA |
| 2142 | TACTGACATGGAAAGATGTCAAA |
| 2143 | ACTGACATGGAAAGATGTCAAAG |
| 2144 | CTGACATGGAAAGATGTCAAAGA |
| 2145 | TGACATGGAAAGATGTCAAAGAT |
| 2146 | GACATGGAAAGATGTCAAAGATA |
| 2147 | ACATGGAAAGATGTCAAAGATAT |
| 2148 | CATGGAAAGATGTCAAAGATATG |
| 2149 | ATGGAAAGATGTCAAAGATATGT |
| 2150 | TGGAAAGATGTCAAAGATATGTT |
| 2151 | GGAAAGATGTCAAAGATATGTTA |
| 2152 | GAAAGATGTCAAAGATATGTTAA |
| 2153 | AAAGATGTCAAAGATATGTTAAG |
| 2154 | AAGATGTCAAAGATATGTTAAGT |
| 2155 | AGATGTCAAAGATATGTTAAGTG |
| 2156 | GATGTCAAAGATATGTTAAGTGT |
| 2157 | ATGTCAAAGATATGTTAAGTGTA |
| 2158 | TGTCAAAGATATGTTAAGTGTAA |
| 2159 | GTCAAAGATATGTTAAGTGTAAA |
| 2160 | TCAAAGATATGTTAAGTGTAAAA |

| ID | SEQUENCE |
|---|---|
| 2161 | CAAAGATATGTTAAGTGTAAAAT |
| 2162 | AAAGATATGTTAAGTGTAAAATG |
| 2163 | AAGATATGTTAAGTGTAAAATGC |
| 2164 | AGATATGTTAAGTGTAAAATGCA |
| 2165 | GATATGTTAAGTGTAAAATGCAA |
| 2166 | ATATGTTAAGTGTAAAATGCAAG |
| 2167 | TATGTTAAGTGTAAAATGCAAGT |
| 2168 | ATGTTAAGTGTAAAATGCAAGTG |
| 2169 | TGTTAAGTGTAAAATGCAAGTGG |
| 2170 | GTTAAGTGTAAAATGCAAGTGGC |
| 2171 | TTAAGTGTAAAATGCAAGTGGCA |
| 2172 | TAAGTGTAAAATGCAAGTGGCAA |
| 2173 | AAGTGTAAAATGCAAGTGGCAAA |
| 2174 | AGTGTAAAATGCAAGTGGCAAAA |
| 2175 | GTGTAAAATGCAAGTGGCAAAAC |
| 2176 | TGTAAAATGCAAGTGGCAAAACA |
| 2177 | GTAAAATGCAAGTGGCAAAACAC |
| 2178 | TAAAATGCAAGTGGCAAAACACT |
| 2179 | AAAATGCAAGTGGCAAAACACTA |
| 2180 | AAATGCAAGTGGCAAAACACTAT |
| 2181 | AATGCAAGTGGCAAAACACTATG |
| 2182 | ATGCAAGTGGCAAAACACTATGT |
| 2183 | TGCAAGTGGCAAAACACTATGTA |
| 2184 | GCAAGTGGCAAAACACTATGTAT |
| 2185 | CAAGTGGCAAAACACTATGTATA |
| 2186 | AAGTGGCAAAACACTATGTATAG |
| 2187 | AGTGGCAAAACACTATGTATAGT |
| 2188 | GTGGCAAAACACTATGTATAGTC |
| 2189 | TGGCAAAACACTATGTATAGTCT |
| 2190 | GGCAAAACACTATGTATAGTCTG |
| 2191 | GCAAAACACTATGTATAGTCTGA |
| 2192 | CAAAACACTATGTATAGTCTGAG |
| 2193 | AAAACACTATGTATAGTCTGAGC |
| 2194 | AAACACTATGTATAGTCTGAGCC |
| 2195 | AACACTATGTATAGTCTGAGCCA |
| 2196 | ACACTATGTATAGTCTGAGCCAG |
| 2197 | CACTATGTATAGTCTGAGCCAGA |
| 2198 | ACTATGTATAGTCTGAGCCAGAT |
| 2199 | CTATGTATAGTCTGAGCCAGATC |
| 2200 | TATGTATAGTCTGAGCCAGATCA |
| 2201 | ATGTATAGTCTGAGCCAGATCAA |
| 2202 | TGTATAGTCTGAGCCAGATCAAA |
| 2203 | GTATAGTCTGAGCCAGATCAAAG |
| 2204 | TATAGTCTGAGCCAGATCAAAGT |
| 2205 | ATAGTCTGAGCCAGATCAAAGTA |
| 2206 | TAGTCTGAGCCAGATCAAAGTAT |
| 2207 | AGTCTGAGCCAGATCAAAGTATG |
| 2208 | GTCTGAGCCAGATCAAAGTATGT |

| ID | SEQUENCE |
|---|---|
| 2209 | TCTGAGCCAGATCAAAGTATGTA |
| 2210 | CTGAGCCAGATCAAAGTATGTAT |
| 2211 | TGAGCCAGATCAAAGTATGTATG |
| 2212 | GAGCCAGATCAAAGTATGTATGT |
| 2213 | AGCCAGATCAAAGTATGTATGTT |
| 2214 | GCCAGATCAAAGTATGTATGTTT |
| 2215 | CCAGATCAAAGTATGTATGTTTT |
| 2216 | CAGATCAAAGTATGTATGTTTTT |
| 2217 | AGATCAAAGTATGTATGTTTTTA |
| 2218 | GATCAAAGTATGTATGTTTTTAA |
| 2219 | ATCAAAGTATGTATGTTTTTAAT |
| 2220 | TCAAAGTATGTATGTTTTTAATA |
| 2221 | CAAAGTATGTATGTTTTTAATAT |
| 2222 | AAAGTATGTATGTTTTTAATATG |
| 2223 | AAGTATGTATGTTTTTAATATGC |
| 2224 | AGTATGTATGTTTTTAATATGCA |
| 2225 | GTATGTATGTTTTTAATATGCAT |
| 2226 | TATGTATGTTTTTAATATGCATA |
| 2227 | ATGTATGTTTTTAATATGCATAG |
| 2228 | TGTATGTTTTTAATATGCATAGA |
| 2229 | GTATGTTTTTAATATGCATAGAA |
| 2230 | TATGTTTTTAATATGCATAGAAC |
| 2231 | ATGTTTTTAATATGCATAGAACA |
| 2232 | TGTTTTTAATATGCATAGAACAA |
| 2233 | GTTTTTAATATGCATAGAACAAA |
| 2234 | TTTTTAATATGCATAGAACAAAA |
| 2235 | TTTTAATATGCATAGAACAAAAG |
| 2236 | TTTAATATGCATAGAACAAAAGA |
| 2237 | TTAATATGCATAGAACAAAAGAT |
| 2238 | TAATATGCATAGAACAAAAGATT |
| 2239 | AATATGCATAGAACAAAAGATTT |
| 2240 | ATATGCATAGAACAAAAGATTTG |
| 2241 | TATGCATAGAACAAAAGATTTGG |
| 2242 | ATGCATAGAACAAAAGATTTGGA |
| 2243 | TGCATAGAACAAAAGATTTGGAA |
| 2244 | GCATAGAACAAAAGATTTGGAAA |
| 2245 | CATAGAACAAAAGATTTGGAAAG |
| 2246 | ATAGAACAAAAGATTTGGAAAGA |
| 2247 | TAGAACAAAAGATTTGGAAAGAT |
| 2248 | AGAACAAAAGATTTGGAAAGATA |
| 2249 | GAACAAAAGATTTGGAAAGATAT |
| 2250 | AACAAAAGATTTGGAAAGATATA |
| 2251 | ACAAAAGATTTGGAAAGATATAC |
| 2252 | CAAAAGATTTGGAAAGATATACA |
| 2253 | AAAAGATTTGGAAAGATATACAC |
| 2254 | AAAGATTTGGAAAGATATACACC |
| 2255 | AAGATTTGGAAAGATATACACCA |
| 2256 | AGATTTGGAAAGATATACACCAA |

| ID | SEQUENCE |
|---|---|
| 2257 | GATTTGGAAAGATATACACCAAA |
| 2258 | ATTTGGAAAGATATACACCAAAC |
| 2259 | TTTGGAAAGATATACACCAAACT |
| 2260 | TTGGAAAGATATACACCAAACTG |
| 2261 | TGGAAAGATATACACCAAACTGT |
| 2262 | GGAAAGATATACACCAAACTGTT |
| 2263 | GAAAGATATACACCAAACTGTTA |
| 2264 | AAAGATATACACCAAACTGTTAA |
| 2265 | AAGATATACACCAAACTGTTAAA |
| 2266 | AGATATACACCAAACTGTTAAAT |
| 2267 | GATATACACCAAACTGTTAAATG |
| 2268 | ATATACACCAAACTGTTAAATGT |
| 2269 | TATACACCAAACTGTTAAATGTG |
| 2270 | ATACACCAAACTGTTAAATGTGG |
| 2271 | TACACCAAACTGTTAAATGTGGT |
| 2272 | ACACCAAACTGTTAAATGTGGTT |
| 2273 | CACCAAACTGTTAAATGTGGTTT |
| 2274 | ACCAAACTGTTAAATGTGGTTTC |
| 2275 | CCAAACTGTTAAATGTGGTTTCT |
| 2276 | CAAACTGTTAAATGTGGTTTCTC |
| 2277 | AAACTGTTAAATGTGGTTTCTCT |
| 2278 | AACTGTTAAATGTGGTTTCTCTT |
| 2279 | ACTGTTAAATGTGGTTTCTCTTC |
| 2280 | CTGTTAAATGTGGTTTCTCTTCG |
| 2281 | TGTTAAATGTGGTTTCTCTTCGG |
| 2282 | GTTAAATGTGGTTTCTCTTCGGG |
| 2283 | TTAAATGTGGTTTCTCTTCGGGG |
| 2284 | TAAATGTGGTTTCTCTTCGGGGA |
| 2285 | AAATGTGGTTTCTCTTCGGGGAG |
| 2286 | AATGTGGTTTCTCTTCGGGGAGG |
| 2287 | ATGTGGTTTCTCTTCGGGGAGGG |
| 2288 | TGTGGTTTCTCTTCGGGGAGGGG |
| 2289 | GTGGTTTCTCTTCGGGGAGGGGG |
| 2290 | TGGTTTCTCTTCGGGGAGGGGGG |
| 2291 | GGTTTCTCTTCGGGGAGGGGGGG |
| 2292 | GTTTCTCTTCGGGGAGGGGGGGA |
| 2293 | TTTCTCTTCGGGGAGGGGGGGAT |
| 2294 | TTCTCTTCGGGGAGGGGGGGATT |
| 2295 | TCTCTTCGGGGAGGGGGGGATTG |
| 2296 | CTCTTCGGGGAGGGGGGGATTGG |
| 2297 | TCTTCGGGGAGGGGGGGATTGGG |
| 2298 | CTTCGGGGAGGGGGGGATTGGGG |
| 2299 | TTCGGGGAGGGGGGGATTGGGGG |
| 2300 | TCGGGGAGGGGGGGATTGGGGGA |
| 2301 | CGGGGAGGGGGGGATTGGGGGAG |
| 2302 | GGGGAGGGGGGGATTGGGGGAGG |
| 2303 | GGGAGGGGGGGATTGGGGGAGGG |
| 2304 | GGAGGGGGGGATTGGGGGAGGGG |

| ID | SEQUENCE |
|---|---|
| 2305 | GAGGGGGGGATTGGGGGAGGGGC |
| 2306 | AGGGGGGGATTGGGGGAGGGGCC |
| 2307 | GGGGGGGATTGGGGGAGGGGCCC |
| 2308 | GGGGGGATTGGGGGAGGGGCCCC |
| 2309 | GGGGGATTGGGGGAGGGGCCCCA |
| 2310 | GGGGATTGGGGGAGGGGCCCCAG |
| 2311 | GGGATTGGGGGAGGGGCCCCAGA |
| 2312 | GGATTGGGGGAGGGGCCCCAGAG |
| 2313 | GATTGGGGGAGGGGCCCCAGAGG |
| 2314 | ATTGGGGGAGGGGCCCCAGAGGG |
| 2315 | TTGGGGGAGGGGCCCCAGAGGGG |
| 2316 | TGGGGGAGGGGCCCCAGAGGGGT |
| 2317 | GGGGGAGGGGCCCCAGAGGGGTT |
| 2318 | GGGGAGGGGCCCCAGAGGGGTTT |
| 2319 | GGGAGGGGCCCCAGAGGGGTTTT |
| 2320 | GGAGGGGCCCCAGAGGGGTTTTA |
| 2321 | GAGGGGCCCCAGAGGGGTTTTAT |
| 2322 | AGGGGCCCCAGAGGGGTTTTATA |
| 2323 | GGGGCCCCAGAGGGGTTTTATAG |
| 2324 | GGGCCCCAGAGGGGTTTTATAGG |
| 2325 | GGCCCCAGAGGGGTTTTATAGGG |
| 2326 | GCCCCAGAGGGGTTTTATAGGGG |
| 2327 | CCCCAGAGGGGTTTTATAGGGGC |
| 2328 | CCCAGAGGGGTTTTATAGGGGCC |
| 2329 | CCAGAGGGGTTTTATAGGGGCCT |
| 2330 | CAGAGGGGTTTTATAGGGGCCTT |
| 2331 | AGAGGGGTTTTATAGGGGCCTTT |
| 2332 | GAGGGGTTTTATAGGGGCCTTTT |
| 2333 | AGGGGTTTTATAGGGGCCTTTTC |
| 2334 | GGGGTTTTATAGGGGCCTTTTCA |
| 2335 | GGGTTTTATAGGGGCCTTTTCAC |
| 2336 | GGTTTTATAGGGGCCTTTTCACT |
| 2337 | GTTTTATAGGGGCCTTTTCACTT |
| 2338 | TTTTATAGGGGCCTTTTCACTTT |
| 2339 | TTTATAGGGGCCTTTTCACTTTC |
| 2340 | TTATAGGGGCCTTTTCACTTTCT |
| 2341 | TATAGGGGCCTTTTCACTTTCTA |
| 2342 | ATAGGGGCCTTTTCACTTTCTAC |
| 2343 | TAGGGGCCTTTTCACTTTCTACT |
| 2344 | AGGGGCCTTTTCACTTTCTACTT |
| 2345 | GGGGCCTTTTCACTTTCTACTTT |
| 2346 | GGGCCTTTTCACTTTCTACTTTT |
| 2347 | GGCCTTTTCACTTTCTACTTTTT |
| 2348 | GCCTTTTCACTTTCTACTTTTTT |
| 2349 | CCTTTTCACTTTCTACTTTTTTC |
| 2350 | CTTTTCACTTTCTACTTTTTTCA |
| 2351 | TTTTCACTTTCTACTTTTTTCAT |
| 2352 | TTTCACTTTCTACTTTTTTCATT |

| ID | SEQUENCE |
|---|---|
| 2353 | TTCACTTTCTACTTTTTCATTT |
| 2354 | TCACTTTCTACTTTTTCATTTT |
| 2355 | CACTTTCTACTTTTTCATTTTG |
| 2356 | ACTTTCTACTTTTTCATTTTGT |
| 2357 | CTTTCTACTTTTTCATTTGTT |
| 2358 | TTTCTACTTTTTCATTTGTTC |
| 2359 | TTCTACTTTTTCATTTGTTCT |
| 2360 | TCTACTTTTTCATTTGTTCTG |
| 2361 | CTACTTTTTCATTTGTTCTGT |
| 2362 | TACTTTTTCATTTGTTCTGTT |
| 2363 | ACTTTTTCATTTGTTCTGTTC |
| 2364 | CTTTTTCATTTGTTCTGTTCG |
| 2365 | TTTTTCATTTGTTCTGTTCGA |
| 2366 | TTTTCATTTGTTCTGTTCGAA |
| 2367 | TTTCATTTGTTCTGTTCGAAT |
| 2368 | TTCATTTGTTCTGTTCGAATT |
| 2369 | TCATTTGTTCTGTTCGAATTT |
| 2370 | CATTTGTTCTGTTCGAATTTT |
| 2371 | ATTTGTTCTGTTCGAATTTTT |
| 2372 | TTTGTTCTGTTCGAATTTTTA |
| 2373 | TTGTTCTGTTCGAATTTTTAT |
| 2374 | TGTTCTGTTCGAATTTTTATA |
| 2375 | GTTCTGTTCGAATTTTTATAA |
| 2376 | TTCTGTTCGAATTTTTATAAG |
| 2377 | TCTGTTCGAATTTTTATAAGT |
| 2378 | CTGTTCGAATTTTTATAAGTA |
| 2379 | TGTTCGAATTTTTATAAGTAT |
| 2380 | GTTCGAATTTTTATAAGTATG |
| 2381 | TTCGAATTTTTATAAGTATGT |
| 2382 | TCGAATTTTTATAAGTATGTA |
| 2383 | CGAATTTTTATAAGTATGTAT |
| 2384 | GAATTTTTATAAGTATGTATT |
| 2385 | AATTTTTATAAGTATGTATTA |
| 2386 | ATTTTTATAAGTATGTATTAC |
| 2387 | TTTTTATAAGTATGTATTACT |
| 2388 | TTTTATAAGTATGTATTACTT |
| 2389 | TTTATAAGTATGTATTACTTT |
| 2390 | TTATAAGTATGTATTACTTTG |
| 2391 | TATAAGTATGTATTACTTTGT |
| 2392 | ATAAGTATGTATTACTTTGTA |
| 2393 | TAAGTATGTATTACTTTGTAA |
| 2394 | AAGTATGTATTACTTTGTAAT |
| 2395 | AGTATGTATTACTTTGTAATC |
| 2396 | GTATGTATTACTTTGTAATCA |
| 2397 | TATGTATTACTTTGTAATCAG |
| 2398 | ATGTATTACTTTGTAATCAGA |
| 2399 | GTATGTATTACTTTGTAATCAG |
| 2400 | TATGTATTACTTTGTAATCAGA |

| ID | SEQUENCE |
|---|---|
| 2401 | ATGTATTACTTTTGTAATCAGAA |
| 2402 | TGTATTACTTTTGTAATCAGAAT |
| 2403 | GTATTACTTTTGTAATCAGAATT |
| 2404 | TATTACTTTTGTAATCAGAATTT |
| 2405 | ATTACTTTTGTAATCAGAATTTT |
| 2406 | TTACTTTTGTAATCAGAATTTTT |
| 2407 | TACTTTTGTAATCAGAATTTTTA |
| 2408 | ACTTTTGTAATCAGAATTTTTAG |
| 2409 | CTTTTGTAATCAGAATTTTTAGA |
| 2410 | TTTTGTAATCAGAATTTTTAGAA |
| 2411 | TTTGTAATCAGAATTTTTAGAAA |
| 2412 | TTGTAATCAGAATTTTTAGAAAG |
| 2413 | TGTAATCAGAATTTTTAGAAAGT |
| 2414 | GTAATCAGAATTTTTAGAAAGTA |
| 2415 | TAATCAGAATTTTTAGAAAGTAT |
| 2416 | AATCAGAATTTTTAGAAAGTATT |
| 2417 | ATCAGAATTTTTAGAAAGTATTT |
| 2418 | TCAGAATTTTTAGAAAGTATTTT |
| 2419 | CAGAATTTTTAGAAAGTATTTTG |
| 2420 | AGAATTTTTAGAAAGTATTTTGC |
| 2421 | GAATTTTTAGAAAGTATTTTGCT |
| 2422 | AATTTTTAGAAAGTATTTTGCTG |
| 2423 | ATTTTTAGAAAGTATTTTGCTGA |
| 2424 | TTTTTAGAAAGTATTTTGCTGAT |
| 2425 | TTTTAGAAAGTATTTTGCTGATT |
| 2426 | TTTAGAAAGTATTTTGCTGATTT |
| 2427 | TTAGAAAGTATTTTGCTGATTTA |
| 2428 | TAGAAAGTATTTTGCTGATTTAA |
| 2429 | AGAAAGTATTTTGCTGATTTAAA |
| 2430 | GAAAGTATTTTGCTGATTTAAAG |
| 2431 | AAAGTATTTTGCTGATTTAAAGG |
| 2432 | AAGTATTTTGCTGATTTAAAGGC |
| 2433 | AGTATTTTGCTGATTTAAAGGCT |
| 2434 | GTATTTTGCTGATTTAAAGGCTT |
| 2435 | TATTTTGCTGATTTAAAGGCTTA |
| 2436 | ATTTTGCTGATTTAAAGGCTTAG |
| 2437 | TTTTGCTGATTTAAAGGCTTAGG |
| 2438 | TTTGCTGATTTAAAGGCTTAGGC |
| 2439 | TTGCTGATTTAAAGGCTTAGGCA |
| 2440 | TGCTGATTTAAAGGCTTAGGCAT |
| 2441 | GCTGATTTAAAGGCTTAGGCATG |
| 2442 | CTGATTTAAAGGCTTAGGCATGT |
| 2443 | TGATTTAAAGGCTTAGGCATGTT |
| 2444 | GATTTAAAGGCTTAGGCATGTTC |
| 2445 | ATTTAAAGGCTTAGGCATGTTCA |
| 2446 | TTTAAAGGCTTAGGCATGTTCAA |
| 2447 | TTAAAGGCTTAGGCATGTTCAAA |
| 2448 | TAAAGGCTTAGGCATGTTCAAAC |

| ID | SEQUENCE |
|---|---|
| 2449 | AAAGGCTTAGGCATGTTCAAACG |
| 2450 | AAGGCTTAGGCATGTTCAAACGC |
| 2451 | AGGCTTAGGCATGTTCAAACGCC |
| 2452 | GGCTTAGGCATGTTCAAACGCCT |
| 2453 | GCTTAGGCATGTTCAAACGCCTG |
| 2454 | CTTAGGCATGTTCAAACGCCTGC |
| 2455 | TTAGGCATGTTCAAACGCCTGCA |
| 2456 | TAGGCATGTTCAAACGCCTGCAA |
| 2457 | AGGCATGTTCAAACGCCTGCAAA |
| 2458 | GGCATGTTCAAACGCCTGCAAAA |
| 2459 | GCATGTTCAAACGCCTGCAAAAC |
| 2460 | CATGTTCAAACGCCTGCAAAACT |
| 2461 | ATGTTCAAACGCCTGCAAAACTA |
| 2462 | TGTTCAAACGCCTGCAAAACTAC |
| 2463 | GTTCAAACGCCTGCAAAACTACT |
| 2464 | TTCAAACGCCTGCAAAACTACTT |
| 2465 | TCAAACGCCTGCAAAACTACTTA |
| 2466 | CAAACGCCTGCAAAACTACTTAT |
| 2467 | AAACGCCTGCAAAACTACTTATC |
| 2468 | AACGCCTGCAAAACTACTTATCA |
| 2469 | ACGCCTGCAAAACTACTTATCAC |
| 2470 | CGCCTGCAAAACTACTTATCACT |
| 2471 | GCCTGCAAAACTACTTATCACTC |
| 2472 | CCTGCAAAACTACTTATCACTCA |
| 2473 | CTGCAAAACTACTTATCACTCAG |
| 2474 | TGCAAAACTACTTATCACTCAGC |
| 2475 | GCAAAACTACTTATCACTCAGCT |
| 2476 | CAAAACTACTTATCACTCAGCTT |
| 2477 | AAAACTACTTATCACTCAGCTTT |
| 2478 | AAACTACTTATCACTCAGCTTTA |
| 2479 | AACTACTTATCACTCAGCTTTAG |
| 2480 | ACTACTTATCACTCAGCTTTAGT |
| 2481 | CTACTTATCACTCAGCTTTAGTT |
| 2482 | TACTTATCACTCAGCTTTAGTTT |
| 2483 | ACTTATCACTCAGCTTTAGTTTT |
| 2484 | CTTATCACTCAGCTTTAGTTTTT |
| 2485 | TTATCACTCAGCTTTAGTTTTTC |
| 2486 | TATCACTCAGCTTTAGTTTTTCT |
| 2487 | ATCACTCAGCTTTAGTTTTTCTA |
| 2488 | TCACTCAGCTTTAGTTTTTCTAA |
| 2489 | CACTCAGCTTTAGTTTTTCTAAT |
| 2490 | ACTCAGCTTTAGTTTTTCTAATC |
| 2491 | CTCAGCTTTAGTTTTTCTAATCC |
| 2492 | TCAGCTTTAGTTTTTCTAATCCA |
| 2493 | CAGCTTTAGTTTTTCTAATCCAA |
| 2494 | AGCTTTAGTTTTTCTAATCCAAG |
| 2495 | GCTTTAGTTTTTCTAATCCAAGA |
| 2496 | CTTTAGTTTTTCTAATCCAAGAA |

| ID | SEQUENCE |
|---|---|
| 2497 | TTTAGTTTTTCTAATCCAAGAAG |
| 2498 | TTAGTTTTTCTAATCCAAGAAGG |
| 2499 | TAGTTTTTCTAATCCAAGAAGGC |
| 2500 | AGTTTTTCTAATCCAAGAAGGCA |
| 2501 | GTTTTTCTAATCCAAGAAGGCAG |
| 2502 | TTTTTCTAATCCAAGAAGGCAGG |
| 2503 | TTTTCTAATCCAAGAAGGCAGGG |
| 2504 | TTTCTAATCCAAGAAGGCAGGGC |
| 2505 | TTCTAATCCAAGAAGGCAGGGCA |
| 2506 | TCTAATCCAAGAAGGCAGGGCAG |
| 2507 | CTAATCCAAGAAGGCAGGGCAGT |
| 2508 | TAATCCAAGAAGGCAGGGCAGTT |
| 2509 | AATCCAAGAAGGCAGGGCAGTTA |
| 2510 | ATCCAAGAAGGCAGGGCAGTTAA |
| 2511 | TCCAAGAAGGCAGGGCAGTTAAC |
| 2512 | CCAAGAAGGCAGGGCAGTTAACC |
| 2513 | CAAGAAGGCAGGGCAGTTAACCT |
| 2514 | AAGAAGGCAGGGCAGTTAACCTT |
| 2515 | AGAAGGCAGGGCAGTTAACCTTT |
| 2516 | GAAGGCAGGGCAGTTAACCTTTT |
| 2517 | AAGGCAGGGCAGTTAACCTTTTT |
| 2518 | AGGCAGGGCAGTTAACCTTTTTG |
| 2519 | GGCAGGGCAGTTAACCTTTTTGG |
| 2520 | GCAGGGCAGTTAACCTTTTTGGT |
| 2521 | CAGGGCAGTTAACCTTTTTGGTG |
| 2522 | AGGGCAGTTAACCTTTTTGGTGC |
| 2523 | GGGCAGTTAACCTTTTTGGTGCC |
| 2524 | GGCAGTTAACCTTTTTGGTGCCA |
| 2525 | GCAGTTAACCTTTTTGGTGCCAA |
| 2526 | CAGTTAACCTTTTTGGTGCCAAT |
| 2527 | AGTTAACCTTTTTGGTGCCAATG |
| 2528 | GTTAACCTTTTTGGTGCCAATGT |
| 2529 | TTAACCTTTTTGGTGCCAATGTG |
| 2530 | TAACCTTTTTGGTGCCAATGTGA |
| 2531 | AACCTTTTTGGTGCCAATGTGAA |
| 2532 | ACCTTTTTGGTGCCAATGTGAAA |
| 2533 | CCTTTTTGGTGCCAATGTGAAAT |
| 2534 | CTTTTTGGTGCCAATGTGAAATG |
| 2535 | TTTTTGGTGCCAATGTGAAATGT |
| 2536 | TTTTGGTGCCAATGTGAAATGTA |
| 2537 | TTTGGTGCCAATGTGAAATGTAA |
| 2538 | TTGGTGCCAATGTGAAATGTAAA |
| 2539 | TGGTGCCAATGTGAAATGTAAAT |
| 2540 | GGTGCCAATGTGAAATGTAAATG |
| 2541 | GTGCCAATGTGAAATGTAAATGA |
| 2542 | TGCCAATGTGAAATGTAAATGAT |
| 2543 | GCCAATGTGAAATGTAAATGATT |
| 2544 | CCAATGTGAAATGTAAATGATTT |

| ID | SEQUENCE |
|---|---|
| 2545 | CAATGTGAAATGTAAATGATTTT |
| 2546 | AATGTGAAATGTAAATGATTTTA |
| 2547 | ATGTGAAATGTAAATGATTTTAT |
| 2548 | TGTGAAATGTAAATGATTTTATG |
| 2549 | GTGAAATGTAAATGATTTTATGT |
| 2550 | TGAAATGTAAATGATTTTATGTT |
| 2551 | GAAATGTAAATGATTTTATGTTT |
| 2552 | AAATGTAAATGATTTTATGTTTT |
| 2553 | AATGTAAATGATTTTATGTTTTT |
| 2554 | ATGTAAATGATTTTATGTTTTTC |
| 2555 | TGTAAATGATTTTATGTTTTTCC |
| 2556 | GTAAATGATTTTATGTTTTTCCT |
| 2557 | TAAATGATTTTATGTTTTTCCTG |
| 2558 | AAATGATTTTATGTTTTTCCTGC |
| 2559 | AATGATTTTATGTTTTTCCTGCT |
| 2560 | ATGATTTTATGTTTTTCCTGCTT |
| 2561 | TGATTTTATGTTTTTCCTGCTTT |
| 2562 | GATTTTATGTTTTTCCTGCTTTG |
| 2563 | ATTTTATGTTTTTCCTGCTTTGT |
| 2564 | TTTTATGTTTTTCCTGCTTTGTG |
| 2565 | TTTATGTTTTTCCTGCTTTGTGG |
| 2566 | TTATGTTTTTCCTGCTTTGTGGA |
| 2567 | TATGTTTTTCCTGCTTTGTGGAT |
| 2568 | ATGTTTTTCCTGCTTTGTGGATG |
| 2569 | TGTTTTTCCTGCTTTGTGGATGA |
| 2570 | GTTTTTCCTGCTTTGTGGATGAA |
| 2571 | TTTTTCCTGCTTTGTGGATGAAA |
| 2572 | TTTTCCTGCTTTGTGGATGAAAA |
| 2573 | TTTCCTGCTTTGTGGATGAAAAA |
| 2574 | TTCCTGCTTTGTGGATGAAAAAT |
| 2575 | TCCTGCTTTGTGGATGAAAAATA |
| 2576 | CCTGCTTTGTGGATGAAAAATAT |
| 2577 | CTGCTTTGTGGATGAAAAATATT |
| 2578 | TGCTTTGTGGATGAAAAATATTT |
| 2579 | GCTTTGTGGATGAAAAATATTTC |
| 2580 | CTTTGTGGATGAAAAATATTTCT |
| 2581 | TTTGTGGATGAAAAATATTTCTG |
| 2582 | TTGTGGATGAAAAATATTTCTGA |
| 2583 | TGTGGATGAAAAATATTTCTGAG |
| 2584 | GTGGATGAAAAATATTTCTGAGT |
| 2585 | TGGATGAAAAATATTTCTGAGTG |
| 2586 | GGATGAAAAATATTTCTGAGTGG |
| 2587 | GATGAAAAATATTTCTGAGTGGT |
| 2588 | ATGAAAAATATTTCTGAGTGGTA |
| 2589 | TGAAAAATATTTCTGAGTGGTAG |
| 2590 | GAAAAATATTTCTGAGTGGTAGT |
| 2591 | AAAAATATTTCTGAGTGGTAGTT |
| 2592 | AAAATATTTCTGAGTGGTAGTTT |

| ID | SEQUENCE |
|---|---|
| 2593 | AAATATTTCTGAGTGGTAGTTTT |
| 2594 | AATATTTCTGAGTGGTAGTTTTT |
| 2595 | ATATTTCTGAGTGGTAGTTTTTT |
| 2596 | TATTTCTGAGTGGTAGTTTTTTG |
| 2597 | ATTTCTGAGTGGTAGTTTTTTGA |
| 2598 | TTTCTGAGTGGTAGTTTTTTGAC |
| 2599 | TTCTGAGTGGTAGTTTTTTGACA |
| 2600 | TCTGAGTGGTAGTTTTTTGACAG |
| 2601 | CTGAGTGGTAGTTTTTTGACAGG |
| 2602 | TGAGTGGTAGTTTTTTGACAGGT |
| 2603 | GAGTGGTAGTTTTTTGACAGGTA |
| 2604 | AGTGGTAGTTTTTTGACAGGTAG |
| 2605 | GTGGTAGTTTTTTGACAGGTAGA |
| 2606 | TGGTAGTTTTTTGACAGGTAGAC |
| 2607 | GGTAGTTTTTTGACAGGTAGACC |
| 2608 | GTAGTTTTTTGACAGGTAGACCA |
| 2609 | TAGTTTTTTGACAGGTAGACCAT |
| 2610 | AGTTTTTTGACAGGTAGACCATG |
| 2611 | GTTTTTTGACAGGTAGACCATGT |
| 2612 | TTTTTTGACAGGTAGACCATGTC |
| 2613 | TTTTTGACAGGTAGACCATGTCT |
| 2614 | TTTTGACAGGTAGACCATGTCTT |
| 2615 | TTTGACAGGTAGACCATGTCTTA |
| 2616 | TTGACAGGTAGACCATGTCTTAT |
| 2617 | TGACAGGTAGACCATGTCTTATC |
| 2618 | GACAGGTAGACCATGTCTTATCT |
| 2619 | ACAGGTAGACCATGTCTTATCTT |
| 2620 | CAGGTAGACCATGTCTTATCTTG |
| 2621 | AGGTAGACCATGTCTTATCTTGT |
| 2622 | GGTAGACCATGTCTTATCTTGTT |
| 2623 | GTAGACCATGTCTTATCTTGTTT |
| 2624 | TAGACCATGTCTTATCTTGTTTC |
| 2625 | AGACCATGTCTTATCTTGTTTCA |
| 2626 | GACCATGTCTTATCTTGTTTCAA |
| 2627 | ACCATGTCTTATCTTGTTTCAAA |
| 2628 | CCATGTCTTATCTTGTTTCAAAA |
| 2629 | CATGTCTTATCTTGTTTCAAAAT |
| 2630 | ATGTCTTATCTTGTTTCAAAATA |
| 2631 | TGTCTTATCTTGTTTCAAAATAA |
| 2632 | GTCTTATCTTGTTTCAAAATAAG |
| 2633 | TCTTATCTTGTTTCAAAATAAGT |
| 2634 | CTTATCTTGTTTCAAAATAAGTA |
| 2635 | TTATCTTGTTTCAAAATAAGTAT |
| 2636 | TATCTTGTTTCAAAATAAGTATT |
| 2637 | ATCTTGTTTCAAAATAAGTATTT |
| 2638 | TCTTGTTTCAAAATAAGTATTTC |
| 2639 | CTTGTTTCAAAATAAGTATTTCT |
| 2640 | TTGTTTCAAAATAAGTATTTCTG |

| ID | SEQUENCE |
|---|---|
| 2641 | TGTTTCAAAATAAGTATTTCTGA |
| 2642 | GTTTCAAAATAAGTATTTCTGAT |
| 2643 | TTTCAAAATAAGTATTTCTGATT |
| 2644 | TTCAAAATAAGTATTTCTGATTT |
| 2645 | TCAAAATAAGTATTTCTGATTTT |
| 2646 | CAAAATAAGTATTTCTGATTTTG |
| 2647 | AAAATAAGTATTTCTGATTTTGT |
| 2648 | AAATAAGTATTTCTGATTTTGTA |
| 2649 | AATAAGTATTTCTGATTTTGTAA |
| 2650 | ATAAGTATTTCTGATTTTGTAAA |
| 2651 | TAAGTATTTCTGATTTTGTAAAA |
| 2652 | AAGTATTTCTGATTTTGTAAAAT |
| 2653 | AGTATTTCTGATTTTGTAAAATG |
| 2654 | GTATTTCTGATTTTGTAAAATGA |
| 2655 | TATTTCTGATTTTGTAAAATGAA |
| 2656 | ATTTCTGATTTTGTAAAATGAAA |
| 2657 | TTTCTGATTTTGTAAAATGAAAT |
| 2658 | TTCTGATTTTGTAAAATGAAATA |
| 2659 | TCTGATTTTGTAAAATGAAATAT |
| 2660 | CTGATTTTGTAAAATGAAATATA |
| 2661 | TGATTTTGTAAAATGAAATATAA |
| 2662 | GATTTTGTAAAATGAAATATAAA |
| 2663 | ATTTTGTAAAATGAAATATAAAA |
| 2664 | TTTTGTAAAATGAAATATAAAAT |
| 2665 | TTTGTAAAATGAAATATAAAATA |
| 2666 | TTGTAAAATGAAATATAAAATAT |
| 2667 | TGTAAAATGAAATATAAAATATG |
| 2668 | GTAAAATGAAATATAAAATATGT |
| 2669 | TAAAATGAAATATAAAATATGTC |
| 2670 | AAAATGAAATATAAAATATGTCT |
| 2671 | AAATGAAATATAAAATATGTCTC |
| 2672 | AATGAAATATAAAATATGTCTCA |
| 2673 | ATGAAATATAAAATATGTCTCAG |
| 2674 | TGAAATATAAAATATGTCTCAGA |
| 2675 | GAAATATAAAATATGTCTCAGAT |
| 2676 | AAATATAAAATATGTCTCAGATC |
| 2677 | AATATAAAATATGTCTCAGATCT |
| 2678 | ATATAAAATATGTCTCAGATCTT |
| 2679 | TATAAAATATGTCTCAGATCTTC |
| 2680 | ATAAAATATGTCTCAGATCTTCC |
| 2681 | TAAAATATGTCTCAGATCTTCCA |
| 2682 | AAAATATGTCTCAGATCTTCCAA |
| 2683 | AAATATGTCTCAGATCTTCCAAT |
| 2684 | AATATGTCTCAGATCTTCCAATT |
| 2685 | ATATGTCTCAGATCTTCCAATTA |
| 2686 | TATGTCTCAGATCTTCCAATTAA |
| 2687 | ATGTCTCAGATCTTCCAATTAAT |
| 2688 | TGTCTCAGATCTTCCAATTAATT |

| ID | SEQUENCE |
|---|---|
| 2689 | GTCTCAGATCTTCCAATTAATTA |
| 2690 | TCTCAGATCTTCCAATTAATTAG |
| 2691 | CTCAGATCTTCCAATTAATTAGT |
| 2692 | TCAGATCTTCCAATTAATTAGTA |
| 2693 | CAGATCTTCCAATTAATTAGTAA |
| 2694 | AGATCTTCCAATTAATTAGTAAG |
| 2695 | GATCTTCCAATTAATTAGTAAGG |
| 2696 | ATCTTCCAATTAATTAGTAAGGA |
| 2697 | TCTTCCAATTAATTAGTAAGGAT |
| 2698 | CTTCCAATTAATTAGTAAGGATT |
| 2699 | TTCCAATTAATTAGTAAGGATTC |
| 2700 | TCCAATTAATTAGTAAGGATTCA |
| 2701 | CCAATTAATTAGTAAGGATTCAT |
| 2702 | CAATTAATTAGTAAGGATTCATC |
| 2703 | AATTAATTAGTAAGGATTCATCC |
| 2704 | ATTAATTAGTAAGGATTCATCCT |
| 2705 | TTAATTAGTAAGGATTCATCCTT |
| 2706 | TAATTAGTAAGGATTCATCCTTA |
| 2707 | AATTAGTAAGGATTCATCCTTAA |
| 2708 | ATTAGTAAGGATTCATCCTTAAT |
| 2709 | TTAGTAAGGATTCATCCTTAATC |
| 2710 | TAGTAAGGATTCATCCTTAATCC |
| 2711 | AGTAAGGATTCATCCTTAATCCT |
| 2712 | GTAAGGATTCATCCTTAATCCTT |
| 2713 | TAAGGATTCATCCTTAATCCTTG |
| 2714 | AAGGATTCATCCTTAATCCTTGC |
| 2715 | AGGATTCATCCTTAATCCTTGCT |
| 2716 | GGATTCATCCTTAATCCTTGCTA |
| 2717 | GATTCATCCTTAATCCTTGCTAG |
| 2718 | ATTCATCCTTAATCCTTGCTAGT |
| 2719 | TTCATCCTTAATCCTTGCTAGTT |
| 2720 | TCATCCTTAATCCTTGCTAGTTT |
| 2721 | CATCCTTAATCCTTGCTAGTTTA |
| 2722 | ATCCTTAATCCTTGCTAGTTTAA |
| 2723 | TCCTTAATCCTTGCTAGTTTAAG |
| 2724 | CCTTAATCCTTGCTAGTTTAAGC |
| 2725 | CTTAATCCTTGCTAGTTTAAGCC |
| 2726 | TTAATCCTTGCTAGTTTAAGCCT |
| 2727 | TAATCCTTGCTAGTTTAAGCCTG |
| 2728 | AATCCTTGCTAGTTTAAGCCTGC |
| 2729 | ATCCTTGCTAGTTTAAGCCTGCC |
| 2730 | TCCTTGCTAGTTTAAGCCTGCCT |
| 2731 | CCTTGCTAGTTTAAGCCTGCCTA |
| 2732 | CTTGCTAGTTTAAGCCTGCCTAA |
| 2733 | TTGCTAGTTTAAGCCTGCCTAAG |
| 2734 | TGCTAGTTTAAGCCTGCCTAAGT |
| 2735 | GCTAGTTTAAGCCTGCCTAAGTC |
| 2736 | CTAGTTTAAGCCTGCCTAAGTCA |

| ID | SEQUENCE |
|---|---|
| 2737 | TAGTTTAAGCCTGCCTAAGTCAC |
| 2738 | AGTTTAAGCCTGCCTAAGTCACT |
| 2739 | GTTTAAGCCTGCCTAAGTCACTT |
| 2740 | TTTAAGCCTGCCTAAGTCACTTT |
| 2741 | TTAAGCCTGCCTAAGTCACTTTA |
| 2742 | TAAGCCTGCCTAAGTCACTTTAC |
| 2743 | AAGCCTGCCTAAGTCACTTTACT |
| 2744 | AGCCTGCCTAAGTCACTTTACTA |
| 2745 | GCCTGCCTAAGTCACTTTACTAA |
| 2746 | CCTGCCTAAGTCACTTTACTAAA |
| 2747 | CTGCCTAAGTCACTTTACTAAAA |
| 2748 | TGCCTAAGTCACTTTACTAAAAG |
| 2749 | GCCTAAGTCACTTTACTAAAAGA |
| 2750 | CCTAAGTCACTTTACTAAAAGAT |
| 2751 | CTAAGTCACTTTACTAAAAGATC |
| 2752 | TAAGTCACTTTACTAAAAGATCT |
| 2753 | AAGTCACTTTACTAAAAGATCTT |
| 2754 | AGTCACTTTACTAAAAGATCTTT |
| 2755 | GTCACTTTACTAAAAGATCTTTG |
| 2756 | TCACTTTACTAAAAGATCTTTGT |
| 2757 | CACTTTACTAAAAGATCTTTGTT |
| 2758 | ACTTTACTAAAAGATCTTTGTTA |
| 2759 | CTTTACTAAAAGATCTTTGTTAA |
| 2760 | TTTACTAAAAGATCTTTGTTAAC |
| 2761 | TTACTAAAAGATCTTTGTTAACT |
| 2762 | TACTAAAAGATCTTTGTTAACTC |
| 2763 | ACTAAAAGATCTTTGTTAACTCA |
| 2764 | CTAAAAGATCTTTGTTAACTCAG |
| 2765 | TAAAAGATCTTTGTTAACTCAGT |
| 2766 | AAAAGATCTTTGTTAACTCAGTA |
| 2767 | AAAGATCTTTGTTAACTCAGTAT |
| 2768 | AAGATCTTTGTTAACTCAGTATT |
| 2769 | AGATCTTTGTTAACTCAGTATTT |
| 2770 | GATCTTTGTTAACTCAGTATTTT |
| 2771 | ATCTTTGTTAACTCAGTATTTTA |
| 2772 | TCTTTGTTAACTCAGTATTTTAA |
| 2773 | CTTTGTTAACTCAGTATTTTAAA |
| 2774 | TTTGTTAACTCAGTATTTTAAAC |
| 2775 | TTGTTAACTCAGTATTTTAAACA |
| 2776 | TGTTAACTCAGTATTTTAAACAT |
| 2777 | GTTAACTCAGTATTTTAAACATC |
| 2778 | TTAACTCAGTATTTTAAACATCT |
| 2779 | TAACTCAGTATTTTAAACATCTG |
| 2780 | AACTCAGTATTTTAAACATCTGT |
| 2781 | ACTCAGTATTTTAAACATCTGTC |
| 2782 | CTCAGTATTTTAAACATCTGTCA |
| 2783 | TCAGTATTTTAAACATCTGTCAG |
| 2784 | CAGTATTTTAAACATCTGTCAGC |

| ID | SEQUENCE |
|---|---|
| 2785 | AGTATTTTAAACATCTGTCAGCT |
| 2786 | GTATTTTAAACATCTGTCAGCTT |
| 2787 | TATTTTAAACATCTGTCAGCTTA |
| 2788 | ATTTTAAACATCTGTCAGCTTAT |
| 2789 | TTTTAAACATCTGTCAGCTTATG |
| 2790 | TTTAAACATCTGTCAGCTTATGT |
| 2791 | TTAAACATCTGTCAGCTTATGTA |
| 2792 | TAAACATCTGTCAGCTTATGTAG |
| 2793 | AAACATCTGTCAGCTTATGTAGG |
| 2794 | AACATCTGTCAGCTTATGTAGGT |
| 2795 | ACATCTGTCAGCTTATGTAGGTA |
| 2796 | CATCTGTCAGCTTATGTAGGTAA |
| 2797 | ATCTGTCAGCTTATGTAGGTAAA |
| 2798 | TCTGTCAGCTTATGTAGGTAAAA |
| 2799 | CTGTCAGCTTATGTAGGTAAAAG |
| 2800 | TGTCAGCTTATGTAGGTAAAAGT |
| 2801 | GTCAGCTTATGTAGGTAAAAGTA |
| 2802 | TCAGCTTATGTAGGTAAAAGTAG |
| 2803 | CAGCTTATGTAGGTAAAAGTAGA |
| 2804 | AGCTTATGTAGGTAAAAGTAGAA |
| 2805 | GCTTATGTAGGTAAAAGTAGAAG |
| 2806 | CTTATGTAGGTAAAAGTAGAAGC |
| 2807 | TTATGTAGGTAAAAGTAGAAGCA |
| 2808 | TATGTAGGTAAAAGTAGAAGCAT |
| 2809 | ATGTAGGTAAAAGTAGAAGCATG |
| 2810 | TGTAGGTAAAAGTAGAAGCATGT |
| 2811 | GTAGGTAAAAGTAGAAGCATGTT |
| 2812 | TAGGTAAAAGTAGAAGCATGTTT |
| 2813 | AGGTAAAAGTAGAAGCATGTTTG |
| 2814 | GGTAAAAGTAGAAGCATGTTTGT |
| 2815 | GTAAAAGTAGAAGCATGTTTGTA |
| 2816 | TAAAAGTAGAAGCATGTTTGTAC |
| 2817 | AAAAGTAGAAGCATGTTTGTACA |
| 2818 | AAAGTAGAAGCATGTTTGTACAC |
| 2819 | AAGTAGAAGCATGTTTGTACACT |
| 2820 | AGTAGAAGCATGTTTGTACACTG |
| 2821 | GTAGAAGCATGTTTGTACACTGC |
| 2822 | TAGAAGCATGTTTGTACACTGCT |
| 2823 | AGAAGCATGTTTGTACACTGCTT |
| 2824 | GAAGCATGTTTGTACACTGCTTG |
| 2825 | AAGCATGTTTGTACACTGCTTGT |
| 2826 | AGCATGTTTGTACACTGCTTGTA |
| 2827 | GCATGTTTGTACACTGCTTGTAG |
| 2828 | CATGTTTGTACACTGCTTGTAGT |
| 2829 | ATGTTTGTACACTGCTTGTAGTT |
| 2830 | TGTTTGTACACTGCTTGTAGTTA |
| 2831 | GTTTGTACACTGCTTGTAGTTAT |
| 2832 | TTTGTACACTGCTTGTAGTTATA |

| ID | SEQUENCE |
|---|---|
| 2833 | TTGTACACTGCTTGTAGTTATAG |
| 2834 | TGTACACTGCTTGTAGTTATAGT |
| 2835 | GTACACTGCTTGTAGTTATAGTG |
| 2836 | TACACTGCTTGTAGTTATAGTGA |
| 2837 | ACACTGCTTGTAGTTATAGTGAC |
| 2838 | CACTGCTTGTAGTTATAGTGACA |
| 2839 | ACTGCTTGTAGTTATAGTGACAG |
| 2840 | CTGCTTGTAGTTATAGTGACAGC |
| 2841 | TGCTTGTAGTTATAGTGACAGCT |
| 2842 | GCTTGTAGTTATAGTGACAGCTT |
| 2843 | CTTGTAGTTATAGTGACAGCTTT |
| 2844 | TTGTAGTTATAGTGACAGCTTTC |
| 2845 | TGTAGTTATAGTGACAGCTTTCC |
| 2846 | GTAGTTATAGTGACAGCTTTCCA |
| 2847 | TAGTTATAGTGACAGCTTTCCAT |
| 2848 | AGTTATAGTGACAGCTTTCCATG |
| 2849 | GTTATAGTGACAGCTTTCCATGT |
| 2850 | TTATAGTGACAGCTTTCCATGTT |
| 2851 | TATAGTGACAGCTTTCCATGTTG |
| 2852 | ATAGTGACAGCTTTCCATGTTGA |
| 2853 | TAGTGACAGCTTTCCATGTTGAG |
| 2854 | AGTGACAGCTTTCCATGTTGAGA |
| 2855 | GTGACAGCTTTCCATGTTGAGAT |
| 2856 | TGACAGCTTTCCATGTTGAGATT |
| 2857 | GACAGCTTTCCATGTTGAGATTC |
| 2858 | ACAGCTTTCCATGTTGAGATTCT |
| 2859 | CAGCTTTCCATGTTGAGATTCTC |
| 2860 | AGCTTTCCATGTTGAGATTCTCA |
| 2861 | GCTTTCCATGTTGAGATTCTCAT |
| 2862 | CTTTCCATGTTGAGATTCTCATA |
| 2863 | TTTCCATGTTGAGATTCTCATAT |
| 2864 | TTCCATGTTGAGATTCTCATATC |
| 2865 | TCCATGTTGAGATTCTCATATCA |
| 2866 | CCATGTTGAGATTCTCATATCAT |
| 2867 | CATGTTGAGATTCTCATATCATC |
| 2868 | ATGTTGAGATTCTCATATCATCT |
| 2869 | TGTTGAGATTCTCATATCATCTT |
| 2870 | GTTGAGATTCTCATATCATCTTG |
| 2871 | TTGAGATTCTCATATCATCTTGT |
| 2872 | TGAGATTCTCATATCATCTTGTA |
| 2873 | GAGATTCTCATATCATCTTGTAT |
| 2874 | AGATTCTCATATCATCTTGTATC |
| 2875 | GATTCTCATATCATCTTGTATCT |
| 2876 | ATTCTCATATCATCTTGTATCTT |
| 2877 | TTCTCATATCATCTTGTATCTTA |
| 2878 | TCTCATATCATCTTGTATCTTAA |
| 2879 | CTCATATCATCTTGTATCTTAAA |
| 2880 | TCATATCATCTTGTATCTTAAAG |

| ID | SEQUENCE |
|---|---|
| 2881 | CATATCATCTTGTATCTTAAAGT |
| 2882 | ATATCATCTTGTATCTTAAAGTT |
| 2883 | TATCATCTTGTATCTTAAAGTTT |
| 2884 | ATCATCTTGTATCTTAAAGTTTC |
| 2885 | TCATCTTGTATCTTAAAGTTTCA |
| 2886 | CATCTTGTATCTTAAAGTTTCAT |
| 2887 | ATCTTGTATCTTAAAGTTTCATG |
| 2888 | TCTTGTATCTTAAAGTTTCATGT |
| 2889 | CTTGTATCTTAAAGTTTCATGTG |
| 2890 | TTGTATCTTAAAGTTTCATGTGA |
| 2891 | TGTATCTTAAAGTTTCATGTGAG |
| 2892 | GTATCTTAAAGTTTCATGTGAGT |
| 2893 | TATCTTAAAGTTTCATGTGAGTT |
| 2894 | ATCTTAAAGTTTCATGTGAGTTT |
| 2895 | TCTTAAAGTTTCATGTGAGTTTT |
| 2896 | CTTAAAGTTTCATGTGAGTTTTT |
| 2897 | TTAAAGTTTCATGTGAGTTTTTA |
| 2898 | TAAAGTTTCATGTGAGTTTTTAC |
| 2899 | AAAGTTTCATGTGAGTTTTTACC |
| 2900 | AAGTTTCATGTGAGTTTTTACCG |
| 2901 | AGTTTCATGTGAGTTTTTACCGT |
| 2902 | GTTTCATGTGAGTTTTTACCGTT |
| 2903 | TTTCATGTGAGTTTTTACCGTTA |
| 2904 | TTCATGTGAGTTTTTACCGTTAG |
| 2905 | TCATGTGAGTTTTTACCGTTAGG |
| 2906 | CATGTGAGTTTTTACCGTTAGGA |
| 2907 | ATGTGAGTTTTTACCGTTAGGAT |
| 2908 | TGTGAGTTTTTACCGTTAGGATG |
| 2909 | GTGAGTTTTTACCGTTAGGATGA |
| 2910 | TGAGTTTTTACCGTTAGGATGAT |
| 2911 | GAGTTTTTACCGTTAGGATGATT |
| 2912 | AGTTTTTACCGTTAGGATGATTA |
| 2913 | GTTTTTACCGTTAGGATGATTAA |
| 2914 | TTTTTACCGTTAGGATGATTAAG |
| 2915 | TTTTACCGTTAGGATGATTAAGA |
| 2916 | TTTACCGTTAGGATGATTAAGAT |
| 2917 | TTACCGTTAGGATGATTAAGATG |
| 2918 | TACCGTTAGGATGATTAAGATGT |
| 2919 | ACCGTTAGGATGATTAAGATGTA |
| 2920 | CCGTTAGGATGATTAAGATGTAT |
| 2921 | CGTTAGGATGATTAAGATGTATA |
| 2922 | GTTAGGATGATTAAGATGTATAT |
| 2923 | TTAGGATGATTAAGATGTATATA |
| 2924 | TAGGATGATTAAGATGTATATAG |
| 2925 | AGGATGATTAAGATGTATATAGG |
| 2926 | GGATGATTAAGATGTATATAGGA |
| 2927 | GATGATTAAGATGTATATAGGAC |
| 2928 | ATGATTAAGATGTATATAGGACA |

| ID | SEQUENCE |
|---|---|
| 2929 | TGATTAAGATGTATATAGGACAA |
| 2930 | GATTAAGATGTATATAGGACAAA |
| 2931 | ATTAAGATGTATATAGGACAAAA |
| 2932 | TTAAGATGTATATAGGACAAAAT |
| 2933 | TAAGATGTATATAGGACAAAATG |
| 2934 | AAGATGTATATAGGACAAAATGT |
| 2935 | AGATGTATATAGGACAAAATGTT |
| 2936 | GATGTATATAGGACAAAATGTTA |
| 2937 | ATGTATATAGGACAAAATGTTAA |
| 2938 | TGTATATAGGACAAAATGTTAAG |
| 2939 | GTATATAGGACAAAATGTTAAGT |
| 2940 | TATATAGGACAAAATGTTAAGTC |
| 2941 | ATATAGGACAAAATGTTAAGTCT |
| 2942 | TATAGGACAAAATGTTAAGTCTT |
| 2943 | ATAGGACAAAATGTTAAGTCTTT |
| 2944 | TAGGACAAAATGTTAAGTCTTTC |
| 2945 | AGGACAAAATGTTAAGTCTTTCC |
| 2946 | GGACAAAATGTTAAGTCTTTCCT |
| 2947 | GACAAAATGTTAAGTCTTTCCTC |
| 2948 | ACAAAATGTTAAGTCTTTCCTCT |
| 2949 | CAAAATGTTAAGTCTTTCCTCTA |
| 2950 | AAAATGTTAAGTCTTTCCTCTAC |
| 2951 | AAATGTTAAGTCTTTCCTCTACC |
| 2952 | AATGTTAAGTCTTTCCTCTACCT |
| 2953 | ATGTTAAGTCTTTCCTCTACCTA |
| 2954 | TGTTAAGTCTTTCCTCTACCTAC |
| 2955 | GTTAAGTCTTTCCTCTACCTACA |
| 2956 | TTAAGTCTTTCCTCTACCTACAT |
| 2957 | TAAGTCTTTCCTCTACCTACATT |
| 2958 | AAGTCTTTCCTCTACCTACATTT |
| 2959 | AGTCTTTCCTCTACCTACATTTG |
| 2960 | GTCTTTCCTCTACCTACATTTGT |
| 2961 | TCTTTCCTCTACCTACATTTGTT |
| 2962 | CTTTCCTCTACCTACATTTGTTT |
| 2963 | TTTCCTCTACCTACATTTGTTTT |
| 2964 | TTCCTCTACCTACATTTGTTTTC |
| 2965 | TCCTCTACCTACATTTGTTTTCT |
| 2966 | CCTCTACCTACATTTGTTTTCTT |
| 2967 | CTCTACCTACATTTGTTTTCTTG |
| 2968 | TCTACCTACATTTGTTTTCTTGG |
| 2969 | CTACCTACATTTGTTTTCTTGGC |
| 2970 | TACCTACATTTGTTTTCTTGGCT |
| 2971 | ACCTACATTTGTTTTCTTGGCTA |
| 2972 | CCTACATTTGTTTTCTTGGCTAG |
| 2973 | CTACATTTGTTTTCTTGGCTAGT |
| 2974 | TACATTTGTTTTCTTGGCTAGTA |
| 2975 | ACATTTGTTTTCTTGGCTAGTAA |
| 2976 | CATTTGTTTTCTTGGCTAGTAAT |

| ID | SEQUENCE |
|---|---|
| 2977 | ATTTGTTTTCTTGGCTAGTAATA |
| 2978 | TTTGTTTTCTTGGCTAGTAATAG |
| 2979 | TTGTTTTCTTGGCTAGTAATAGT |
| 2980 | TGTTTTCTTGGCTAGTAATAGTA |
| 2981 | GTTTTCTTGGCTAGTAATAGTAG |
| 2982 | TTTTCTTGGCTAGTAATAGTAGT |
| 2983 | TTTCTTGGCTAGTAATAGTAGTA |
| 2984 | TTCTTGGCTAGTAATAGTAGTAG |
| 2985 | TCTTGGCTAGTAATAGTAGTAGA |
| 2986 | CTTGGCTAGTAATAGTAGTAGAT |
| 2987 | TTGGCTAGTAATAGTAGTAGATA |
| 2988 | TGGCTAGTAATAGTAGTAGATAC |
| 2989 | GGCTAGTAATAGTAGTAGATACT |
| 2990 | GCTAGTAATAGTAGTAGATACTT |
| 2991 | CTAGTAATAGTAGTAGATACTTC |
| 2992 | TAGTAATAGTAGTAGATACTTCT |
| 2993 | AGTAATAGTAGTAGATACTTCTG |
| 2994 | GTAATAGTAGTAGATACTTCTGA |
| 2995 | TAATAGTAGTAGATACTTCTGAA |
| 2996 | AATAGTAGTAGATACTTCTGAAA |
| 2997 | ATAGTAGTAGATACTTCTGAAAT |
| 2998 | TAGTAGTAGATACTTCTGAAATA |
| 2999 | AGTAGTAGATACTTCTGAAATAA |
| 3000 | GTAGTAGATACTTCTGAAATAAA |
| 3001 | TAGTAGATACTTCTGAAATAAAT |
| 3002 | AGTAGATACTTCTGAAATAAATG |
| 3003 | GTAGATACTTCTGAAATAAATGT |
| 3004 | TAGATACTTCTGAAATAAATGTT |
| 3005 | AGATACTTCTGAAATAAATGTTC |
| 3006 | GATACTTCTGAAATAAATGTTCT |
| 3007 | ATACTTCTGAAATAAATGTTCTC |
| 3008 | TACTTCTGAAATAAATGTTCTCT |
| 3009 | ACTTCTGAAATAAATGTTCTCTC |
| 3010 | CTTCTGAAATAAATGTTCTCTCA |
| 3011 | TTCTGAAATAAATGTTCTCTCAA |
| 3012 | TCTGAAATAAATGTTCTCTCAAG |
| 3013 | CTGAAATAAATGTTCTCTCAAGA |
| 3014 | TGAAATAAATGTTCTCTCAAGAT |
| 3015 | GAAATAAATGTTCTCTCAAGATC |
| 3016 | AAATAAATGTTCTCTCAAGATCC |
| 3017 | AATAAATGTTCTCTCAAGATCCT |
| 3018 | ATAAATGTTCTCTCAAGATCCTT |
| 3019 | TAAATGTTCTCTCAAGATCCTTA |
| 3020 | AAATGTTCTCTCAAGATCCTTAA |
| 3021 | AATGTTCTCTCAAGATCCTTAAA |
| 3022 | ATGTTCTCTCAAGATCCTTAAAA |
| 3023 | TGTTCTCTCAAGATCCTTAAAAC |
| 3024 | GTTCTCTCAAGATCCTTAAAACC |

| ID | SEQUENCE |
|---|---|
| 3025 | TTCTCTCAAGATCCTTAAAACCT |
| 3026 | TCTCTCAAGATCCTTAAAACCTC |
| 3027 | CTCTCAAGATCCTTAAAACCTCT |
| 3028 | TCTCAAGATCCTTAAAACCTCTT |
| 3029 | CTCAAGATCCTTAAAACCTCTTG |
| 3030 | TCAAGATCCTTAAAACCTCTTGG |
| 3031 | CAAGATCCTTAAAACCTCTTGGA |
| 3032 | AAGATCCTTAAAACCTCTTGGAA |
| 3033 | AGATCCTTAAAACCTCTTGGAAA |
| 3034 | GATCCTTAAAACCTCTTGGAAAT |
| 3035 | ATCCTTAAAACCTCTTGGAAATT |
| 3036 | TCCTTAAAACCTCTTGGAAATTA |
| 3037 | CCTTAAAACCTCTTGGAAATTAT |
| 3038 | CTTAAAACCTCTTGGAAATTATA |
| 3039 | TTAAAACCTCTTGGAAATTATAA |
| 3040 | TAAAACCTCTTGGAAATTATAAA |
| 3041 | AAAACCTCTTGGAAATTATAAAA |
| 3042 | AAACCTCTTGGAAATTATAAAAA |
| 3043 | AACCTCTTGGAAATTATAAAAAT |
| 3044 | ACCTCTTGGAAATTATAAAAATA |
| 3045 | CCTCTTGGAAATTATAAAAATAT |
| 3046 | CTCTTGGAAATTATAAAAATATT |
| 3047 | TCTTGGAAATTATAAAAATATTG |
| 3048 | CTTGGAAATTATAAAAATATTGG |
| 3049 | TTGGAAATTATAAAAATATTGGC |
| 3050 | TGGAAATTATAAAAATATTGGCA |
| 3051 | GGAAATTATAAAAATATTGGCAA |
| 3052 | GAAATTATAAAAATATTGGCAAG |
| 3053 | AAATTATAAAAATATTGGCAAGA |
| 3054 | AATTATAAAAATATTGGCAAGAA |
| 3055 | ATTATAAAAATATTGGCAAGAAA |
| 3056 | TTATAAAAATATTGGCAAGAAAA |
| 3057 | TATAAAAATATTGGCAAGAAAAG |
| 3058 | ATAAAAATATTGGCAAGAAAAGA |
| 3059 | TAAAAATATTGGCAAGAAAAGAA |
| 3060 | AAAAATATTGGCAAGAAAAGAAG |
| 3061 | AAAATATTGGCAAGAAAAGAAGA |
| 3062 | AAATATTGGCAAGAAAAGAAGAA |
| 3063 | AATATTGGCAAGAAAAGAAGAAT |
| 3064 | ATATTGGCAAGAAAAGAAGAATA |
| 3065 | TATTGGCAAGAAAAGAAGAATAG |
| 3066 | ATTGGCAAGAAAAGAAGAATAGT |
| 3067 | TTGGCAAGAAAAGAAGAATAGTT |
| 3068 | TGGCAAGAAAAGAAGAATAGTTG |
| 3069 | GGCAAGAAAAGAAGAATAGTTGT |
| 3070 | GCAAGAAAAGAAGAATAGTTGTT |
| 3071 | CAAGAAAAGAAGAATAGTTGTTT |
| 3072 | AAGAAAAGAAGAATAGTTGTTTA |

| ID | SEQUENCE |
|---|---|
| 3073 | AGAAAAGAAGAATAGTTGTTTAA |
| 3074 | GAAAAGAAGAATAGTTGTTTAAA |
| 3075 | AAAAGAAGAATAGTTGTTTAAAT |
| 3076 | AAAGAAGAATAGTTGTTTAAATA |
| 3077 | AAGAAGAATAGTTGTTTAAATAT |
| 3078 | AGAAGAATAGTTGTTTAAATATT |
| 3079 | GAAGAATAGTTGTTTAAATATTT |
| 3080 | AAGAATAGTTGTTTAAATATTTT |
| 3081 | AGAATAGTTGTTTAAATATTTTT |
| 3082 | GAATAGTTGTTTAAATATTTTTT |
| 3083 | AATAGTTGTTTAAATATTTTTTA |
| 3084 | ATAGTTGTTTAAATATTTTTTAA |
| 3085 | TAGTTGTTTAAATATTTTTTAAA |
| 3086 | AGTTGTTTAAATATTTTTTAAAA |
| 3087 | GTTGTTTAAATATTTTTTAAAAA |
| 3088 | TTGTTTAAATATTTTTTAAAAAA |
| 3089 | TGTTTAAATATTTTTTAAAAAAC |
| 3090 | GTTTAAATATTTTTTAAAAAACA |
| 3091 | TTTAAATATTTTTTAAAAAACAC |
| 3092 | TTAAATATTTTTTAAAAAACACT |
| 3093 | TAAATATTTTTTAAAAAACACTT |
| 3094 | AAATATTTTTTAAAAAACACTTG |
| 3095 | AATATTTTTTAAAAAACACTTGA |
| 3096 | ATATTTTTTAAAAAACACTTGAA |
| 3097 | TATTTTTTAAAAAACACTTGAAT |
| 3098 | ATTTTTTAAAAAACACTTGAATA |
| 3099 | TTTTTTAAAAAACACTTGAATAA |
| 3100 | TTTTTAAAAAACACTTGAATAAG |
| 3101 | TTTTAAAAAACACTTGAATAAGA |
| 3102 | TTTAAAAAACACTTGAATAAGAA |
| 3103 | TTAAAAAACACTTGAATAAGAAT |
| 3104 | TAAAAAACACTTGAATAAGAATC |
| 3105 | AAAAAACACTTGAATAAGAATCA |
| 3106 | AAAAACACTTGAATAAGAATCAG |
| 3107 | AAAACACTTGAATAAGAATCAGT |
| 3108 | AAACACTTGAATAAGAATCAGTA |
| 3109 | AACACTTGAATAAGAATCAGTAG |
| 3110 | ACACTTGAATAAGAATCAGTAGG |
| 3111 | CACTTGAATAAGAATCAGTAGGG |
| 3112 | ACTTGAATAAGAATCAGTAGGGT |
| 3113 | CTTGAATAAGAATCAGTAGGGTA |
| 3114 | TTGAATAAGAATCAGTAGGGTAT |
| 3115 | TGAATAAGAATCAGTAGGGTATA |
| 3116 | GAATAAGAATCAGTAGGGTATAA |
| 3117 | AATAAGAATCAGTAGGGTATAAA |
| 3118 | ATAAGAATCAGTAGGGTATAAAC |
| 3119 | TAAGAATCAGTAGGGTATAAACT |
| 3120 | AAGAATCAGTAGGGTATAAACTA |

| ID | SEQUENCE |
|---|---|
| 3121 | AGAATCAGTAGGGTATAAACTAG |
| 3122 | GAATCAGTAGGGTATAAACTAGA |
| 3123 | AATCAGTAGGGTATAAACTAGAA |
| 3124 | ATCAGTAGGGTATAAACTAGAAG |
| 3125 | TCAGTAGGGTATAAACTAGAAGT |
| 3126 | CAGTAGGGTATAAACTAGAAGTT |
| 3127 | AGTAGGGTATAAACTAGAAGTTT |
| 3128 | GTAGGGTATAAACTAGAAGTTTA |
| 3129 | TAGGGTATAAACTAGAAGTTTAA |
| 3130 | AGGGTATAAACTAGAAGTTTAAA |
| 3131 | GGGTATAAACTAGAAGTTTAAAA |
| 3132 | GGTATAAACTAGAAGTTTAAAAA |
| 3133 | GTATAAACTAGAAGTTTAAAAAT |
| 3134 | TATAAACTAGAAGTTTAAAAATG |
| 3135 | ATAAACTAGAAGTTTAAAAATGC |
| 3136 | TAAACTAGAAGTTTAAAAATGCT |
| 3137 | AAACTAGAAGTTTAAAAATGCTT |
| 3138 | AACTAGAAGTTTAAAAATGCTTC |
| 3139 | ACTAGAAGTTTAAAAATGCTTCA |
| 3140 | CTAGAAGTTTAAAAATGCTTCAT |
| 3141 | TAGAAGTTTAAAAATGCTTCATA |
| 3142 | AGAAGTTTAAAAATGCTTCATAG |
| 3143 | GAAGTTTAAAAATGCTTCATAGA |
| 3144 | AAGTTTAAAAATGCTTCATAGAA |
| 3145 | AGTTTAAAAATGCTTCATAGAAC |
| 3146 | GTTTAAAAATGCTTCATAGAACG |
| 3147 | TTTAAAAATGCTTCATAGAACGT |
| 3148 | TTAAAAATGCTTCATAGAACGTC |
| 3149 | TAAAAATGCTTCATAGAACGTCC |
| 3150 | AAAAATGCTTCATAGAACGTCCA |
| 3151 | AAAATGCTTCATAGAACGTCCAG |
| 3152 | AAATGCTTCATAGAACGTCCAGG |
| 3153 | AATGCTTCATAGAACGTCCAGGG |
| 3154 | ATGCTTCATAGAACGTCCAGGGT |
| 3155 | TGCTTCATAGAACGTCCAGGGTT |
| 3156 | GCTTCATAGAACGTCCAGGGTTT |
| 3157 | CTTCATAGAACGTCCAGGGTTTA |
| 3158 | TTCATAGAACGTCCAGGGTTTAC |
| 3159 | TCATAGAACGTCCAGGGTTTACA |
| 3160 | CATAGAACGTCCAGGGTTTACAT |
| 3161 | ATAGAACGTCCAGGGTTTACATT |
| 3162 | TAGAACGTCCAGGGTTTACATTA |
| 3163 | AGAACGTCCAGGGTTTACATTAC |
| 3164 | GAACGTCCAGGGTTTACATTACA |
| 3165 | AACGTCCAGGGTTTACATTACAA |
| 3166 | ACGTCCAGGGTTTACATTACAAG |
| 3167 | CGTCCAGGGTTTACATTACAAGA |
| 3168 | GTCCAGGGTTTACATTACAAGAT |

| ID | SEQUENCE |
|---|---|
| 3169 | TCCAGGGTTTACATTACAAGATT |
| 3170 | CCAGGGTTTACATTACAAGATTC |
| 3171 | CAGGGTTTACATTACAAGATTCT |
| 3172 | AGGGTTTACATTACAAGATTCTC |
| 3173 | GGGTTTACATTACAAGATTCTCA |
| 3174 | GGTTTACATTACAAGATTCTCAC |
| 3175 | GTTTACATTACAAGATTCTCACA |
| 3176 | TTTACATTACAAGATTCTCACAA |
| 3177 | TTACATTACAAGATTCTCACAAC |
| 3178 | TACATTACAAGATTCTCACAACA |
| 3179 | ACATTACAAGATTCTCACAACAA |
| 3180 | CATTACAAGATTCTCACAACAAA |
| 3181 | ATTACAAGATTCTCACAACAAAC |
| 3182 | TTACAAGATTCTCACAACAAACC |
| 3183 | TACAAGATTCTCACAACAAACCT |
| 3184 | ACAAGATTCTCACAACAAACCTA |
| 3185 | CAAGATTCTCACAACAAACCTAT |
| 3186 | AAGATTCTCACAACAAACCTATT |
| 3187 | AGATTCTCACAACAAACCTATTG |
| 3188 | GATTCTCACAACAAACCTATTGT |
| 3189 | ATTCTCACAACAAACCTATTGTA |
| 3190 | TTCTCACAACAAACCTATTGTAG |
| 3191 | TCTCACAACAAACCTATTGTAGA |
| 3192 | CTCACAACAAACCTATTGTAGAG |
| 3193 | TCACAACAAACCTATTGTAGAGG |
| 3194 | CACAACAAACCTATTGTAGAGGT |
| 3195 | ACAACAAACCTATTGTAGAGGTG |
| 3196 | CAACAAACCTATTGTAGAGGTGA |
| 3197 | AACAAACCTATTGTAGAGGTGAG |
| 3198 | ACAAACCTATTGTAGAGGTGAGT |
| 3199 | CAAACCTATTGTAGAGGTGAGTA |
| 3200 | AAACCTATTGTAGAGGTGAGTAA |
| 3201 | AACCTATTGTAGAGGTGAGTAAG |
| 3202 | ACCTATTGTAGAGGTGAGTAAGG |
| 3203 | CCTATTGTAGAGGTGAGTAAGGC |
| 3204 | CTATTGTAGAGGTGAGTAAGGCA |
| 3205 | TATTGTAGAGGTGAGTAAGGCAT |
| 3206 | ATTGTAGAGGTGAGTAAGGCATG |
| 3207 | TTGTAGAGGTGAGTAAGGCATGT |
| 3208 | TGTAGAGGTGAGTAAGGCATGTT |
| 3209 | GTAGAGGTGAGTAAGGCATGTTA |
| 3210 | TAGAGGTGAGTAAGGCATGTTAC |
| 3211 | AGAGGTGAGTAAGGCATGTTACT |
| 3212 | GAGGTGAGTAAGGCATGTTACTA |
| 3213 | AGGTGAGTAAGGCATGTTACTAC |
| 3214 | GGTGAGTAAGGCATGTTACTACA |
| 3215 | GTGAGTAAGGCATGTTACTACAG |
| 3216 | TGAGTAAGGCATGTTACTACAGA |

| ID | SEQUENCE |
|---|---|
| 3217 | GAGTAAGGCATGTTACTACAGAG |
| 3218 | AGTAAGGCATGTTACTACAGAGG |
| 3219 | GTAAGGCATGTTACTACAGAGGA |
| 3220 | TAAGGCATGTTACTACAGAGGAA |
| 3221 | AAGGCATGTTACTACAGAGGAAA |
| 3222 | AGGCATGTTACTACAGAGGAAAG |
| 3223 | GGCATGTTACTACAGAGGAAAGT |
| 3224 | GCATGTTACTACAGAGGAAAGTT |
| 3225 | CATGTTACTACAGAGGAAAGTTT |
| 3226 | ATGTTACTACAGAGGAAAGTTTG |
| 3227 | TGTTACTACAGAGGAAAGTTTGA |
| 3228 | GTTACTACAGAGGAAAGTTTGAG |
| 3229 | TTACTACAGAGGAAAGTTTGAGA |
| 3230 | TACTACAGAGGAAAGTTTGAGAG |
| 3231 | ACTACAGAGGAAAGTTTGAGAGT |
| 3232 | CTACAGAGGAAAGTTTGAGAGTA |
| 3233 | TACAGAGGAAAGTTTGAGAGTAA |
| 3234 | ACAGAGGAAAGTTTGAGAGTAAA |
| 3235 | CAGAGGAAAGTTTGAGAGTAAAA |
| 3236 | AGAGGAAAGTTTGAGAGTAAAAC |
| 3237 | GAGGAAAGTTTGAGAGTAAAACT |
| 3238 | AGGAAAGTTTGAGAGTAAAACTG |
| 3239 | GGAAAGTTTGAGAGTAAAACTGT |
| 3240 | GAAAGTTTGAGAGTAAAACTGTA |
| 3241 | AAAGTTTGAGAGTAAAACTGTAA |
| 3242 | AAGTTTGAGAGTAAAACTGTAAA |
| 3243 | AGTTTGAGAGTAAAACTGTAAAA |
| 3244 | GTTTGAGAGTAAAACTGTAAAAA |
| 3245 | TTTGAGAGTAAAACTGTAAAAAA |
| 3246 | TTGAGAGTAAAACTGTAAAAAAT |
| 3247 | TGAGAGTAAAACTGTAAAAAATT |
| 3248 | GAGAGTAAAACTGTAAAAAATTA |
| 3249 | AGAGTAAAACTGTAAAAAATTAT |
| 3250 | GAGTAAAACTGTAAAAAATTATA |
| 3251 | AGTAAAACTGTAAAAAATTATAT |
| 3252 | GTAAAACTGTAAAAAATTATATT |
| 3253 | TAAAACTGTAAAAAATTATATTT |
| 3254 | AAAACTGTAAAAAATTATATTTT |
| 3255 | AAACTGTAAAAAATTATATTTTT |
| 3256 | AACTGTAAAAAATTATATTTTTG |
| 3257 | ACTGTAAAAAATTATATTTTTGT |
| 3258 | CTGTAAAAAATTATATTTTTGTT |
| 3259 | TGTAAAAAATTATATTTTTGTTG |
| 3260 | GTAAAAAATTATATTTTTGTTGT |
| 3261 | TAAAAAATTATATTTTTGTTGTA |
| 3262 | AAAAAATTATATTTTTGTTGTAC |
| 3263 | AAAAATTATATTTTTGTTGTACT |
| 3264 | AAAATTATATTTTTGTTGTACTT |

| ID | SEQUENCE |
|---|---|
| 3265 | AAATTATATTTTGTTGTACTTT |
| 3266 | AATTATATTTTGTTGTACTTTC |
| 3267 | ATTATATTTTGTTGTACTTTCT |
| 3268 | TTATATTTTGTTGTACTTTCTA |
| 3269 | TATATTTTGTTGTACTTTCTAA |
| 3270 | ATATTTTGTTGTACTTTCTAAG |
| 3271 | TATTTTGTTGTACTTTCTAAGA |
| 3272 | ATTTTGTTGTACTTTCTAAGAG |
| 3273 | TTTTTGTTGTACTTTCTAAGAGA |
| 3274 | TTTTGTTGTACTTTCTAAGAGAA |
| 3275 | TTTGTTGTACTTTCTAAGAGAAA |
| 3276 | TTGTTGTACTTTCTAAGAGAAAG |
| 3277 | TGTTGTACTTTCTAAGAGAAAGA |
| 3278 | GTTGTACTTTCTAAGAGAAAGAG |
| 3279 | TTGTACTTTCTAAGAGAAAGAGT |
| 3280 | TGTACTTTCTAAGAGAAAGAGTA |
| 3281 | GTACTTTCTAAGAGAAAGAGTAT |
| 3282 | TACTTTCTAAGAGAAAGAGTATT |
| 3283 | ACTTTCTAAGAGAAAGAGTATTG |
| 3284 | CTTTCTAAGAGAAAGAGTATTGT |
| 3285 | TTTCTAAGAGAAAGAGTATTGTT |
| 3286 | TTCTAAGAGAAAGAGTATTGTTA |
| 3287 | TCTAAGAGAAAGAGTATTGTTAT |
| 3288 | CTAAGAGAAAGAGTATTGTTATG |
| 3289 | TAAGAGAAAGAGTATTGTTATGT |
| 3290 | AAGAGAAAGAGTATTGTTATGTT |
| 3291 | AGAGAAAGAGTATTGTTATGTTC |
| 3292 | GAGAAAGAGTATTGTTATGTTCT |
| 3293 | AGAAAGAGTATTGTTATGTTCTC |
| 3294 | GAAAGAGTATTGTTATGTTCTCC |
| 3295 | AAAGAGTATTGTTATGTTCTCCT |
| 3296 | AAGAGTATTGTTATGTTCTCCTA |
| 3297 | AGAGTATTGTTATGTTCTCCTAA |
| 3298 | GAGTATTGTTATGTTCTCCTAAC |
| 3299 | AGTATTGTTATGTTCTCCTAACT |
| 3300 | GTATTGTTATGTTCTCCTAACTT |
| 3301 | TATTGTTATGTTCTCCTAACTTC |
| 3302 | ATTGTTATGTTCTCCTAACTTCT |
| 3303 | TTGTTATGTTCTCCTAACTTCTG |
| 3304 | TGTTATGTTCTCCTAACTTCTGT |
| 3305 | GTTATGTTCTCCTAACTTCTGTT |
| 3306 | TTATGTTCTCCTAACTTCTGTTG |
| 3307 | TATGTTCTCCTAACTTCTGTTGA |
| 3308 | ATGTTCTCCTAACTTCTGTTGAT |
| 3309 | TGTTCTCCTAACTTCTGTTGATT |
| 3310 | GTTCTCCTAACTTCTGTTGATTA |
| 3311 | TTCTCCTAACTTCTGTTGATTAC |
| 3312 | TCTCCTAACTTCTGTTGATTACT |

| ID | SEQUENCE |
|---|---|
| 3313 | CTCCTAACTTCTGTTGATTACTA |
| 3314 | TCCTAACTTCTGTTGATTACTAC |
| 3315 | CCTAACTTCTGTTGATTACTACT |
| 3316 | CTAACTTCTGTTGATTACTACTT |
| 3317 | TAACTTCTGTTGATTACTACTTT |
| 3318 | AACTTCTGTTGATTACTACTTTA |
| 3319 | ACTTCTGTTGATTACTACTTTAA |
| 3320 | CTTCTGTTGATTACTACTTTAAG |
| 3321 | TTCTGTTGATTACTACTTTAAGT |
| 3322 | TCTGTTGATTACTACTTTAAGTG |
| 3323 | CTGTTGATTACTACTTTAAGTGA |
| 3324 | TGTTGATTACTACTTTAAGTGAT |
| 3325 | GTTGATTACTACTTTAAGTGATA |
| 3326 | TTGATTACTACTTTAAGTGATAT |
| 3327 | TGATTACTACTTTAAGTGATATT |
| 3328 | GATTACTACTTTAAGTGATATTC |
| 3329 | ATTACTACTTTAAGTGATATTCA |
| 3330 | TTACTACTTTAAGTGATATTCAT |
| 3331 | TACTACTTTAAGTGATATTCATT |
| 3332 | ACTACTTTAAGTGATATTCATTT |
| 3333 | CTACTTTAAGTGATATTCATTTA |
| 3334 | TACTTTAAGTGATATTCATTTAA |
| 3335 | ACTTTAAGTGATATTCATTTAAA |
| 3336 | CTTTAAGTGATATTCATTTAAAA |
| 3337 | TTTAAGTGATATTCATTTAAAAC |
| 3338 | TTAAGTGATATTCATTTAAAACA |
| 3339 | TAAGTGATATTCATTTAAAACAT |
| 3340 | AAGTGATATTCATTTAAAACATT |
| 3341 | AGTGATATTCATTTAAAACATTG |
| 3342 | GTGATATTCATTTAAAACATTGC |
| 3343 | TGATATTCATTTAAAACATTGCA |
| 3344 | GATATTCATTTAAAACATTGCAA |
| 3345 | ATATTCATTTAAAACATTGCAAA |
| 3346 | TATTCATTTAAAACATTGCAAAT |
| 3347 | ATTCATTTAAAACATTGCAAATT |
| 3348 | TTCATTTAAAACATTGCAAATTT |
| 3349 | TCATTTAAAACATTGCAAATTTA |
| 3350 | CATTTAAAACATTGCAAATTTAT |
| 3351 | ATTTAAAACATTGCAAATTTATT |
| 3352 | TTTAAAACATTGCAAATTTATTT |
| 3353 | TTAAAACATTGCAAATTTATTTT |
| 3354 | TAAAACATTGCAAATTTATTTTA |
| 3355 | AAAACATTGCAAATTTATTTTAT |
| 3356 | AAACATTGCAAATTTATTTTATT |
| 3357 | AACATTGCAAATTTATTTTATTT |
| 3358 | ACATTGCAAATTTATTTTATTTA |
| 3359 | CATTGCAAATTTATTTTATTTAT |
| 3360 | ATTGCAAATTTATTTTATTTATT |

| ID | SEQUENCE |
|---|---|
| 3361 | TTGCAAATTTATTTTATTTATTT |
| 3362 | TGCAAATTTATTTTATTTATTTA |
| 3363 | GCAAATTTATTTTATTTATTTAA |
| 3364 | CAAATTTATTTTATTTATTTAAT |
| 3365 | AAATTTATTTTATTTATTTAATT |
| 3366 | AATTTATTTTATTTATTTAATTT |
| 3367 | ATTTATTTTATTTATTTAATTTT |
| 3368 | TTTATTTTATTTATTTAATTTTC |
| 3369 | TTATTTTATTTATTTAATTTTCT |
| 3370 | TATTTTATTTATTTAATTTTCTT |
| 3371 | ATTTTATTTATTTAATTTTCTTT |
| 3372 | TTTTATTTATTTAATTTTCTTTT |
| 3373 | TTTATTTATTTAATTTTCTTTTT |
| 3374 | TTATTTATTTAATTTTCTTTTTG |
| 3375 | TATTTATTTAATTTTCTTTTTGA |
| 3376 | ATTTATTTAATTTTCTTTTTGAG |
| 3377 | TTTATTTAATTTTCTTTTTGAGA |
| 3378 | TTATTTAATTTTCTTTTTGAGAT |
| 3379 | TATTTAATTTTCTTTTTGAGATG |
| 3380 | ATTTAATTTTCTTTTTGAGATGG |
| 3381 | TTTAATTTTCTTTTTGAGATGGA |
| 3382 | TTAATTTTCTTTTTGAGATGGAG |
| 3383 | TAATTTTCTTTTTGAGATGGAGT |
| 3384 | AATTTTCTTTTTGAGATGGAGTC |
| 3385 | ATTTTCTTTTTGAGATGGAGTCT |
| 3386 | TTTTCTTTTTGAGATGGAGTCTT |
| 3387 | TTTCTTTTTGAGATGGAGTCTTG |
| 3388 | TTCTTTTTGAGATGGAGTCTTGC |
| 3389 | TCTTTTTGAGATGGAGTCTTGCT |
| 3390 | CTTTTTGAGATGGAGTCTTGCTT |
| 3391 | TTTTTGAGATGGAGTCTTGCTTG |
| 3392 | TTTTGAGATGGAGTCTTGCTTGT |
| 3393 | TTTGAGATGGAGTCTTGCTTGTC |
| 3394 | TTGAGATGGAGTCTTGCTTGTCA |
| 3395 | TGAGATGGAGTCTTGCTTGTCAC |
| 3396 | GAGATGGAGTCTTGCTTGTCACC |
| 3397 | AGATGGAGTCTTGCTTGTCACCC |
| 3398 | GATGGAGTCTTGCTTGTCACCCA |
| 3399 | ATGGAGTCTTGCTTGTCACCCAG |
| 3400 | TGGAGTCTTGCTTGTCACCCAGG |
| 3401 | GGAGTCTTGCTTGTCACCCAGGC |
| 3402 | GAGTCTTGCTTGTCACCCAGGCT |
| 3403 | AGTCTTGCTTGTCACCCAGGCTG |
| 3404 | GTCTTGCTTGTCACCCAGGCTGG |
| 3405 | TCTTGCTTGTCACCCAGGCTGGA |
| 3406 | CTTGCTTGTCACCCAGGCTGGAG |
| 3407 | TTGCTTGTCACCCAGGCTGGAGT |
| 3408 | TGCTTGTCACCCAGGCTGGAGTG |

| ID | SEQUENCE |
|---|---|
| 3409 | GCTTGTCACCCAGGCTGGAGTGC |
| 3410 | CTTGTCACCCAGGCTGGAGTGCA |
| 3411 | TTGTCACCCAGGCTGGAGTGCAG |
| 3412 | TGTCACCCAGGCTGGAGTGCAGT |
| 3413 | GTCACCCAGGCTGGAGTGCAGTG |
| 3414 | TCACCCAGGCTGGAGTGCAGTGG |
| 3415 | CACCCAGGCTGGAGTGCAGTGGA |
| 3416 | ACCCAGGCTGGAGTGCAGTGGAG |
| 3417 | CCCAGGCTGGAGTGCAGTGGAGT |
| 3418 | CCAGGCTGGAGTGCAGTGGAGTG |
| 3419 | CAGGCTGGAGTGCAGTGGAGTGA |
| 3420 | AGGCTGGAGTGCAGTGGAGTGAT |
| 3421 | GGCTGGAGTGCAGTGGAGTGATC |
| 3422 | GCTGGAGTGCAGTGGAGTGATCT |
| 3423 | CTGGAGTGCAGTGGAGTGATCTC |
| 3424 | TGGAGTGCAGTGGAGTGATCTCT |
| 3425 | GGAGTGCAGTGGAGTGATCTCTG |
| 3426 | GAGTGCAGTGGAGTGATCTCTGC |
| 3427 | AGTGCAGTGGAGTGATCTCTGCT |
| 3428 | GTGCAGTGGAGTGATCTCTGCTC |
| 3429 | TGCAGTGGAGTGATCTCTGCTCA |
| 3430 | GCAGTGGAGTGATCTCTGCTCAC |
| 3431 | CAGTGGAGTGATCTCTGCTCACT |
| 3432 | AGTGGAGTGATCTCTGCTCACTG |
| 3433 | GTGGAGTGATCTCTGCTCACTGC |
| 3434 | TGGAGTGATCTCTGCTCACTGCA |
| 3435 | GGAGTGATCTCTGCTCACTGCAA |
| 3436 | GAGTGATCTCTGCTCACTGCAAC |
| 3437 | AGTGATCTCTGCTCACTGCAACC |
| 3438 | GTGATCTCTGCTCACTGCAACCT |
| 3439 | TGATCTCTGCTCACTGCAACCTC |
| 3440 | GATCTCTGCTCACTGCAACCTCC |
| 3441 | ATCTCTGCTCACTGCAACCTCCG |
| 3442 | TCTCTGCTCACTGCAACCTCCGC |
| 3443 | CTCTGCTCACTGCAACCTCCGCC |
| 3444 | TCTGCTCACTGCAACCTCCGCCT |
| 3445 | CTGCTCACTGCAACCTCCGCCTT |
| 3446 | TGCTCACTGCAACCTCCGCCTTC |
| 3447 | GCTCACTGCAACCTCCGCCTTCT |
| 3448 | CTCACTGCAACCTCCGCCTTCTG |
| 3449 | TCACTGCAACCTCCGCCTTCTGG |
| 3450 | CACTGCAACCTCCGCCTTCTGGG |
| 3451 | ACTGCAACCTCCGCCTTCTGGGT |
| 3452 | CTGCAACCTCCGCCTTCTGGGTT |
| 3453 | TGCAACCTCCGCCTTCTGGGTTC |
| 3454 | GCAACCTCCGCCTTCTGGGTTCA |
| 3455 | CAACCTCCGCCTTCTGGGTTCAA |
| 3456 | AACCTCCGCCTTCTGGGTTCAAG |

| ID | SEQUENCE |
|---|---|
| 3457 | ACCTCCGCCTTCTGGGTTCAAGC |
| 3458 | CCTCCGCCTTCTGGGTTCAAGCG |
| 3459 | CTCCGCCTTCTGGGTTCAAGCGA |
| 3460 | TCCGCCTTCTGGGTTCAAGCGAT |
| 3461 | CCGCCTTCTGGGTTCAAGCGATT |
| 3462 | CGCCTTCTGGGTTCAAGCGATTC |
| 3463 | GCCTTCTGGGTTCAAGCGATTCT |
| 3464 | CCTTCTGGGTTCAAGCGATTCTC |
| 3465 | CTTCTGGGTTCAAGCGATTCTCG |
| 3466 | TTCTGGGTTCAAGCGATTCTCGT |
| 3467 | TCTGGGTTCAAGCGATTCTCGTG |
| 3468 | CTGGGTTCAAGCGATTCTCGTGC |
| 3469 | TGGGTTCAAGCGATTCTCGTGCC |
| 3470 | GGGTTCAAGCGATTCTCGTGCCT |
| 3471 | GGTTCAAGCGATTCTCGTGCCTC |
| 3472 | GTTCAAGCGATTCTCGTGCCTCA |
| 3473 | TTCAAGCGATTCTCGTGCCTCAG |
| 3474 | TCAAGCGATTCTCGTGCCTCAGC |
| 3475 | CAAGCGATTCTCGTGCCTCAGCT |
| 3476 | AAGCGATTCTCGTGCCTCAGCTT |
| 3477 | AGCGATTCTCGTGCCTCAGCTTC |
| 3478 | GCGATTCTCGTGCCTCAGCTTCC |
| 3479 | CGATTCTCGTGCCTCAGCTTCCT |
| 3480 | GATTCTCGTGCCTCAGCTTCCTG |
| 3481 | ATTCTCGTGCCTCAGCTTCCTGA |
| 3482 | TTCTCGTGCCTCAGCTTCCTGAG |
| 3483 | TCTCGTGCCTCAGCTTCCTGAGT |
| 3484 | CTCGTGCCTCAGCTTCCTGAGTA |
| 3485 | TCGTGCCTCAGCTTCCTGAGTAG |
| 3486 | CGTGCCTCAGCTTCCTGAGTAGC |
| 3487 | GTGCCTCAGCTTCCTGAGTAGCT |
| 3488 | TGCCTCAGCTTCCTGAGTAGCTG |
| 3489 | GCCTCAGCTTCCTGAGTAGCTGG |
| 3490 | CCTCAGCTTCCTGAGTAGCTGGA |
| 3491 | CTCAGCTTCCTGAGTAGCTGGAA |
| 3492 | TCAGCTTCCTGAGTAGCTGGAAT |
| 3493 | CAGCTTCCTGAGTAGCTGGAATT |
| 3494 | AGCTTCCTGAGTAGCTGGAATTA |
| 3495 | GCTTCCTGAGTAGCTGGAATTAC |
| 3496 | CTTCCTGAGTAGCTGGAATTACA |
| 3497 | TTCCTGAGTAGCTGGAATTACAG |
| 3498 | TCCTGAGTAGCTGGAATTACAGG |
| 3499 | CCTGAGTAGCTGGAATTACAGGC |
| 3500 | CTGAGTAGCTGGAATTACAGGCA |
| 3501 | TGAGTAGCTGGAATTACAGGCAG |
| 3502 | GAGTAGCTGGAATTACAGGCAGG |
| 3503 | AGTAGCTGGAATTACAGGCAGGT |
| 3504 | GTAGCTGGAATTACAGGCAGGTG |

| ID | SEQUENCE |
|---|---|
| 3505 | TAGCTGGAATTACAGGCAGGTGC |
| 3506 | AGCTGGAATTACAGGCAGGTGCC |
| 3507 | GCTGGAATTACAGGCAGGTGCCA |
| 3508 | CTGGAATTACAGGCAGGTGCCAC |
| 3509 | TGGAATTACAGGCAGGTGCCACC |
| 3510 | GGAATTACAGGCAGGTGCCACCA |
| 3511 | GAATTACAGGCAGGTGCCACCAT |
| 3512 | AATTACAGGCAGGTGCCACCATG |
| 3513 | ATTACAGGCAGGTGCCACCATGC |
| 3514 | TTACAGGCAGGTGCCACCATGCC |
| 3515 | TACAGGCAGGTGCCACCATGCCC |
| 3516 | ACAGGCAGGTGCCACCATGCCCG |
| 3517 | CAGGCAGGTGCCACCATGCCCGA |
| 3518 | AGGCAGGTGCCACCATGCCCGAC |
| 3519 | GGCAGGTGCCACCATGCCCGACT |
| 3520 | GCAGGTGCCACCATGCCCGACTA |
| 3521 | CAGGTGCCACCATGCCCGACTAA |
| 3522 | AGGTGCCACCATGCCCGACTAAT |
| 3523 | GGTGCCACCATGCCCGACTAATT |
| 3524 | GTGCCACCATGCCCGACTAATTT |
| 3525 | TGCCACCATGCCCGACTAATTTT |
| 3526 | GCCACCATGCCCGACTAATTTTT |
| 3527 | CCACCATGCCCGACTAATTTTTT |
| 3528 | CACCATGCCCGACTAATTTTTTT |
| 3529 | ACCATGCCCGACTAATTTTTTTT |
| 3530 | TTTTTTTATTTTTAGTAGAGAC |
| 3531 | TTTTTTATTTTTAGTAGAGACG |
| 3532 | TTTTTATTTTTAGTAGAGACGG |
| 3533 | TTTTTATTTTAGTAGAGACGGG |
| 3534 | TTTTATTTTAGTAGAGACGGGG |
| 3535 | TTTATTTTTAGTAGAGACGGGGT |
| 3536 | TTATTTTTAGTAGAGACGGGGTT |
| 3537 | TATTTTTAGTAGAGACGGGGTTT |
| 3538 | ATTTTTAGTAGAGACGGGGTTTC |
| 3539 | TTTTTAGTAGAGACGGGGTTTCA |
| 3540 | TTTTAGTAGAGACGGGGTTTCAC |
| 3541 | TTTAGTAGAGACGGGGTTTCACC |
| 3542 | TTAGTAGAGACGGGGTTTCACCA |
| 3543 | TAGTAGAGACGGGGTTTCACCAT |
| 3544 | AGTAGAGACGGGGTTTCACCATG |
| 3545 | GTAGAGACGGGGTTTCACCATGT |
| 3546 | TAGAGACGGGGTTTCACCATGTT |
| 3547 | AGAGACGGGGTTTCACCATGTTG |
| 3548 | GAGACGGGGTTTCACCATGTTGG |
| 3549 | AGACGGGGTTTCACCATGTTGGC |
| 3550 | GACGGGGTTTCACCATGTTGGCC |
| 3551 | ACGGGGTTTCACCATGTTGGCCA |
| 3552 | CGGGGTTTCACCATGTTGGCCAG |

| ID | SEQUENCE |
|---|---|
| 3553 | GGGGTTTCACCATGTTGGCCAGG |
| 3554 | GGGTTTCACCATGTTGGCCAGGC |
| 3555 | GGTTTCACCATGTTGGCCAGGCT |
| 3556 | GTTTCACCATGTTGGCCAGGCTG |
| 3557 | TTTCACCATGTTGGCCAGGCTGG |
| 3558 | TTCACCATGTTGGCCAGGCTGGT |
| 3559 | TCACCATGTTGGCCAGGCTGGTA |
| 3560 | CACCATGTTGGCCAGGCTGGTAT |
| 3561 | ACCATGTTGGCCAGGCTGGTATC |
| 3562 | CCATGTTGGCCAGGCTGGTATCA |
| 3563 | CATGTTGGCCAGGCTGGTATCAA |
| 3564 | ATGTTGGCCAGGCTGGTATCAAA |
| 3565 | TGTTGGCCAGGCTGGTATCAAAC |
| 3566 | GTTGGCCAGGCTGGTATCAAACT |
| 3567 | TTGGCCAGGCTGGTATCAAACTC |
| 3568 | TGGCCAGGCTGGTATCAAACTCC |
| 3569 | GGCCAGGCTGGTATCAAACTCCT |
| 3570 | GCCAGGCTGGTATCAAACTCCTG |
| 3571 | CCAGGCTGGTATCAAACTCCTGA |
| 3572 | CAGGCTGGTATCAAACTCCTGAC |
| 3573 | AGGCTGGTATCAAACTCCTGACC |
| 3574 | GGCTGGTATCAAACTCCTGACCT |
| 3575 | GCTGGTATCAAACTCCTGACCTC |
| 3576 | CTGGTATCAAACTCCTGACCTCA |
| 3577 | TGGTATCAAACTCCTGACCTCAA |
| 3578 | GGTATCAAACTCCTGACCTCAAG |
| 3579 | GTATCAAACTCCTGACCTCAAGA |
| 3580 | TATCAAACTCCTGACCTCAAGAG |
| 3581 | ATCAAACTCCTGACCTCAAGAGA |
| 3582 | TCAAACTCCTGACCTCAAGAGAT |
| 3583 | CAAACTCCTGACCTCAAGAGATC |
| 3584 | AAACTCCTGACCTCAAGAGATCC |
| 3585 | AACTCCTGACCTCAAGAGATCCA |
| 3586 | ACTCCTGACCTCAAGAGATCCAC |
| 3587 | CTCCTGACCTCAAGAGATCCACT |
| 3588 | TCCTGACCTCAAGAGATCCACTC |
| 3589 | CCTGACCTCAAGAGATCCACTCG |
| 3590 | CTGACCTCAAGAGATCCACTCGC |
| 3591 | TGACCTCAAGAGATCCACTCGCC |
| 3592 | GACCTCAAGAGATCCACTCGCCT |
| 3593 | ACCTCAAGAGATCCACTCGCCTT |
| 3594 | CCTCAAGAGATCCACTCGCCTTG |
| 3595 | CTCAAGAGATCCACTCGCCTTGC |
| 3596 | TCAAGAGATCCACTCGCCTTGCC |
| 3597 | CAAGAGATCCACTCGCCTTGCCC |
| 3598 | AAGAGATCCACTCGCCTTGCCCT |
| 3599 | AGAGATCCACTCGCCTTGCCCTC |
| 3600 | GAGATCCACTCGCCTTGCCCTCC |

| ID | SEQUENCE |
|---|---|
| 3601 | AGATCCACTCGCCTTGCCCTCCC |
| 3602 | GATCCACTCGCCTTGCCCTCCCA |
| 3603 | ATCCACTCGCCTTGCCCTCCCAA |
| 3604 | TCCACTCGCCTTGCCCTCCCAAA |
| 3605 | CCACTCGCCTTGCCCTCCCAAAG |
| 3606 | CACTCGCCTTGCCCTCCCAAAGT |
| 3607 | ACTCGCCTTGCCCTCCCAAAGTG |
| 3608 | CTCGCCTTGCCCTCCCAAAGTGC |
| 3609 | TCGCCTTGCCCTCCCAAAGTGCT |
| 3610 | CGCCTTGCCCTCCCAAAGTGCTG |
| 3611 | GCCTTGCCCTCCCAAAGTGCTGG |
| 3612 | CCTTGCCCTCCCAAAGTGCTGGG |
| 3613 | CTTGCCCTCCCAAAGTGCTGGGA |
| 3614 | TTGCCCTCCCAAAGTGCTGGGAT |
| 3615 | TGCCCTCCCAAAGTGCTGGGATT |
| 3616 | GCCCTCCCAAAGTGCTGGGATTA |
| 3617 | CCCTCCCAAAGTGCTGGGATTAC |
| 3618 | CCTCCCAAAGTGCTGGGATTACA |
| 3619 | CTCCCAAAGTGCTGGGATTACAG |
| 3620 | TCCCAAAGTGCTGGGATTACAGG |
| 3621 | CCCAAAGTGCTGGGATTACAGGC |
| 3622 | CCAAAGTGCTGGGATTACAGGCT |
| 3623 | CAAAGTGCTGGGATTACAGGCTT |
| 3624 | AAAGTGCTGGGATTACAGGCTTG |
| 3625 | AAGTGCTGGGATTACAGGCTTGA |
| 3626 | AGTGCTGGGATTACAGGCTTGAG |
| 3627 | GTGCTGGGATTACAGGCTTGAGC |
| 3628 | TGCTGGGATTACAGGCTTGAGCC |
| 3629 | GCTGGGATTACAGGCTTGAGCCA |
| 3630 | CTGGGATTACAGGCTTGAGCCAC |
| 3631 | TGGGATTACAGGCTTGAGCCACC |
| 3632 | GGGATTACAGGCTTGAGCCACCA |
| 3633 | GGATTACAGGCTTGAGCCACCAC |
| 3634 | GATTACAGGCTTGAGCCACCACG |
| 3635 | ATTACAGGCTTGAGCCACCACGC |
| 3636 | TTACAGGCTTGAGCCACCACGCC |
| 3637 | TACAGGCTTGAGCCACCACGCCC |
| 3638 | ACAGGCTTGAGCCACCACGCCCG |
| 3639 | CAGGCTTGAGCCACCACGCCCGG |
| 3640 | AGGCTTGAGCCACCACGCCCGGC |
| 3641 | GGCTTGAGCCACCACGCCCGGCT |
| 3642 | GCTTGAGCCACCACGCCCGGCTA |
| 3643 | CTTGAGCCACCACGCCCGGCTAA |
| 3644 | TTGAGCCACCACGCCCGGCTAAA |
| 3645 | TGAGCCACCACGCCCGGCTAAAA |
| 3646 | GAGCCACCACGCCCGGCTAAAAC |
| 3647 | AGCCACCACGCCCGGCTAAAACA |
| 3648 | GCCACCACGCCCGGCTAAAACAT |

| ID | SEQUENCE |
|---|---|
| 3649 | CCACCACGCCCGGCTAAAACATT |
| 3650 | CACCACGCCCGGCTAAAACATTG |
| 3651 | ACCACGCCCGGCTAAAACATTGC |
| 3652 | CCACGCCCGGCTAAAACATTGCA |
| 3653 | CACGCCCGGCTAAAACATTGCAA |
| 3654 | ACGCCCGGCTAAAACATTGCAAA |
| 3655 | CGCCCGGCTAAAACATTGCAAAT |
| 3656 | GCCCGGCTAAAACATTGCAAATT |
| 3657 | CCCGGCTAAAACATTGCAAATTT |
| 3658 | CCGGCTAAAACATTGCAAATTTA |
| 3659 | CGGCTAAAACATTGCAAATTTAA |
| 3660 | GGCTAAAACATTGCAAATTTAAA |
| 3661 | GCTAAAACATTGCAAATTTAAAT |
| 3662 | CTAAAACATTGCAAATTTAAATG |
| 3663 | TAAAACATTGCAAATTTAAATGA |
| 3664 | AAAACATTGCAAATTTAAATGAG |
| 3665 | AAACATTGCAAATTTAAATGAGA |
| 3666 | AACATTGCAAATTTAAATGAGAG |
| 3667 | ACATTGCAAATTTAAATGAGAGT |
| 3668 | CATTGCAAATTTAAATGAGAGTT |
| 3669 | ATTGCAAATTTAAATGAGAGTTT |
| 3670 | TTGCAAATTTAAATGAGAGTTTT |
| 3671 | TGCAAATTTAAATGAGAGTTTTA |
| 3672 | GCAAATTTAAATGAGAGTTTTAA |
| 3673 | CAAATTTAAATGAGAGTTTTAAA |
| 3674 | AAATTTAAATGAGAGTTTTAAAA |
| 3675 | AATTTAAATGAGAGTTTTAAAAA |
| 3676 | ATTTAAATGAGAGTTTTAAAAAT |
| 3677 | TTTAAATGAGAGTTTTAAAAATT |
| 3678 | TTAAATGAGAGTTTTAAAAATTA |
| 3679 | TAAATGAGAGTTTTAAAAATTAA |
| 3680 | AAATGAGAGTTTTAAAAATTAAA |
| 3681 | AATGAGAGTTTTAAAAATTAAAT |
| 3682 | ATGAGAGTTTTAAAAATTAAATA |
| 3683 | TGAGAGTTTTAAAAATTAAATAA |
| 3684 | GAGAGTTTTAAAAATTAAATAAT |
| 3685 | AGAGTTTTAAAAATTAAATAATG |
| 3686 | GAGTTTTAAAAATTAAATAATGA |
| 3687 | AGTTTTAAAAATTAAATAATGAC |
| 3688 | GTTTTAAAAATTAAATAATGACT |
| 3689 | TTTTAAAAATTAAATAATGACTG |
| 3690 | TTTAAAAATTAAATAATGACTGC |
| 3691 | TTAAAAATTAAATAATGACTGCC |
| 3692 | TAAAAATTAAATAATGACTGCCC |
| 3693 | AAAAATTAAATAATGACTGCCCT |
| 3694 | AAAATTAAATAATGACTGCCCTG |
| 3695 | AAATTAAATAATGACTGCCCTGT |
| 3696 | AATTAAATAATGACTGCCCTGTT |

| ID | SEQUENCE |
|---|---|
| 3697 | ATTAAATAATGACTGCCCTGTTT |
| 3698 | TTAAATAATGACTGCCCTGTTTC |
| 3699 | TAAATAATGACTGCCCTGTTTCT |
| 3700 | AAATAATGACTGCCCTGTTTCTG |
| 3701 | AATAATGACTGCCCTGTTTCTGT |
| 3702 | ATAATGACTGCCCTGTTTCTGTT |
| 3703 | TAATGACTGCCCTGTTTCTGTTT |
| 3704 | AATGACTGCCCTGTTTCTGTTTT |
| 3705 | ATGACTGCCCTGTTTCTGTTTTA |
| 3706 | TGACTGCCCTGTTTCTGTTTTAG |
| 3707 | GACTGCCCTGTTTCTGTTTTAGT |
| 3708 | ACTGCCCTGTTTCTGTTTTAGTA |
| 3709 | CTGCCCTGTTTCTGTTTTAGTAT |
| 3710 | TGCCCTGTTTCTGTTTTAGTATG |
| 3711 | GCCCTGTTTCTGTTTTAGTATGT |
| 3712 | CCCTGTTTCTGTTTTAGTATGTA |
| 3713 | CCTGTTTCTGTTTTAGTATGTAA |
| 3714 | CTGTTTCTGTTTTAGTATGTAAA |
| 3715 | TGTTTCTGTTTTAGTATGTAAAT |
| 3716 | GTTTCTGTTTTAGTATGTAAATC |
| 3717 | TTTCTGTTTTAGTATGTAAATCC |
| 3718 | TTCTGTTTTAGTATGTAAATCCT |
| 3719 | TCTGTTTTAGTATGTAAATCCTC |
| 3720 | CTGTTTTAGTATGTAAATCCTCA |
| 3721 | TGTTTTAGTATGTAAATCCTCAG |
| 3722 | GTTTTAGTATGTAAATCCTCAGT |
| 3723 | TTTTAGTATGTAAATCCTCAGTT |
| 3724 | TTTAGTATGTAAATCCTCAGTTC |
| 3725 | TTAGTATGTAAATCCTCAGTTCT |
| 3726 | TAGTATGTAAATCCTCAGTTCTT |
| 3727 | AGTATGTAAATCCTCAGTTCTTC |
| 3728 | GTATGTAAATCCTCAGTTCTTCA |
| 3729 | TATGTAAATCCTCAGTTCTTCAC |
| 3730 | ATGTAAATCCTCAGTTCTTCACC |
| 3731 | TGTAAATCCTCAGTTCTTCACCT |
| 3732 | GTAAATCCTCAGTTCTTCACCTT |
| 3733 | TAAATCCTCAGTTCTTCACCTTT |
| 3734 | AAATCCTCAGTTCTTCACCTTTG |
| 3735 | AATCCTCAGTTCTTCACCTTTGC |
| 3736 | ATCCTCAGTTCTTCACCTTTGCA |
| 3737 | TCCTCAGTTCTTCACCTTTGCAC |
| 3738 | CCTCAGTTCTTCACCTTTGCACT |
| 3739 | CTCAGTTCTTCACCTTTGCACTG |
| 3740 | TCAGTTCTTCACCTTTGCACTGT |
| 3741 | CAGTTCTTCACCTTTGCACTGTC |
| 3742 | AGTTCTTCACCTTTGCACTGTCT |
| 3743 | GTTCTTCACCTTTGCACTGTCTG |
| 3744 | TTCTTCACCTTTGCACTGTCTGC |

| ID | SEQUENCE |
|---|---|
| 3745 | TCTTCACCTTTGCACTGTCTGCC |
| 3746 | CTTCACCTTTGCACTGTCTGCCA |
| 3747 | TTCACCTTTGCACTGTCTGCCAC |
| 3748 | TCACCTTTGCACTGTCTGCCACT |
| 3749 | CACCTTTGCACTGTCTGCCACTT |
| 3750 | ACCTTTGCACTGTCTGCCACTTA |
| 3751 | CCTTTGCACTGTCTGCCACTTAG |
| 3752 | CTTTGCACTGTCTGCCACTTAGT |
| 3753 | TTTGCACTGTCTGCCACTTAGTT |
| 3754 | TTGCACTGTCTGCCACTTAGTTT |
| 3755 | TGCACTGTCTGCCACTTAGTTTG |
| 3756 | GCACTGTCTGCCACTTAGTTTGG |
| 3757 | CACTGTCTGCCACTTAGTTTGGT |
| 3758 | ACTGTCTGCCACTTAGTTTGGTT |
| 3759 | CTGTCTGCCACTTAGTTTGGTTA |
| 3760 | TGTCTGCCACTTAGTTTGGTTAT |
| 3761 | GTCTGCCACTTAGTTTGGTTATA |
| 3762 | TCTGCCACTTAGTTTGGTTATAT |
| 3763 | CTGCCACTTAGTTTGGTTATATA |
| 3764 | TGCCACTTAGTTTGGTTATATAG |
| 3765 | GCCACTTAGTTTGGTTATATAGT |
| 3766 | CCACTTAGTTTGGTTATATAGTC |
| 3767 | CACTTAGTTTGGTTATATAGTCA |
| 3768 | ACTTAGTTTGGTTATATAGTCAT |
| 3769 | CTTAGTTTGGTTATATAGTCATT |
| 3770 | TTAGTTTGGTTATATAGTCATTA |
| 3771 | TAGTTTGGTTATATAGTCATTAA |
| 3772 | AGTTTGGTTATATAGTCATTAAC |
| 3773 | GTTTGGTTATATAGTCATTAACT |
| 3774 | TTTGGTTATATAGTCATTAACTT |
| 3775 | TTGGTTATATAGTCATTAACTTG |
| 3776 | TGGTTATATAGTCATTAACTTGA |
| 3777 | GGTTATATAGTCATTAACTTGAA |
| 3778 | GTTATATAGTCATTAACTTGAAT |
| 3779 | TTATATAGTCATTAACTTGAATT |
| 3780 | TATATAGTCATTAACTTGAATTT |
| 3781 | ATATAGTCATTAACTTGAATTTG |
| 3782 | TATAGTCATTAACTTGAATTTGG |
| 3783 | ATAGTCATTAACTTGAATTTGGT |
| 3784 | TAGTCATTAACTTGAATTTGGTC |
| 3785 | AGTCATTAACTTGAATTTGGTCT |
| 3786 | GTCATTAACTTGAATTTGGTCTG |
| 3787 | TCATTAACTTGAATTTGGTCTGT |
| 3788 | CATTAACTTGAATTTGGTCTGTA |
| 3789 | ATTAACTTGAATTTGGTCTGTAT |
| 3790 | TTAACTTGAATTTGGTCTGTATA |
| 3791 | TAACTTGAATTTGGTCTGTATAG |
| 3792 | AACTTGAATTTGGTCTGTATAGT |

| ID | SEQUENCE |
|---|---|
| 3793 | ACTTGAATTTGGTCTGTATAGTC |
| 3794 | CTTGAATTTGGTCTGTATAGTCT |
| 3795 | TTGAATTTGGTCTGTATAGTCTA |
| 3796 | TGAATTTGGTCTGTATAGTCTAG |
| 3797 | GAATTTGGTCTGTATAGTCTAGA |
| 3798 | AATTTGGTCTGTATAGTCTAGAC |
| 3799 | ATTTGGTCTGTATAGTCTAGACT |
| 3800 | TTTGGTCTGTATAGTCTAGACTT |
| 3801 | TTGGTCTGTATAGTCTAGACTTT |
| 3802 | TGGTCTGTATAGTCTAGACTTTA |
| 3803 | GGTCTGTATAGTCTAGACTTTAA |
| 3804 | GTCTGTATAGTCTAGACTTTAAA |
| 3805 | TCTGTATAGTCTAGACTTTAAAT |
| 3806 | CTGTATAGTCTAGACTTTAAATT |
| 3807 | TGTATAGTCTAGACTTTAAATTT |
| 3808 | GTATAGTCTAGACTTTAAATTTA |
| 3809 | TATAGTCTAGACTTTAAATTTAA |
| 3810 | ATAGTCTAGACTTTAAATTTAAA |
| 3811 | TAGTCTAGACTTTAAATTTAAAG |
| 3812 | AGTCTAGACTTTAAATTTAAAGT |
| 3813 | GTCTAGACTTTAAATTTAAAGTT |
| 3814 | TCTAGACTTTAAATTTAAAGTTT |
| 3815 | CTAGACTTTAAATTTAAAGTTTT |
| 3816 | TAGACTTTAAATTTAAAGTTTTC |
| 3817 | AGACTTTAAATTTAAAGTTTTCT |
| 3818 | GACTTTAAATTTAAAGTTTTCTA |
| 3819 | ACTTTAAATTTAAAGTTTTCTAC |
| 3820 | CTTTAAATTTAAAGTTTTCTACA |
| 3821 | TTTAAATTTAAAGTTTTCTACAA |
| 3822 | TTAAATTTAAAGTTTTCTACAAG |
| 3823 | TAAATTTAAAGTTTTCTACAAGG |
| 3824 | AAATTTAAAGTTTTCTACAAGGG |
| 3825 | AATTTAAAGTTTTCTACAAGGGG |
| 3826 | ATTTAAAGTTTTCTACAAGGGGA |
| 3827 | TTTAAAGTTTTCTACAAGGGGAG |
| 3828 | TTAAAGTTTTCTACAAGGGGAGA |
| 3829 | TAAAGTTTTCTACAAGGGGAGAA |
| 3830 | AAAGTTTTCTACAAGGGGAGAAA |
| 3831 | AAGTTTTCTACAAGGGGAGAAAA |
| 3832 | AGTTTTCTACAAGGGGAGAAAAG |
| 3833 | GTTTTCTACAAGGGGAGAAAAGT |
| 3834 | TTTTCTACAAGGGGAGAAAAGTG |
| 3835 | TTTCTACAAGGGGAGAAAAGTGT |
| 3836 | TTCTACAAGGGGAGAAAAGTGTT |
| 3837 | TCTACAAGGGGAGAAAAGTGTTA |
| 3838 | CTACAAGGGGAGAAAAGTGTTAA |
| 3839 | TACAAGGGGAGAAAAGTGTTAAA |
| 3840 | ACAAGGGGAGAAAAGTGTTAAAA |

| ID | SEQUENCE |
|---|---|
| 3841 | CAAGGGGAGAAAAGTGTTAAAAT |
| 3842 | AAGGGGAGAAAAGTGTTAAAATT |
| 3843 | AGGGGAGAAAAGTGTTAAAATTT |
| 3844 | GGGGAGAAAAGTGTTAAAATTTT |
| 3845 | GGGAGAAAAGTGTTAAAATTTTT |
| 3846 | GGAGAAAAGTGTTAAAATTTTTA |
| 3847 | GAGAAAAGTGTTAAAATTTTTAA |
| 3848 | AGAAAAGTGTTAAAATTTTTAAA |
| 3849 | GAAAAGTGTTAAAATTTTTAAAA |
| 3850 | AAAAGTGTTAAAATTTTTAAAAT |
| 3851 | AAAGTGTTAAAATTTTTAAAATA |
| 3852 | AAGTGTTAAAATTTTTAAAATAT |
| 3853 | AGTGTTAAAATTTTTAAAATATG |
| 3854 | GTGTTAAAATTTTTAAAATATGT |
| 3855 | TGTTAAAATTTTTAAAATATGTT |
| 3856 | GTTAAAATTTTTAAAATATGTTT |
| 3857 | TTAAAATTTTTAAAATATGTTTT |
| 3858 | TAAAATTTTTAAAATATGTTTTC |
| 3859 | AAAATTTTTAAAATATGTTTTCC |
| 3860 | AAATTTTTAAAATATGTTTTCCA |
| 3861 | AATTTTTAAAATATGTTTTCCAG |
| 3862 | ATTTTTAAAATATGTTTTCCAGG |
| 3863 | TTTTTAAAATATGTTTTCCAGGA |
| 3864 | TTTTAAAATATGTTTTCCAGGAC |
| 3865 | TTTAAAATATGTTTTCCAGGACA |
| 3866 | TTAAAATATGTTTTCCAGGACAC |
| 3867 | TAAAATATGTTTTCCAGGACACT |
| 3868 | AAAATATGTTTTCCAGGACACTT |
| 3869 | AAATATGTTTTCCAGGACACTTC |
| 3870 | AATATGTTTTCCAGGACACTTCA |
| 3871 | ATATGTTTTCCAGGACACTTCAC |
| 3872 | TATGTTTTCCAGGACACTTCACT |
| 3873 | ATGTTTTCCAGGACACTTCACTT |
| 3874 | TGTTTTCCAGGACACTTCACTTC |
| 3875 | GTTTTCCAGGACACTTCACTTCC |
| 3876 | TTTTCCAGGACACTTCACTTCCA |
| 3877 | TTTCCAGGACACTTCACTTCCAA |
| 3878 | TTCCAGGACACTTCACTTCCAAG |
| 3879 | TCCAGGACACTTCACTTCCAAGT |
| 3880 | CCAGGACACTTCACTTCCAAGTC |
| 3881 | CAGGACACTTCACTTCCAAGTCA |
| 3882 | AGGACACTTCACTTCCAAGTCAG |
| 3883 | GGACACTTCACTTCCAAGTCAGG |
| 3884 | GACACTTCACTTCCAAGTCAGGT |
| 3885 | ACACTTCACTTCCAAGTCAGGTA |
| 3886 | CACTTCACTTCCAAGTCAGGTAG |
| 3887 | ACTTCACTTCCAAGTCAGGTAGG |
| 3888 | CTTCACTTCCAAGTCAGGTAGGT |

| ID | SEQUENCE |
|---|---|
| 3889 | TTCACTTCCAAGTCAGGTAGGTA |
| 3890 | TCACTTCCAAGTCAGGTAGGTAG |
| 3891 | CACTTCCAAGTCAGGTAGGTAGT |
| 3892 | ACTTCCAAGTCAGGTAGGTAGTT |
| 3893 | CTTCCAAGTCAGGTAGGTAGTTC |
| 3894 | TTCCAAGTCAGGTAGGTAGTTCA |
| 3895 | TCCAAGTCAGGTAGGTAGTTCAA |
| 3896 | CCAAGTCAGGTAGGTAGTTCAAT |
| 3897 | CAAGTCAGGTAGGTAGTTCAATC |
| 3898 | AAGTCAGGTAGGTAGTTCAATCT |
| 3899 | AGTCAGGTAGGTAGTTCAATCTA |
| 3900 | GTCAGGTAGGTAGTTCAATCTAG |
| 3901 | TCAGGTAGGTAGTTCAATCTAGT |
| 3902 | CAGGTAGGTAGTTCAATCTAGTT |
| 3903 | AGGTAGGTAGTTCAATCTAGTTG |
| 3904 | GGTAGGTAGTTCAATCTAGTTGT |
| 3905 | GTAGGTAGTTCAATCTAGTTGTT |
| 3906 | TAGGTAGTTCAATCTAGTTGTTA |
| 3907 | AGGTAGTTCAATCTAGTTGTTAG |
| 3908 | GGTAGTTCAATCTAGTTGTTAGC |
| 3909 | GTAGTTCAATCTAGTTGTTAGCC |
| 3910 | TAGTTCAATCTAGTTGTTAGCCA |
| 3911 | AGTTCAATCTAGTTGTTAGCCAA |
| 3912 | GTTCAATCTAGTTGTTAGCCAAG |
| 3913 | TTCAATCTAGTTGTTAGCCAAGG |
| 3914 | TCAATCTAGTTGTTAGCCAAGGA |
| 3915 | CAATCTAGTTGTTAGCCAAGGAC |
| 3916 | AATCTAGTTGTTAGCCAAGGACT |
| 3917 | ATCTAGTTGTTAGCCAAGGACTC |
| 3918 | TCTAGTTGTTAGCCAAGGACTCA |
| 3919 | CTAGTTGTTAGCCAAGGACTCAA |
| 3920 | TAGTTGTTAGCCAAGGACTCAAG |
| 3921 | AGTTGTTAGCCAAGGACTCAAGG |
| 3922 | GTTGTTAGCCAAGGACTCAAGGA |
| 3923 | TTGTTAGCCAAGGACTCAAGGAC |
| 3924 | TGTTAGCCAAGGACTCAAGGACT |
| 3925 | GTTAGCCAAGGACTCAAGGACTG |
| 3926 | TTAGCCAAGGACTCAAGGACTGA |
| 3927 | TAGCCAAGGACTCAAGGACTGAA |
| 3928 | AGCCAAGGACTCAAGGACTGAAT |
| 3929 | GCCAAGGACTCAAGGACTGAATT |
| 3930 | CCAAGGACTCAAGGACTGAATTG |
| 3931 | CAAGGACTCAAGGACTGAATTGT |
| 3932 | AAGGACTCAAGGACTGAATTGTT |
| 3933 | AGGACTCAAGGACTGAATTGTTT |
| 3934 | GGACTCAAGGACTGAATTGTTTT |
| 3935 | GACTCAAGGACTGAATTGTTTTA |
| 3936 | ACTCAAGGACTGAATTGTTTTAA |

| ID | SEQUENCE |
|---|---|
| 3937 | CTCAAGGACTGAATTGTTTTAAC |
| 3938 | TCAAGGACTGAATTGTTTTAACA |
| 3939 | CAAGGACTGAATTGTTTTAACAT |
| 3940 | AAGGACTGAATTGTTTTAACATA |
| 3941 | AGGACTGAATTGTTTTAACATAA |
| 3942 | GGACTGAATTGTTTTAACATAAG |
| 3943 | GACTGAATTGTTTTAACATAAGG |
| 3944 | ACTGAATTGTTTTAACATAAGGC |
| 3945 | CTGAATTGTTTTAACATAAGGCT |
| 3946 | TGAATTGTTTTAACATAAGGCTT |
| 3947 | GAATTGTTTTAACATAAGGCTTT |
| 3948 | AATTGTTTTAACATAAGGCTTTT |
| 3949 | ATTGTTTTAACATAAGGCTTTTC |
| 3950 | TTGTTTTAACATAAGGCTTTTCC |
| 3951 | TGTTTTAACATAAGGCTTTTCCT |
| 3952 | GTTTTAACATAAGGCTTTTCCTG |
| 3953 | TTTTAACATAAGGCTTTTCCTGT |
| 3954 | TTTAACATAAGGCTTTTCCTGTT |
| 3955 | TTAACATAAGGCTTTTCCTGTTC |
| 3956 | TAACATAAGGCTTTTCCTGTTCT |
| 3957 | AACATAAGGCTTTTCCTGTTCTG |
| 3958 | ACATAAGGCTTTTCCTGTTCTGG |
| 3959 | CATAAGGCTTTTCCTGTTCTGGG |
| 3960 | ATAAGGCTTTTCCTGTTCTGGGA |
| 3961 | TAAGGCTTTTCCTGTTCTGGGAG |
| 3962 | AAGGCTTTTCCTGTTCTGGGAGC |
| 3963 | AGGCTTTTCCTGTTCTGGGAGCC |
| 3964 | GGCTTTTCCTGTTCTGGGAGCCG |
| 3965 | GCTTTTCCTGTTCTGGGAGCCGC |
| 3966 | CTTTTCCTGTTCTGGGAGCCGCA |
| 3967 | TTTTCCTGTTCTGGGAGCCGCAC |
| 3968 | TTTCCTGTTCTGGGAGCCGCACT |
| 3969 | TTCCTGTTCTGGGAGCCGCACTT |
| 3970 | TCCTGTTCTGGGAGCCGCACTTC |
| 3971 | CCTGTTCTGGGAGCCGCACTTCA |
| 3972 | CTGTTCTGGGAGCCGCACTTCAT |
| 3973 | TGTTCTGGGAGCCGCACTTCATT |
| 3974 | GTTCTGGGAGCCGCACTTCATTA |
| 3975 | TTCTGGGAGCCGCACTTCATTAA |
| 3976 | TCTGGGAGCCGCACTTCATTAAA |
| 3977 | CTGGGAGCCGCACTTCATTAAAA |
| 3978 | TGGGAGCCGCACTTCATTAAAAT |
| 3979 | GGGAGCCGCACTTCATTAAAATT |
| 3980 | GGAGCCGCACTTCATTAAAATTC |
| 3981 | GAGCCGCACTTCATTAAAATTCT |
| 3982 | AGCCGCACTTCATTAAAATTCTT |
| 3983 | GCCGCACTTCATTAAAATTCTTC |
| 3984 | CCGCACTTCATTAAAATTCTTCT |

| ID | SEQUENCE |
|---|---|
| 3985 | CGCACTTCATTAAAATTCTTCTA |
| 3986 | GCACTTCATTAAAATTCTTCTAA |
| 3987 | CACTTCATTAAAATTCTTCTAAA |
| 3988 | ACTTCATTAAAATTCTTCTAAAA |
| 3989 | CTTCATTAAAATTCTTCTAAAAC |
| 3990 | TTCATTAAAATTCTTCTAAAACT |
| 3991 | TCATTAAAATTCTTCTAAAACTT |
| 3992 | CATTAAAATTCTTCTAAAACTTG |
| 3993 | ATTAAAATTCTTCTAAAACTTGT |
| 3994 | TTAAAATTCTTCTAAAACTTGTA |
| 3995 | TAAAATTCTTCTAAAACTTGTAT |
| 3996 | AAAATTCTTCTAAAACTTGTATG |
| 3997 | AAATTCTTCTAAAACTTGTATGT |
| 3998 | AATTCTTCTAAAACTTGTATGTT |
| 3999 | ATTCTTCTAAAACTTGTATGTTT |
| 4000 | TTCTTCTAAAACTTGTATGTTTA |
| 4001 | TCTTCTAAAACTTGTATGTTTAG |
| 4002 | CTTCTAAAACTTGTATGTTTAGA |
| 4003 | TTCTAAAACTTGTATGTTTAGAG |
| 4004 | TCTAAAACTTGTATGTTTAGAGT |
| 4005 | CTAAAACTTGTATGTTTAGAGTT |
| 4006 | TAAAACTTGTATGTTTAGAGTTA |
| 4007 | AAAACTTGTATGTTTAGAGTTAA |
| 4008 | AAACTTGTATGTTTAGAGTTAAG |
| 4009 | AACTTGTATGTTTAGAGTTAAGC |
| 4010 | ACTTGTATGTTTAGAGTTAAGCA |
| 4011 | CTTGTATGTTTAGAGTTAAGCAA |
| 4012 | TTGTATGTTTAGAGTTAAGCAAG |
| 4013 | TGTATGTTTAGAGTTAAGCAAGA |
| 4014 | GTATGTTTAGAGTTAAGCAAGAC |
| 4015 | TATGTTTAGAGTTAAGCAAGACT |
| 4016 | ATGTTTAGAGTTAAGCAAGACTT |
| 4017 | TGTTTAGAGTTAAGCAAGACTTT |
| 4018 | GTTTAGAGTTAAGCAAGACTTTT |
| 4019 | TTTAGAGTTAAGCAAGACTTTTT |
| 4020 | TTAGAGTTAAGCAAGACTTTTTT |
| 4021 | TAGAGTTAAGCAAGACTTTTTTT |
| 4022 | AGAGTTAAGCAAGACTTTTTTTC |
| 4023 | GAGTTAAGCAAGACTTTTTTTCT |
| 4024 | AGTTAAGCAAGACTTTTTTCTT |
| 4025 | GTTAAGCAAGACTTTTTTCTTC |
| 4026 | TTAAGCAAGACTTTTTTCTTCC |
| 4027 | TAAGCAAGACTTTTTTCTTCCT |
| 4028 | AAGCAAGACTTTTTTCTTCCTC |
| 4029 | AGCAAGACTTTTTTCTTCCTCT |
| 4030 | GCAAGACTTTTTTCTTCCTCTC |
| 4031 | CAAGACTTTTTTCTTCCTCTCC |
| 4032 | AAGACTTTTTTCTTCCTCTCCA |

| ID | SEQUENCE |
|---|---|
| 4033 | AGACTTTTTTCTTCCTCTCCAT |
| 4034 | GACTTTTTTCTTCCTCTCCATG |
| 4035 | ACTTTTTTCTTCCTCTCCATGA |
| 4036 | CTTTTTTCTTCCTCTCCATGAG |
| 4037 | TTTTTTCTTCCTCTCCATGAGT |
| 4038 | TTTTTCTTCCTCTCCATGAGTT |
| 4039 | TTTTCTTCCTCTCCATGAGTTG |
| 4040 | TTTCTTCCTCTCCATGAGTTGT |
| 4041 | TTCTTCCTCTCCATGAGTTGTG |
| 4042 | TCTTCCTCTCCATGAGTTGTGA |
| 4043 | TCTTCCTCTCCATGAGTTGTGAA |
| 4044 | CTTCCTCTCCATGAGTTGTGAAA |
| 4045 | TTCCTCTCCATGAGTTGTGAAAT |
| 4046 | TCCTCTCCATGAGTTGTGAAATT |
| 4047 | CCTCTCCATGAGTTGTGAAATTT |
| 4048 | CTCTCCATGAGTTGTGAAATTTA |
| 4049 | TCTCCATGAGTTGTGAAATTTAA |
| 4050 | CTCCATGAGTTGTGAAATTTAAT |
| 4051 | TCCATGAGTTGTGAAATTTAATG |
| 4052 | CCATGAGTTGTGAAATTTAATGC |
| 4053 | CATGAGTTGTGAAATTTAATGCA |
| 4054 | ATGAGTTGTGAAATTTAATGCAC |
| 4055 | TGAGTTGTGAAATTTAATGCACA |
| 4056 | GAGTTGTGAAATTTAATGCACAA |
| 4057 | AGTTGTGAAATTTAATGCACAAC |
| 4058 | GTTGTGAAATTTAATGCACAACG |
| 4059 | TTGTGAAATTTAATGCACAACGC |
| 4060 | TGTGAAATTTAATGCACAACGCT |
| 4061 | GTGAAATTTAATGCACAACGCTG |
| 4062 | TGAAATTTAATGCACAACGCTGA |
| 4063 | GAAATTTAATGCACAACGCTGAT |
| 4064 | AAATTTAATGCACAACGCTGATG |
| 4065 | AATTTAATGCACAACGCTGATGT |
| 4066 | ATTTAATGCACAACGCTGATGTG |
| 4067 | TTTAATGCACAACGCTGATGTGG |
| 4068 | TTAATGCACAACGCTGATGTGGC |
| 4069 | TAATGCACAACGCTGATGTGGCT |
| 4070 | AATGCACAACGCTGATGTGGCTA |
| 4071 | ATGCACAACGCTGATGTGGCTAA |
| 4072 | TGCACAACGCTGATGTGGCTAAC |
| 4073 | GCACAACGCTGATGTGGCTAACA |
| 4074 | CACAACGCTGATGTGGCTAACAA |
| 4075 | ACAACGCTGATGTGGCTAACAAG |
| 4076 | CAACGCTGATGTGGCTAACAAGT |
| 4077 | AACGCTGATGTGGCTAACAAGTT |
| 4078 | ACGCTGATGTGGCTAACAAGTTT |
| 4079 | CGCTGATGTGGCTAACAAGTTTA |
| 4080 | GCTGATGTGGCTAACAAGTTTAT |

| ID | SEQUENCE |
|---|---|
| 4081 | CTGATGTGGCTAACAAGTTTATT |
| 4082 | TGATGTGGCTAACAAGTTTATTT |
| 4083 | GATGTGGCTAACAAGTTTATTTT |
| 4084 | ATGTGGCTAACAAGTTTATTTTA |
| 4085 | TGTGGCTAACAAGTTTATTTTAA |
| 4086 | GTGGCTAACAAGTTTATTTTAAG |
| 4087 | TGGCTAACAAGTTTATTTTAAGA |
| 4088 | GGCTAACAAGTTTATTTTAAGAA |
| 4089 | GCTAACAAGTTTATTTTAAGAAT |
| 4090 | CTAACAAGTTTATTTTAAGAATT |
| 4091 | TAACAAGTTTATTTTAAGAATTG |
| 4092 | AACAAGTTTATTTTAAGAATTGT |
| 4093 | ACAAGTTTATTTTAAGAATTGTT |
| 4094 | CAAGTTTATTTTAAGAATTGTTT |
| 4095 | AAGTTTATTTTAAGAATTGTTTA |
| 4096 | AGTTTATTTTAAGAATTGTTTAG |
| 4097 | GTTTATTTTAAGAATTGTTTAGA |
| 4098 | TTTATTTTAAGAATTGTTTAGAA |
| 4099 | TTATTTTAAGAATTGTTTAGAAA |
| 4100 | TATTTTAAGAATTGTTTAGAAAT |
| 4101 | ATTTTAAGAATTGTTTAGAAATG |
| 4102 | TTTTAAGAATTGTTTAGAAATGC |
| 4103 | TTTAAGAATTGTTTAGAAATGCT |
| 4104 | TTAAGAATTGTTTAGAAATGCTG |
| 4105 | TAAGAATTGTTTAGAAATGCTGT |
| 4106 | AAGAATTGTTTAGAAATGCTGTT |
| 4107 | AGAATTGTTTAGAAATGCTGTTG |
| 4108 | GAATTGTTTAGAAATGCTGTTGC |
| 4109 | AATTGTTTAGAAATGCTGTTGCT |
| 4110 | ATTGTTTAGAAATGCTGTTGCTT |
| 4111 | TTGTTTAGAAATGCTGTTGCTTC |
| 4112 | TGTTTAGAAATGCTGTTGCTTCA |
| 4113 | GTTTAGAAATGCTGTTGCTTCAG |
| 4114 | TTTAGAAATGCTGTTGCTTCAGG |
| 4115 | TTAGAAATGCTGTTGCTTCAGGT |
| 4116 | TAGAAATGCTGTTGCTTCAGGTT |
| 4117 | AGAAATGCTGTTGCTTCAGGTTC |
| 4118 | GAAATGCTGTTGCTTCAGGTTCT |
| 4119 | AAATGCTGTTGCTTCAGGTTCTT |
| 4120 | AATGCTGTTGCTTCAGGTTCTTA |
| 4121 | ATGCTGTTGCTTCAGGTTCTTAA |
| 4122 | TGCTGTTGCTTCAGGTTCTTAAA |
| 4123 | GCTGTTGCTTCAGGTTCTTAAAA |
| 4124 | CTGTTGCTTCAGGTTCTTAAAAT |
| 4125 | TGTTGCTTCAGGTTCTTAAAATC |
| 4126 | GTTGCTTCAGGTTCTTAAAATCA |
| 4127 | TTGCTTCAGGTTCTTAAAATCAC |
| 4128 | TGCTTCAGGTTCTTAAAATCACT |

| ID | SEQUENCE |
|---|---|
| 4129 | GCTTCAGGTTCTTAAAATCACTC |
| 4130 | CTTCAGGTTCTTAAAATCACTCA |
| 4131 | TTCAGGTTCTTAAAATCACTCAG |
| 4132 | TCAGGTTCTTAAAATCACTCAGC |
| 4133 | CAGGTTCTTAAAATCACTCAGCA |
| 4134 | AGGTTCTTAAAATCACTCAGCAC |
| 4135 | GGTTCTTAAAATCACTCAGCACT |
| 4136 | GTTCTTAAAATCACTCAGCACTC |
| 4137 | TTCTTAAAATCACTCAGCACTCC |
| 4138 | TCTTAAAATCACTCAGCACTCCA |
| 4139 | CTTAAAATCACTCAGCACTCCAA |
| 4140 | TTAAAATCACTCAGCACTCCAAC |
| 4141 | TAAAATCACTCAGCACTCCAACT |
| 4142 | AAAATCACTCAGCACTCCAACTT |
| 4143 | AAATCACTCAGCACTCCAACTTC |
| 4144 | AATCACTCAGCACTCCAACTTCT |
| 4145 | ATCACTCAGCACTCCAACTTCTA |
| 4146 | TCACTCAGCACTCCAACTTCTAA |
| 4147 | CACTCAGCACTCCAACTTCTAAT |
| 4148 | ACTCAGCACTCCAACTTCTAATC |
| 4149 | CTCAGCACTCCAACTTCTAATCA |
| 4150 | TCAGCACTCCAACTTCTAATCAA |
| 4151 | CAGCACTCCAACTTCTAATCAAA |
| 4152 | AGCACTCCAACTTCTAATCAAAT |
| 4153 | GCACTCCAACTTCTAATCAAATT |
| 4154 | CACTCCAACTTCTAATCAAATTT |
| 4155 | ACTCCAACTTCTAATCAAATTTT |
| 4156 | CTCCAACTTCTAATCAAATTTTT |
| 4157 | TCCAACTTCTAATCAAATTTTTG |
| 4158 | CCAACTTCTAATCAAATTTTTGG |
| 4159 | CAACTTCTAATCAAATTTTTGGA |
| 4160 | AACTTCTAATCAAATTTTTGGAG |
| 4161 | ACTTCTAATCAAATTTTTGGAGA |
| 4162 | CTTCTAATCAAATTTTTGGAGAC |
| 4163 | TTCTAATCAAATTTTTGGAGACT |
| 4164 | TCTAATCAAATTTTTGGAGACTT |
| 4165 | CTAATCAAATTTTTGGAGACTTA |
| 4166 | TAATCAAATTTTTGGAGACTTAA |
| 4167 | AATCAAATTTTTGGAGACTTAAC |
| 4168 | ATCAAATTTTTGGAGACTTAACA |
| 4169 | TCAAATTTTTGGAGACTTAACAG |
| 4170 | CAAATTTTTGGAGACTTAACAGC |
| 4171 | AAATTTTTGGAGACTTAACAGCA |
| 4172 | AATTTTTGGAGACTTAACAGCAT |
| 4173 | ATTTTTGGAGACTTAACAGCATT |
| 4174 | TTTTTGGAGACTTAACAGCATTT |
| 4175 | TTTTGGAGACTTAACAGCATTTG |
| 4176 | TTTGGAGACTTAACAGCATTTGT |

| ID | SEQUENCE |
|---|---|
| 4177 | TTGGAGACTTAACAGCATTTGTC |
| 4178 | TGGAGACTTAACAGCATTTGTCT |
| 4179 | GGAGACTTAACAGCATTTGTCTG |
| 4180 | GAGACTTAACAGCATTTGTCTGT |
| 4181 | AGACTTAACAGCATTTGTCTGTG |
| 4182 | GACTTAACAGCATTTGTCTGTGT |
| 4183 | ACTTAACAGCATTTGTCTGTGTT |
| 4184 | CTTAACAGCATTTGTCTGTGTTT |
| 4185 | TTAACAGCATTTGTCTGTGTTTG |
| 4186 | TAACAGCATTTGTCTGTGTTTGA |
| 4187 | AACAGCATTTGTCTGTGTTTGAA |
| 4188 | ACAGCATTTGTCTGTGTTTGAAC |
| 4189 | CAGCATTTGTCTGTGTTTGAACT |
| 4190 | AGCATTTGTCTGTGTTTGAACTA |
| 4191 | GCATTTGTCTGTGTTTGAACTAT |
| 4192 | CATTTGTCTGTGTTTGAACTATA |
| 4193 | ATTTGTCTGTGTTTGAACTATAA |
| 4194 | TTTGTCTGTGTTTGAACTATAAA |
| 4195 | TTGTCTGTGTTTGAACTATAAAA |
| 4196 | TGTCTGTGTTTGAACTATAAAAA |
| 4197 | GTCTGTGTTTGAACTATAAAAAG |
| 4198 | TCTGTGTTTGAACTATAAAAAGC |
| 4199 | CTGTGTTTGAACTATAAAAAGCA |
| 4200 | TGTGTTTGAACTATAAAAAGCAC |
| 4201 | GTGTTTGAACTATAAAAAGCACC |
| 4202 | TGTTTGAACTATAAAAAGCACCG |
| 4203 | GTTTGAACTATAAAAAGCACCGG |
| 4204 | TTTGAACTATAAAAAGCACCGGA |
| 4205 | TTGAACTATAAAAAGCACCGGAT |
| 4206 | TGAACTATAAAAAGCACCGGATC |
| 4207 | GAACTATAAAAAGCACCGGATCT |
| 4208 | AACTATAAAAAGCACCGGATCTT |
| 4209 | ACTATAAAAAGCACCGGATCTTT |
| 4210 | CTATAAAAAGCACCGGATCTTTT |
| 4211 | TATAAAAAGCACCGGATCTTTTC |
| 4212 | ATAAAAAGCACCGGATCTTTTCC |
| 4213 | TAAAAAGCACCGGATCTTTTCCA |
| 4214 | AAAAAGCACCGGATCTTTTCCAT |
| 4215 | AAAAGCACCGGATCTTTTCCATC |
| 4216 | AAAGCACCGGATCTTTTCCATCT |
| 4217 | AAGCACCGGATCTTTTCCATCTA |
| 4218 | AGCACCGGATCTTTTCCATCTAA |
| 4219 | GCACCGGATCTTTTCCATCTAAT |
| 4220 | CACCGGATCTTTTCCATCTAATT |
| 4221 | ACCGGATCTTTTCCATCTAATTC |
| 4222 | CCGGATCTTTTCCATCTAATTCC |
| 4223 | CGGATCTTTTCCATCTAATTCCG |
| 4224 | GGATCTTTTCCATCTAATTCCGC |

| ID | SEQUENCE |
|---|---|
| 4225 | GATCTTTTCCATCTAATTCCGCA |
| 4226 | ATCTTTTCCATCTAATTCCGCAA |
| 4227 | TCTTTTCCATCTAATTCCGCAAA |
| 4228 | CTTTTCCATCTAATTCCGCAAAA |
| 4229 | TTTTCCATCTAATTCCGCAAAAA |
| 4230 | TTTCCATCTAATTCCGCAAAAAT |
| 4231 | TTCCATCTAATTCCGCAAAAATT |
| 4232 | TCCATCTAATTCCGCAAAAATTG |
| 4233 | CCATCTAATTCCGCAAAAATTGA |
| 4234 | CATCTAATTCCGCAAAAATTGAT |
| 4235 | ATCTAATTCCGCAAAAATTGATC |
| 4236 | TCTAATTCCGCAAAAATTGATCA |
| 4237 | CTAATTCCGCAAAAATTGATCAT |
| 4238 | TAATTCCGCAAAAATTGATCATT |
| 4239 | AATTCCGCAAAAATTGATCATTT |
| 4240 | ATTCCGCAAAAATTGATCATTTG |
| 4241 | TTCCGCAAAAATTGATCATTTGC |
| 4242 | TCCGCAAAAATTGATCATTTGCA |
| 4243 | CCGCAAAAATTGATCATTTGCAA |
| 4244 | CGCAAAAATTGATCATTTGCAAA |
| 4245 | GCAAAAATTGATCATTTGCAAAG |
| 4246 | CAAAAATTGATCATTTGCAAAGT |
| 4247 | AAAAATTGATCATTTGCAAAGTC |
| 4248 | AAAATTGATCATTTGCAAAGTCA |
| 4249 | AAATTGATCATTTGCAAAGTCAA |
| 4250 | AATTGATCATTTGCAAAGTCAAA |
| 4251 | ATTGATCATTTGCAAAGTCAAAA |
| 4252 | TTGATCATTTGCAAAGTCAAAAC |
| 4253 | TGATCATTTGCAAAGTCAAAACT |
| 4254 | GATCATTTGCAAAGTCAAAACTA |
| 4255 | ATCATTTGCAAAGTCAAAACTAT |
| 4256 | TCATTTGCAAAGTCAAAACTATA |
| 4257 | CATTTGCAAAGTCAAAACTATAG |
| 4258 | ATTTGCAAAGTCAAAACTATAGC |
| 4259 | TTTGCAAAGTCAAAACTATAGCC |
| 4260 | TTGCAAAGTCAAAACTATAGCCA |
| 4261 | TGCAAAGTCAAAACTATAGCCAT |
| 4262 | GCAAAGTCAAAACTATAGCCATA |
| 4263 | CAAAGTCAAAACTATAGCCATAT |
| 4264 | AAAGTCAAAACTATAGCCATATC |
| 4265 | AAGTCAAAACTATAGCCATATCC |
| 4266 | AGTCAAAACTATAGCCATATCCA |
| 4267 | GTCAAAACTATAGCCATATCCAA |
| 4268 | TCAAAACTATAGCCATATCCAAA |
| 4269 | CAAAACTATAGCCATATCCAAAT |
| 4270 | AAAACTATAGCCATATCCAAATC |
| 4271 | AAACTATAGCCATATCCAAATCT |
| 4272 | AACTATAGCCATATCCAAATCTT |

| ID | SEQUENCE |
|---|---|
| 4273 | ACTATAGCCATATCCAAATCTTT |
| 4274 | CTATAGCCATATCCAAATCTTTT |
| 4275 | TATAGCCATATCCAAATCTTTTC |
| 4276 | ATAGCCATATCCAAATCTTTTCC |
| 4277 | TAGCCATATCCAAATCTTTTCCC |
| 4278 | AGCCATATCCAAATCTTTTCCCC |
| 4279 | GCCATATCCAAATCTTTTCCCCC |
| 4280 | CCATATCCAAATCTTTTCCCCCT |
| 4281 | CATATCCAAATCTTTTCCCCCTC |
| 4282 | ATATCCAAATCTTTTCCCCCTCC |
| 4283 | TATCCAAATCTTTTCCCCCTCCC |
| 4284 | ATCCAAATCTTTTCCCCCTCCCA |
| 4285 | TCCAAATCTTTTCCCCCTCCCAA |
| 4286 | CCAAATCTTTTCCCCCTCCCAAG |
| 4287 | CAAATCTTTTCCCCCTCCCAAGA |
| 4288 | AAATCTTTTCCCCCTCCCAAGAG |
| 4289 | AATCTTTTCCCCCTCCCAAGAGT |
| 4290 | ATCTTTTCCCCCTCCCAAGAGTT |
| 4291 | TCTTTTCCCCCTCCCAAGAGTTC |
| 4292 | CTTTTCCCCCTCCCAAGAGTTCT |
| 4293 | TTTTCCCCCTCCCAAGAGTTCTC |
| 4294 | TTTCCCCCTCCCAAGAGTTCTCA |
| 4295 | TTCCCCCTCCCAAGAGTTCTCAG |
| 4296 | TCCCCCTCCCAAGAGTTCTCAGT |
| 4297 | CCCCCTCCCAAGAGTTCTCAGTG |
| 4298 | CCCCTCCCAAGAGTTCTCAGTGT |
| 4299 | CCCTCCCAAGAGTTCTCAGTGTC |
| 4300 | CCTCCCAAGAGTTCTCAGTGTCT |
| 4301 | CTCCCAAGAGTTCTCAGTGTCTA |
| 4302 | TCCCAAGAGTTCTCAGTGTCTAC |
| 4303 | CCCAAGAGTTCTCAGTGTCTACA |
| 4304 | CCAAGAGTTCTCAGTGTCTACAT |
| 4305 | CAAGAGTTCTCAGTGTCTACATG |
| 4306 | AAGAGTTCTCAGTGTCTACATGT |
| 4307 | AGAGTTCTCAGTGTCTACATGTA |
| 4308 | GAGTTCTCAGTGTCTACATGTAG |
| 4309 | AGTTCTCAGTGTCTACATGTAGA |
| 4310 | GTTCTCAGTGTCTACATGTAGAC |
| 4311 | TTCTCAGTGTCTACATGTAGACT |
| 4312 | TCTCAGTGTCTACATGTAGACTA |
| 4313 | CTCAGTGTCTACATGTAGACTAT |
| 4314 | TCAGTGTCTACATGTAGACTATT |
| 4315 | CAGTGTCTACATGTAGACTATTC |
| 4316 | AGTGTCTACATGTAGACTATTCC |
| 4317 | GTGTCTACATGTAGACTATTCCT |
| 4318 | TGTCTACATGTAGACTATTCCTT |
| 4319 | GTCTACATGTAGACTATTCCTTT |
| 4320 | TCTACATGTAGACTATTCCTTTT |

| ID | SEQUENCE |
|---|---|
| 4321 | CTACATGTAGACTATTCCTTTTC |
| 4322 | TACATGTAGACTATTCCTTTTCT |
| 4323 | ACATGTAGACTATTCCTTTTCTG |
| 4324 | CATGTAGACTATTCCTTTTCTGT |
| 4325 | ATGTAGACTATTCCTTTTCTGTA |
| 4326 | TGTAGACTATTCCTTTTCTGTAT |
| 4327 | GTAGACTATTCCTTTTCTGTATA |
| 4328 | TAGACTATTCCTTTTCTGTATAA |
| 4329 | AGACTATTCCTTTTCTGTATAAA |
| 4330 | GACTATTCCTTTTCTGTATAAAG |
| 4331 | ACTATTCCTTTTCTGTATAAAGT |
| 4332 | CTATTCCTTTTCTGTATAAAGTT |
| 4333 | TATTCCTTTTCTGTATAAAGTTC |
| 4334 | ATTCCTTTTCTGTATAAAGTTCA |
| 4335 | TTCCTTTTCTGTATAAAGTTCAC |
| 4336 | TCCTTTTCTGTATAAAGTTCACT |
| 4337 | CCTTTTCTGTATAAAGTTCACTC |
| 4338 | CTTTTCTGTATAAAGTTCACTCT |
| 4339 | TTTTCTGTATAAAGTTCACTCTA |
| 4340 | TTTCTGTATAAAGTTCACTCTAG |
| 4341 | TTCTGTATAAAGTTCACTCTAGG |
| 4342 | TCTGTATAAAGTTCACTCTAGGA |
| 4343 | CTGTATAAAGTTCACTCTAGGAT |
| 4344 | TGTATAAAGTTCACTCTAGGATT |
| 4345 | GTATAAAGTTCACTCTAGGATTT |
| 4346 | TATAAAGTTCACTCTAGGATTTC |
| 4347 | ATAAAGTTCACTCTAGGATTTCA |
| 4348 | TAAAGTTCACTCTAGGATTTCAA |
| 4349 | AAAGTTCACTCTAGGATTTCAAG |
| 4350 | AAGTTCACTCTAGGATTTCAAGT |
| 4351 | AGTTCACTCTAGGATTTCAAGTC |
| 4352 | GTTCACTCTAGGATTTCAAGTCA |
| 4353 | TTCACTCTAGGATTTCAAGTCAC |
| 4354 | TCACTCTAGGATTTCAAGTCACC |
| 4355 | CACTCTAGGATTTCAAGTCACCA |
| 4356 | ACTCTAGGATTTCAAGTCACCAC |
| 4357 | CTCTAGGATTTCAAGTCACCACT |
| 4358 | TCTAGGATTTCAAGTCACCACTT |
| 4359 | CTAGGATTTCAAGTCACCACTTA |
| 4360 | TAGGATTTCAAGTCACCACTTAT |
| 4361 | AGGATTTCAAGTCACCACTTATT |
| 4362 | GGATTTCAAGTCACCACTTATTT |
| 4363 | GATTTCAAGTCACCACTTATTTT |
| 4364 | ATTTCAAGTCACCACTTATTTTA |
| 4365 | TTTCAAGTCACCACTTATTTTAC |
| 4366 | TTCAAGTCACCACTTATTTTACA |
| 4367 | TCAAGTCACCACTTATTTTACAT |
| 4368 | CAAGTCACCACTTATTTTACATT |

| ID | SEQUENCE |
|---|---|
| 4369 | AAGTCACCACTTATTTTACATTT |
| 4370 | AGTCACCACTTATTTTACATTTT |
| 4371 | GTCACCACTTATTTTACATTTTA |
| 4372 | TCACCACTTATTTTACATTTTAG |
| 4373 | CACCACTTATTTTACATTTTAGT |
| 4374 | ACCACTTATTTTACATTTTAGTC |
| 4375 | CCACTTATTTTACATTTTAGTCA |
| 4376 | CACTTATTTTACATTTTAGTCAT |
| 4377 | ACTTATTTTACATTTTAGTCATG |
| 4378 | CTTATTTTACATTTTAGTCATGC |
| 4379 | TTATTTTACATTTTAGTCATGCA |
| 4380 | TATTTTACATTTTAGTCATGCAA |
| 4381 | ATTTTACATTTTAGTCATGCAAA |
| 4382 | TTTTACATTTTAGTCATGCAAAG |
| 4383 | TTTACATTTTAGTCATGCAAAGA |
| 4384 | TTACATTTTAGTCATGCAAAGAT |
| 4385 | TACATTTTAGTCATGCAAAGATT |
| 4386 | ACATTTTAGTCATGCAAAGATTC |
| 4387 | CATTTTAGTCATGCAAAGATTCA |
| 4388 | ATTTTAGTCATGCAAAGATTCAA |
| 4389 | TTTTAGTCATGCAAAGATTCAAG |
| 4390 | TTTAGTCATGCAAAGATTCAAGT |
| 4391 | TTAGTCATGCAAAGATTCAAGTA |
| 4392 | TAGTCATGCAAAGATTCAAGTAG |
| 4393 | AGTCATGCAAAGATTCAAGTAGT |
| 4394 | GTCATGCAAAGATTCAAGTAGTT |
| 4395 | TCATGCAAAGATTCAAGTAGTTT |
| 4396 | CATGCAAAGATTCAAGTAGTTTT |
| 4397 | ATGCAAAGATTCAAGTAGTTTTG |
| 4398 | TGCAAAGATTCAAGTAGTTTTGC |
| 4399 | GCAAAGATTCAAGTAGTTTTGCA |
| 4400 | CAAAGATTCAAGTAGTTTTGCAA |
| 4401 | AAAGATTCAAGTAGTTTTGCAAT |
| 4402 | AAGATTCAAGTAGTTTTGCAATA |
| 4403 | AGATTCAAGTAGTTTTGCAATAA |
| 4404 | GATTCAAGTAGTTTTGCAATAAG |
| 4405 | ATTCAAGTAGTTTTGCAATAAGT |
| 4406 | TTCAAGTAGTTTTGCAATAAGTA |
| 4407 | TCAAGTAGTTTTGCAATAAGTAC |
| 4408 | CAAGTAGTTTTGCAATAAGTACT |
| 4409 | AAGTAGTTTTGCAATAAGTACTT |
| 4410 | AGTAGTTTTGCAATAAGTACTTA |
| 4411 | GTAGTTTTGCAATAAGTACTTAT |
| 4412 | TAGTTTTGCAATAAGTACTTATC |
| 4413 | AGTTTTGCAATAAGTACTTATCT |
| 4414 | GTTTTGCAATAAGTACTTATCTT |
| 4415 | TTTTGCAATAAGTACTTATCTTT |
| 4416 | TTTGCAATAAGTACTTATCTTTA |

| ID | SEQUENCE |
|---|---|
| 4417 | TTGCAATAAGTACTTATCTTTAT |
| 4418 | TGCAATAAGTACTTATCTTTATT |
| 4419 | GCAATAAGTACTTATCTTTATTT |
| 4420 | CAATAAGTACTTATCTTTATTTG |
| 4421 | AATAAGTACTTATCTTTATTTGT |
| 4422 | ATAAGTACTTATCTTTATTTGTA |
| 4423 | TAAGTACTTATCTTTATTTGTAA |
| 4424 | AAGTACTTATCTTTATTTGTAAT |
| 4425 | AGTACTTATCTTTATTTGTAATA |
| 4426 | GTACTTATCTTTATTTGTAATAA |
| 4427 | TACTTATCTTTATTTGTAATAAT |
| 4428 | ACTTATCTTTATTTGTAATAATT |
| 4429 | CTTATCTTTATTTGTAATAATTT |
| 4430 | TTATCTTTATTTGTAATAATTTA |
| 4431 | TATCTTTATTTGTAATAATTTAG |
| 4432 | ATCTTTATTTGTAATAATTTAGT |
| 4433 | TCTTTATTTGTAATAATTTAGTC |
| 4434 | CTTTATTTGTAATAATTTAGTCT |
| 4435 | TTTATTTGTAATAATTTAGTCTG |
| 4436 | TTATTTGTAATAATTTAGTCTGC |
| 4437 | TATTTGTAATAATTTAGTCTGCT |
| 4438 | ATTTGTAATAATTTAGTCTGCTG |
| 4439 | TTTGTAATAATTTAGTCTGCTGA |
| 4440 | TTGTAATAATTTAGTCTGCTGAT |
| 4441 | TGTAATAATTTAGTCTGCTGATC |
| 4442 | GTAATAATTTAGTCTGCTGATCA |
| 4443 | TAATAATTTAGTCTGCTGATCAA |
| 4444 | AATAATTTAGTCTGCTGATCAAA |
| 4445 | ATAATTTAGTCTGCTGATCAAAA |
| 4446 | TAATTTAGTCTGCTGATCAAAAG |
| 4447 | AATTTAGTCTGCTGATCAAAAGC |
| 4448 | ATTTAGTCTGCTGATCAAAAGCA |
| 4449 | TTTAGTCTGCTGATCAAAAGCAT |
| 4450 | TTAGTCTGCTGATCAAAAGCATT |
| 4451 | TAGTCTGCTGATCAAAAGCATTG |
| 4452 | AGTCTGCTGATCAAAAGCATTGT |
| 4453 | GTCTGCTGATCAAAAGCATTGTC |
| 4454 | TCTGCTGATCAAAAGCATTGTCT |
| 4455 | CTGCTGATCAAAAGCATTGTCTT |
| 4456 | TGCTGATCAAAAGCATTGTCTTA |
| 4457 | GCTGATCAAAAGCATTGTCTTAA |
| 4458 | CTGATCAAAAGCATTGTCTTAAT |
| 4459 | TGATCAAAAGCATTGTCTTAATT |
| 4460 | GATCAAAAGCATTGTCTTAATTT |
| 4461 | ATCAAAAGCATTGTCTTAATTTT |
| 4462 | TCAAAAGCATTGTCTTAATTTTT |
| 4463 | CAAAAGCATTGTCTTAATTTTTG |
| 4464 | AAAAGCATTGTCTTAATTTTTGA |

| ID | SEQUENCE |
|---|---|
| 4465 | AAAGCATTGTCTTAATTTTGAG |
| 4466 | AAGCATTGTCTTAATTTTGAGA |
| 4467 | AGCATTGTCTTAATTTTGAGAA |
| 4468 | GCATTGTCTTAATTTTGAGAAC |
| 4469 | CATTGTCTTAATTTTGAGAACT |
| 4470 | ATTGTCTTAATTTTGAGAACTG |
| 4471 | TTGTCTTAATTTTGAGAACTGG |
| 4472 | TGTCTTAATTTTGAGAACTGGT |
| 4473 | GTCTTAATTTTGAGAACTGGTT |
| 4474 | TCTTAATTTTGAGAACTGGTTT |
| 4475 | CTTAATTTTGAGAACTGGTTTT |
| 4476 | TTAATTTTGAGAACTGGTTTTA |
| 4477 | TAATTTTGAGAACTGGTTTTAG |
| 4478 | AATTTTGAGAACTGGTTTTAGC |
| 4479 | ATTTTGAGAACTGGTTTTAGCA |
| 4480 | TTTTGAGAACTGGTTTTAGCAT |
| 4481 | TTTGAGAACTGGTTTTAGCATT |
| 4482 | TTGAGAACTGGTTTTAGCATTT |
| 4483 | TGAGAACTGGTTTTAGCATTTA |
| 4484 | GAGAACTGGTTTTAGCATTTAC |
| 4485 | AGAACTGGTTTTAGCATTTACA |
| 4486 | GAACTGGTTTTAGCATTTACAA |
| 4487 | AACTGGTTTTAGCATTTACAAA |
| 4488 | ACTGGTTTTAGCATTTACAAAC |
| 4489 | CTGGTTTTAGCATTTACAAACT |
| 4490 | TGGTTTTAGCATTTACAAACTA |
| 4491 | GGTTTTAGCATTTACAAACTAA |
| 4492 | GTTTTAGCATTTACAAACTAAA |
| 4493 | TTTTAGCATTTACAAACTAAAT |
| 4494 | TTTAGCATTTACAAACTAAATT |
| 4495 | TTAGCATTTACAAACTAAATTC |
| 4496 | TAGCATTTACAAACTAAATTCC |
| 4497 | AGCATTTACAAACTAAATTCCA |
| 4498 | GCATTTACAAACTAAATTCCAG |
| 4499 | CATTTACAAACTAAATTCCAGT |
| 4500 | ATTTACAAACTAAATTCCAGTT |
| 4501 | TTTACAAACTAAATTCCAGTTA |
| 4502 | TTACAAACTAAATTCCAGTTAA |
| 4503 | TACAAACTAAATTCCAGTTAAT |
| 4504 | ACAAACTAAATTCCAGTTAATT |
| 4505 | CAAACTAAATTCCAGTTAATTA |
| 4506 | AAACTAAATTCCAGTTAATTAA |
| 4507 | AACTAAATTCCAGTTAATTAAT |
| 4508 | ACTAAATTCCAGTTAATTAATT |
| 4509 | CTAAATTCCAGTTAATTAATTA |
| 4510 | TAAATTCCAGTTAATTAATTAA |
| 4511 | AAATTCCAGTTAATTAATTAAT |
| 4512 | AATTCCAGTTAATTAATTAATA |

| ID | SEQUENCE |
|---|---|
| 4513 | AATTCCAGTTAATTAATTAATAG |
| 4514 | ATTCCAGTTAATTAATTAATAGC |
| 4515 | TTCCAGTTAATTAATTAATAGCT |
| 4516 | TCCAGTTAATTAATTAATAGCTT |
| 4517 | CCAGTTAATTAATTAATAGCTTT |
| 4518 | CAGTTAATTAATTAATAGCTTTA |
| 4519 | AGTTAATTAATTAATAGCTTTAT |
| 4520 | GTTAATTAATTAATAGCTTTATA |
| 4521 | TTAATTAATTAATAGCTTTATAT |
| 4522 | TAATTAATTAATAGCTTTATATT |
| 4523 | AATTAATTAATAGCTTTATATTG |
| 4524 | ATTAATTAATAGCTTTATATTGC |
| 4525 | TTAATTAATAGCTTTATATTGCC |
| 4526 | TAATTAATAGCTTTATATTGCCT |
| 4527 | AATTAATAGCTTTATATTGCCTT |
| 4528 | ATTAATAGCTTTATATTGCCTTT |
| 4529 | TTAATAGCTTTATATTGCCTTTC |
| 4530 | TAATAGCTTTATATTGCCTTTCC |
| 4531 | AATAGCTTTATATTGCCTTTCCT |
| 4532 | ATAGCTTTATATTGCCTTTCCTG |
| 4533 | TAGCTTTATATTGCCTTTCCTGC |
| 4534 | AGCTTTATATTGCCTTTCCTGCT |
| 4535 | GCTTTATATTGCCTTTCCTGCTA |
| 4536 | CTTTATATTGCCTTTCCTGCTAC |
| 4537 | TTTATATTGCCTTTCCTGCTACA |
| 4538 | TTATATTGCCTTTCCTGCTACAT |
| 4539 | TATATTGCCTTTCCTGCTACATT |
| 4540 | ATATTGCCTTTCCTGCTACATTT |
| 4541 | TATTGCCTTTCCTGCTACATTTG |
| 4542 | ATTGCCTTTCCTGCTACATTTGG |
| 4543 | TTGCCTTTCCTGCTACATTTGGT |
| 4544 | TGCCTTTCCTGCTACATTTGGTT |
| 4545 | GCCTTTCCTGCTACATTTGGTTT |
| 4546 | CCTTTCCTGCTACATTTGGTTTT |
| 4547 | CTTTCCTGCTACATTTGGTTTTT |
| 4548 | TTTCCTGCTACATTTGGTTTTTT |
| 4549 | TTCCTGCTACATTTGGTTTTTTC |
| 4550 | TCCTGCTACATTTGGTTTTTTCC |
| 4551 | CCTGCTACATTTGGTTTTTTCCC |
| 4552 | CTGCTACATTTGGTTTTTTCCCC |
| 4553 | TGCTACATTTGGTTTTTTCCCCT |
| 4554 | GCTACATTTGGTTTTTTCCCCTG |
| 4555 | CTACATTTGGTTTTTTCCCCTGT |
| 4556 | TACATTTGGTTTTTTCCCCTGTC |
| 4557 | ACATTTGGTTTTTTCCCCTGTCC |
| 4558 | CATTTGGTTTTTTCCCCTGTCCC |
| 4559 | ATTTGGTTTTTTCCCCTGTCCCT |
| 4560 | TTTGGTTTTTTCCCCTGTCCCTT |

| ID | SEQUENCE |
|---|---|
| 4561 | TTGGTTTTTCCCCTGTCCCTTT |
| 4562 | TGGTTTTTTCCCCTGTCCCTTTG |
| 4563 | GGTTTTTTCCCCTGTCCCTTTGA |
| 4564 | GTTTTTTCCCCTGTCCCTTTGAT |
| 4565 | TTTTTTCCCCTGTCCCTTTGATT |
| 4566 | TTTTTCCCCTGTCCCTTTGATTA |
| 4567 | TTTTCCCCTGTCCCTTTGATTAC |
| 4568 | TTTCCCCTGTCCCTTTGATTACG |
| 4569 | TTCCCCTGTCCCTTTGATTACGG |
| 4570 | TCCCCTGTCCCTTTGATTACGGG |
| 4571 | CCCCTGTCCCTTTGATTACGGGC |
| 4572 | CCCTGTCCCTTTGATTACGGGCT |
| 4573 | CCTGTCCCTTTGATTACGGGCTA |
| 4574 | CTGTCCCTTTGATTACGGGCTAA |
| 4575 | TGTCCCTTTGATTACGGGCTAAG |
| 4576 | GTCCCTTTGATTACGGGCTAAGG |
| 4577 | TCCCTTTGATTACGGGCTAAGGT |
| 4578 | CCCTTTGATTACGGGCTAAGGTA |
| 4579 | CCTTTGATTACGGGCTAAGGTAG |
| 4580 | CTTTGATTACGGGCTAAGGTAGG |
| 4581 | TTTGATTACGGGCTAAGGTAGGG |
| 4582 | TTGATTACGGGCTAAGGTAGGGT |
| 4583 | TGATTACGGGCTAAGGTAGGGTA |
| 4584 | GATTACGGGCTAAGGTAGGGTAG |
| 4585 | ATTACGGGCTAAGGTAGGGTAGA |
| 4586 | TTACGGGCTAAGGTAGGGTAGAG |
| 4587 | TACGGGCTAAGGTAGGGTAGAGT |
| 4588 | ACGGGCTAAGGTAGGGTAGAGTG |
| 4589 | CGGGCTAAGGTAGGGTAGAGTGG |
| 4590 | GGGCTAAGGTAGGGTAGAGTGGG |
| 4591 | GGCTAAGGTAGGGTAGAGTGGGT |
| 4592 | GCTAAGGTAGGGTAGAGTGGGTG |
| 4593 | CTAAGGTAGGGTAGAGTGGGTGT |
| 4594 | TAAGGTAGGGTAGAGTGGGTGTA |
| 4595 | AAGGTAGGGTAGAGTGGGTGTAG |
| 4596 | AGGTAGGGTAGAGTGGGTGTAGT |
| 4597 | GGTAGGGTAGAGTGGGTGTAGTG |
| 4598 | GTAGGGTAGAGTGGGTGTAGTGA |
| 4599 | TAGGGTAGAGTGGGTGTAGTGAG |
| 4600 | AGGGTAGAGTGGGTGTAGTGAGT |
| 4601 | GGGTAGAGTGGGTGTAGTGAGTG |
| 4602 | GGTAGAGTGGGTGTAGTGAGTGT |
| 4603 | GTAGAGTGGGTGTAGTGAGTGTA |
| 4604 | TAGAGTGGGTGTAGTGAGTGTAT |
| 4605 | AGAGTGGGTGTAGTGAGTGTATA |
| 4606 | GAGTGGGTGTAGTGAGTGTATAT |
| 4607 | AGTGGGTGTAGTGAGTGTATATA |
| 4608 | GTGGGTGTAGTGAGTGTATATAA |

| ID | SEQUENCE |
|---|---|
| 4609 | TGGGTGTAGTGAGTGTATATAAT |
| 4610 | GGGTGTAGTGAGTGTATATAATG |
| 4611 | GGTGTAGTGAGTGTATATAATGT |
| 4612 | GTGTAGTGAGTGTATATAATGTG |
| 4613 | TGTAGTGAGTGTATATAATGTGA |
| 4614 | GTAGTGAGTGTATATAATGTGAT |
| 4615 | TAGTGAGTGTATATAATGTGATT |
| 4616 | AGTGAGTGTATATAATGTGATTT |
| 4617 | GTGAGTGTATATAATGTGATTTG |
| 4618 | TGAGTGTATATAATGTGATTTGG |
| 4619 | GAGTGTATATAATGTGATTTGGC |
| 4620 | AGTGTATATAATGTGATTTGGCC |
| 4621 | GTGTATATAATGTGATTTGGCCC |
| 4622 | TGTATATAATGTGATTTGGCCCT |
| 4623 | GTATATAATGTGATTTGGCCCTG |
| 4624 | TATATAATGTGATTTGGCCCTGT |
| 4625 | ATATAATGTGATTTGGCCCTGTG |
| 4626 | TATAATGTGATTTGGCCCTGTGT |
| 4627 | ATAATGTGATTTGGCCCTGTGTA |
| 4628 | TAATGTGATTTGGCCCTGTGTAT |
| 4629 | AATGTGATTTGGCCCTGTGTATT |
| 4630 | ATGTGATTTGGCCCTGTGTATTA |
| 4631 | TGTGATTTGGCCCTGTGTATTAT |
| 4632 | GTGATTTGGCCCTGTGTATTATG |
| 4633 | TGATTTGGCCCTGTGTATTATGA |
| 4634 | GATTTGGCCCTGTGTATTATGAT |
| 4635 | ATTTGGCCCTGTGTATTATGATA |
| 4636 | TTTGGCCCTGTGTATTATGATAT |
| 4637 | TTGGCCCTGTGTATTATGATATT |
| 4638 | TGGCCCTGTGTATTATGATATTT |
| 4639 | GGCCCTGTGTATTATGATATTTT |
| 4640 | GCCCTGTGTATTATGATATTTTG |
| 4641 | CCCTGTGTATTATGATATTTTGT |
| 4642 | CCTGTGTATTATGATATTTTGTT |
| 4643 | CTGTGTATTATGATATTTTGTTA |
| 4644 | TGTGTATTATGATATTTTGTTAT |
| 4645 | GTGTATTATGATATTTTGTTATT |
| 4646 | TGTATTATGATATTTTGTTATTT |
| 4647 | GTATTATGATATTTTGTTATTTT |
| 4648 | TATTATGATATTTTGTTATTTTT |
| 4649 | ATTATGATATTTTGTTATTTTTG |
| 4650 | TTATGATATTTTGTTATTTTTGT |
| 4651 | TATGATATTTTGTTATTTTTGTT |
| 4652 | ATGATATTTTGTTATTTTTGTTG |
| 4653 | TGATATTTTGTTATTTTTGTTGT |
| 4654 | GATATTTTGTTATTTTTGTTGTT |
| 4655 | ATATTTTGTTATTTTTGTTGTTA |
| 4656 | TATTTTGTTATTTTTGTTGTTAT |

| ID | SEQUENCE |
|---|---|
| 4657 | ATTTTGTTATTTTTGTTGTTATA |
| 4658 | TTTTGTTATTTTTGTTGTTATAT |
| 4659 | TTTGTTATTTTTGTTGTTATATT |
| 4660 | TTGTTATTTTTGTTGTTATATTA |
| 4661 | TGTTATTTTTGTTGTTATATTAT |
| 4662 | GTTATTTTTGTTGTTATATTATT |
| 4663 | TTATTTTTGTTGTTATATTATTT |
| 4664 | TATTTTTGTTGTTATATTATTTA |
| 4665 | ATTTTTGTTGTTATATTATTTAC |
| 4666 | TTTTTGTTGTTATATTATTTACA |
| 4667 | TTTTGTTGTTATATTATTTACAT |
| 4668 | TTTGTTGTTATATTATTTACATT |
| 4669 | TTGTTGTTATATTATTTACATTT |
| 4670 | TGTTGTTATATTATTTACATTTC |
| 4671 | GTTGTTATATTATTTACATTTCA |
| 4672 | TTGTTATATTATTTACATTTCAG |
| 4673 | TGTTATATTATTTACATTTCAGT |
| 4674 | GTTATATTATTTACATTTCAGTA |
| 4675 | TTATATTATTTACATTTCAGTAG |
| 4676 | TATATTATTTACATTTCAGTAGT |
| 4677 | ATATTATTTACATTTCAGTAGTT |
| 4678 | TATTATTTACATTTCAGTAGTTG |
| 4679 | ATTATTTACATTTCAGTAGTTGT |
| 4680 | TTATTTACATTTCAGTAGTTGTT |
| 4681 | TATTTACATTTCAGTAGTTGTTT |
| 4682 | ATTTACATTTCAGTAGTTGTTTT |
| 4683 | TTTACATTTCAGTAGTTGTTTTT |
| 4684 | TTACATTTCAGTAGTTGTTTTTT |
| 4685 | TACATTTCAGTAGTTGTTTTTTG |
| 4686 | ACATTTCAGTAGTTGTTTTTTGT |
| 4687 | CATTTCAGTAGTTGTTTTTTGTG |
| 4688 | ATTTCAGTAGTTGTTTTTTGTGT |
| 4689 | TTTCAGTAGTTGTTTTTTGTGTT |
| 4690 | TTCAGTAGTTGTTTTTTGTGTTT |
| 4691 | TCAGTAGTTGTTTTTTGTGTTTC |
| 4692 | CAGTAGTTGTTTTTTGTGTTTCC |
| 4693 | AGTAGTTGTTTTTTGTGTTTCCA |
| 4694 | GTAGTTGTTTTTTGTGTTTCCAT |
| 4695 | TAGTTGTTTTTTGTGTTTCCATT |
| 4696 | AGTTGTTTTTTGTGTTTCCATTT |
| 4697 | GTTGTTTTTTGTGTTTCCATTTT |
| 4698 | TTGTTTTTTGTGTTTCCATTTTA |
| 4699 | TGTTTTTTGTGTTTCCATTTTAG |
| 4700 | GTTTTTTGTGTTTCCATTTTAGT |
| 4701 | TTTTTTGTGTTTCCATTTTAGTG |
| 4702 | TTTTTGTGTTTCCATTTTAGTGG |
| 4703 | TTTTGTGTTTCCATTTTAGTGGA |
| 4704 | TTTGTGTTTCCATTTTAGTGGAT |

| ID | SEQUENCE |
|---|---|
| 4705 | TTGTGTTTCCATTTTAGTGGATA |
| 4706 | TGTGTTTCCATTTTAGTGGATAA |
| 4707 | GTGTTTCCATTTTAGTGGATAAA |
| 4708 | TGTTTCCATTTTAGTGGATAAAA |
| 4709 | GTTTCCATTTTAGTGGATAAAAT |
| 4710 | TTTCCATTTTAGTGGATAAAATT |
| 4711 | TTCCATTTTAGTGGATAAAATTT |
| 4712 | TCCATTTTAGTGGATAAAATTTG |
| 4713 | CCATTTTAGTGGATAAAATTTGT |
| 4714 | CATTTTAGTGGATAAAATTTGTA |
| 4715 | ATTTTAGTGGATAAAATTTGTAT |
| 4716 | TTTTAGTGGATAAAATTTGTATT |
| 4717 | TTTAGTGGATAAAATTTGTATTT |
| 4718 | TTAGTGGATAAAATTTGTATTTT |
| 4719 | TAGTGGATAAAATTTGTATTTTG |
| 4720 | AGTGGATAAAATTTGTATTTTGA |
| 4721 | GTGGATAAAATTTGTATTTTGAA |
| 4722 | TGGATAAAATTTGTATTTTGAAC |
| 4723 | GGATAAAATTTGTATTTTGAACT |
| 4724 | GATAAAATTTGTATTTTGAACTA |
| 4725 | ATAAAATTTGTATTTTGAACTAT |
| 4726 | TAAAATTTGTATTTTGAACTATG |
| 4727 | AAAATTTGTATTTTGAACTATGA |
| 4728 | AAATTTGTATTTTGAACTATGAA |
| 4729 | AATTTGTATTTTGAACTATGAAT |
| 4730 | ATTTGTATTTTGAACTATGAATG |
| 4731 | TTTGTATTTTGAACTATGAATGG |
| 4732 | TTGTATTTTGAACTATGAATGGA |
| 4733 | TGTATTTTGAACTATGAATGGAG |
| 4734 | GTATTTTGAACTATGAATGGAGA |
| 4735 | TATTTTGAACTATGAATGGAGAC |
| 4736 | ATTTTGAACTATGAATGGAGACT |
| 4737 | TTTTGAACTATGAATGGAGACTA |
| 4738 | TTTGAACTATGAATGGAGACTAC |
| 4739 | TTGAACTATGAATGGAGACTACC |
| 4740 | TGAACTATGAATGGAGACTACCG |
| 4741 | GAACTATGAATGGAGACTACCGC |
| 4742 | AACTATGAATGGAGACTACCGCC |
| 4743 | ACTATGAATGGAGACTACCGCCC |
| 4744 | CTATGAATGGAGACTACCGCCCC |
| 4745 | TATGAATGGAGACTACCGCCCCA |
| 4746 | ATGAATGGAGACTACCGCCCCAG |
| 4747 | TGAATGGAGACTACCGCCCCAGC |
| 4748 | GAATGGAGACTACCGCCCCAGCA |
| 4749 | AATGGAGACTACCGCCCCAGCAT |
| 4750 | ATGGAGACTACCGCCCCAGCATT |
| 4751 | TGGAGACTACCGCCCCAGCATTA |
| 4752 | GGAGACTACCGCCCCAGCATTAG |

| ID | SEQUENCE |
|---|---|
| 4753 | GAGACTACCGCCCCAGCATTAGT |
| 4754 | AGACTACCGCCCCAGCATTAGTT |
| 4755 | GACTACCGCCCCAGCATTAGTTT |
| 4756 | ACTACCGCCCCAGCATTAGTTTC |
| 4757 | CTACCGCCCCAGCATTAGTTTCA |
| 4758 | TACCGCCCCAGCATTAGTTTCAC |
| 4759 | ACCGCCCCAGCATTAGTTTCACA |
| 4760 | CCGCCCCAGCATTAGTTTCACAT |
| 4761 | CGCCCCAGCATTAGTTTCACATG |
| 4762 | GCCCCAGCATTAGTTTCACATGA |
| 4763 | CCCCAGCATTAGTTTCACATGAT |
| 4764 | CCCAGCATTAGTTTCACATGATA |
| 4765 | CCAGCATTAGTTTCACATGATAT |
| 4766 | CAGCATTAGTTTCACATGATATA |
| 4767 | AGCATTAGTTTCACATGATATAC |
| 4768 | GCATTAGTTTCACATGATATACC |
| 4769 | CATTAGTTTCACATGATATACCC |
| 4770 | ATTAGTTTCACATGATATACCCT |
| 4771 | TTAGTTTCACATGATATACCCTT |
| 4772 | TAGTTTCACATGATATACCCTTT |
| 4773 | AGTTTCACATGATATACCCTTTA |
| 4774 | GTTTCACATGATATACCCTTTAA |
| 4775 | TTTCACATGATATACCCTTTAAA |
| 4776 | TTCACATGATATACCCTTTAAAC |
| 4777 | TCACATGATATACCCTTTAAACC |
| 4778 | CACATGATATACCCTTTAAACCC |
| 4779 | ACATGATATACCCTTTAAACCCG |
| 4780 | CATGATATACCCTTTAAACCCGA |
| 4781 | ATGATATACCCTTTAAACCCGAA |
| 4782 | TGATATACCCTTTAAACCCGAAT |
| 4783 | GATATACCCTTTAAACCCGAATC |
| 4784 | ATATACCCTTTAAACCCGAATCA |
| 4785 | TATACCCTTTAAACCCGAATCAT |
| 4786 | ATACCCTTTAAACCCGAATCATT |
| 4787 | TACCCTTTAAACCCGAATCATTG |
| 4788 | ACCCTTTAAACCCGAATCATTGT |
| 4789 | CCCTTTAAACCCGAATCATTGTT |
| 4790 | CCTTTAAACCCGAATCATTGTTT |
| 4791 | CTTTAAACCCGAATCATTGTTTT |
| 4792 | TTTAAACCCGAATCATTGTTTTA |
| 4793 | TTAAACCCGAATCATTGTTTTAT |
| 4794 | TAAACCCGAATCATTGTTTTATT |
| 4795 | AAACCCGAATCATTGTTTTATTT |
| 4796 | AACCCGAATCATTGTTTTATTTC |
| 4797 | ACCCGAATCATTGTTTTATTTCC |
| 4798 | CCCGAATCATTGTTTTATTTCCT |
| 4799 | CCGAATCATTGTTTTATTTCCTG |
| 4800 | CGAATCATTGTTTTATTTCCTGA |

| ID | SEQUENCE |
|---|---|
| 4801 | GAATCATTGTTTTATTTCCTGAT |
| 4802 | AATCATTGTTTTATTTCCTGATT |
| 4803 | ATCATTGTTTTATTTCCTGATTA |
| 4804 | TCATTGTTTTATTTCCTGATTAC |
| 4805 | CATTGTTTTATTTCCTGATTACA |
| 4806 | ATTGTTTTATTTCCTGATTACAC |
| 4807 | TTGTTTTATTTCCTGATTACACA |
| 4808 | TGTTTTATTTCCTGATTACACAG |
| 4809 | GTTTTATTTCCTGATTACACAGG |
| 4810 | TTTTATTTCCTGATTACACAGGT |
| 4811 | TTTATTTCCTGATTACACAGGTG |
| 4812 | TTATTTCCTGATTACACAGGTGT |
| 4813 | TATTTCCTGATTACACAGGTGTT |
| 4814 | ATTTCCTGATTACACAGGTGTTG |
| 4815 | TTTCCTGATTACACAGGTGTTGA |
| 4816 | TTCCTGATTACACAGGTGTTGAA |
| 4817 | TCCTGATTACACAGGTGTTGAAT |
| 4818 | CCTGATTACACAGGTGTTGAATG |
| 4819 | CTGATTACACAGGTGTTGAATGG |
| 4820 | TGATTACACAGGTGTTGAATGGG |
| 4821 | GATTACACAGGTGTTGAATGGGG |
| 4822 | ATTACACAGGTGTTGAATGGGGA |
| 4823 | TTACACAGGTGTTGAATGGGGAA |
| 4824 | TACACAGGTGTTGAATGGGGAAA |
| 4825 | ACACAGGTGTTGAATGGGGAAAG |
| 4826 | CACAGGTGTTGAATGGGGAAAGG |
| 4827 | ACAGGTGTTGAATGGGGAAAGGG |
| 4828 | CAGGTGTTGAATGGGGAAAGGGG |
| 4829 | AGGTGTTGAATGGGGAAAGGGGC |
| 4830 | GGTGTTGAATGGGGAAAGGGGCT |
| 4831 | GTGTTGAATGGGGAAAGGGGCTA |
| 4832 | TGTTGAATGGGGAAAGGGGCTAG |
| 4833 | GTTGAATGGGGAAAGGGGCTAGT |
| 4834 | TTGAATGGGGAAAGGGGCTAGTA |
| 4835 | TGAATGGGGAAAGGGGCTAGTAT |
| 4836 | GAATGGGGAAAGGGGCTAGTATA |
| 4837 | AATGGGGAAAGGGGCTAGTATAT |
| 4838 | ATGGGGAAAGGGGCTAGTATATC |
| 4839 | TGGGGAAAGGGGCTAGTATATCA |
| 4840 | GGGGAAAGGGGCTAGTATATCAG |
| 4841 | GGGAAAGGGGCTAGTATATCAGT |
| 4842 | GGAAAGGGGCTAGTATATCAGTA |
| 4843 | GAAAGGGGCTAGTATATCAGTAG |
| 4844 | AAAGGGGCTAGTATATCAGTAGG |
| 4845 | AAGGGGCTAGTATATCAGTAGGA |
| 4846 | AGGGGCTAGTATATCAGTAGGAT |
| 4847 | GGGGCTAGTATATCAGTAGGATA |
| 4848 | GGGCTAGTATATCAGTAGGATAT |

| ID | SEQUENCE |
|---|---|
| 4849 | GGCTAGTATATCAGTAGGATATA |
| 4850 | GCTAGTATATCAGTAGGATATAC |
| 4851 | CTAGTATATCAGTAGGATATACT |
| 4852 | TAGTATATCAGTAGGATATACTA |
| 4853 | AGTATATCAGTAGGATATACTAT |
| 4854 | GTATATCAGTAGGATATACTATG |
| 4855 | TATATCAGTAGGATATACTATGG |
| 4856 | ATATCAGTAGGATATACTATGGG |
| 4857 | TATCAGTAGGATATACTATGGGA |
| 4858 | ATCAGTAGGATATACTATGGGAT |
| 4859 | TCAGTAGGATATACTATGGGATG |
| 4860 | CAGTAGGATATACTATGGGATGT |
| 4861 | AGTAGGATATACTATGGGATGTA |
| 4862 | GTAGGATATACTATGGGATGTAT |
| 4863 | TAGGATATACTATGGGATGTATA |
| 4864 | AGGATATACTATGGGATGTATAT |
| 4865 | GGATATACTATGGGATGTATATA |
| 4866 | GATATACTATGGGATGTATATAT |
| 4867 | ATATACTATGGGATGTATATATA |
| 4868 | TATACTATGGGATGTATATATAT |
| 4869 | ATACTATGGGATGTATATATATC |
| 4870 | TACTATGGGATGTATATATATCA |
| 4871 | ACTATGGGATGTATATATATCAT |
| 4872 | CTATGGGATGTATATATATCATT |
| 4873 | TATGGGATGTATATATATCATTG |
| 4874 | ATGGGATGTATATATATCATTGC |
| 4875 | TGGGATGTATATATATCATTGCT |
| 4876 | GGGATGTATATATATCATTGCTG |
| 4877 | GGATGTATATATATCATTGCTGT |
| 4878 | GATGTATATATATCATTGCTGTT |
| 4879 | ATGTATATATATCATTGCTGTTA |
| 4880 | TGTATATATATCATTGCTGTTAG |
| 4881 | GTATATATATCATTGCTGTTAGA |
| 4882 | TATATATATCATTGCTGTTAGAG |
| 4883 | ATATATATCATTGCTGTTAGAGA |
| 4884 | TATATATCATTGCTGTTAGAGAA |
| 4885 | ATATATCATTGCTGTTAGAGAAA |
| 4886 | TATATCATTGCTGTTAGAGAAAT |
| 4887 | ATATCATTGCTGTTAGAGAAATG |
| 4888 | TATCATTGCTGTTAGAGAAATGA |
| 4889 | ATCATTGCTGTTAGAGAAATGAA |
| 4890 | TCATTGCTGTTAGAGAAATGAAA |
| 4891 | CATTGCTGTTAGAGAAATGAAAT |
| 4892 | ATTGCTGTTAGAGAAATGAAATA |
| 4893 | TTGCTGTTAGAGAAATGAAATAA |
| 4894 | TGCTGTTAGAGAAATGAAATAAA |
| 4895 | GCTGTTAGAGAAATGAAATAAAA |
| 4896 | CTGTTAGAGAAATGAAATAAAAT |

| ID | SEQUENCE |
|---|---|
| 4897 | TGTTAGAGAAATGAAATAAAATG |
| 4898 | GTTAGAGAAATGAAATAAAATGG |
| 4899 | TTAGAGAAATGAAATAAAATGGG |
| 4900 | TAGAGAAATGAAATAAAATGGGG |
| 4901 | AGAGAAATGAAATAAAATGGGGC |
| 4902 | GAGAAATGAAATAAAATGGGGCT |
| 4903 | AGAAATGAAATAAAATGGGGCTG |
| 4904 | GAAATGAAATAAAATGGGGCTGG |
| 4905 | AAATGAAATAAAATGGGGCTGGG |
| 4906 | AATGAAATAAAATGGGGCTGGGC |
| 4907 | ATGAAATAAAATGGGGCTGGGCT |
| 4908 | TGAAATAAAATGGGGCTGGGCTC |
| 4909 | GAAATAAAATGGGGCTGGGCTCA |
| 4910 | AAATAAAATGGGGCTGGGCTCAG |
| 4911 | AATAAAATGGGGCTGGGCTCAGT |
| 4912 | ATAAAATGGGGCTGGGCTCAGTG |
| 4913 | TAAAATGGGGCTGGGCTCAGTGG |
| 4914 | AAAATGGGGCTGGGCTCAGTGGC |
| 4915 | AAATGGGGCTGGGCTCAGTGGCT |
| 4916 | AATGGGGCTGGGCTCAGTGGCTC |
| 4917 | ATGGGGCTGGGCTCAGTGGCTCA |
| 4918 | TGGGGCTGGGCTCAGTGGCTCAC |
| 4919 | GGGGCTGGGCTCAGTGGCTCACG |
| 4920 | GGGCTGGGCTCAGTGGCTCACGC |
| 4921 | GGCTGGGCTCAGTGGCTCACGCC |
| 4922 | GCTGGGCTCAGTGGCTCACGCCT |
| 4923 | CTGGGCTCAGTGGCTCACGCCTG |
| 4924 | TGGGCTCAGTGGCTCACGCCTGT |
| 4925 | GGGCTCAGTGGCTCACGCCTGTA |
| 4926 | GGCTCAGTGGCTCACGCCTGTAA |
| 4927 | GCTCAGTGGCTCACGCCTGTAAT |
| 4928 | CTCAGTGGCTCACGCCTGTAATC |
| 4929 | TCAGTGGCTCACGCCTGTAATCC |
| 4930 | CAGTGGCTCACGCCTGTAATCCC |
| 4931 | AGTGGCTCACGCCTGTAATCCCA |
| 4932 | GTGGCTCACGCCTGTAATCCCAG |
| 4933 | TGGCTCACGCCTGTAATCCCAGC |
| 4934 | GGCTCACGCCTGTAATCCCAGCA |
| 4935 | GCTCACGCCTGTAATCCCAGCAC |
| 4936 | CTCACGCCTGTAATCCCAGCACT |
| 4937 | TCACGCCTGTAATCCCAGCACTT |
| 4938 | CACGCCTGTAATCCCAGCACTTT |
| 4939 | ACGCCTGTAATCCCAGCACTTTG |
| 4940 | CGCCTGTAATCCCAGCACTTTGG |
| 4941 | GCCTGTAATCCCAGCACTTTGGG |
| 4942 | CCTGTAATCCCAGCACTTTGGGA |
| 4943 | CTGTAATCCCAGCACTTTGGGAG |
| 4944 | TGTAATCCCAGCACTTTGGGAGG |

| ID | SEQUENCE |
|---|---|
| 4945 | GTAATCCCAGCACTTTGGGAGGC |
| 4946 | TAATCCCAGCACTTTGGGAGGCT |
| 4947 | AATCCCAGCACTTTGGGAGGCTG |
| 4948 | ATCCCAGCACTTTGGGAGGCTGA |
| 4949 | TCCCAGCACTTTGGGAGGCTGAG |
| 4950 | CCCAGCACTTTGGGAGGCTGAGG |
| 4951 | CCAGCACTTTGGGAGGCTGAGGC |
| 4952 | CAGCACTTTGGGAGGCTGAGGCA |
| 4953 | AGCACTTTGGGAGGCTGAGGCAG |
| 4954 | GCACTTTGGGAGGCTGAGGCAGG |
| 4955 | CACTTTGGGAGGCTGAGGCAGGT |
| 4956 | ACTTTGGGAGGCTGAGGCAGGTG |
| 4957 | CTTTGGGAGGCTGAGGCAGGTGG |
| 4958 | TTTGGGAGGCTGAGGCAGGTGGA |
| 4959 | TTGGGAGGCTGAGGCAGGTGGAT |
| 4960 | TGGGAGGCTGAGGCAGGTGGATC |
| 4961 | GGGAGGCTGAGGCAGGTGGATCA |
| 4962 | GGAGGCTGAGGCAGGTGGATCAC |
| 4963 | GAGGCTGAGGCAGGTGGATCACG |
| 4964 | AGGCTGAGGCAGGTGGATCACGA |
| 4965 | GGCTGAGGCAGGTGGATCACGAG |
| 4966 | GCTGAGGCAGGTGGATCACGAGG |
| 4967 | CTGAGGCAGGTGGATCACGAGGT |
| 4968 | TGAGGCAGGTGGATCACGAGGTC |
| 4969 | GAGGCAGGTGGATCACGAGGTCA |
| 4970 | AGGCAGGTGGATCACGAGGTCAG |
| 4971 | GGCAGGTGGATCACGAGGTCAGG |
| 4972 | GCAGGTGGATCACGAGGTCAGGA |
| 4973 | CAGGTGGATCACGAGGTCAGGAG |
| 4974 | AGGTGGATCACGAGGTCAGGAGA |
| 4975 | GGTGGATCACGAGGTCAGGAGAT |
| 4976 | GTGGATCACGAGGTCAGGAGATC |
| 4977 | TGGATCACGAGGTCAGGAGATCG |
| 4978 | GGATCACGAGGTCAGGAGATCGA |
| 4979 | GATCACGAGGTCAGGAGATCGAG |
| 4980 | ATCACGAGGTCAGGAGATCGAGA |
| 4981 | TCACGAGGTCAGGAGATCGAGAC |
| 4982 | CACGAGGTCAGGAGATCGAGACC |
| 4983 | ACGAGGTCAGGAGATCGAGACCA |
| 4984 | CGAGGTCAGGAGATCGAGACCAT |
| 4985 | GAGGTCAGGAGATCGAGACCATC |
| 4986 | AGGTCAGGAGATCGAGACCATCC |
| 4987 | GGTCAGGAGATCGAGACCATCCT |
| 4988 | GTCAGGAGATCGAGACCATCCTG |
| 4989 | TCAGGAGATCGAGACCATCCTGG |
| 4990 | CAGGAGATCGAGACCATCCTGGC |
| 4991 | AGGAGATCGAGACCATCCTGGCT |
| 4992 | GGAGATCGAGACCATCCTGGCTA |

| ID | SEQUENCE |
|---|---|
| 4993 | GAGATCGAGACCATCCTGGCTAA |
| 4994 | AGATCGAGACCATCCTGGCTAAC |
| 4995 | GATCGAGACCATCCTGGCTAACA |
| 4996 | ATCGAGACCATCCTGGCTAACAC |
| 4997 | TCGAGACCATCCTGGCTAACACG |
| 4998 | CGAGACCATCCTGGCTAACACGG |
| 4999 | GAGACCATCCTGGCTAACACGGT |
| 5000 | AGACCATCCTGGCTAACACGGTG |
| 5001 | GACCATCCTGGCTAACACGGTGA |
| 5002 | ACCATCCTGGCTAACACGGTGAA |
| 5003 | CCATCCTGGCTAACACGGTGAAA |
| 5004 | CATCCTGGCTAACACGGTGAAAC |
| 5005 | ATCCTGGCTAACACGGTGAAACC |
| 5006 | TCCTGGCTAACACGGTGAAACCC |
| 5007 | CCTGGCTAACACGGTGAAACCCC |
| 5008 | CTGGCTAACACGGTGAAACCCCG |
| 5009 | TGGCTAACACGGTGAAACCCCGT |
| 5010 | GGCTAACACGGTGAAACCCCGTC |
| 5011 | GCTAACACGGTGAAACCCCGTCT |
| 5012 | CTAACACGGTGAAACCCCGTCTC |
| 5013 | TAACACGGTGAAACCCCGTCTCT |
| 5014 | AACACGGTGAAACCCCGTCTCTA |
| 5015 | ACACGGTGAAACCCCGTCTCTAC |
| 5016 | CACGGTGAAACCCCGTCTCTACT |
| 5017 | ACGGTGAAACCCCGTCTCTACTA |
| 5018 | CGGTGAAACCCCGTCTCTACTAA |
| 5019 | GGTGAAACCCCGTCTCTACTAAA |
| 5020 | GTGAAACCCCGTCTCTACTAAAA |
| 5021 | TGAAACCCCGTCTCTACTAAAAA |
| 5022 | GAAACCCCGTCTCTACTAAAAAA |
| 5023 | AAACCCCGTCTCTACTAAAAAAC |
| 5024 | AACCCCGTCTCTACTAAAAAACA |
| 5025 | ACCCCGTCTCTACTAAAAAACAG |
| 5026 | CCCCGTCTCTACTAAAAAACAGA |
| 5027 | CCCGTCTCTACTAAAAAACAGAA |
| 5028 | CCGTCTCTACTAAAAAACAGAAA |
| 5029 | CGTCTCTACTAAAAAACAGAAAA |
| 5030 | GTCTCTACTAAAAAACAGAAAAT |
| 5031 | TCTCTACTAAAAAACAGAAAATT |
| 5032 | CTCTACTAAAAAACAGAAAATTA |
| 5033 | TCTACTAAAAAACAGAAAATTAG |
| 5034 | CTACTAAAAAACAGAAAATTAGC |
| 5035 | TACTAAAAAACAGAAAATTAGCC |
| 5036 | ACTAAAAAACAGAAAATTAGCCG |
| 5037 | CTAAAAAACAGAAAATTAGCCGG |
| 5038 | TAAAAAACAGAAAATTAGCCGGG |
| 5039 | AAAAAACAGAAAATTAGCCGGGC |
| 5040 | AAAAACAGAAAATTAGCCGGGCG |

| ID | SEQUENCE |
|---|---|
| 5041 | AAAACAGAAAATTAGCCGGGCGT |
| 5042 | AAACAGAAAATTAGCCGGGCGTG |
| 5043 | AACAGAAAATTAGCCGGGCGTGG |
| 5044 | ACAGAAAATTAGCCGGGCGTGGT |
| 5045 | CAGAAAATTAGCCGGGCGTGGTG |
| 5046 | AGAAAATTAGCCGGGCGTGGTGG |
| 5047 | GAAAATTAGCCGGGCGTGGTGGC |
| 5048 | AAAATTAGCCGGGCGTGGTGGCG |
| 5049 | AAATTAGCCGGGCGTGGTGGCGG |
| 5050 | AATTAGCCGGGCGTGGTGGCGGG |
| 5051 | ATTAGCCGGGCGTGGTGGCGGGC |
| 5052 | TTAGCCGGGCGTGGTGGCGGGCG |
| 5053 | CGGGCGCCTGTAGTCCCAGCTAC |
| 5054 | GGGCGCCTGTAGTCCCAGCTACT |
| 5055 | GGCGCCTGTAGTCCCAGCTACTC |
| 5056 | GCGCCTGTAGTCCCAGCTACTCG |
| 5057 | CGCCTGTAGTCCCAGCTACTCGG |
| 5058 | GCCTGTAGTCCCAGCTACTCGGG |
| 5059 | CCTGTAGTCCCAGCTACTCGGGA |
| 5060 | CTGTAGTCCCAGCTACTCGGGAG |
| 5061 | TGTAGTCCCAGCTACTCGGGAGG |
| 5062 | GTAGTCCCAGCTACTCGGGAGGC |
| 5063 | TAGTCCCAGCTACTCGGGAGGCT |
| 5064 | AGTCCCAGCTACTCGGGAGGCTG |
| 5065 | GTCCCAGCTACTCGGGAGGCTGA |
| 5066 | TCCCAGCTACTCGGGAGGCTGAG |
| 5067 | CCCAGCTACTCGGGAGGCTGAGG |
| 5068 | CCAGCTACTCGGGAGGCTGAGGC |
| 5069 | CAGCTACTCGGGAGGCTGAGGCA |
| 5070 | AGCTACTCGGGAGGCTGAGGCAG |
| 5071 | GCTACTCGGGAGGCTGAGGCAGG |
| 5072 | CTACTCGGGAGGCTGAGGCAGGA |
| 5073 | TACTCGGGAGGCTGAGGCAGGAG |
| 5074 | ACTCGGGAGGCTGAGGCAGGAGA |
| 5075 | CTCGGGAGGCTGAGGCAGGAGAA |
| 5076 | TCGGGAGGCTGAGGCAGGAGAAT |
| 5077 | CGGGAGGCTGAGGCAGGAGAATG |
| 5078 | GGGAGGCTGAGGCAGGAGAATGG |
| 5079 | GGAGGCTGAGGCAGGAGAATGGT |
| 5080 | GAGGCTGAGGCAGGAGAATGGTG |
| 5081 | AGGCTGAGGCAGGAGAATGGTGT |
| 5082 | GGCTGAGGCAGGAGAATGGTGTG |
| 5083 | GCTGAGGCAGGAGAATGGTGTGA |
| 5084 | CTGAGGCAGGAGAATGGTGTGAA |
| 5085 | TGAGGCAGGAGAATGGTGTGAAC |
| 5086 | GAGGCAGGAGAATGGTGTGAACC |
| 5087 | AGGCAGGAGAATGGTGTGAACCC |
| 5088 | GGCAGGAGAATGGTGTGAACCCG |

| ID | SEQUENCE |
|---|---|
| 5089 | GCAGGAGAATGGTGTGAACCCGG |
| 5090 | CAGGAGAATGGTGTGAACCCGGG |
| 5091 | AGGAGAATGGTGTGAACCCGGGA |
| 5092 | GGAGAATGGTGTGAACCCGGGAG |
| 5093 | GAGAATGGTGTGAACCCGGGAGG |
| 5094 | AGAATGGTGTGAACCCGGGAGGC |
| 5095 | GAATGGTGTGAACCCGGGAGGCA |
| 5096 | AATGGTGTGAACCCGGGAGGCAG |
| 5097 | ATGGTGTGAACCCGGGAGGCAGA |
| 5098 | TGGTGTGAACCCGGGAGGCAGAG |
| 5099 | GGTGTGAACCCGGGAGGCAGAGC |
| 5100 | GTGTGAACCCGGGAGGCAGAGCT |
| 5101 | TGTGAACCCGGGAGGCAGAGCTT |
| 5102 | GTGAACCCGGGAGGCAGAGCTTG |
| 5103 | TGAACCCGGGAGGCAGAGCTTGC |
| 5104 | GAACCCGGGAGGCAGAGCTTGCA |
| 5105 | AACCCGGGAGGCAGAGCTTGCAG |
| 5106 | ACCCGGGAGGCAGAGCTTGCAGT |
| 5107 | CCCGGGAGGCAGAGCTTGCAGTG |
| 5108 | CCGGGAGGCAGAGCTTGCAGTGA |
| 5109 | CGGGAGGCAGAGCTTGCAGTGAG |
| 5110 | GGGAGGCAGAGCTTGCAGTGAGC |
| 5111 | GGAGGCAGAGCTTGCAGTGAGCC |
| 5112 | GAGGCAGAGCTTGCAGTGAGCCG |
| 5113 | AGGCAGAGCTTGCAGTGAGCCGA |
| 5114 | GGCAGAGCTTGCAGTGAGCCGAG |
| 5115 | GCAGAGCTTGCAGTGAGCCGAGA |
| 5116 | CAGAGCTTGCAGTGAGCCGAGAT |
| 5117 | AGAGCTTGCAGTGAGCCGAGATC |
| 5118 | GAGCTTGCAGTGAGCCGAGATCT |
| 5119 | AGCTTGCAGTGAGCCGAGATCTC |
| 5120 | GCTTGCAGTGAGCCGAGATCTCG |
| 5121 | CTTGCAGTGAGCCGAGATCTCGC |
| 5122 | TTGCAGTGAGCCGAGATCTCGCC |
| 5123 | TGCAGTGAGCCGAGATCTCGCCA |
| 5124 | GCAGTGAGCCGAGATCTCGCCAC |
| 5125 | CAGTGAGCCGAGATCTCGCCACT |
| 5126 | AGTGAGCCGAGATCTCGCCACTG |
| 5127 | GTGAGCCGAGATCTCGCCACTGC |
| 5128 | TGAGCCGAGATCTCGCCACTGCA |
| 5129 | GAGCCGAGATCTCGCCACTGCAC |
| 5130 | AGCCGAGATCTCGCCACTGCACT |
| 5131 | GCCGAGATCTCGCCACTGCACTC |
| 5132 | CCGAGATCTCGCCACTGCACTCC |
| 5133 | CGAGATCTCGCCACTGCACTCCA |
| 5134 | GAGATCTCGCCACTGCACTCCAG |
| 5135 | AGATCTCGCCACTGCACTCCAGC |
| 5136 | GATCTCGCCACTGCACTCCAGCC |

| ID | SEQUENCE |
|---|---|
| 5137 | ATCTCGCCACTGCACTCCAGCCT |
| 5138 | TCTCGCCACTGCACTCCAGCCTG |
| 5139 | CTCGCCACTGCACTCCAGCCTGG |
| 5140 | TCGCCACTGCACTCCAGCCTGGG |
| 5141 | CGCCACTGCACTCCAGCCTGGGC |
| 5142 | GCCACTGCACTCCAGCCTGGGCA |
| 5143 | CCACTGCACTCCAGCCTGGGCAA |
| 5144 | CACTGCACTCCAGCCTGGGCAAC |
| 5145 | ACTGCACTCCAGCCTGGGCAACA |
| 5146 | CTGCACTCCAGCCTGGGCAACAG |
| 5147 | TGCACTCCAGCCTGGGCAACAGA |
| 5148 | GCACTCCAGCCTGGGCAACAGAG |
| 5149 | CACTCCAGCCTGGGCAACAGAGC |
| 5150 | ACTCCAGCCTGGGCAACAGAGCA |
| 5151 | CTCCAGCCTGGGCAACAGAGCAA |
| 5152 | TCCAGCCTGGGCAACAGAGCAAG |
| 5153 | CCAGCCTGGGCAACAGAGCAAGA |
| 5154 | CAGCCTGGGCAACAGAGCAAGAC |
| 5155 | AGCCTGGGCAACAGAGCAAGACT |
| 5156 | GCCTGGGCAACAGAGCAAGACTC |
| 5157 | CCTGGGCAACAGAGCAAGACTCT |
| 5158 | CTGGGCAACAGAGCAAGACTCTG |
| 5159 | TGGGCAACAGAGCAAGACTCTGT |
| 5160 | GGGCAACAGAGCAAGACTCTGTC |
| 5161 | GGCAACAGAGCAAGACTCTGTCT |
| 5162 | GCAACAGAGCAAGACTCTGTCTC |
| 5163 | CAACAGAGCAAGACTCTGTCTCA |
| 5164 | AACAGAGCAAGACTCTGTCTCAA |
| 5165 | ACAGAGCAAGACTCTGTCTCAAA |
| 5166 | CAGAGCAAGACTCTGTCTCAAAA |
| 5167 | AGAGCAAGACTCTGTCTCAAAAA |
| 5168 | GAGCAAGACTCTGTCTCAAAAAA |
| 5169 | AGCAAGACTCTGTCTCAAAAAAA |
| 5170 | GCAAGACTCTGTCTCAAAAAAAA |
| 5171 | AAAAAAAGAAATAAGAAAATGG |
| 5172 | AAAAAAGAAATAAGAAAATGGG |
| 5173 | AAAAAGAAATAAGAAAATGGGA |
| 5174 | AAAAGAAATAAGAAAATGGGAA |
| 5175 | AAAGAAATAAGAAAATGGGAAG |
| 5176 | AAGAAATAAGAAAATGGGAAGC |
| 5177 | AGAAATAAGAAAATGGGAAGCA |
| 5178 | AGAAATAAGAAAATGGGAAGCAA |
| 5179 | GAAATAAGAAAATGGGAAGCAAT |
| 5180 | AAATAAGAAAATGGGAAGCAATA |
| 5181 | AATAAGAAAATGGGAAGCAATAT |
| 5182 | ATAAGAAAATGGGAAGCAATATT |
| 5183 | TAAGAAAATGGGAAGCAATATTT |
| 5184 | AAGAAAATGGGAAGCAATATTTG |

| ID | SEQUENCE |
|---|---|
| 5185 | AGAAAATGGGAAGCAATATTTGA |
| 5186 | GAAAATGGGAAGCAATATTTGAC |
| 5187 | AAAATGGGAAGCAATATTTGACA |
| 5188 | AAATGGGAAGCAATATTTGACAT |
| 5189 | AATGGGAAGCAATATTTGACATA |
| 5190 | ATGGGAAGCAATATTTGACATAG |
| 5191 | TGGGAAGCAATATTTGACATAGT |
| 5192 | GGGAAGCAATATTTGACATAGTT |
| 5193 | GGAAGCAATATTTGACATAGTTC |
| 5194 | GAAGCAATATTTGACATAGTTCT |
| 5195 | AAGCAATATTTGACATAGTTCTT |
| 5196 | AGCAATATTTGACATAGTTCTTT |
| 5197 | GCAATATTTGACATAGTTCTTTT |
| 5198 | CAATATTTGACATAGTTCTTTTT |
| 5199 | AATATTTGACATAGTTCTTTTTA |
| 5200 | ATATTTGACATAGTTCTTTTTAG |
| 5201 | TATTTGACATAGTTCTTTTTAGT |
| 5202 | ATTTGACATAGTTCTTTTTAGTC |
| 5203 | TTTGACATAGTTCTTTTTAGTCA |
| 5204 | TTGACATAGTTCTTTTTAGTCAA |
| 5205 | TGACATAGTTCTTTTTAGTCAAA |
| 5206 | GACATAGTTCTTTTTAGTCAAAT |
| 5207 | ACATAGTTCTTTTTAGTCAAATC |
| 5208 | CATAGTTCTTTTTAGTCAAATCT |
| 5209 | ATAGTTCTTTTTAGTCAAATCTA |
| 5210 | TAGTTCTTTTTAGTCAAATCTAC |
| 5211 | AGTTCTTTTTAGTCAAATCTACT |
| 5212 | GTTCTTTTTAGTCAAATCTACTT |
| 5213 | TTCTTTTTAGTCAAATCTACTTG |
| 5214 | TCTTTTTAGTCAAATCTACTTGT |
| 5215 | CTTTTTAGTCAAATCTACTTGTT |
| 5216 | TTTTTAGTCAAATCTACTTGTTA |
| 5217 | TTTTAGTCAAATCTACTTGTTAA |
| 5218 | TTTAGTCAAATCTACTTGTTAAA |
| 5219 | TTAGTCAAATCTACTTGTTAAAA |
| 5220 | TAGTCAAATCTACTTGTTAAAAA |
| 5221 | AGTCAAATCTACTTGTTAAAAAA |
| 5222 | GTCAAATCTACTTGTTAAAAAAA |
| 5223 | TCAAATCTACTTGTTAAAAAAAG |
| 5224 | CAAATCTACTTGTTAAAAAAGG |
| 5225 | AAATCTACTTGTTAAAAAAGGG |
| 5226 | AATCTACTTGTTAAAAAAGGGT |
| 5227 | ATCTACTTGTTAAAAAAGGGTA |
| 5228 | TCTACTTGTTAAAAAAGGGTAG |
| 5229 | CTACTTGTTAAAAAAGGGTAGC |
| 5230 | TACTTGTTAAAAAAGGGTAGCA |
| 5231 | ACTTGTTAAAAAAGGGTAGCAG |
| 5232 | CTTGTTAAAAAAGGGTAGCAGT |

| ID | SEQUENCE |
|---|---|
| 5233 | TTGTTAAAAAAGGGTAGCAGTT |
| 5234 | TGTTAAAAAAGGGTAGCAGTTT |
| 5235 | GTTAAAAAAGGGTAGCAGTTTA |
| 5236 | TTAAAAAAGGGTAGCAGTTTAT |
| 5237 | TAAAAAAGGGTAGCAGTTTATT |
| 5238 | AAAAAAGGGTAGCAGTTTATTC |
| 5239 | AAAAAGGGTAGCAGTTTATTCA |
| 5240 | AAAAGGGTAGCAGTTTATTCAT |
| 5241 | AAAGGGTAGCAGTTTATTCATC |
| 5242 | AAGGGTAGCAGTTTATTCATCT |
| 5243 | AGGGTAGCAGTTTATTCATCTG |
| 5244 | GGGTAGCAGTTTATTCATCTGT |
| 5245 | GGTAGCAGTTTATTCATCTGTG |
| 5246 | GTAGCAGTTTATTCATCTGTGA |
| 5247 | TAGCAGTTTATTCATCTGTGAA |
| 5248 | AGCAGTTTATTCATCTGTGAAA |
| 5249 | GCAGTTTATTCATCTGTGAAAG |
| 5250 | CAGTTTATTCATCTGTGAAAGG |
| 5251 | AGTTTATTCATCTGTGAAAGGA |
| 5252 | GTTTATTCATCTGTGAAAGGAA |
| 5253 | TTTATTCATCTGTGAAAGGAAA |
| 5254 | TTATTCATCTGTGAAAGGAAAA |
| 5255 | TATTCATCTGTGAAAGGAAAAT |
| 5256 | ATTCATCTGTGAAAGGAAAATA |
| 5257 | TTCATCTGTGAAAGGAAAATAA |
| 5258 | TCATCTGTGAAAGGAAAATAAT |
| 5259 | CATCTGTGAAAGGAAAATAATA |
| 5260 | ATCTGTGAAAGGAAAATAATAC |
| 5261 | TCTGTGAAAGGAAAATAATACT |
| 5262 | CTGTGAAAGGAAAATAATACTT |
| 5263 | TGTGAAAGGAAAATAATACTTA |
| 5264 | GTGAAAGGAAAATAATACTTAT |
| 5265 | TGAAAGGAAAATAATACTTATC |
| 5266 | GAAAGGAAAATAATACTTATCT |
| 5267 | AAAGGAAAATAATACTTATCTT |
| 5268 | AAGGAAAATAATACTTATCTTA |
| 5269 | AGGAAAATAATACTTATCTTAC |
| 5270 | GGAAAATAATACTTATCTTACA |
| 5271 | GAAAATAATACTTATCTTACAA |
| 5272 | AAAATAATACTTATCTTACAAG |
| 5273 | AAATAATACTTATCTTACAAGG |
| 5274 | AATAATACTTATCTTACAAGGT |
| 5275 | ATAATACTTATCTTACAAGGTT |
| 5276 | TAATACTTATCTTACAAGGTTG |
| 5277 | AATACTTATCTTACAAGGTTGC |
| 5278 | ATACTTATCTTACAAGGTTGCA |
| 5279 | TACTTATCTTACAAGGTTGCAA |
| 5280 | ACTTATCTTACAAGGTTGCAAG |

| ID | SEQUENCE |
|---|---|
| 5281 | ACTTATCTTACAAGGTTGCAAGA |
| 5282 | CTTATCTTACAAGGTTGCAAGAG |
| 5283 | TTATCTTACAAGGTTGCAAGAGC |
| 5284 | TATCTTACAAGGTTGCAAGAGCT |
| 5285 | ATCTTACAAGGTTGCAAGAGCTC |
| 5286 | TCTTACAAGGTTGCAAGAGCTCA |
| 5287 | CTTACAAGGTTGCAAGAGCTCAA |
| 5288 | TTACAAGGTTGCAAGAGCTCAAG |
| 5289 | TACAAGGTTGCAAGAGCTCAAGG |
| 5290 | ACAAGGTTGCAAGAGCTCAAGGA |
| 5291 | CAAGGTTGCAAGAGCTCAAGGAG |
| 5292 | AAGGTTGCAAGAGCTCAAGGAGA |
| 5293 | AGGTTGCAAGAGCTCAAGGAGAC |
| 5294 | GGTTGCAAGAGCTCAAGGAGACC |
| 5295 | GTTGCAAGAGCTCAAGGAGACCA |
| 5296 | TTGCAAGAGCTCAAGGAGACCAT |
| 5297 | TGCAAGAGCTCAAGGAGACCATG |
| 5298 | GCAAGAGCTCAAGGAGACCATGT |
| 5299 | CAAGAGCTCAAGGAGACCATGTA |
| 5300 | AAGAGCTCAAGGAGACCATGTAT |
| 5301 | AGAGCTCAAGGAGACCATGTATG |
| 5302 | GAGCTCAAGGAGACCATGTATGT |
| 5303 | AGCTCAAGGAGACCATGTATGTA |
| 5304 | GCTCAAGGAGACCATGTATGTAA |
| 5305 | CTCAAGGAGACCATGTATGTAAA |
| 5306 | TCAAGGAGACCATGTATGTAAAG |
| 5307 | CAAGGAGACCATGTATGTAAAGT |
| 5308 | AAGGAGACCATGTATGTAAAGTT |
| 5309 | AGGAGACCATGTATGTAAAGTTC |
| 5310 | GGAGACCATGTATGTAAAGTTCC |
| 5311 | GAGACCATGTATGTAAAGTTCCT |
| 5312 | AGACCATGTATGTAAAGTTCCTG |
| 5313 | GACCATGTATGTAAAGTTCCTGC |
| 5314 | ACCATGTATGTAAAGTTCCTGCT |
| 5315 | CCATGTATGTAAAGTTCCTGCTG |
| 5316 | CATGTATGTAAAGTTCCTGCTGT |
| 5317 | ATGTATGTAAAGTTCCTGCTGTA |
| 5318 | TGTATGTAAAGTTCCTGCTGTAA |
| 5319 | GTATGTAAAGTTCCTGCTGTAAA |
| 5320 | TATGTAAAGTTCCTGCTGTAAAT |
| 5321 | ATGTAAAGTTCCTGCTGTAAATA |
| 5322 | TGTAAAGTTCCTGCTGTAAATAT |
| 5323 | GTAAAGTTCCTGCTGTAAATATG |
| 5324 | TAAAGTTCCTGCTGTAAATATGA |
| 5325 | AAAGTTCCTGCTGTAAATATGAA |
| 5326 | AAGTTCCTGCTGTAAATATGAAC |
| 5327 | AGTTCCTGCTGTAAATATGAACT |
| 5328 | GTTCCTGCTGTAAATATGAACTC |

| ID | SEQUENCE |
|---|---|
| 5329 | TTCCTGCTGTAAATATGAACTCC |
| 5330 | TCCTGCTGTAAATATGAACTCCC |
| 5331 | CCTGCTGTAAATATGAACTCCCA |
| 5332 | CTGCTGTAAATATGAACTCCCAT |
| 5333 | TGCTGTAAATATGAACTCCCATC |
| 5334 | GCTGTAAATATGAACTCCCATCC |
| 5335 | CTGTAAATATGAACTCCCATCCT |
| 5336 | TGTAAATATGAACTCCCATCCTA |
| 5337 | GTAAATATGAACTCCCATCCTAA |
| 5338 | TAAATATGAACTCCCATCCTAAT |
| 5339 | AAATATGAACTCCCATCCTAATA |
| 5340 | AATATGAACTCCCATCCTAATAC |
| 5341 | ATATGAACTCCCATCCTAATACC |
| 5342 | TATGAACTCCCATCCTAATACCC |
| 5343 | ATGAACTCCCATCCTAATACCCT |
| 5344 | TGAACTCCCATCCTAATACCCTT |
| 5345 | GAACTCCCATCCTAATACCCTTT |
| 5346 | AACTCCCATCCTAATACCCTTTT |
| 5347 | ACTCCCATCCTAATACCCTTTTA |
| 5348 | CTCCCATCCTAATACCCTTTTAC |
| 5349 | TCCCATCCTAATACCCTTTTACC |
| 5350 | CCCATCCTAATACCCTTTTACCT |
| 5351 | CCATCCTAATACCCTTTTACCTC |
| 5352 | CATCCTAATACCCTTTTACCTCT |
| 5353 | ATCCTAATACCCTTTTACCTCTC |
| 5354 | TCCTAATACCCTTTTACCTCTCT |
| 5355 | CCTAATACCCTTTTACCTCTCTG |
| 5356 | CTAATACCCTTTTACCTCTCTGT |
| 5357 | TAATACCCTTTTACCTCTCTGTG |
| 5358 | AATACCCTTTTACCTCTCTGTGG |
| 5359 | ATACCCTTTTACCTCTCTGTGGG |
| 5360 | TACCCTTTTACCTCTCTGTGGGT |
| 5361 | ACCCTTTTACCTCTCTGTGGGTT |
| 5362 | CCCTTTTACCTCTCTGTGGGTTT |
| 5363 | CCTTTTACCTCTCTGTGGGTTTG |
| 5364 | CTTTTACCTCTCTGTGGGTTTGT |
| 5365 | TTTTACCTCTCTGTGGGTTTGTC |
| 5366 | TTTACCTCTCTGTGGGTTTGTCT |
| 5367 | TTACCTCTCTGTGGGTTTGTCTT |
| 5368 | TACCTCTCTGTGGGTTTGTCTTG |
| 5369 | ACCTCTCTGTGGGTTTGTCTTGA |
| 5370 | CCTCTCTGTGGGTTTGTCTTGAC |
| 5371 | CTCTCTGTGGGTTTGTCTTGACC |
| 5372 | TCTCTGTGGGTTTGTCTTGACCT |
| 5373 | CTCTGTGGGTTTGTCTTGACCTG |
| 5374 | TCTGTGGGTTTGTCTTGACCTGG |
| 5375 | CTGTGGGTTTGTCTTGACCTGGA |
| 5376 | TGTGGGTTTGTCTTGACCTGGAA |

| ID | SEQUENCE |
|---|---|
| 5377 | GTGGGTTTGTCTTGACCTGGAAA |
| 5378 | TGGGTTTGTCTTGACCTGGAAAT |
| 5379 | GGGTTTGTCTTGACCTGGAAATT |
| 5380 | GGTTTGTCTTGACCTGGAAATTT |
| 5381 | GTTTGTCTTGACCTGGAAATTTG |
| 5382 | TTTGTCTTGACCTGGAAATTTGG |
| 5383 | TTGTCTTGACCTGGAAATTTGGG |
| 5384 | TGTCTTGACCTGGAAATTTGGGC |
| 5385 | GTCTTGACCTGGAAATTTGGGCT |
| 5386 | TCTTGACCTGGAAATTTGGGCTA |
| 5387 | CTTGACCTGGAAATTTGGGCTAA |
| 5388 | TTGACCTGGAAATTTGGGCTAAA |
| 5389 | TGACCTGGAAATTTGGGCTAAAA |
| 5390 | GACCTGGAAATTTGGGCTAAAAC |
| 5391 | ACCTGGAAATTTGGGCTAAAACT |
| 5392 | CCTGGAAATTTGGGCTAAAACTT |
| 5393 | CTGGAAATTTGGGCTAAAACTTA |
| 5394 | TGGAAATTTGGGCTAAAACTTAG |
| 5395 | GGAAATTTGGGCTAAAACTTAGA |
| 5396 | GAAATTTGGGCTAAAACTTAGAA |
| 5397 | AAATTTGGGCTAAAACTTAGAAA |
| 5398 | AATTTGGGCTAAAACTTAGAAAA |
| 5399 | ATTTGGGCTAAAACTTAGAAAAA |
| 5400 | TTTGGGCTAAAACTTAGAAAAAA |
| 5401 | TTGGGCTAAAACTTAGAAAAAAT |
| 5402 | TGGGCTAAAACTTAGAAAAAATT |
| 5403 | GGGCTAAAACTTAGAAAAAATTC |
| 5404 | GGCTAAAACTTAGAAAAAATTCT |
| 5405 | GCTAAAACTTAGAAAAAATTCTT |
| 5406 | CTAAAACTTAGAAAAAATTCTTA |
| 5407 | TAAAACTTAGAAAAAATTCTTAC |
| 5408 | AAAACTTAGAAAAAATTCTTACA |
| 5409 | AAACTTAGAAAAAATTCTTACAT |
| 5410 | AACTTAGAAAAAATTCTTACATG |
| 5411 | ACTTAGAAAAAATTCTTACATGA |
| 5412 | CTTAGAAAAAATTCTTACATGAT |
| 5413 | TTAGAAAAAATTCTTACATGATA |
| 5414 | TAGAAAAAATTCTTACATGATAA |
| 5415 | AGAAAAAATTCTTACATGATAAC |
| 5416 | GAAAAAATTCTTACATGATAACT |
| 5417 | AAAAAATTCTTACATGATAACTC |
| 5418 | AAAAATTCTTACATGATAACTCA |
| 5419 | AAAATTCTTACATGATAACTCAG |
| 5420 | AAATTCTTACATGATAACTCAGT |
| 5421 | AATTCTTACATGATAACTCAGTG |
| 5422 | ATTCTTACATGATAACTCAGTGA |
| 5423 | TTCTTACATGATAACTCAGTGAT |
| 5424 | TCTTACATGATAACTCAGTGATG |

| ID | SEQUENCE |
|---|---|
| 5425 | CTTACATGATAACTCAGTGATGC |
| 5426 | TTACATGATAACTCAGTGATGCT |
| 5427 | TACATGATAACTCAGTGATGCTT |
| 5428 | ACATGATAACTCAGTGATGCTTA |
| 5429 | CATGATAACTCAGTGATGCTTAC |
| 5430 | ATGATAACTCAGTGATGCTTACT |
| 5431 | TGATAACTCAGTGATGCTTACTC |
| 5432 | GATAACTCAGTGATGCTTACTCA |
| 5433 | ATAACTCAGTGATGCTTACTCAT |
| 5434 | TAACTCAGTGATGCTTACTCATA |
| 5435 | AACTCAGTGATGCTTACTCATAG |
| 5436 | ACTCAGTGATGCTTACTCATAGT |
| 5437 | CTCAGTGATGCTTACTCATAGTT |
| 5438 | TCAGTGATGCTTACTCATAGTTT |
| 5439 | CAGTGATGCTTACTCATAGTTTT |
| 5440 | AGTGATGCTTACTCATAGTTTTT |
| 5441 | GTGATGCTTACTCATAGTTTTTG |
| 5442 | TGATGCTTACTCATAGTTTTTGG |
| 5443 | GATGCTTACTCATAGTTTTTGGT |
| 5444 | ATGCTTACTCATAGTTTTTGGTG |
| 5445 | TGCTTACTCATAGTTTTTGGTGT |
| 5446 | GCTTACTCATAGTTTTTGGTGTT |
| 5447 | CTTACTCATAGTTTTTGGTGTTT |
| 5448 | TTACTCATAGTTTTTGGTGTTTC |
| 5449 | TACTCATAGTTTTTGGTGTTTCT |
| 5450 | ACTCATAGTTTTTGGTGTTTCTC |
| 5451 | CTCATAGTTTTTGGTGTTTCTCA |
| 5452 | TCATAGTTTTTGGTGTTTCTCAT |
| 5453 | CATAGTTTTTGGTGTTTCTCATA |
| 5454 | ATAGTTTTTGGTGTTTCTCATAG |
| 5455 | TAGTTTTTGGTGTTTCTCATAGA |
| 5456 | AGTTTTTGGTGTTTCTCATAGAT |
| 5457 | GTTTTTGGTGTTTCTCATAGATA |
| 5458 | TTTTTGGTGTTTCTCATAGATAA |
| 5459 | TTTTGGTGTTTCTCATAGATAAG |
| 5460 | TTTGGTGTTTCTCATAGATAAGA |
| 5461 | TTGGTGTTTCTCATAGATAAGAT |
| 5462 | TGGTGTTTCTCATAGATAAGATA |
| 5463 | GGTGTTTCTCATAGATAAGATAT |
| 5464 | GTGTTTCTCATAGATAAGATATA |
| 5465 | TGTTTCTCATAGATAAGATATAA |
| 5466 | GTTTCTCATAGATAAGATATAAA |
| 5467 | TTTCTCATAGATAAGATATAAAT |
| 5468 | TTCTCATAGATAAGATATAAATC |
| 5469 | TCTCATAGATAAGATATAAATCA |
| 5470 | CTCATAGATAAGATATAAATCAG |
| 5471 | TCATAGATAAGATATAAATCAGC |
| 5472 | CATAGATAAGATATAAATCAGCT |

| ID | SEQUENCE |
|---|---|
| 5473 | ATAGATAAGATATAAATCAGCTG |
| 5474 | TAGATAAGATATAAATCAGCTGG |
| 5475 | AGATAAGATATAAATCAGCTGGG |
| 5476 | GATAAGATATAAATCAGCTGGGC |
| 5477 | ATAAGATATAAATCAGCTGGGCG |
| 5478 | TAAGATATAAATCAGCTGGGCGC |
| 5479 | AAGATATAAATCAGCTGGGCGCG |
| 5480 | AGATATAAATCAGCTGGGCGCGG |
| 5481 | GATATAAATCAGCTGGGCGCGGT |
| 5482 | ATATAAATCAGCTGGGCGCGGTG |
| 5483 | TATAAATCAGCTGGGCGCGGTGG |
| 5484 | ATAAATCAGCTGGGCGCGGTGGC |
| 5485 | TAAATCAGCTGGGCGCGGTGGCT |
| 5486 | AAATCAGCTGGGCGCGGTGGCTC |
| 5487 | AATCAGCTGGGCGCGGTGGCTCA |
| 5488 | ATCAGCTGGGCGCGGTGGCTCAT |
| 5489 | TCAGCTGGGCGCGGTGGCTCATG |
| 5490 | CAGCTGGGCGCGGTGGCTCATGC |
| 5491 | AGCTGGGCGCGGTGGCTCATGCC |
| 5492 | GCTGGGCGCGGTGGCTCATGCCT |
| 5493 | CTGGGCGCGGTGGCTCATGCCTG |
| 5494 | TGGGCGCGGTGGCTCATGCCTGT |
| 5495 | GGGCGCGGTGGCTCATGCCTGTA |
| 5496 | GGCGCGGTGGCTCATGCCTGTAA |
| 5497 | GCGCGGTGGCTCATGCCTGTAAT |
| 5498 | CGCGGTGGCTCATGCCTGTAATC |
| 5499 | GCGGTGGCTCATGCCTGTAATCC |
| 5500 | CGGTGGCTCATGCCTGTAATCCC |
| 5501 | GGTGGCTCATGCCTGTAATCCCA |
| 5502 | GTGGCTCATGCCTGTAATCCCAG |
| 5503 | TGGCTCATGCCTGTAATCCCAGC |
| 5504 | GGCTCATGCCTGTAATCCCAGCA |
| 5505 | GCTCATGCCTGTAATCCCAGCAC |
| 5506 | CTCATGCCTGTAATCCCAGCACT |
| 5507 | TCATGCCTGTAATCCCAGCACTT |
| 5508 | CATGCCTGTAATCCCAGCACTTT |
| 5509 | ATGCCTGTAATCCCAGCACTTTG |
| 5510 | TGCCTGTAATCCCAGCACTTTGG |
| 5511 | GCCTGTAATCCCAGCACTTTGGG |
| 5512 | CCTGTAATCCCAGCACTTTGGGA |
| 5513 | CTGTAATCCCAGCACTTTGGGAG |
| 5514 | TGTAATCCCAGCACTTTGGGAGG |
| 5515 | GTAATCCCAGCACTTTGGGAGGC |
| 5516 | TAATCCCAGCACTTTGGGAGGCC |
| 5517 | AATCCCAGCACTTTGGGAGGCCG |
| 5518 | ATCCCAGCACTTTGGGAGGCCGA |
| 5519 | TCCCAGCACTTTGGGAGGCCGAG |
| 5520 | CCCAGCACTTTGGGAGGCCGAGG |

| ID | SEQUENCE |
|---|---|
| 5521 | CCAGCACTTTGGGAGGCCGAGGC |
| 5522 | CAGCACTTTGGGAGGCCGAGGCG |
| 5523 | AGCACTTTGGGAGGCCGAGGCGG |
| 5524 | GCACTTTGGGAGGCCGAGGCGGG |
| 5525 | CACTTTGGGAGGCCGAGGCGGGC |
| 5526 | ACTTTGGGAGGCCGAGGCGGGCA |
| 5527 | CTTTGGGAGGCCGAGGCGGGCAG |
| 5528 | TTTGGGAGGCCGAGGCGGGCAGA |
| 5529 | TTGGGAGGCCGAGGCGGGCAGAT |
| 5530 | TGGGAGGCCGAGGCGGGCAGATC |
| 5531 | GGGAGGCCGAGGCGGGCAGATCA |
| 5532 | GGAGGCCGAGGCGGGCAGATCAC |
| 5533 | GAGGCCGAGGCGGGCAGATCACC |
| 5534 | AGGCCGAGGCGGGCAGATCACCT |
| 5535 | GGCCGAGGCGGGCAGATCACCTG |
| 5536 | GCCGAGGCGGGCAGATCACCTGA |
| 5537 | CCGAGGCGGGCAGATCACCTGAG |
| 5538 | CGAGGCGGGCAGATCACCTGAGG |
| 5539 | GAGGCGGGCAGATCACCTGAGGT |
| 5540 | AGGCGGGCAGATCACCTGAGGTC |
| 5541 | GGCGGGCAGATCACCTGAGGTCG |
| 5542 | GCGGGCAGATCACCTGAGGTCGG |
| 5543 | CGGGCAGATCACCTGAGGTCGGG |
| 5544 | GGGCAGATCACCTGAGGTCGGGA |
| 5545 | GGCAGATCACCTGAGGTCGGGAG |
| 5546 | GCAGATCACCTGAGGTCGGGAGG |
| 5547 | CAGATCACCTGAGGTCGGGAGGT |
| 5548 | AGATCACCTGAGGTCGGGAGGTC |
| 5549 | GATCACCTGAGGTCGGGAGGTCG |
| 5550 | ATCACCTGAGGTCGGGAGGTCGA |
| 5551 | TCACCTGAGGTCGGGAGGTCGAG |
| 5552 | CACCTGAGGTCGGGAGGTCGAGA |
| 5553 | ACCTGAGGTCGGGAGGTCGAGAC |
| 5554 | CCTGAGGTCGGGAGGTCGAGACC |
| 5555 | CTGAGGTCGGGAGGTCGAGACCA |
| 5556 | TGAGGTCGGGAGGTCGAGACCAG |
| 5557 | GAGGTCGGGAGGTCGAGACCAGC |
| 5558 | AGGTCGGGAGGTCGAGACCAGCC |
| 5559 | GGTCGGGAGGTCGAGACCAGCCT |
| 5560 | GTCGGGAGGTCGAGACCAGCCTG |
| 5561 | TCGGGAGGTCGAGACCAGCCTGA |
| 5562 | CGGGAGGTCGAGACCAGCCTGAC |
| 5563 | GGGAGGTCGAGACCAGCCTGACC |
| 5564 | GGAGGTCGAGACCAGCCTGACCA |
| 5565 | GAGGTCGAGACCAGCCTGACCAA |
| 5566 | AGGTCGAGACCAGCCTGACCAAC |
| 5567 | GGTCGAGACCAGCCTGACCAACA |
| 5568 | GTCGAGACCAGCCTGACCAACAT |

| ID | SEQUENCE |
|---|---|
| 5569 | TCGAGACCAGCCTGACCAACATG |
| 5570 | CGAGACCAGCCTGACCAACATGG |
| 5571 | GAGACCAGCCTGACCAACATGGA |
| 5572 | AGACCAGCCTGACCAACATGGAG |
| 5573 | GACCAGCCTGACCAACATGGAGA |
| 5574 | ACCAGCCTGACCAACATGGAGAA |
| 5575 | CCAGCCTGACCAACATGGAGAAA |
| 5576 | CAGCCTGACCAACATGGAGAAAC |
| 5577 | AGCCTGACCAACATGGAGAAACC |
| 5578 | GCCTGACCAACATGGAGAAACCC |
| 5579 | CCTGACCAACATGGAGAAACCCC |
| 5580 | CTGACCAACATGGAGAAACCCCG |
| 5581 | TGACCAACATGGAGAAACCCCGT |
| 5582 | GACCAACATGGAGAAACCCCGTC |
| 5583 | ACCAACATGGAGAAACCCCGTCT |
| 5584 | CCAACATGGAGAAACCCCGTCTC |
| 5585 | CAACATGGAGAAACCCCGTCTCT |
| 5586 | AACATGGAGAAACCCCGTCTCTA |
| 5587 | ACATGGAGAAACCCCGTCTCTAC |
| 5588 | CATGGAGAAACCCCGTCTCTACT |
| 5589 | ATGGAGAAACCCCGTCTCTACTA |
| 5590 | TGGAGAAACCCCGTCTCTACTAA |
| 5591 | GGAGAAACCCCGTCTCTACTAAA |
| 5592 | GAGAAACCCCGTCTCTACTAAAA |
| 5593 | AGAAACCCCGTCTCTACTAAAAA |
| 5594 | GAAACCCCGTCTCTACTAAAAAT |
| 5595 | AAACCCCGTCTCTACTAAAAATA |
| 5596 | AACCCCGTCTCTACTAAAAATAC |
| 5597 | ACCCCGTCTCTACTAAAAATACA |
| 5598 | CCCCGTCTCTACTAAAAATACAA |
| 5599 | CCCGTCTCTACTAAAAATACAAA |
| 5600 | CCGTCTCTACTAAAAATACAAAA |
| 5601 | CGTCTCTACTAAAAATACAAAAT |
| 5602 | GTCTCTACTAAAAATACAAAATT |
| 5603 | TCTCTACTAAAAATACAAAATTA |
| 5604 | CTCTACTAAAAATACAAAATTAG |
| 5605 | TCTACTAAAAATACAAAATTAGC |
| 5606 | CTACTAAAAATACAAAATTAGCT |
| 5607 | TACTAAAAATACAAAATTAGCTG |
| 5608 | ACTAAAAATACAAAATTAGCTGG |
| 5609 | CTAAAAATACAAAATTAGCTGGG |
| 5610 | TAAAAATACAAAATTAGCTGGGC |
| 5611 | AAAAATACAAAATTAGCTGGGCG |
| 5612 | AAAATACAAAATTAGCTGGGCGT |
| 5613 | AAATACAAAATTAGCTGGGCGTG |
| 5614 | AATACAAAATTAGCTGGGCGTGG |
| 5615 | ATACAAAATTAGCTGGGCGTGGT |
| 5616 | TACAAAATTAGCTGGGCGTGGTG |

| ID | SEQUENCE |
|---|---|
| 5617 | ACAAAATTAGCTGGGCGTGGTGG |
| 5618 | CAAAATTAGCTGGGCGTGGTGGC |
| 5619 | AAAATTAGCTGGGCGTGGTGGCT |
| 5620 | AAATTAGCTGGGCGTGGTGGCTC |
| 5621 | AATTAGCTGGGCGTGGTGGCTCA |
| 5622 | ATTAGCTGGGCGTGGTGGCTCAT |
| 5623 | TTAGCTGGGCGTGGTGGCTCATG |
| 5624 | TAGCTGGGCGTGGTGGCTCATGC |
| 5625 | AGCTGGGCGTGGTGGCTCATGCC |
| 5626 | GCTGGGCGTGGTGGCTCATGCCT |
| 5627 | CTGGGCGTGGTGGCTCATGCCTG |
| 5628 | TGGGCGTGGTGGCTCATGCCTGT |
| 5629 | GGGCGTGGTGGCTCATGCCTGTA |
| 5630 | GGCGTGGTGGCTCATGCCTGTAA |
| 5631 | GCGTGGTGGCTCATGCCTGTAAT |
| 5632 | CGTGGTGGCTCATGCCTGTAATC |
| 5633 | GTGGTGGCTCATGCCTGTAATCC |
| 5634 | TGGTGGCTCATGCCTGTAATCCC |
| 5635 | GGTGGCTCATGCCTGTAATCCCA |
| 5636 | GTGGCTCATGCCTGTAATCCCAG |
| 5637 | TGGCTCATGCCTGTAATCCCAGC |
| 5638 | GGCTCATGCCTGTAATCCCAGCT |
| 5639 | GCTCATGCCTGTAATCCCAGCTA |
| 5640 | CTCATGCCTGTAATCCCAGCTAC |
| 5641 | TCATGCCTGTAATCCCAGCTACT |
| 5642 | CATGCCTGTAATCCCAGCTACTT |
| 5643 | ATGCCTGTAATCCCAGCTACTTG |
| 5644 | TGCCTGTAATCCCAGCTACTTGG |
| 5645 | GCCTGTAATCCCAGCTACTTGGG |
| 5646 | CCTGTAATCCCAGCTACTTGGGA |
| 5647 | CTGTAATCCCAGCTACTTGGGAG |
| 5648 | TGTAATCCCAGCTACTTGGGAGG |
| 5649 | GTAATCCCAGCTACTTGGGAGGC |
| 5650 | TAATCCCAGCTACTTGGGAGGCT |
| 5651 | AATCCCAGCTACTTGGGAGGCTG |
| 5652 | ATCCCAGCTACTTGGGAGGCTGA |
| 5653 | TCCCAGCTACTTGGGAGGCTGAG |
| 5654 | CCCAGCTACTTGGGAGGCTGAGG |
| 5655 | CCAGCTACTTGGGAGGCTGAGGC |
| 5656 | CAGCTACTTGGGAGGCTGAGGCA |
| 5657 | AGCTACTTGGGAGGCTGAGGCAG |
| 5658 | GCTACTTGGGAGGCTGAGGCAGG |
| 5659 | CTACTTGGGAGGCTGAGGCAGGA |
| 5660 | TACTTGGGAGGCTGAGGCAGGAG |
| 5661 | ACTTGGGAGGCTGAGGCAGGAGA |
| 5662 | CTTGGGAGGCTGAGGCAGGAGAA |
| 5663 | TTGGGAGGCTGAGGCAGGAGAAT |
| 5664 | TGGGAGGCTGAGGCAGGAGAATC |

| ID | SEQUENCE |
|---|---|
| 5665 | GGGAGGCTGAGGCAGGAGAATCG |
| 5666 | GGAGGCTGAGGCAGGAGAATCGC |
| 5667 | GAGGCTGAGGCAGGAGAATCGCT |
| 5668 | AGGCTGAGGCAGGAGAATCGCTT |
| 5669 | GGCTGAGGCAGGAGAATCGCTTG |
| 5670 | GCTGAGGCAGGAGAATCGCTTGA |
| 5671 | CTGAGGCAGGAGAATCGCTTGAA |
| 5672 | TGAGGCAGGAGAATCGCTTGAAC |
| 5673 | GAGGCAGGAGAATCGCTTGAACC |
| 5674 | AGGCAGGAGAATCGCTTGAACCC |
| 5675 | GGCAGGAGAATCGCTTGAACCCA |
| 5676 | GCAGGAGAATCGCTTGAACCCAG |
| 5677 | CAGGAGAATCGCTTGAACCCAGG |
| 5678 | AGGAGAATCGCTTGAACCCAGGA |
| 5679 | GGAGAATCGCTTGAACCCAGGAG |
| 5680 | GAGAATCGCTTGAACCCAGGAGG |
| 5681 | AGAATCGCTTGAACCCAGGAGGC |
| 5682 | GAATCGCTTGAACCCAGGAGGCG |
| 5683 | AATCGCTTGAACCCAGGAGGCGG |
| 5684 | ATCGCTTGAACCCAGGAGGCGGA |
| 5685 | TCGCTTGAACCCAGGAGGCGGAG |
| 5686 | CGCTTGAACCCAGGAGGCGGAGG |
| 5687 | GCTTGAACCCAGGAGGCGGAGGT |
| 5688 | CTTGAACCCAGGAGGCGGAGGTT |
| 5689 | TTGAACCCAGGAGGCGGAGGTTG |
| 5690 | TGAACCCAGGAGGCGGAGGTTGT |
| 5691 | GAACCCAGGAGGCGGAGGTTGTG |
| 5692 | AACCCAGGAGGCGGAGGTTGTGG |
| 5693 | ACCCAGGAGGCGGAGGTTGTGGT |
| 5694 | CCCAGGAGGCGGAGGTTGTGGTG |
| 5695 | CCAGGAGGCGGAGGTTGTGGTGA |
| 5696 | CAGGAGGCGGAGGTTGTGGTGAG |
| 5697 | AGGAGGCGGAGGTTGTGGTGAGC |
| 5698 | GGAGGCGGAGGTTGTGGTGAGCG |
| 5699 | GAGGCGGAGGTTGTGGTGAGCGA |
| 5700 | AGGCGGAGGTTGTGGTGAGCGAA |
| 5701 | GGCGGAGGTTGTGGTGAGCGAAG |
| 5702 | GCGGAGGTTGTGGTGAGCGAAGA |
| 5703 | CGGAGGTTGTGGTGAGCGAAGAT |
| 5704 | GGAGGTTGTGGTGAGCGAAGATC |
| 5705 | GAGGTTGTGGTGAGCGAAGATCG |
| 5706 | AGGTTGTGGTGAGCGAAGATCGT |
| 5707 | GGTTGTGGTGAGCGAAGATCGTG |
| 5708 | GTTGTGGTGAGCGAAGATCGTGC |
| 5709 | TTGTGGTGAGCGAAGATCGTGCC |
| 5710 | TGTGGTGAGCGAAGATCGTGCCA |
| 5711 | GTGGTGAGCGAAGATCGTGCCAT |
| 5712 | TGGTGAGCGAAGATCGTGCCATT |

| ID | SEQUENCE |
|---|---|
| 5713 | GGTGAGCGAAGATCGTGCCATTG |
| 5714 | GTGAGCGAAGATCGTGCCATTGC |
| 5715 | TGAGCGAAGATCGTGCCATTGCA |
| 5716 | GAGCGAAGATCGTGCCATTGCAC |
| 5717 | AGCGAAGATCGTGCCATTGCACT |
| 5718 | GCGAAGATCGTGCCATTGCACTC |
| 5719 | CGAAGATCGTGCCATTGCACTCC |
| 5720 | GAAGATCGTGCCATTGCACTCCA |
| 5721 | AAGATCGTGCCATTGCACTCCAG |
| 5722 | AGATCGTGCCATTGCACTCCAGC |
| 5723 | GATCGTGCCATTGCACTCCAGCC |
| 5724 | ATCGTGCCATTGCACTCCAGCCT |
| 5725 | TCGTGCCATTGCACTCCAGCCTG |
| 5726 | CGTGCCATTGCACTCCAGCCTGG |
| 5727 | GTGCCATTGCACTCCAGCCTGGG |
| 5728 | TGCCATTGCACTCCAGCCTGGGC |
| 5729 | GCCATTGCACTCCAGCCTGGGCA |
| 5730 | CCATTGCACTCCAGCCTGGGCAA |
| 5731 | CATTGCACTCCAGCCTGGGCAAC |
| 5732 | ATTGCACTCCAGCCTGGGCAACA |
| 5733 | TTGCACTCCAGCCTGGGCAACAA |
| 5734 | TGCACTCCAGCCTGGGCAACAAG |
| 5735 | GCACTCCAGCCTGGGCAACAAGA |
| 5736 | CACTCCAGCCTGGGCAACAAGAG |
| 5737 | ACTCCAGCCTGGGCAACAAGAGC |
| 5738 | CTCCAGCCTGGGCAACAAGAGCA |
| 5739 | TCCAGCCTGGGCAACAAGAGCAA |
| 5740 | CCAGCCTGGGCAACAAGAGCAAA |
| 5741 | CAGCCTGGGCAACAAGAGCAAAA |
| 5742 | AGCCTGGGCAACAAGAGCAAAAC |
| 5743 | GCCTGGGCAACAAGAGCAAAACT |
| 5744 | CCTGGGCAACAAGAGCAAAACTC |
| 5745 | CTGGGCAACAAGAGCAAAACTCT |
| 5746 | TGGGCAACAAGAGCAAAACTCTG |
| 5747 | GGGCAACAAGAGCAAAACTCTGT |
| 5748 | GGCAACAAGAGCAAAACTCTGTC |
| 5749 | GCAACAAGAGCAAAACTCTGTCT |
| 5750 | CAACAAGAGCAAAACTCTGTCTC |
| 5751 | AACAAGAGCAAAACTCTGTCTCA |
| 5752 | ACAAGAGCAAAACTCTGTCTCAA |
| 5753 | CAAGAGCAAAACTCTGTCTCAAA |
| 5754 | AAGAGCAAAACTCTGTCTCAAAA |
| 5755 | AGAGCAAAACTCTGTCTCAAAAA |
| 5756 | GAGCAAAACTCTGTCTCAAAAAA |
| 5757 | AGCAAAACTCTGTCTCAAAAAAA |
| 5758 | GCAAAACTCTGTCTCAAAAAAAA |
| 5759 | AAAAAAAGATATAAATCACAAT |
| 5760 | AAAAAAAGATATAAATCACAATA |

| ID | SEQUENCE |
|---|---|
| 5761 | AAAAAAGATATAAATCACAATAA |
| 5762 | AAAAAGATATAAATCACAATAAA |
| 5763 | AAAAGATATAAATCACAATAAAT |
| 5764 | AAAGATATAAATCACAATAAATA |
| 5765 | AAGATATAAATCACAATAAATAA |
| 5766 | AGATATAAATCACAATAAATAAA |
| 5767 | GATATAAATCACAATAAATAAAT |
| 5768 | ATATAAATCACAATAAATAAATA |
| 5769 | TATAAATCACAATAAATAAATAG |
| 5770 | ATAAATCACAATAAATAAATAGG |
| 5771 | TAAATCACAATAAATAAATAGGT |
| 5772 | AAATCACAATAAATAAATAGGTC |
| 5773 | AATCACAATAAATAAATAGGTCA |
| 5774 | ATCACAATAAATAAATAGGTCAA |
| 5775 | TCACAATAAATAAATAGGTCAAT |
| 5776 | CACAATAAATAAATAGGTCAATA |
| 5777 | ACAATAAATAAATAGGTCAATAC |
| 5778 | CAATAAATAAATAGGTCAATACA |
| 5779 | AATAAATAAATAGGTCAATACAA |
| 5780 | ATAAATAAATAGGTCAATACAAA |
| 5781 | TAAATAAATAGGTCAATACAAAT |
| 5782 | AAATAAATAGGTCAATACAAATG |
| 5783 | AATAAATAGGTCAATACAAATGT |
| 5784 | ATAAATAGGTCAATACAAATGTT |
| 5785 | TAAATAGGTCAATACAAATGTTA |
| 5786 | AAATAGGTCAATACAAATGTTAG |
| 5787 | AATAGGTCAATACAAATGTTAGC |
| 5788 | ATAGGTCAATACAAATGTTAGCC |
| 5789 | TAGGTCAATACAAATGTTAGCCA |
| 5790 | AGGTCAATACAAATGTTAGCCAG |
| 5791 | GGTCAATACAAATGTTAGCCAGG |
| 5792 | GTCAATACAAATGTTAGCCAGGC |
| 5793 | TCAATACAAATGTTAGCCAGGCG |
| 5794 | CAATACAAATGTTAGCCAGGCGT |
| 5795 | AATACAAATGTTAGCCAGGCGTG |
| 5796 | ATACAAATGTTAGCCAGGCGTGG |
| 5797 | TACAAATGTTAGCCAGGCGTGGT |
| 5798 | ACAAATGTTAGCCAGGCGTGGTG |
| 5799 | CAAATGTTAGCCAGGCGTGGTGG |
| 5800 | AAATGTTAGCCAGGCGTGGTGGC |
| 5801 | AATGTTAGCCAGGCGTGGTGGCA |
| 5802 | ATGTTAGCCAGGCGTGGTGGCAC |
| 5803 | TGTTAGCCAGGCGTGGTGGCACA |
| 5804 | GTTAGCCAGGCGTGGTGGCACAT |
| 5805 | TTAGCCAGGCGTGGTGGCACATG |
| 5806 | TAGCCAGGCGTGGTGGCACATGC |
| 5807 | AGCCAGGCGTGGTGGCACATGCC |
| 5808 | GCCAGGCGTGGTGGCACATGCCC |

| ID | SEQUENCE |
|---|---|
| 5809 | CCAGGCGTGGTGGCACATGCCCA |
| 5810 | CAGGCGTGGTGGCACATGCCCAT |
| 5811 | AGGCGTGGTGGCACATGCCCATA |
| 5812 | GGCGTGGTGGCACATGCCCATAG |
| 5813 | GCGTGGTGGCACATGCCCATAGT |
| 5814 | CGTGGTGGCACATGCCCATAGTC |
| 5815 | GTGGTGGCACATGCCCATAGTCG |
| 5816 | TGGTGGCACATGCCCATAGTCGC |
| 5817 | GGTGGCACATGCCCATAGTCGCA |
| 5818 | GTGGCACATGCCCATAGTCGCAG |
| 5819 | TGGCACATGCCCATAGTCGCAGC |
| 5820 | GGCACATGCCCATAGTCGCAGCT |
| 5821 | GCACATGCCCATAGTCGCAGCTA |
| 5822 | CACATGCCCATAGTCGCAGCTAC |
| 5823 | ACATGCCCATAGTCGCAGCTACT |
| 5824 | CATGCCCATAGTCGCAGCTACTC |
| 5825 | ATGCCCATAGTCGCAGCTACTCT |
| 5826 | TGCCCATAGTCGCAGCTACTCTG |
| 5827 | GCCCATAGTCGCAGCTACTCTGG |
| 5828 | CCCATAGTCGCAGCTACTCTGGA |
| 5829 | CCATAGTCGCAGCTACTCTGGAG |
| 5830 | CATAGTCGCAGCTACTCTGGAGG |
| 5831 | ATAGTCGCAGCTACTCTGGAGGC |
| 5832 | TAGTCGCAGCTACTCTGGAGGCA |
| 5833 | AGTCGCAGCTACTCTGGAGGCAG |
| 5834 | GTCGCAGCTACTCTGGAGGCAGA |
| 5835 | TCGCAGCTACTCTGGAGGCAGAG |
| 5836 | CGCAGCTACTCTGGAGGCAGAGG |
| 5837 | GCAGCTACTCTGGAGGCAGAGGC |
| 5838 | CAGCTACTCTGGAGGCAGAGGCA |
| 5839 | AGCTACTCTGGAGGCAGAGGCAG |
| 5840 | GCTACTCTGGAGGCAGAGGCAGG |
| 5841 | CTACTCTGGAGGCAGAGGCAGGA |
| 5842 | TACTCTGGAGGCAGAGGCAGGAG |
| 5843 | ACTCTGGAGGCAGAGGCAGGAGG |
| 5844 | CTCTGGAGGCAGAGGCAGGAGGA |
| 5845 | TCTGGAGGCAGAGGCAGGAGGAT |
| 5846 | CTGGAGGCAGAGGCAGGAGGATC |
| 5847 | TGGAGGCAGAGGCAGGAGGATCA |
| 5848 | GGAGGCAGAGGCAGGAGGATCAC |
| 5849 | GAGGCAGAGGCAGGAGGATCACT |
| 5850 | AGGCAGAGGCAGGAGGATCACTT |
| 5851 | GGCAGAGGCAGGAGGATCACTTG |
| 5852 | GCAGAGGCAGGAGGATCACTTGA |
| 5853 | CAGAGGCAGGAGGATCACTTGAG |
| 5854 | AGAGGCAGGAGGATCACTTGAGC |
| 5855 | GAGGCAGGAGGATCACTTGAGCC |
| 5856 | AGGCAGGAGGATCACTTGAGCCC |

| ID | SEQUENCE |
|---|---|
| 5857 | GGCAGGAGGATCACTTGAGCCCA |
| 5858 | GCAGGAGGATCACTTGAGCCCAT |
| 5859 | CAGGAGGATCACTTGAGCCCATG |
| 5860 | AGGAGGATCACTTGAGCCCATGA |
| 5861 | GGAGGATCACTTGAGCCCATGAA |
| 5862 | GAGGATCACTTGAGCCCATGAAT |
| 5863 | AGGATCACTTGAGCCCATGAATT |
| 5864 | GGATCACTTGAGCCCATGAATTT |
| 5865 | GATCACTTGAGCCCATGAATTTG |
| 5866 | ATCACTTGAGCCCATGAATTTGA |
| 5867 | TCACTTGAGCCCATGAATTTGAG |
| 5868 | CACTTGAGCCCATGAATTTGAGG |
| 5869 | ACTTGAGCCCATGAATTTGAGGC |
| 5870 | CTTGAGCCCATGAATTTGAGGCA |
| 5871 | TTGAGCCCATGAATTTGAGGCAG |
| 5872 | TGAGCCCATGAATTTGAGGCAGC |
| 5873 | GAGCCCATGAATTTGAGGCAGCA |
| 5874 | AGCCCATGAATTTGAGGCAGCAG |
| 5875 | GCCCATGAATTTGAGGCAGCAGT |
| 5876 | CCCATGAATTTGAGGCAGCAGTG |
| 5877 | CCATGAATTTGAGGCAGCAGTGA |
| 5878 | CATGAATTTGAGGCAGCAGTGAG |
| 5879 | ATGAATTTGAGGCAGCAGTGAGC |
| 5880 | TGAATTTGAGGCAGCAGTGAGCT |
| 5881 | GAATTTGAGGCAGCAGTGAGCTA |
| 5882 | AATTTGAGGCAGCAGTGAGCTAT |
| 5883 | ATTTGAGGCAGCAGTGAGCTATG |
| 5884 | TTTGAGGCAGCAGTGAGCTATGA |
| 5885 | TTGAGGCAGCAGTGAGCTATGAT |
| 5886 | TGAGGCAGCAGTGAGCTATGATT |
| 5887 | GAGGCAGCAGTGAGCTATGATTG |
| 5888 | AGGCAGCAGTGAGCTATGATTGT |
| 5889 | GGCAGCAGTGAGCTATGATTGTG |
| 5890 | GCAGCAGTGAGCTATGATTGTGC |
| 5891 | CAGCAGTGAGCTATGATTGTGCC |
| 5892 | AGCAGTGAGCTATGATTGTGCCA |
| 5893 | GCAGTGAGCTATGATTGTGCCAC |
| 5894 | CAGTGAGCTATGATTGTGCCACT |
| 5895 | AGTGAGCTATGATTGTGCCACTG |
| 5896 | GTGAGCTATGATTGTGCCACTGT |
| 5897 | TGAGCTATGATTGTGCCACTGTA |
| 5898 | GAGCTATGATTGTGCCACTGTAC |
| 5899 | AGCTATGATTGTGCCACTGTACT |
| 5900 | GCTATGATTGTGCCACTGTACTC |
| 5901 | CTATGATTGTGCCACTGTACTCC |
| 5902 | TATGATTGTGCCACTGTACTCCA |
| 5903 | ATGATTGTGCCACTGTACTCCAG |
| 5904 | TGATTGTGCCACTGTACTCCAGT |

| ID | SEQUENCE |
|---|---|
| 5905 | GATTGTGCCACTGTACTCCAGTC |
| 5906 | ATTGTGCCACTGTACTCCAGTCT |
| 5907 | TTGTGCCACTGTACTCCAGTCTG |
| 5908 | TGTGCCACTGTACTCCAGTCTGG |
| 5909 | GTGCCACTGTACTCCAGTCTGGG |
| 5910 | TGCCACTGTACTCCAGTCTGGGT |
| 5911 | GCCACTGTACTCCAGTCTGGGTG |
| 5912 | CCACTGTACTCCAGTCTGGGTGA |
| 5913 | CACTGTACTCCAGTCTGGGTGAC |
| 5914 | ACTGTACTCCAGTCTGGGTGACA |
| 5915 | CTGTACTCCAGTCTGGGTGACAG |
| 5916 | TGTACTCCAGTCTGGGTGACAGA |
| 5917 | GTACTCCAGTCTGGGTGACAGAG |
| 5918 | TACTCCAGTCTGGGTGACAGAGT |
| 5919 | ACTCCAGTCTGGGTGACAGAGTG |
| 5920 | CTCCAGTCTGGGTGACAGAGTGA |
| 5921 | TCCAGTCTGGGTGACAGAGTGAG |
| 5922 | CCAGTCTGGGTGACAGAGTGAGA |
| 5923 | CAGTCTGGGTGACAGAGTGAGAC |
| 5924 | AGTCTGGGTGACAGAGTGAGACC |
| 5925 | GTCTGGGTGACAGAGTGAGACCC |
| 5926 | TCTGGGTGACAGAGTGAGACCCC |
| 5927 | CTGGGTGACAGAGTGAGACCCCA |
| 5928 | TGGGTGACAGAGTGAGACCCCAT |
| 5929 | GGGTGACAGAGTGAGACCCCATC |
| 5930 | GGTGACAGAGTGAGACCCCATCT |
| 5931 | GTGACAGAGTGAGACCCCATCTC |
| 5932 | TGACAGAGTGAGACCCCATCTCT |
| 5933 | GACAGAGTGAGACCCCATCTCTA |
| 5934 | ACAGAGTGAGACCCCATCTCTAA |
| 5935 | CAGAGTGAGACCCCATCTCTAAA |
| 5936 | AGAGTGAGACCCCATCTCTAAAT |
| 5937 | GAGTGAGACCCCATCTCTAAATA |
| 5938 | AGTGAGACCCCATCTCTAAATAA |
| 5939 | GTGAGACCCCATCTCTAAATAAA |
| 5940 | TGAGACCCCATCTCTAAATAAAT |
| 5941 | GAGACCCCATCTCTAAATAAATA |
| 5942 | AGACCCCATCTCTAAATAAATAG |
| 5943 | GACCCCATCTCTAAATAAATAGG |
| 5944 | ACCCCATCTCTAAATAAATAGGT |
| 5945 | CCCCATCTCTAAATAAATAGGTC |
| 5946 | CCCATCTCTAAATAAATAGGTCA |
| 5947 | CCATCTCTAAATAAATAGGTCAA |
| 5948 | CATCTCTAAATAAATAGGTCAAA |
| 5949 | ATCTCTAAATAAATAGGTCAAAC |
| 5950 | TCTCTAAATAAATAGGTCAAACC |
| 5951 | CTCTAAATAAATAGGTCAAACCC |
| 5952 | TCTAAATAAATAGGTCAAACCCT |

| ID | SEQUENCE |
|---|---|
| 5953 | CTAAATAAATAGGTCAAACCCTT |
| 5954 | TAAATAAATAGGTCAAACCCTTA |
| 5955 | AAATAAATAGGTCAAACCCTTAA |
| 5956 | AATAAATAGGTCAAACCCTTAAA |
| 5957 | ATAAATAGGTCAAACCCTTAAAA |
| 5958 | TAAATAGGTCAAACCCTTAAAAA |
| 5959 | AAATAGGTCAAACCCTTAAAAAT |
| 5960 | AATAGGTCAAACCCTTAAAAATA |
| 5961 | ATAGGTCAAACCCTTAAAAATAT |
| 5962 | TAGGTCAAACCCTTAAAAATATT |
| 5963 | AGGTCAAACCCTTAAAAATATTT |
| 5964 | GGTCAAACCCTTAAAAATATTTA |
| 5965 | GTCAAACCCTTAAAAATATTTAA |
| 5966 | TCAAACCCTTAAAAATATTTAAA |
| 5967 | CAAACCCTTAAAAATATTTAAAT |
| 5968 | AAACCCTTAAAAATATTTAAATT |
| 5969 | AACCCTTAAAAATATTTAAATTC |
| 5970 | ACCCTTAAAAATATTTAAATTCT |
| 5971 | CCCTTAAAAATATTTAAATTCTT |
| 5972 | CCTTAAAAATATTTAAATTCTTA |
| 5973 | CTTAAAAATATTTAAATTCTTAA |
| 5974 | TTAAAAATATTTAAATTCTTAAA |
| 5975 | TAAAAATATTTAAATTCTTAAAA |
| 5976 | AAAAATATTTAAATTCTTAAAAA |
| 5977 | AAAATATTTAAATTCTTAAAAAA |
| 5978 | AAATATTTAAATTCTTAAAAAAT |
| 5979 | AATATTTAAATTCTTAAAAAATT |
| 5980 | ATATTTAAATTCTTAAAAAATTG |
| 5981 | TATTTAAATTCTTAAAAAATTGA |
| 5982 | ATTTAAATTCTTAAAAAATTGAA |
| 5983 | TTTAAATTCTTAAAAAATTGAAA |
| 5984 | TTAAATTCTTAAAAAATTGAAAA |
| 5985 | TAAATTCTTAAAAAATTGAAAAG |
| 5986 | AAATTCTTAAAAAATTGAAAAGA |
| 5987 | AATTCTTAAAAAATTGAAAAGAT |
| 5988 | ATTCTTAAAAAATTGAAAAGATT |
| 5989 | TTCTTAAAAAATTGAAAAGATTA |
| 5990 | TCTTAAAAAATTGAAAAGATTAT |
| 5991 | CTTAAAAAATTGAAAAGATTATT |
| 5992 | TTAAAAAATTGAAAAGATTATTC |
| 5993 | TAAAAAATTGAAAAGATTATTCT |
| 5994 | AAAAAATTGAAAAGATTATTCTT |
| 5995 | AAAAATTGAAAAGATTATTCTTC |
| 5996 | AAAATTGAAAAGATTATTCTTCT |
| 5997 | AAATTGAAAAGATTATTCTTCTC |
| 5998 | AATTGAAAAGATTATTCTTCTCA |
| 5999 | ATTGAAAAGATTATTCTTCTCAA |
| 6000 | TTGAAAAGATTATTCTTCTCAAA |

| ID | SEQUENCE |
|---|---|
| 6001 | TGAAAAGATTATTCTTCTCAAAT |
| 6002 | GAAAAGATTATTCTTCTCAAATT |
| 6003 | AAAAGATTATTCTTCTCAAATTT |
| 6004 | AAAGATTATTCTTCTCAAATTTA |
| 6005 | AAGATTATTCTTCTCAAATTTAG |
| 6006 | AGATTATTCTTCTCAAATTTAGT |
| 6007 | GATTATTCTTCTCAAATTTAGTT |
| 6008 | ATTATTCTTCTCAAATTTAGTTG |
| 6009 | TTATTCTTCTCAAATTTAGTTGA |
| 6010 | TATTCTTCTCAAATTTAGTTGAG |
| 6011 | ATTCTTCTCAAATTTAGTTGAGC |
| 6012 | TTCTTCTCAAATTTAGTTGAGCT |
| 6013 | TCTTCTCAAATTTAGTTGAGCTT |
| 6014 | CTTCTCAAATTTAGTTGAGCTTT |
| 6015 | TTCTCAAATTTAGTTGAGCTTTC |
| 6016 | TCTCAAATTTAGTTGAGCTTTCT |
| 6017 | CTCAAATTTAGTTGAGCTTTCTA |
| 6018 | TCAAATTTAGTTGAGCTTTCTAA |
| 6019 | CAAATTTAGTTGAGCTTTCTAAG |
| 6020 | AAATTTAGTTGAGCTTTCTAAGA |
| 6021 | AATTTAGTTGAGCTTTCTAAGAG |
| 6022 | ATTTAGTTGAGCTTTCTAAGAGA |
| 6023 | TTTAGTTGAGCTTTCTAAGAGAA |
| 6024 | TTAGTTGAGCTTTCTAAGAGAAG |
| 6025 | TAGTTGAGCTTTCTAAGAGAAGC |
| 6026 | AGTTGAGCTTTCTAAGAGAAGCA |
| 6027 | GTTGAGCTTTCTAAGAGAAGCAA |
| 6028 | TTGAGCTTTCTAAGAGAAGCAAT |
| 6029 | TGAGCTTTCTAAGAGAAGCAATT |
| 6030 | GAGCTTTCTAAGAGAAGCAATTG |
| 6031 | AGCTTTCTAAGAGAAGCAATTGG |
| 6032 | GCTTTCTAAGAGAAGCAATTGGC |
| 6033 | CTTTCTAAGAGAAGCAATTGGCT |
| 6034 | TTTCTAAGAGAAGCAATTGGCTT |
| 6035 | TTCTAAGAGAAGCAATTGGCTTT |
| 6036 | TCTAAGAGAAGCAATTGGCTTTT |
| 6037 | CTAAGAGAAGCAATTGGCTTTTT |
| 6038 | TAAGAGAAGCAATTGGCTTTTTC |
| 6039 | AAGAGAAGCAATTGGCTTTTTCC |
| 6040 | AGAGAAGCAATTGGCTTTTTCCC |
| 6041 | GAGAAGCAATTGGCTTTTTCCCA |
| 6042 | AGAAGCAATTGGCTTTTTCCCAC |
| 6043 | GAAGCAATTGGCTTTTTCCCACT |
| 6044 | AAGCAATTGGCTTTTTCCCACTT |
| 6045 | AGCAATTGGCTTTTTCCCACTTC |
| 6046 | GCAATTGGCTTTTTCCCACTTCA |
| 6047 | CAATTGGCTTTTTCCCACTTCAA |
| 6048 | AATTGGCTTTTTCCCACTTCAAT |

| ID | SEQUENCE |
|---|---|
| 6049 | ATTGGCTTTTCCCACTTCAATA |
| 6050 | TTGGCTTTTCCCACTTCAATAA |
| 6051 | TGGCTTTTCCCACTTCAATAAT |
| 6052 | GGCTTTTCCCACTTCAATAATC |
| 6053 | GCTTTTCCCACTTCAATAATCA |
| 6054 | CTTTTCCCACTTCAATAATCAT |
| 6055 | TTTTCCCACTTCAATAATCATT |
| 6056 | TTTCCCACTTCAATAATCATTT |
| 6057 | TTCCCACTTCAATAATCATTTT |
| 6058 | TCCCACTTCAATAATCATTTTC |
| 6059 | CCCACTTCAATAATCATTTTCA |
| 6060 | CCACTTCAATAATCATTTTCAG |
| 6061 | CACTTCAATAATCATTTTCAGT |
| 6062 | ACTTCAATAATCATTTTCAGTT |
| 6063 | CTTCAATAATCATTTTCAGTTT |
| 6064 | TTCAATAATCATTTTCAGTTTG |
| 6065 | TCAATAATCATTTTCAGTTTGA |
| 6066 | CAATAATCATTTTCAGTTTGAC |
| 6067 | AATAATCATTTTCAGTTTGACT |
| 6068 | ATAATCATTTTCAGTTTGACTC |
| 6069 | TAATCATTTTCAGTTTGACTCA |
| 6070 | AATCATTTTCAGTTTGACTCAT |
| 6071 | ATCATTTTCAGTTTGACTCATA |
| 6072 | TCATTTTCAGTTTGACTCATAC |
| 6073 | CATTTTCAGTTTGACTCATACA |
| 6074 | ATTTTCAGTTTGACTCATACAG |
| 6075 | TTTTCAGTTTGACTCATACAGT |
| 6076 | TTTCAGTTTGACTCATACAGTT |
| 6077 | TTCAGTTTGACTCATACAGTTA |
| 6078 | TCAGTTTGACTCATACAGTTAA |
| 6079 | CAGTTTGACTCATACAGTTAAC |
| 6080 | AGTTTGACTCATACAGTTAACA |
| 6081 | GTTTGACTCATACAGTTAACAC |
| 6082 | TTTGACTCATACAGTTAACACA |
| 6083 | TTGACTCATACAGTTAACACAA |
| 6084 | TGACTCATACAGTTAACACAAT |
| 6085 | GACTCATACAGTTAACACAATG |
| 6086 | ACTCATACAGTTAACACAATGT |
| 6087 | CTCATACAGTTAACACAATGTG |
| 6088 | TCATACAGTTAACACAATGTGA |
| 6089 | CATACAGTTAACACAATGTGAA |
| 6090 | ATACAGTTAACACAATGTGAAT |
| 6091 | TACAGTTAACACAATGTGAATT |
| 6092 | ACAGTTAACACAATGTGAATTT |
| 6093 | CAGTTAACACAATGTGAATTTC |
| 6094 | AGTTAACACAATGTGAATTTCT |
| 6095 | GTTAACACAATGTGAATTTCTT |
| 6096 | TTAACACAATGTGAATTTCTTC |

| ID | SEQUENCE |
|---|---|
| 6097 | TTAACACAATGTGAATTTCTTCC |
| 6098 | TAACACAATGTGAATTTCTTCCT |
| 6099 | AACACAATGTGAATTTCTTCCTC |
| 6100 | ACACAATGTGAATTTCTTCCTCA |
| 6101 | CACAATGTGAATTTCTTCCTCAG |
| 6102 | ACAATGTGAATTTCTTCCTCAGC |
| 6103 | CAATGTGAATTTCTTCCTCAGCA |
| 6104 | AATGTGAATTTCTTCCTCAGCAT |
| 6105 | ATGTGAATTTCTTCCTCAGCATA |
| 6106 | TGTGAATTTCTTCCTCAGCATAA |
| 6107 | GTGAATTTCTTCCTCAGCATAAC |
| 6108 | TGAATTTCTTCCTCAGCATAACA |
| 6109 | GAATTTCTTCCTCAGCATAACAG |
| 6110 | AATTTCTTCCTCAGCATAACAGA |
| 6111 | ATTTCTTCCTCAGCATAACAGAG |
| 6112 | TTTCTTCCTCAGCATAACAGAGT |
| 6113 | TTCTTCCTCAGCATAACAGAGTT |
| 6114 | TCTTCCTCAGCATAACAGAGTTA |
| 6115 | CTTCCTCAGCATAACAGAGTTAT |
| 6116 | TTCCTCAGCATAACAGAGTTATA |
| 6117 | TCCTCAGCATAACAGAGTTATAG |
| 6118 | CCTCAGCATAACAGAGTTATAGA |
| 6119 | CTCAGCATAACAGAGTTATAGAA |
| 6120 | TCAGCATAACAGAGTTATAGAAT |
| 6121 | CAGCATAACAGAGTTATAGAATG |
| 6122 | AGCATAACAGAGTTATAGAATGA |
| 6123 | GCATAACAGAGTTATAGAATGAC |
| 6124 | CATAACAGAGTTATAGAATGACA |
| 6125 | ATAACAGAGTTATAGAATGACAG |
| 6126 | TAACAGAGTTATAGAATGACAGG |
| 6127 | AACAGAGTTATAGAATGACAGGG |
| 6128 | ACAGAGTTATAGAATGACAGGGC |
| 6129 | CAGAGTTATAGAATGACAGGGCT |
| 6130 | AGAGTTATAGAATGACAGGGCTG |
| 6131 | GAGTTATAGAATGACAGGGCTGG |
| 6132 | AGTTATAGAATGACAGGGCTGGA |
| 6133 | GTTATAGAATGACAGGGCTGGAA |
| 6134 | TTATAGAATGACAGGGCTGGAAG |
| 6135 | TATAGAATGACAGGGCTGGAAGT |
| 6136 | ATAGAATGACAGGGCTGGAAGTG |
| 6137 | TAGAATGACAGGGCTGGAAGTGA |
| 6138 | AGAATGACAGGGCTGGAAGTGAC |
| 6139 | GAATGACAGGGCTGGAAGTGACC |
| 6140 | AATGACAGGGCTGGAAGTGACCT |
| 6141 | ATGACAGGGCTGGAAGTGACCTT |
| 6142 | TGACAGGGCTGGAAGTGACCTTA |
| 6143 | GACAGGGCTGGAAGTGACCTTAG |
| 6144 | ACAGGGCTGGAAGTGACCTTAGA |

| ID | SEQUENCE |
|---|---|
| 6145 | CAGGGCTGGAAGTGACCTTAGAG |
| 6146 | AGGGCTGGAAGTGACCTTAGAGA |
| 6147 | GGGCTGGAAGTGACCTTAGAGAG |
| 6148 | GGCTGGAAGTGACCTTAGAGAGT |
| 6149 | GCTGGAAGTGACCTTAGAGAGTA |
| 6150 | CTGGAAGTGACCTTAGAGAGTAT |
| 6151 | TGGAAGTGACCTTAGAGAGTATC |
| 6152 | GGAAGTGACCTTAGAGAGTATCC |
| 6153 | GAAGTGACCTTAGAGAGTATCCA |
| 6154 | AAGTGACCTTAGAGAGTATCCAG |
| 6155 | AGTGACCTTAGAGAGTATCCAGT |
| 6156 | GTGACCTTAGAGAGTATCCAGTT |
| 6157 | TGACCTTAGAGAGTATCCAGTTC |
| 6158 | GACCTTAGAGAGTATCCAGTTCT |
| 6159 | ACCTTAGAGAGTATCCAGTTCTT |
| 6160 | CCTTAGAGAGTATCCAGTTCTTT |
| 6161 | CTTAGAGAGTATCCAGTTCTTTC |
| 6162 | TTAGAGAGTATCCAGTTCTTTCA |
| 6163 | TAGAGAGTATCCAGTTCTTTCAT |
| 6164 | AGAGAGTATCCAGTTCTTTCATT |
| 6165 | GAGAGTATCCAGTTCTTTCATTT |
| 6166 | AGAGTATCCAGTTCTTTCATTTT |
| 6167 | GAGTATCCAGTTCTTTCATTTTA |
| 6168 | AGTATCCAGTTCTTTCATTTTAC |
| 6169 | GTATCCAGTTCTTTCATTTTACA |
| 6170 | TATCCAGTTCTTTCATTTTACAG |
| 6171 | ATCCAGTTCTTTCATTTTACAGG |
| 6172 | TCCAGTTCTTTCATTTTACAGGT |
| 6173 | CCAGTTCTTTCATTTTACAGGTG |
| 6174 | CAGTTCTTTCATTTTACAGGTGA |
| 6175 | AGTTCTTTCATTTTACAGGTGAG |
| 6176 | GTTCTTTCATTTTACAGGTGAGG |
| 6177 | TTCTTTCATTTTACAGGTGAGGC |
| 6178 | TCTTTCATTTTACAGGTGAGGCA |
| 6179 | CTTTCATTTTACAGGTGAGGCAA |
| 6180 | TTTCATTTTACAGGTGAGGCAAC |
| 6181 | TTCATTTTACAGGTGAGGCAACT |
| 6182 | TCATTTTACAGGTGAGGCAACTG |
| 6183 | CATTTTACAGGTGAGGCAACTGA |
| 6184 | ATTTTACAGGTGAGGCAACTGAG |
| 6185 | TTTTACAGGTGAGGCAACTGAGA |
| 6186 | TTTACAGGTGAGGCAACTGAGAC |
| 6187 | TTACAGGTGAGGCAACTGAGACT |
| 6188 | TACAGGTGAGGCAACTGAGACTC |
| 6189 | ACAGGTGAGGCAACTGAGACTCA |
| 6190 | CAGGTGAGGCAACTGAGACTCAA |
| 6191 | AGGTGAGGCAACTGAGACTCAAA |
| 6192 | GGTGAGGCAACTGAGACTCAAAG |

| ID | SEQUENCE |
|---|---|
| 6193 | GTGAGGCAACTGAGACTCAAAGG |
| 6194 | TGAGGCAACTGAGACTCAAAGGT |
| 6195 | GAGGCAACTGAGACTCAAAGGTG |
| 6196 | AGGCAACTGAGACTCAAAGGTGA |
| 6197 | GGCAACTGAGACTCAAAGGTGAT |
| 6198 | GCAACTGAGACTCAAAGGTGATG |
| 6199 | CAACTGAGACTCAAAGGTGATGT |
| 6200 | AACTGAGACTCAAAGGTGATGTA |
| 6201 | ACTGAGACTCAAAGGTGATGTAA |
| 6202 | CTGAGACTCAAAGGTGATGTAAT |
| 6203 | TGAGACTCAAAGGTGATGTAATT |
| 6204 | GAGACTCAAAGGTGATGTAATTT |
| 6205 | AGACTCAAAGGTGATGTAATTTG |
| 6206 | GACTCAAAGGTGATGTAATTTGT |
| 6207 | ACTCAAAGGTGATGTAATTTGTG |
| 6208 | CTCAAAGGTGATGTAATTTGTGC |
| 6209 | TCAAAGGTGATGTAATTTGTGCA |
| 6210 | CAAAGGTGATGTAATTTGTGCAA |
| 6211 | AAAGGTGATGTAATTTGTGCAAA |
| 6212 | AAGGTGATGTAATTTGTGCAAAG |
| 6213 | AGGTGATGTAATTTGTGCAAAGA |
| 6214 | GGTGATGTAATTTGTGCAAAGAT |
| 6215 | GTGATGTAATTTGTGCAAAGATT |
| 6216 | TGATGTAATTTGTGCAAAGATTA |
| 6217 | GATGTAATTTGTGCAAAGATTAT |
| 6218 | ATGTAATTTGTGCAAAGATTATA |
| 6219 | TGTAATTTGTGCAAAGATTATAG |
| 6220 | GTAATTTGTGCAAAGATTATAGC |
| 6221 | TAATTTGTGCAAAGATTATAGCT |
| 6222 | AATTTGTGCAAAGATTATAGCTA |
| 6223 | ATTTGTGCAAAGATTATAGCTAA |
| 6224 | TTTGTGCAAAGATTATAGCTAAT |
| 6225 | TTGTGCAAAGATTATAGCTAATT |
| 6226 | TGTGCAAAGATTATAGCTAATTA |
| 6227 | GTGCAAAGATTATAGCTAATTAG |
| 6228 | TGCAAAGATTATAGCTAATTAGT |
| 6229 | GCAAAGATTATAGCTAATTAGTA |
| 6230 | CAAAGATTATAGCTAATTAGTAG |
| 6231 | AAAGATTATAGCTAATTAGTAGC |
| 6232 | AAGATTATAGCTAATTAGTAGCA |
| 6233 | AGATTATAGCTAATTAGTAGCAG |
| 6234 | GATTATAGCTAATTAGTAGCAGA |
| 6235 | ATTATAGCTAATTAGTAGCAGAG |
| 6236 | TTATAGCTAATTAGTAGCAGAGC |
| 6237 | TATAGCTAATTAGTAGCAGAGCC |
| 6238 | ATAGCTAATTAGTAGCAGAGCCC |
| 6239 | TAGCTAATTAGTAGCAGAGCCCT |
| 6240 | AGCTAATTAGTAGCAGAGCCCTG |

| ID | SEQUENCE |
|---|---|
| 6241 | GCTAATTAGTAGCAGAGCCCTGA |
| 6242 | CTAATTAGTAGCAGAGCCCTGAC |
| 6243 | TAATTAGTAGCAGAGCCCTGACT |
| 6244 | AATTAGTAGCAGAGCCCTGACTG |
| 6245 | ATTAGTAGCAGAGCCCTGACTGG |
| 6246 | TTAGTAGCAGAGCCCTGACTGGG |
| 6247 | TAGTAGCAGAGCCCTGACTGGGA |
| 6248 | AGTAGCAGAGCCCTGACTGGGAC |
| 6249 | GTAGCAGAGCCCTGACTGGGACA |
| 6250 | TAGCAGAGCCCTGACTGGGACAT |
| 6251 | AGCAGAGCCCTGACTGGGACATA |
| 6252 | GCAGAGCCCTGACTGGGACATAG |
| 6253 | CAGAGCCCTGACTGGGACATAGT |
| 6254 | AGAGCCCTGACTGGGACATAGTT |
| 6255 | GAGCCCTGACTGGGACATAGTTT |
| 6256 | AGCCCTGACTGGGACATAGTTTG |
| 6257 | GCCCTGACTGGGACATAGTTTGA |
| 6258 | CCCTGACTGGGACATAGTTTGAA |
| 6259 | CCTGACTGGGACATAGTTTGAAG |
| 6260 | CTGACTGGGACATAGTTTGAAGG |
| 6261 | TGACTGGGACATAGTTTGAAGGT |
| 6262 | GACTGGGACATAGTTTGAAGGTG |
| 6263 | ACTGGGACATAGTTTGAAGGTGA |
| 6264 | CTGGGACATAGTTTGAAGGTGAA |
| 6265 | TGGGACATAGTTTGAAGGTGAAA |
| 6266 | GGGACATAGTTTGAAGGTGAAAA |
| 6267 | GGACATAGTTTGAAGGTGAAAAA |
| 6268 | GACATAGTTTGAAGGTGAAAAAC |
| 6269 | ACATAGTTTGAAGGTGAAAAACT |
| 6270 | CATAGTTTGAAGGTGAAAAACTT |
| 6271 | ATAGTTTGAAGGTGAAAAACTTC |
| 6272 | TAGTTTGAAGGTGAAAAACTTCA |
| 6273 | AGTTTGAAGGTGAAAAACTTCAC |
| 6274 | GTTTGAAGGTGAAAAACTTCACC |
| 6275 | TTTGAAGGTGAAAAACTTCACCA |
| 6276 | TTGAAGGTGAAAAACTTCACCAA |
| 6277 | TGAAGGTGAAAAACTTCACCAAG |
| 6278 | GAAGGTGAAAAACTTCACCAAGC |
| 6279 | AAGGTGAAAAACTTCACCAAGCT |
| 6280 | AGGTGAAAAACTTCACCAAGCTA |
| 6281 | GGTGAAAAACTTCACCAAGCTAC |
| 6282 | GTGAAAAACTTCACCAAGCTACC |
| 6283 | TGAAAAACTTCACCAAGCTACCT |
| 6284 | GAAAAACTTCACCAAGCTACCTT |
| 6285 | AAAAACTTCACCAAGCTACCTTT |
| 6286 | AAAACTTCACCAAGCTACCTTTC |
| 6287 | AAACTTCACCAAGCTACCTTTCT |
| 6288 | AACTTCACCAAGCTACCTTTCTT |

| ID | SEQUENCE |
|---|---|
| 6289 | ACTTCACCAAGCTACCTTTCTTG |
| 6290 | CTTCACCAAGCTACCTTTCTTGA |
| 6291 | TTCACCAAGCTACCTTTCTTGAA |
| 6292 | TCACCAAGCTACCTTTCTTGAAA |
| 6293 | CACCAAGCTACCTTTCTTGAAAG |
| 6294 | ACCAAGCTACCTTTCTTGAAAGG |
| 6295 | CCAAGCTACCTTTCTTGAAAGGT |
| 6296 | CAAGCTACCTTTCTTGAAAGGTC |
| 6297 | AAGCTACCTTTCTTGAAAGGTCC |
| 6298 | AGCTACCTTTCTTGAAAGGTCCA |
| 6299 | GCTACCTTTCTTGAAAGGTCCAA |
| 6300 | CTACCTTTCTTGAAAGGTCCAAA |
| 6301 | TACCTTTCTTGAAAGGTCCAAAT |
| 6302 | ACCTTTCTTGAAAGGTCCAAATG |
| 6303 | CCTTTCTTGAAAGGTCCAAATGT |
| 6304 | CTTTCTTGAAAGGTCCAAATGTT |
| 6305 | TTTCTTGAAAGGTCCAAATGTTT |
| 6306 | TTCTTGAAAGGTCCAAATGTTTA |
| 6307 | TCTTGAAAGGTCCAAATGTTTAT |
| 6308 | CTTGAAAGGTCCAAATGTTTATG |
| 6309 | TTGAAAGGTCCAAATGTTTATGT |
| 6310 | TGAAAGGTCCAAATGTTTATGTT |
| 6311 | GAAAGGTCCAAATGTTTATGTTT |
| 6312 | AAAGGTCCAAATGTTTATGTTTT |
| 6313 | AAGGTCCAAATGTTTATGTTTTC |
| 6314 | AGGTCCAAATGTTTATGTTTTCA |
| 6315 | GGTCCAAATGTTTATGTTTTCAA |
| 6316 | GTCCAAATGTTTATGTTTTCAAC |
| 6317 | TCCAAATGTTTATGTTTTCAACT |
| 6318 | CCAAATGTTTATGTTTTCAACTA |
| 6319 | CAAATGTTTATGTTTTCAACTAC |
| 6320 | AAATGTTTATGTTTTCAACTACT |
| 6321 | AATGTTTATGTTTTCAACTACTC |
| 6322 | ATGTTTATGTTTTCAACTACTCT |
| 6323 | TGTTTATGTTTTCAACTACTCTT |
| 6324 | GTTTATGTTTTCAACTACTCTTT |
| 6325 | TTTATGTTTTCAACTACTCTTTC |
| 6326 | TTATGTTTTCAACTACTCTTTCC |
| 6327 | TATGTTTTCAACTACTCTTTCCA |
| 6328 | ATGTTTTCAACTACTCTTTCCAC |
| 6329 | TGTTTTCAACTACTCTTTCCACT |
| 6330 | GTTTTCAACTACTCTTTCCACTG |
| 6331 | TTTTCAACTACTCTTTCCACTGT |
| 6332 | TTTCAACTACTCTTTCCACTGTA |
| 6333 | TTCAACTACTCTTTCCACTGTAC |
| 6334 | TCAACTACTCTTTCCACTGTACC |
| 6335 | CAACTACTCTTTCCACTGTACCA |
| 6336 | AACTACTCTTTCCACTGTACCAT |

| ID | SEQUENCE |
|---|---|
| 6337 | ACTACTCTTTCCACTGTACCATA |
| 6338 | CTACTCTTTCCACTGTACCATAA |
| 6339 | TACTCTTTCCACTGTACCATAAC |
| 6340 | ACTCTTTCCACTGTACCATAACT |
| 6341 | CTCTTTCCACTGTACCATAACTT |
| 6342 | TCTTTCCACTGTACCATAACTTT |
| 6343 | CTTTCCACTGTACCATAACTTTC |
| 6344 | TTTCCACTGTACCATAACTTTCA |
| 6345 | TTCCACTGTACCATAACTTTCAC |
| 6346 | TCCACTGTACCATAACTTTCACT |
| 6347 | CCACTGTACCATAACTTTCACTA |
| 6348 | CACTGTACCATAACTTTCACTAC |
| 6349 | ACTGTACCATAACTTTCACTACA |
| 6350 | CTGTACCATAACTTTCACTACAT |
| 6351 | TGTACCATAACTTTCACTACATA |
| 6352 | GTACCATAACTTTCACTACATAT |
| 6353 | TACCATAACTTTCACTACATATT |
| 6354 | ACCATAACTTTCACTACATATTA |
| 6355 | CCATAACTTTCACTACATATTAA |
| 6356 | CATAACTTTCACTACATATTAAA |
| 6357 | ATAACTTTCACTACATATTAAAT |
| 6358 | TAACTTTCACTACATATTAAATG |
| 6359 | AACTTTCACTACATATTAAATGA |
| 6360 | ACTTTCACTACATATTAAATGAC |
| 6361 | CTTTCACTACATATTAAATGACA |
| 6362 | TTTCACTACATATTAAATGACAC |
| 6363 | TTCACTACATATTAAATGACACT |
| 6364 | TCACTACATATTAAATGACACTT |
| 6365 | CACTACATATTAAATGACACTTT |
| 6366 | ACTACATATTAAATGACACTTTA |
| 6367 | CTACATATTAAATGACACTTTAT |
| 6368 | TACATATTAAATGACACTTTATA |
| 6369 | ACATATTAAATGACACTTTATAA |
| 6370 | CATATTAAATGACACTTTATAAC |
| 6371 | ATATTAAATGACACTTTATAACT |
| 6372 | TATTAAATGACACTTTATAACTA |
| 6373 | ATTAAATGACACTTTATAACTAA |
| 6374 | TTAAATGACACTTTATAACTAAT |
| 6375 | TAAATGACACTTTATAACTAATA |
| 6376 | AAATGACACTTTATAACTAATAT |
| 6377 | AATGACACTTTATAACTAATATA |
| 6378 | ATGACACTTTATAACTAATATAA |
| 6379 | TGACACTTTATAACTAATATAAT |
| 6380 | GACACTTTATAACTAATATAATA |
| 6381 | ACACTTTATAACTAATATAATAG |
| 6382 | CACTTTATAACTAATATAATAGG |
| 6383 | ACTTTATAACTAATATAATAGGA |
| 6384 | CTTTATAACTAATATAATAGGAC |

| ID | SEQUENCE |
| --- | --- |
| 6385 | TTTATAACTAATATAATAGGACA |
| 6386 | TTATAACTAATATAATAGGACAA |
| 6387 | TATAACTAATATAATAGGACAAT |
| 6388 | ATAACTAATATAATAGGACAATC |
| 6389 | TAACTAATATAATAGGACAATCA |
| 6390 | AACTAATATAATAGGACAATCAT |
| 6391 | ACTAATATAATAGGACAATCATC |
| 6392 | CTAATATAATAGGACAATCATCA |
| 6393 | TAATATAATAGGACAATCATCAA |
| 6394 | AATATAATAGGACAATCATCAAT |
| 6395 | ATATAATAGGACAATCATCAATG |
| 6396 | TATAATAGGACAATCATCAATGC |
| 6397 | ATAATAGGACAATCATCAATGCA |
| 6398 | TAATAGGACAATCATCAATGCAT |
| 6399 | AATAGGACAATCATCAATGCATA |
| 6400 | ATAGGACAATCATCAATGCATAT |
| 6401 | TAGGACAATCATCAATGCATATA |
| 6402 | AGGACAATCATCAATGCATATAT |
| 6403 | GGACAATCATCAATGCATATATA |
| 6404 | GACAATCATCAATGCATATATAG |
| 6405 | ACAATCATCAATGCATATATAGC |
| 6406 | CAATCATCAATGCATATATAGCC |
| 6407 | AATCATCAATGCATATATAGCCA |
| 6408 | ATCATCAATGCATATATAGCCAG |
| 6409 | TCATCAATGCATATATAGCCAGC |
| 6410 | CATCAATGCATATATAGCCAGCC |
| 6411 | ATCAATGCATATATAGCCAGCCC |
| 6412 | TCAATGCATATATAGCCAGCCCT |
| 6413 | CAATGCATATATAGCCAGCCCTT |
| 6414 | AATGCATATATAGCCAGCCCTTC |
| 6415 | ATGCATATATAGCCAGCCCTTCA |
| 6416 | TGCATATATAGCCAGCCCTTCAT |
| 6417 | GCATATATAGCCAGCCCTTCATA |
| 6418 | CATATATAGCCAGCCCTTCATAT |
| 6419 | ATATATAGCCAGCCCTTCATATC |
| 6420 | TATATAGCCAGCCCTTCATATCT |
| 6421 | ATATAGCCAGCCCTTCATATCTG |
| 6422 | TATAGCCAGCCCTTCATATCTGT |
| 6423 | ATAGCCAGCCCTTCATATCTGTG |
| 6424 | TAGCCAGCCCTTCATATCTGTGG |
| 6425 | AGCCAGCCCTTCATATCTGTGGG |
| 6426 | GCCAGCCCTTCATATCTGTGGGT |
| 6427 | CCAGCCCTTCATATCTGTGGGTT |
| 6428 | CAGCCCTTCATATCTGTGGGTTT |
| 6429 | AGCCCTTCATATCTGTGGGTTTT |
| 6430 | GCCCTTCATATCTGTGGGTTTTG |
| 6431 | CCCTTCATATCTGTGGGTTTTGC |
| 6432 | CCTTCATATCTGTGGGTTTTGCA |

| ID | SEQUENCE |
|---|---|
| 6433 | CTTCATATCTGTGGGTTTTGCAT |
| 6434 | TTCATATCTGTGGGTTTTGCATC |
| 6435 | TCATATCTGTGGGTTTTGCATCC |
| 6436 | CATATCTGTGGGTTTTGCATCCA |
| 6437 | ATATCTGTGGGTTTTGCATCCAT |
| 6438 | TATCTGTGGGTTTTGCATCCATG |
| 6439 | ATCTGTGGGTTTTGCATCCATGG |
| 6440 | TCTGTGGGTTTTGCATCCATGGA |
| 6441 | CTGTGGGTTTTGCATCCATGGAT |
| 6442 | TGTGGGTTTTGCATCCATGGATT |
| 6443 | GTGGGTTTTGCATCCATGGATTC |
| 6444 | TGGGTTTTGCATCCATGGATTCA |
| 6445 | GGGTTTTGCATCCATGGATTCAA |
| 6446 | GGTTTTGCATCCATGGATTCAAC |
| 6447 | GTTTTGCATCCATGGATTCAACC |
| 6448 | TTTTGCATCCATGGATTCAACCA |
| 6449 | TTTGCATCCATGGATTCAACCAA |
| 6450 | TTGCATCCATGGATTCAACCAAG |
| 6451 | TGCATCCATGGATTCAACCAAGG |
| 6452 | GCATCCATGGATTCAACCAAGGA |
| 6453 | CATCCATGGATTCAACCAAGGAG |
| 6454 | ATCCATGGATTCAACCAAGGAGG |
| 6455 | TCCATGGATTCAACCAAGGAGGA |
| 6456 | CCATGGATTCAACCAAGGAGGAA |
| 6457 | CATGGATTCAACCAAGGAGGAAT |
| 6458 | ATGGATTCAACCAAGGAGGAATT |
| 6459 | TGGATTCAACCAAGGAGGAATTG |
| 6460 | GGATTCAACCAAGGAGGAATTGA |
| 6461 | GATTCAACCAAGGAGGAATTGAA |
| 6462 | ATTCAACCAAGGAGGAATTGAAA |
| 6463 | TTCAACCAAGGAGGAATTGAAAA |
| 6464 | TCAACCAAGGAGGAATTGAAAAC |
| 6465 | CAACCAAGGAGGAATTGAAAACA |
| 6466 | AACCAAGGAGGAATTGAAAACAC |
| 6467 | ACCAAGGAGGAATTGAAAACACT |
| 6468 | CCAAGGAGGAATTGAAAACACTG |
| 6469 | CAAGGAGGAATTGAAAACACTGA |
| 6470 | AAGGAGGAATTGAAAACACTGAG |
| 6471 | AGGAGGAATTGAAAACACTGAGA |
| 6472 | GGAGGAATTGAAAACACTGAGAA |
| 6473 | GAGGAATTGAAAACACTGAGAAA |
| 6474 | AGGAATTGAAAACACTGAGAAAA |
| 6475 | GGAATTGAAAACACTGAGAAAAA |
| 6476 | GAATTGAAAACACTGAGAAAAAA |
| 6477 | AATTGAAAACACTGAGAAAAAAA |
| 6478 | ATTGAAAACACTGAGAAAAAAAA |
| 6479 | AAAAAAAGACCACACAATAAAAA |
| 6480 | AAAAAAAGACCACACAATAAAAA |

| ID | SEQUENCE |
|---|---|
| 6481 | AAAAAAGACCACACAATAAAAAA |
| 6482 | AAAAAGACCACACAATAAAAAAA |
| 6483 | AAAAGACCACACAATAAAAAAAA |
| 6484 | AAAAAAATACAAAATAATACAA |
| 6485 | AAAAAAATACAAAATAATACAAA |
| 6486 | AAAAAATACAAAATAATACAAAG |
| 6487 | AAAAATACAAAATAATACAAAGA |
| 6488 | AAAATACAAAATAATACAAAGAA |
| 6489 | AAATACAAAATAATACAAAGAAA |
| 6490 | AATACAAAATAATACAAAGAAAA |
| 6491 | ATACAAAATAATACAAAGAAAAA |
| 6492 | TACAAAATAATACAAAGAAAAAG |
| 6493 | ACAAAATAATACAAAGAAAAAGC |
| 6494 | CAAAATAATACAAAGAAAAAGCC |
| 6495 | AAAATAATACAAAGAAAAAGCCA |
| 6496 | AAATAATACAAAGAAAAAGCCAA |
| 6497 | AATAATACAAAGAAAAAGCCAAA |
| 6498 | ATAATACAAAGAAAAAGCCAAAA |
| 6499 | TAATACAAAGAAAAAGCCAAAAT |
| 6500 | AATACAAAGAAAAAGCCAAAATT |
| 6501 | ATACAAAGAAAAAGCCAAAATTG |
| 6502 | TACAAAGAAAAAGCCAAAATTGT |
| 6503 | ACAAAGAAAAAGCCAAAATTGTC |
| 6504 | CAAAGAAAAAGCCAAAATTGTCA |
| 6505 | AAAGAAAAAGCCAAAATTGTCAT |
| 6506 | AAGAAAAAGCCAAAATTGTCATA |
| 6507 | AGAAAAAGCCAAAATTGTCATAC |
| 6508 | GAAAAAGCCAAAATTGTCATACT |
| 6509 | AAAAAGCCAAAATTGTCATACTG |
| 6510 | AAAAGCCAAAATTGTCATACTGT |
| 6511 | AAAGCCAAAATTGTCATACTGTT |
| 6512 | AAGCCAAAATTGTCATACTGTTG |
| 6513 | AGCCAAAATTGTCATACTGTTGT |
| 6514 | GCCAAAATTGTCATACTGTTGTT |
| 6515 | CCAAAATTGTCATACTGTTGTTA |
| 6516 | CAAAATTGTCATACTGTTGTTAA |
| 6517 | AAAATTGTCATACTGTTGTTAAG |
| 6518 | AAATTGTCATACTGTTGTTAAGC |
| 6519 | AATTGTCATACTGTTGTTAAGCA |
| 6520 | ATTGTCATACTGTTGTTAAGCAA |
| 6521 | TTGTCATACTGTTGTTAAGCAAC |
| 6522 | TGTCATACTGTTGTTAAGCAACA |
| 6523 | GTCATACTGTTGTTAAGCAACAG |
| 6524 | TCATACTGTTGTTAAGCAACAGT |
| 6525 | CATACTGTTGTTAAGCAACAGTA |
| 6526 | ATACTGTTGTTAAGCAACAGTAT |
| 6527 | TACTGTTGTTAAGCAACAGTATA |
| 6528 | ACTGTTGTTAAGCAACAGTATAA |

| ID | SEQUENCE |
|---|---|
| 6529 | CTGTTGTTAAGCAACAGTATAAC |
| 6530 | TGTTGTTAAGCAACAGTATAACA |
| 6531 | GTTGTTAAGCAACAGTATAACAA |
| 6532 | TTGTTAAGCAACAGTATAACAAC |
| 6533 | TGTTAAGCAACAGTATAACAACT |
| 6534 | GTTAAGCAACAGTATAACAACTA |
| 6535 | TTAAGCAACAGTATAACAACTAT |
| 6536 | TAAGCAACAGTATAACAACTATT |
| 6537 | AAGCAACAGTATAACAACTATTT |
| 6538 | AGCAACAGTATAACAACTATTTA |
| 6539 | GCAACAGTATAACAACTATTTAC |
| 6540 | CAACAGTATAACAACTATTTACA |
| 6541 | AACAGTATAACAACTATTTACAT |
| 6542 | ACAGTATAACAACTATTTACATA |
| 6543 | CAGTATAACAACTATTTACATAG |
| 6544 | AGTATAACAACTATTTACATAGC |
| 6545 | GTATAACAACTATTTACATAGCA |
| 6546 | TATAACAACTATTTACATAGCAT |
| 6547 | ATAACAACTATTTACATAGCATT |
| 6548 | TAACAACTATTTACATAGCATTA |
| 6549 | AACAACTATTTACATAGCATTAA |
| 6550 | ACAACTATTTACATAGCATTAAG |
| 6551 | CAACTATTTACATAGCATTAAGG |
| 6552 | AACTATTTACATAGCATTAAGGT |
| 6553 | ACTATTTACATAGCATTAAGGTT |
| 6554 | CTATTTACATAGCATTAAGGTTG |
| 6555 | TATTTACATAGCATTAAGGTTGG |
| 6556 | ATTTACATAGCATTAAGGTTGGT |
| 6557 | TTTACATAGCATTAAGGTTGGTG |
| 6558 | TTACATAGCATTAAGGTTGGTGC |
| 6559 | TACATAGCATTAAGGTTGGTGCA |
| 6560 | ACATAGCATTAAGGTTGGTGCAA |
| 6561 | CATAGCATTAAGGTTGGTGCAAA |
| 6562 | ATAGCATTAAGGTTGGTGCAAAA |
| 6563 | TAGCATTAAGGTTGGTGCAAAAA |
| 6564 | AGCATTAAGGTTGGTGCAAAAAT |
| 6565 | GCATTAAGGTTGGTGCAAAAATG |
| 6566 | CATTAAGGTTGGTGCAAAAATGC |
| 6567 | ATTAAGGTTGGTGCAAAAATGCA |
| 6568 | TTAAGGTTGGTGCAAAAATGCAA |
| 6569 | TAAGGTTGGTGCAAAAATGCAAA |
| 6570 | AAGGTTGGTGCAAAAATGCAAAA |
| 6571 | AGGTTGGTGCAAAAATGCAAAAA |
| 6572 | GGTTGGTGCAAAAATGCAAAAAA |
| 6573 | GTTGGTGCAAAAATGCAAAAAAA |
| 6574 | TTGGTGCAAAAATGCAAAAAAAA |
| 6575 | AAAAAAAGCAATTATTTTAAA |
| 6576 | AAAAAAAGCAATTATTTTAAAC |

| ID | SEQUENCE |
|---|---|
| 6577 | AAAAAAGCAATTATTTTAAACC |
| 6578 | AAAAAGCAATTATTTTAAACCA |
| 6579 | AAAAGCAATTATTTTAAACCAA |
| 6580 | AAAGCAATTATTTTAAACCAAC |
| 6581 | AAGCAATTATTTTAAACCAACC |
| 6582 | AGCAATTATTTTAAACCAACCT |
| 6583 | GCAATTATTTTAAACCAACCTA |
| 6584 | CAATTATTTTAAACCAACCTAA |
| 6585 | AATTATTTTAAACCAACCTAAT |
| 6586 | ATTATTTTAAACCAACCTAATA |
| 6587 | TTATTTTAAACCAACCTAATAT |
| 6588 | TATTTTAAACCAACCTAATATA |
| 6589 | ATTTTAAACCAACCTAATATAT |
| 6590 | TTTTAAACCAACCTAATATATT |
| 6591 | TTTAAACCAACCTAATATATTG |
| 6592 | TTAAACCAACCTAATATATTGT |
| 6593 | TAAACCAACCTAATATATTGTA |
| 6594 | AAACCAACCTAATATATTGTAT |
| 6595 | AACCAACCTAATATATTGTATT |
| 6596 | ACCAACCTAATATATTGTATTA |
| 6597 | CCAACCTAATATATTGTATTAG |
| 6598 | CAACCTAATATATTGTATTAGG |
| 6599 | AACCTAATATATTGTATTAGGT |
| 6600 | ACCTAATATATTGTATTAGGTA |
| 6601 | CCTAATATATTGTATTAGGTAT |
| 6602 | CTAATATATTGTATTAGGTATT |
| 6603 | TAATATATTGTATTAGGTATTA |
| 6604 | AATATATTGTATTAGGTATTAA |
| 6605 | ATATATTGTATTAGGTATTAAA |
| 6606 | TATATTGTATTAGGTATTAAAG |
| 6607 | ATATTGTATTAGGTATTAAAGT |
| 6608 | TATTGTATTAGGTATTAAAGTC |
| 6609 | ATTGTATTAGGTATTAAAGTCA |
| 6610 | TTGTATTAGGTATTAAAGTCAT |
| 6611 | TGTATTAGGTATTAAAGTCATC |
| 6612 | GTATTAGGTATTAAAGTCATCT |
| 6613 | TATTAGGTATTAAAGTCATCTG |
| 6614 | ATTAGGTATTAAAGTCATCTGG |
| 6615 | TTAGGTATTAAAGTCATCTGGA |
| 6616 | TAGGTATTAAAGTCATCTGGAC |
| 6617 | AGGTATTAAAGTCATCTGGACA |
| 6618 | GGTATTAAAGTCATCTGGACAT |
| 6619 | GTATTAAAGTCATCTGGACATG |
| 6620 | TATTAAAGTCATCTGGACATGA |
| 6621 | ATTAAAGTCATCTGGACATGAA |
| 6622 | TTAAAGTCATCTGGACATGAAT |
| 6623 | TAAAGTCATCTGGACATGAATT |
| 6624 | AAAGTCATCTGGACATGAATTA |

| ID | SEQUENCE |
|---|---|
| 6625 | AAAGTCATCTGGACATGAATTAA |
| 6626 | AAGTCATCTGGACATGAATTAAA |
| 6627 | AGTCATCTGGACATGAATTAAAG |
| 6628 | GTCATCTGGACATGAATTAAAGT |
| 6629 | TCATCTGGACATGAATTAAAGTA |
| 6630 | CATCTGGACATGAATTAAAGTAT |
| 6631 | ATCTGGACATGAATTAAAGTATA |
| 6632 | TCTGGACATGAATTAAAGTATAT |
| 6633 | CTGGACATGAATTAAAGTATATG |
| 6634 | TGGACATGAATTAAAGTATATGA |
| 6635 | GGACATGAATTAAAGTATATGAT |
| 6636 | GACATGAATTAAAGTATATGATG |
| 6637 | ACATGAATTAAAGTATATGATGC |
| 6638 | CATGAATTAAAGTATATGATGCC |
| 6639 | ATGAATTAAAGTATATGATGCCA |
| 6640 | TGAATTAAAGTATATGATGCCAG |
| 6641 | GAATTAAAGTATATGATGCCAGC |
| 6642 | AATTAAAGTATATGATGCCAGCC |
| 6643 | ATTAAAGTATATGATGCCAGCCT |
| 6644 | TTAAAGTATATGATGCCAGCCTG |
| 6645 | TAAAGTATATGATGCCAGCCTGG |
| 6646 | AAAGTATATGATGCCAGCCTGGA |
| 6647 | AAGTATATGATGCCAGCCTGGAC |
| 6648 | AGTATATGATGCCAGCCTGGACA |
| 6649 | GTATATGATGCCAGCCTGGACAA |
| 6650 | TATATGATGCCAGCCTGGACAAA |
| 6651 | ATATGATGCCAGCCTGGACAAAA |
| 6652 | TATGATGCCAGCCTGGACAAAAG |
| 6653 | ATGATGCCAGCCTGGACAAAAGG |
| 6654 | TGATGCCAGCCTGGACAAAAGGC |
| 6655 | GATGCCAGCCTGGACAAAAGGCA |
| 6656 | ATGCCAGCCTGGACAAAAGGCAA |
| 6657 | TGCCAGCCTGGACAAAAGGCAAA |
| 6658 | GCCAGCCTGGACAAAAGGCAAAA |
| 6659 | CCAGCCTGGACAAAAGGCAAAAC |
| 6660 | CAGCCTGGACAAAAGGCAAAACC |
| 6661 | AGCCTGGACAAAAGGCAAAACCC |
| 6662 | GCCTGGACAAAAGGCAAAACCCT |
| 6663 | CCTGGACAAAAGGCAAAACCCTG |
| 6664 | CTGGACAAAAGGCAAAACCCTGT |
| 6665 | TGGACAAAAGGCAAAACCCTGTC |
| 6666 | GGACAAAAGGCAAAACCCTGTCT |
| 6667 | GACAAAAGGCAAAACCCTGTCTC |
| 6668 | ACAAAAGGCAAAACCCTGTCTCT |
| 6669 | CAAAAGGCAAAACCCTGTCTCTA |
| 6670 | AAAAGGCAAAACCCTGTCTCTAC |
| 6671 | AAAGGCAAAACCCTGTCTCTACA |
| 6672 | AAGGCAAAACCCTGTCTCTACAA |

| ID | SEQUENCE |
|---|---|
| 6673 | AGGCAAAACCCTGTCTCTACAAA |
| 6674 | GGCAAAACCCTGTCTCTACAAAA |
| 6675 | GCAAAACCCTGTCTCTACAAAAA |
| 6676 | CAAAACCCTGTCTCTACAAAAAA |
| 6677 | AAAACCCTGTCTCTACAAAAAAT |
| 6678 | AAACCCTGTCTCTACAAAAAATA |
| 6679 | AACCCTGTCTCTACAAAAAATAC |
| 6680 | ACCCTGTCTCTACAAAAAATACA |
| 6681 | CCCTGTCTCTACAAAAAATACAA |
| 6682 | CCTGTCTCTACAAAAAATACAAA |
| 6683 | CTGTCTCTACAAAAAATACAAAA |
| 6684 | TGTCTCTACAAAAAATACAAAAA |
| 6685 | GTCTCTACAAAAAATACAAAAAT |
| 6686 | TCTCTACAAAAAATACAAAAATT |
| 6687 | CTCTACAAAAAATACAAAAATTA |
| 6688 | TCTACAAAAAATACAAAAATTAG |
| 6689 | CTACAAAAAATACAAAAATTAGC |
| 6690 | TACAAAAAATACAAAAATTAGCT |
| 6691 | ACAAAAAATACAAAAATTAGCTG |
| 6692 | CAAAAAATACAAAAATTAGCTGG |
| 6693 | AAAAAATACAAAAATTAGCTGGG |
| 6694 | AAAAATACAAAAATTAGCTGGGC |
| 6695 | AAAATACAAAAATTAGCTGGGCA |
| 6696 | AAATACAAAAATTAGCTGGGCAT |
| 6697 | AATACAAAAATTAGCTGGGCATG |
| 6698 | ATACAAAAATTAGCTGGGCATGG |
| 6699 | TACAAAAATTAGCTGGGCATGGT |
| 6700 | ACAAAAATTAGCTGGGCATGGTG |
| 6701 | CAAAAATTAGCTGGGCATGGTGG |
| 6702 | AAAAATTAGCTGGGCATGGTGGT |
| 6703 | AAAATTAGCTGGGCATGGTGGTG |
| 6704 | AAATTAGCTGGGCATGGTGGTGT |
| 6705 | AATTAGCTGGGCATGGTGGTGTG |
| 6706 | ATTAGCTGGGCATGGTGGTGTGT |
| 6707 | TTAGCTGGGCATGGTGGTGTGTG |
| 6708 | TAGCTGGGCATGGTGGTGTGTGC |
| 6709 | AGCTGGGCATGGTGGTGTGTGCC |
| 6710 | GCTGGGCATGGTGGTGTGTGCCT |
| 6711 | CTGGGCATGGTGGTGTGTGCCTG |
| 6712 | TGGGCATGGTGGTGTGTGCCTGT |
| 6713 | GGGCATGGTGGTGTGTGCCTGTA |
| 6714 | GGCATGGTGGTGTGTGCCTGTAG |
| 6715 | GCATGGTGGTGTGTGCCTGTAGT |
| 6716 | CATGGTGGTGTGTGCCTGTAGTC |
| 6717 | ATGGTGGTGTGTGCCTGTAGTCC |
| 6718 | TGGTGGTGTGTGCCTGTAGTCCT |
| 6719 | GGTGGTGTGTGCCTGTAGTCCTG |
| 6720 | GTGGTGTGTGCCTGTAGTCCTGG |

| ID | SEQUENCE |
|---|---|
| 6721 | TGGTGTGTGCCTGTAGTCCTGGC |
| 6722 | GGTGTGTGCCTGTAGTCCTGGCT |
| 6723 | GTGTGTGCCTGTAGTCCTGGCTA |
| 6724 | TGTGTGCCTGTAGTCCTGGCTAC |
| 6725 | GTGTGCCTGTAGTCCTGGCTACT |
| 6726 | TGTGCCTGTAGTCCTGGCTACTC |
| 6727 | GTGCCTGTAGTCCTGGCTACTCC |
| 6728 | TGCCTGTAGTCCTGGCTACTCCG |
| 6729 | GCCTGTAGTCCTGGCTACTCCGG |
| 6730 | CCTGTAGTCCTGGCTACTCCGGA |
| 6731 | CTGTAGTCCTGGCTACTCCGGAG |
| 6732 | TGTAGTCCTGGCTACTCCGGAGC |
| 6733 | GTAGTCCTGGCTACTCCGGAGCC |
| 6734 | TAGTCCTGGCTACTCCGGAGCCT |
| 6735 | AGTCCTGGCTACTCCGGAGCCTG |
| 6736 | GTCCTGGCTACTCCGGAGCCTGA |
| 6737 | TCCTGGCTACTCCGGAGCCTGAG |
| 6738 | CCTGGCTACTCCGGAGCCTGAGG |
| 6739 | CTGGCTACTCCGGAGCCTGAGGT |
| 6740 | TGGCTACTCCGGAGCCTGAGGTG |
| 6741 | GGCTACTCCGGAGCCTGAGGTGG |
| 6742 | GCTACTCCGGAGCCTGAGGTGGG |
| 6743 | CTACTCCGGAGCCTGAGGTGGGA |
| 6744 | TACTCCGGAGCCTGAGGTGGGAG |
| 6745 | ACTCCGGAGCCTGAGGTGGGAGG |
| 6746 | CTCCGGAGCCTGAGGTGGGAGGA |
| 6747 | TCCGGAGCCTGAGGTGGGAGGAT |
| 6748 | CCGGAGCCTGAGGTGGGAGGATC |
| 6749 | CGGAGCCTGAGGTGGGAGGATCG |
| 6750 | GGAGCCTGAGGTGGGAGGATCGC |
| 6751 | GAGCCTGAGGTGGGAGGATCGCT |
| 6752 | AGCCTGAGGTGGGAGGATCGCTT |
| 6753 | GCCTGAGGTGGGAGGATCGCTTG |
| 6754 | CCTGAGGTGGGAGGATCGCTTGA |
| 6755 | CTGAGGTGGGAGGATCGCTTGAG |
| 6756 | TGAGGTGGGAGGATCGCTTGAGT |
| 6757 | GAGGTGGGAGGATCGCTTGAGTC |
| 6758 | AGGTGGGAGGATCGCTTGAGTCT |
| 6759 | GGTGGGAGGATCGCTTGAGTCTG |
| 6760 | GTGGGAGGATCGCTTGAGTCTGG |
| 6761 | TGGGAGGATCGCTTGAGTCTGGG |
| 6762 | GGGAGGATCGCTTGAGTCTGGGA |
| 6763 | GGAGGATCGCTTGAGTCTGGGAG |
| 6764 | GAGGATCGCTTGAGTCTGGGAGG |
| 6765 | AGGATCGCTTGAGTCTGGGAGGC |
| 6766 | GGATCGCTTGAGTCTGGGAGGCA |
| 6767 | GATCGCTTGAGTCTGGGAGGCAG |
| 6768 | ATCGCTTGAGTCTGGGAGGCAGA |

| ID | SEQUENCE |
|---|---|
| 6769 | TCGCTTGAGTCTGGGAGGCAGAG |
| 6770 | CGCTTGAGTCTGGGAGGCAGAGG |
| 6771 | GCTTGAGTCTGGGAGGCAGAGGC |
| 6772 | CTTGAGTCTGGGAGGCAGAGGCT |
| 6773 | TTGAGTCTGGGAGGCAGAGGCTG |
| 6774 | TGAGTCTGGGAGGCAGAGGCTGC |
| 6775 | GAGTCTGGGAGGCAGAGGCTGCA |
| 6776 | AGTCTGGGAGGCAGAGGCTGCAT |
| 6777 | GTCTGGGAGGCAGAGGCTGCATT |
| 6778 | TCTGGGAGGCAGAGGCTGCATTG |
| 6779 | CTGGGAGGCAGAGGCTGCATTGA |
| 6780 | TGGGAGGCAGAGGCTGCATTGAG |
| 6781 | GGGAGGCAGAGGCTGCATTGAGC |
| 6782 | GGAGGCAGAGGCTGCATTGAGCT |
| 6783 | GAGGCAGAGGCTGCATTGAGCTA |
| 6784 | AGGCAGAGGCTGCATTGAGCTAT |
| 6785 | GGCAGAGGCTGCATTGAGCTATG |
| 6786 | GCAGAGGCTGCATTGAGCTATGA |
| 6787 | CAGAGGCTGCATTGAGCTATGAT |
| 6788 | AGAGGCTGCATTGAGCTATGATC |
| 6789 | GAGGCTGCATTGAGCTATGATCA |
| 6790 | AGGCTGCATTGAGCTATGATCAT |
| 6791 | GGCTGCATTGAGCTATGATCATG |
| 6792 | GCTGCATTGAGCTATGATCATGG |
| 6793 | CTGCATTGAGCTATGATCATGGC |
| 6794 | TGCATTGAGCTATGATCATGGCA |
| 6795 | GCATTGAGCTATGATCATGGCAC |
| 6796 | CATTGAGCTATGATCATGGCACT |
| 6797 | ATTGAGCTATGATCATGGCACTG |
| 6798 | TTGAGCTATGATCATGGCACTGC |
| 6799 | TGAGCTATGATCATGGCACTGCA |
| 6800 | GAGCTATGATCATGGCACTGCAT |
| 6801 | AGCTATGATCATGGCACTGCATT |
| 6802 | GCTATGATCATGGCACTGCATTC |
| 6803 | CTATGATCATGGCACTGCATTCC |
| 6804 | TATGATCATGGCACTGCATTCCA |
| 6805 | ATGATCATGGCACTGCATTCCAG |
| 6806 | TGATCATGGCACTGCATTCCAGC |
| 6807 | GATCATGGCACTGCATTCCAGCC |
| 6808 | ATCATGGCACTGCATTCCAGCCT |
| 6809 | TCATGGCACTGCATTCCAGCCTG |
| 6810 | CATGGCACTGCATTCCAGCCTGG |
| 6811 | ATGGCACTGCATTCCAGCCTGGG |
| 6812 | TGGCACTGCATTCCAGCCTGGGT |
| 6813 | GGCACTGCATTCCAGCCTGGGTG |
| 6814 | GCACTGCATTCCAGCCTGGGTGA |
| 6815 | CACTGCATTCCAGCCTGGGTGAC |
| 6816 | ACTGCATTCCAGCCTGGGTGACA |

| ID | SEQUENCE |
|---|---|
| 6817 | CTGCATTCCAGCCTGGGTGACAG |
| 6818 | TGCATTCCAGCCTGGGTGACAGT |
| 6819 | GCATTCCAGCCTGGGTGACAGTG |
| 6820 | CATTCCAGCCTGGGTGACAGTGC |
| 6821 | ATTCCAGCCTGGGTGACAGTGCA |
| 6822 | TTCCAGCCTGGGTGACAGTGCAA |
| 6823 | TCCAGCCTGGGTGACAGTGCAAG |
| 6824 | CCAGCCTGGGTGACAGTGCAAGA |
| 6825 | CAGCCTGGGTGACAGTGCAAGAC |
| 6826 | AGCCTGGGTGACAGTGCAAGACC |
| 6827 | GCCTGGGTGACAGTGCAAGACCT |
| 6828 | CCTGGGTGACAGTGCAAGACCTT |
| 6829 | CTGGGTGACAGTGCAAGACCTTG |
| 6830 | TGGGTGACAGTGCAAGACCTTGT |
| 6831 | GGGTGACAGTGCAAGACCTTGTC |
| 6832 | GGTGACAGTGCAAGACCTTGTCT |
| 6833 | GTGACAGTGCAAGACCTTGTCTC |
| 6834 | TGACAGTGCAAGACCTTGTCTCA |
| 6835 | GACAGTGCAAGACCTTGTCTCAG |
| 6836 | ACAGTGCAAGACCTTGTCTCAGA |
| 6837 | CAGTGCAAGACCTTGTCTCAGAA |
| 6838 | AGTGCAAGACCTTGTCTCAGAAT |
| 6839 | GTGCAAGACCTTGTCTCAGAATA |
| 6840 | TGCAAGACCTTGTCTCAGAATAA |
| 6841 | GCAAGACCTTGTCTCAGAATAAA |
| 6842 | CAAGACCTTGTCTCAGAATAAAT |
| 6843 | AAGACCTTGTCTCAGAATAAATA |
| 6844 | AGACCTTGTCTCAGAATAAATAA |
| 6845 | GACCTTGTCTCAGAATAAATAAA |
| 6846 | ACCTTGTCTCAGAATAAATAAAG |
| 6847 | CCTTGTCTCAGAATAAATAAAGT |
| 6848 | CTTGTCTCAGAATAAATAAAGTA |
| 6849 | TTGTCTCAGAATAAATAAAGTAT |
| 6850 | TGTCTCAGAATAAATAAAGTATG |
| 6851 | GTCTCAGAATAAATAAAGTATGT |
| 6852 | TCTCAGAATAAATAAAGTATGTG |
| 6853 | CTCAGAATAAATAAAGTATGTGA |
| 6854 | TCAGAATAAATAAAGTATGTGAT |
| 6855 | CAGAATAAATAAAGTATGTGATG |
| 6856 | AGAATAAATAAAGTATGTGATGA |
| 6857 | GAATAAATAAAGTATGTGATGAA |
| 6858 | AATAAATAAAGTATGTGATGAAG |
| 6859 | ATAAATAAAGTATGTGATGAAGA |
| 6860 | TAAATAAAGTATGTGATGAAGAT |
| 6861 | AAATAAAGTATGTGATGAAGATG |
| 6862 | AATAAAGTATGTGATGAAGATGT |
| 6863 | ATAAAGTATGTGATGAAGATGTG |
| 6864 | TAAAGTATGTGATGAAGATGTGC |

| ID | SEQUENCE |
|---|---|
| 6865 | AAAGTATGTGATGAAGATGTGCA |
| 6866 | AAGTATGTGATGAAGATGTGCAT |
| 6867 | AGTATGTGATGAAGATGTGCATA |
| 6868 | GTATGTGATGAAGATGTGCATAC |
| 6869 | TATGTGATGAAGATGTGCATACA |
| 6870 | ATGTGATGAAGATGTGCATACAT |
| 6871 | TGTGATGAAGATGTGCATACATT |
| 6872 | GTGATGAAGATGTGCATACATTA |
| 6873 | TGATGAAGATGTGCATACATTAT |
| 6874 | GATGAAGATGTGCATACATTATA |
| 6875 | ATGAAGATGTGCATACATTATAT |
| 6876 | TGAAGATGTGCATACATTATATG |
| 6877 | GAAGATGTGCATACATTATATGC |
| 6878 | AAGATGTGCATACATTATATGCA |
| 6879 | AGATGTGCATACATTATATGCAA |
| 6880 | GATGTGCATACATTATATGCAAA |
| 6881 | ATGTGCATACATTATATGCAAAT |
| 6882 | TGTGCATACATTATATGCAAATA |
| 6883 | GTGCATACATTATATGCAAATAC |
| 6884 | TGCATACATTATATGCAAATACT |
| 6885 | GCATACATTATATGCAAATACTG |
| 6886 | CATACATTATATGCAAATACTGT |
| 6887 | ATACATTATATGCAAATACTGTT |
| 6888 | TACATTATATGCAAATACTGTTT |
| 6889 | ACATTATATGCAAATACTGTTTT |
| 6890 | CATTATATGCAAATACTGTTTTT |
| 6891 | ATTATATGCAAATACTGTTTTTT |
| 6892 | TTATATGCAAATACTGTTTTTTT |
| 6893 | TATATGCAAATACTGTTTTTTTT |
| 6894 | TTTTTTTAATTTAAACAGTCTC |
| 6895 | TTTTTTTAATTTAAACAGTCTCA |
| 6896 | TTTTTTAATTTAAACAGTCTCAC |
| 6897 | TTTTTAATTTAAACAGTCTCACT |
| 6898 | TTTTAATTTAAACAGTCTCACTG |
| 6899 | TTTAATTTAAACAGTCTCACTGT |
| 6900 | TTAATTTAAACAGTCTCACTGTG |
| 6901 | TAATTTAAACAGTCTCACTGTGT |
| 6902 | AATTTAAACAGTCTCACTGTGTT |
| 6903 | ATTTAAACAGTCTCACTGTGTTG |
| 6904 | TTTAAACAGTCTCACTGTGTTGC |
| 6905 | TTAAACAGTCTCACTGTGTTGCC |
| 6906 | TAAACAGTCTCACTGTGTTGCCC |
| 6907 | AAACAGTCTCACTGTGTTGCCCA |
| 6908 | AACAGTCTCACTGTGTTGCCCAG |
| 6909 | ACAGTCTCACTGTGTTGCCCAGG |
| 6910 | CAGTCTCACTGTGTTGCCCAGGA |
| 6911 | AGTCTCACTGTGTTGCCCAGGAT |
| 6912 | GTCTCACTGTGTTGCCCAGGATG |

| ID | SEQUENCE |
|---|---|
| 6913 | TCTCACTGTGTTGCCCAGGATGG |
| 6914 | CTCACTGTGTTGCCCAGGATGGA |
| 6915 | TCACTGTGTTGCCCAGGATGGAG |
| 6916 | CACTGTGTTGCCCAGGATGGAGT |
| 6917 | ACTGTGTTGCCCAGGATGGAGTG |
| 6918 | CTGTGTTGCCCAGGATGGAGTGC |
| 6919 | TGTGTTGCCCAGGATGGAGTGCA |
| 6920 | GTGTTGCCCAGGATGGAGTGCAA |
| 6921 | TGTTGCCCAGGATGGAGTGCAAT |
| 6922 | GTTGCCCAGGATGGAGTGCAATG |
| 6923 | TTGCCCAGGATGGAGTGCAATGG |
| 6924 | TGCCCAGGATGGAGTGCAATGGC |
| 6925 | GCCCAGGATGGAGTGCAATGGCA |
| 6926 | CCCAGGATGGAGTGCAATGGCAC |
| 6927 | CCAGGATGGAGTGCAATGGCACA |
| 6928 | CAGGATGGAGTGCAATGGCACAA |
| 6929 | AGGATGGAGTGCAATGGCACAAT |
| 6930 | GGATGGAGTGCAATGGCACAATC |
| 6931 | GATGGAGTGCAATGGCACAATCT |
| 6932 | ATGGAGTGCAATGGCACAATCTT |
| 6933 | TGGAGTGCAATGGCACAATCTTG |
| 6934 | GGAGTGCAATGGCACAATCTTGG |
| 6935 | GAGTGCAATGGCACAATCTTGGC |
| 6936 | AGTGCAATGGCACAATCTTGGCT |
| 6937 | GTGCAATGGCACAATCTTGGCTC |
| 6938 | TGCAATGGCACAATCTTGGCTCA |
| 6939 | GCAATGGCACAATCTTGGCTCAT |
| 6940 | CAATGGCACAATCTTGGCTCATG |
| 6941 | AATGGCACAATCTTGGCTCATGG |
| 6942 | ATGGCACAATCTTGGCTCATGGC |
| 6943 | TGGCACAATCTTGGCTCATGGCA |
| 6944 | GGCACAATCTTGGCTCATGGCAA |
| 6945 | GCACAATCTTGGCTCATGGCAAA |
| 6946 | CACAATCTTGGCTCATGGCAAAC |
| 6947 | ACAATCTTGGCTCATGGCAAACT |
| 6948 | CAATCTTGGCTCATGGCAAACTC |
| 6949 | AATCTTGGCTCATGGCAAACTCT |
| 6950 | ATCTTGGCTCATGGCAAACTCTG |
| 6951 | TCTTGGCTCATGGCAAACTCTGC |
| 6952 | CTTGGCTCATGGCAAACTCTGCC |
| 6953 | TTGGCTCATGGCAAACTCTGCCT |
| 6954 | TGGCTCATGGCAAACTCTGCCTC |
| 6955 | GGCTCATGGCAAACTCTGCCTCG |
| 6956 | GCTCATGGCAAACTCTGCCTCGC |
| 6957 | CTCATGGCAAACTCTGCCTCGCA |
| 6958 | TCATGGCAAACTCTGCCTCGCAA |
| 6959 | CATGGCAAACTCTGCCTCGCAAG |
| 6960 | ATGGCAAACTCTGCCTCGCAAGC |

| ID | SEQUENCE |
|---|---|
| 6961 | TGGCAAACTCTGCCTCGCAAGCA |
| 6962 | GGCAAACTCTGCCTCGCAAGCAG |
| 6963 | GCAAACTCTGCCTCGCAAGCAGC |
| 6964 | CAAACTCTGCCTCGCAAGCAGCT |
| 6965 | AAACTCTGCCTCGCAAGCAGCTG |
| 6966 | AACTCTGCCTCGCAAGCAGCTGG |
| 6967 | ACTCTGCCTCGCAAGCAGCTGGG |
| 6968 | CTCTGCCTCGCAAGCAGCTGGGA |
| 6969 | TCTGCCTCGCAAGCAGCTGGGAC |
| 6970 | CTGCCTCGCAAGCAGCTGGGACT |
| 6971 | TGCCTCGCAAGCAGCTGGGACTA |
| 6972 | GCCTCGCAAGCAGCTGGGACTAC |
| 6973 | CCTCGCAAGCAGCTGGGACTACA |
| 6974 | CTCGCAAGCAGCTGGGACTACAG |
| 6975 | TCGCAAGCAGCTGGGACTACAGG |
| 6976 | CGCAAGCAGCTGGGACTACAGGC |
| 6977 | GCAAGCAGCTGGGACTACAGGCA |
| 6978 | CAAGCAGCTGGGACTACAGGCAT |
| 6979 | AAGCAGCTGGGACTACAGGCATG |
| 6980 | AGCAGCTGGGACTACAGGCATGC |
| 6981 | GCAGCTGGGACTACAGGCATGCT |
| 6982 | CAGCTGGGACTACAGGCATGCTC |
| 6983 | AGCTGGGACTACAGGCATGCTCC |
| 6984 | GCTGGGACTACAGGCATGCTCCA |
| 6985 | CTGGGACTACAGGCATGCTCCAC |
| 6986 | TGGGACTACAGGCATGCTCCACG |
| 6987 | GGGACTACAGGCATGCTCCACGG |
| 6988 | GGACTACAGGCATGCTCCACGGT |
| 6989 | GACTACAGGCATGCTCCACGGTG |
| 6990 | ACTACAGGCATGCTCCACGGTGC |
| 6991 | CTACAGGCATGCTCCACGGTGCC |
| 6992 | TACAGGCATGCTCCACGGTGCCC |
| 6993 | ACAGGCATGCTCCACGGTGCCCA |
| 6994 | CAGGCATGCTCCACGGTGCCCAG |
| 6995 | AGGCATGCTCCACGGTGCCCAGT |
| 6996 | GGCATGCTCCACGGTGCCCAGTT |
| 6997 | GCATGCTCCACGGTGCCCAGTTA |
| 6998 | CATGCTCCACGGTGCCCAGTTAA |
| 6999 | ATGCTCCACGGTGCCCAGTTAAT |
| 7000 | TGCTCCACGGTGCCCAGTTAATT |
| 7001 | GCTCCACGGTGCCCAGTTAATTT |
| 7002 | CTCCACGGTGCCCAGTTAATTTT |
| 7003 | TCCACGGTGCCCAGTTAATTTTT |
| 7004 | CCACGGTGCCCAGTTAATTTTTT |
| 7005 | CACGGTGCCCAGTTAATTTTTTT |
| 7006 | ACGGTGCCCAGTTAATTTTTTTT |
| 7007 | CGGTGCCCAGTTAATTTTTTTTG |
| 7008 | GGTGCCCAGTTAATTTTTTTGT |

| ID | SEQUENCE |
|---|---|
| 7009 | GTGCCCAGTTAATTTTTTTGTA |
| 7010 | TGCCCAGTTAATTTTTTTGTAT |
| 7011 | GCCCAGTTAATTTTTTTGTATT |
| 7012 | CCCAGTTAATTTTTTTGTATTC |
| 7013 | CCAGTTAATTTTTTTGTATTCT |
| 7014 | CAGTTAATTTTTTTGTATTCTT |
| 7015 | AGTTAATTTTTTTGTATTCTTA |
| 7016 | GTTAATTTTTTTGTATTCTTAG |
| 7017 | TTAATTTTTTTGTATTCTTAGT |
| 7018 | TAATTTTTTTGTATTCTTAGTA |
| 7019 | AATTTTTTTGTATTCTTAGTAG |
| 7020 | ATTTTTTTGTATTCTTAGTAGA |
| 7021 | TTTTTTTGTATTCTTAGTAGAG |
| 7022 | TTTTTTGTATTCTTAGTAGAGA |
| 7023 | TTTTTGTATTCTTAGTAGAGAC |
| 7024 | TTTTGTATTCTTAGTAGAGACA |
| 7025 | TTTGTATTCTTAGTAGAGACAG |
| 7026 | TTGTATTCTTAGTAGAGACAGG |
| 7027 | TGTATTCTTAGTAGAGACAGGG |
| 7028 | GTATTCTTAGTAGAGACAGGGT |
| 7029 | TATTCTTAGTAGAGACAGGGTT |
| 7030 | ATTCTTAGTAGAGACAGGGTTT |
| 7031 | TTCTTAGTAGAGACAGGGTTTC |
| 7032 | TCTTAGTAGAGACAGGGTTTCA |
| 7033 | CTTAGTAGAGACAGGGTTTCAC |
| 7034 | TTAGTAGAGACAGGGTTTCACC |
| 7035 | TAGTAGAGACAGGGTTTCACCA |
| 7036 | AGTAGAGACAGGGTTTCACCAT |
| 7037 | GTAGAGACAGGGTTTCACCATG |
| 7038 | TAGAGACAGGGTTTCACCATGT |
| 7039 | AGAGACAGGGTTTCACCATGTT |
| 7040 | GAGACAGGGTTTCACCATGTTG |
| 7041 | AGACAGGGTTTCACCATGTTGG |
| 7042 | GACAGGGTTTCACCATGTTGGC |
| 7043 | ACAGGGTTTCACCATGTTGGCC |
| 7044 | CAGGGTTTCACCATGTTGGCCA |
| 7045 | AGGGTTTCACCATGTTGGCCAG |
| 7046 | GGGTTTCACCATGTTGGCCAGG |
| 7047 | GGTTTCACCATGTTGGCCAGGC |
| 7048 | GTTTCACCATGTTGGCCAGGCT |
| 7049 | TTTCACCATGTTGGCCAGGCTA |
| 7050 | TTCACCATGTTGGCCAGGCTAG |
| 7051 | TCACCATGTTGGCCAGGCTAGT |
| 7052 | CACCATGTTGGCCAGGCTAGTC |
| 7053 | ACCATGTTGGCCAGGCTAGTCT |
| 7054 | CCATGTTGGCCAGGCTAGTCTT |
| 7055 | CATGTTGGCCAGGCTAGTCTTG |
| 7056 | ATGTTGGCCAGGCTAGTCTTGA |

| ID | SEQUENCE |
|---|---|
| 7057 | ATGTTGGCCAGGCTAGTCTTGAA |
| 7058 | TGTTGGCCAGGCTAGTCTTGAAT |
| 7059 | GTTGGCCAGGCTAGTCTTGAATT |
| 7060 | TTGGCCAGGCTAGTCTTGAATTT |
| 7061 | TGGCCAGGCTAGTCTTGAATTTC |
| 7062 | GGCCAGGCTAGTCTTGAATTTCT |
| 7063 | GCCAGGCTAGTCTTGAATTTCTG |
| 7064 | CCAGGCTAGTCTTGAATTTCTGA |
| 7065 | CAGGCTAGTCTTGAATTTCTGAC |
| 7066 | AGGCTAGTCTTGAATTTCTGACC |
| 7067 | GGCTAGTCTTGAATTTCTGACCT |
| 7068 | GCTAGTCTTGAATTTCTGACCTC |
| 7069 | CTAGTCTTGAATTTCTGACCTCA |
| 7070 | TAGTCTTGAATTTCTGACCTCAA |
| 7071 | AGTCTTGAATTTCTGACCTCAAG |
| 7072 | GTCTTGAATTTCTGACCTCAAGT |
| 7073 | TCTTGAATTTCTGACCTCAAGTG |
| 7074 | CTTGAATTTCTGACCTCAAGTGA |
| 7075 | TTGAATTTCTGACCTCAAGTGAT |
| 7076 | TGAATTTCTGACCTCAAGTGATT |
| 7077 | GAATTTCTGACCTCAAGTGATTC |
| 7078 | AATTTCTGACCTCAAGTGATTCA |
| 7079 | ATTTCTGACCTCAAGTGATTCAT |
| 7080 | TTTCTGACCTCAAGTGATTCATC |
| 7081 | TTCTGACCTCAAGTGATTCATCT |
| 7082 | TCTGACCTCAAGTGATTCATCTC |
| 7083 | CTGACCTCAAGTGATTCATCTCC |
| 7084 | TGACCTCAAGTGATTCATCTCCC |
| 7085 | GACCTCAAGTGATTCATCTCCCA |
| 7086 | ACCTCAAGTGATTCATCTCCCAA |
| 7087 | CCTCAAGTGATTCATCTCCCAAA |
| 7088 | CTCAAGTGATTCATCTCCCAAAG |
| 7089 | TCAAGTGATTCATCTCCCAAAGT |
| 7090 | CAAGTGATTCATCTCCCAAAGTG |
| 7091 | AAGTGATTCATCTCCCAAAGTGC |
| 7092 | AGTGATTCATCTCCCAAAGTGCT |
| 7093 | GTGATTCATCTCCCAAAGTGCTG |
| 7094 | TGATTCATCTCCCAAAGTGCTGG |
| 7095 | GATTCATCTCCCAAAGTGCTGGG |
| 7096 | ATTCATCTCCCAAAGTGCTGGGA |
| 7097 | TTCATCTCCCAAAGTGCTGGGAT |
| 7098 | TCATCTCCCAAAGTGCTGGGATT |
| 7099 | CATCTCCCAAAGTGCTGGGATTA |
| 7100 | ATCTCCCAAAGTGCTGGGATTAC |
| 7101 | TCTCCCAAAGTGCTGGGATTACA |
| 7102 | CTCCCAAAGTGCTGGGATTACAG |
| 7103 | TCCCAAAGTGCTGGGATTACAGG |
| 7104 | CCCAAAGTGCTGGGATTACAGGC |

| ID | SEQUENCE |
|---|---|
| 7105 | CCAAAGTGCTGGGATTACAGGCG |
| 7106 | CAAAGTGCTGGGATTACAGGCGT |
| 7107 | AAAGTGCTGGGATTACAGGCGTG |
| 7108 | AAGTGCTGGGATTACAGGCGTGA |
| 7109 | AGTGCTGGGATTACAGGCGTGAG |
| 7110 | GTGCTGGGATTACAGGCGTGAGC |
| 7111 | TGCTGGGATTACAGGCGTGAGCC |
| 7112 | GCTGGGATTACAGGCGTGAGCCA |
| 7113 | CTGGGATTACAGGCGTGAGCCAC |
| 7114 | TGGGATTACAGGCGTGAGCCACC |
| 7115 | GGGATTACAGGCGTGAGCCACCA |
| 7116 | GGATTACAGGCGTGAGCCACCAC |
| 7117 | GATTACAGGCGTGAGCCACCACG |
| 7118 | ATTACAGGCGTGAGCCACCACGG |
| 7119 | TTACAGGCGTGAGCCACCACGGC |
| 7120 | TACAGGCGTGAGCCACCACGGCC |
| 7121 | ACAGGCGTGAGCCACCACGGCCG |
| 7122 | CAGGCGTGAGCCACCACGGCCGG |
| 7123 | AGGCGTGAGCCACCACGGCCGGC |
| 7124 | GGCGTGAGCCACCACGGCCGGCT |
| 7125 | GCGTGAGCCACCACGGCCGGCTA |
| 7126 | CGTGAGCCACCACGGCCGGCTAA |
| 7127 | GTGAGCCACCACGGCCGGCTAAT |
| 7128 | TGAGCCACCACGGCCGGCTAATT |
| 7129 | GAGCCACCACGGCCGGCTAATTT |
| 7130 | AGCCACCACGGCCGGCTAATTTT |
| 7131 | GCCACCACGGCCGGCTAATTTTT |
| 7132 | CCACCACGGCCGGCTAATTTTTG |
| 7133 | CACCACGGCCGGCTAATTTTTGT |
| 7134 | ACCACGGCCGGCTAATTTTTGTA |
| 7135 | CCACGGCCGGCTAATTTTTGTAT |
| 7136 | CACGGCCGGCTAATTTTTGTATT |
| 7137 | ACGGCCGGCTAATTTTTGTATTT |
| 7138 | CGGCCGGCTAATTTTTGTATTTT |
| 7139 | GGCCGGCTAATTTTTGTATTTTT |
| 7140 | GCCGGCTAATTTTTGTATTTTTT |
| 7141 | CCGGCTAATTTTTGTATTTTTTA |
| 7142 | CGGCTAATTTTTGTATTTTTTAG |
| 7143 | GGCTAATTTTTGTATTTTTTAGT |
| 7144 | GCTAATTTTTGTATTTTTTAGTA |
| 7145 | CTAATTTTTGTATTTTTTAGTAG |
| 7146 | TAATTTTTGTATTTTTTAGTAGT |
| 7147 | AATTTTTGTATTTTTTAGTAGTG |
| 7148 | ATTTTTGTATTTTTTAGTAGTGA |
| 7149 | TTTTTGTATTTTTTAGTAGTGAC |
| 7150 | TTTTGTATTTTTTAGTAGTGACT |
| 7151 | TTTGTATTTTTTAGTAGTGACTG |
| 7152 | TTGTATTTTTTAGTAGTGACTGG |

| ID | SEQUENCE |
|---|---|
| 7153 | TGTATTTTTAGTAGTGACTGGT |
| 7154 | GTATTTTTAGTAGTGACTGGTT |
| 7155 | TATTTTTAGTAGTGACTGGTTT |
| 7156 | ATTTTTAGTAGTGACTGGTTTC |
| 7157 | TTTTTAGTAGTGACTGGTTTCG |
| 7158 | TTTTAGTAGTGACTGGTTTCGC |
| 7159 | TTTAGTAGTGACTGGTTTCGCG |
| 7160 | TTAGTAGTGACTGGTTTCGCGG |
| 7161 | TAGTAGTGACTGGTTTCGCGGT |
| 7162 | AGTAGTGACTGGTTTCGCGGTG |
| 7163 | GTAGTGACTGGTTTCGCGGTGT |
| 7164 | TAGTGACTGGTTTCGCGGTGTT |
| 7165 | AGTGACTGGTTTCGCGGTGTTG |
| 7166 | GTGACTGGTTTCGCGGTGTTGA |
| 7167 | TGACTGGTTTCGCGGTGTTGAC |
| 7168 | GACTGGTTTCGCGGTGTTGACC |
| 7169 | ACTGGTTTCGCGGTGTTGACCA |
| 7170 | CTGGTTTCGCGGTGTTGACCAG |
| 7171 | TGGTTTCGCGGTGTTGACCAGG |
| 7172 | GGTTTCGCGGTGTTGACCAGGC |
| 7173 | GTTTCGCGGTGTTGACCAGGCT |
| 7174 | TTTCGCGGTGTTGACCAGGCTG |
| 7175 | TTCGCGGTGTTGACCAGGCTGG |
| 7176 | TCGCGGTGTTGACCAGGCTGGT |
| 7177 | CGCGGTGTTGACCAGGCTGGTC |
| 7178 | GCGGTGTTGACCAGGCTGGTCT |
| 7179 | CGGTGTTGACCAGGCTGGTCTC |
| 7180 | GGTGTTGACCAGGCTGGTCTCG |
| 7181 | GTGTTGACCAGGCTGGTCTCGA |
| 7182 | TGTTGACCAGGCTGGTCTCGAA |
| 7183 | GTTGACCAGGCTGGTCTCGAAC |
| 7184 | TTGACCAGGCTGGTCTCGAACT |
| 7185 | TGACCAGGCTGGTCTCGAACTC |
| 7186 | GACCAGGCTGGTCTCGAACTCC |
| 7187 | ACCAGGCTGGTCTCGAACTCCT |
| 7188 | CCAGGCTGGTCTCGAACTCCTG |
| 7189 | CAGGCTGGTCTCGAACTCCTGA |
| 7190 | AGGCTGGTCTCGAACTCCTGAT |
| 7191 | GGCTGGTCTCGAACTCCTGATC |
| 7192 | GCTGGTCTCGAACTCCTGATCT |
| 7193 | CTGGTCTCGAACTCCTGATCTC |
| 7194 | TGGTCTCGAACTCCTGATCTCA |
| 7195 | GGTCTCGAACTCCTGATCTCAG |
| 7196 | GTCTCGAACTCCTGATCTCAGG |
| 7197 | TCTCGAACTCCTGATCTCAGGT |
| 7198 | CTCGAACTCCTGATCTCAGGTG |
| 7199 | TCGAACTCCTGATCTCAGGTGA |
| 7200 | CGAACTCCTGATCTCAGGTGAT |

| ID | SEQUENCE |
|---|---|
| 7201 | CGAACTCCTGATCTCAGGTGATC |
| 7202 | GAACTCCTGATCTCAGGTGATCT |
| 7203 | AACTCCTGATCTCAGGTGATCTG |
| 7204 | ACTCCTGATCTCAGGTGATCTGC |
| 7205 | CTCCTGATCTCAGGTGATCTGCC |
| 7206 | TCCTGATCTCAGGTGATCTGCCT |
| 7207 | CCTGATCTCAGGTGATCTGCCTG |
| 7208 | CTGATCTCAGGTGATCTGCCTGC |
| 7209 | TGATCTCAGGTGATCTGCCTGCC |
| 7210 | GATCTCAGGTGATCTGCCTGCCT |
| 7211 | ATCTCAGGTGATCTGCCTGCCTC |
| 7212 | TCTCAGGTGATCTGCCTGCCTCG |
| 7213 | CTCAGGTGATCTGCCTGCCTCGG |
| 7214 | TCAGGTGATCTGCCTGCCTCGGC |
| 7215 | CAGGTGATCTGCCTGCCTCGGCC |
| 7216 | AGGTGATCTGCCTGCCTCGGCCT |
| 7217 | GGTGATCTGCCTGCCTCGGCCTC |
| 7218 | GTGATCTGCCTGCCTCGGCCTCA |
| 7219 | TGATCTGCCTGCCTCGGCCTCAC |
| 7220 | GATCTGCCTGCCTCGGCCTCACA |
| 7221 | ATCTGCCTGCCTCGGCCTCACAA |
| 7222 | TCTGCCTGCCTCGGCCTCACAAA |
| 7223 | CTGCCTGCCTCGGCCTCACAAAG |
| 7224 | TGCCTGCCTCGGCCTCACAAAGT |
| 7225 | GCCTGCCTCGGCCTCACAAAGTG |
| 7226 | CCTGCCTCGGCCTCACAAAGTGC |
| 7227 | CTGCCTCGGCCTCACAAAGTGCT |
| 7228 | TGCCTCGGCCTCACAAAGTGCTG |
| 7229 | GCCTCGGCCTCACAAAGTGCTGG |
| 7230 | CCTCGGCCTCACAAAGTGCTGGG |
| 7231 | CTCGGCCTCACAAAGTGCTGGGA |
| 7232 | TCGGCCTCACAAAGTGCTGGGAT |
| 7233 | CGGCCTCACAAAGTGCTGGGATT |
| 7234 | GGCCTCACAAAGTGCTGGGATTA |
| 7235 | GCCTCACAAAGTGCTGGGATTAC |
| 7236 | CCTCACAAAGTGCTGGGATTACA |
| 7237 | CTCACAAAGTGCTGGGATTACAG |
| 7238 | TCACAAAGTGCTGGGATTACAGG |
| 7239 | CACAAAGTGCTGGGATTACAGGT |
| 7240 | ACAAAGTGCTGGGATTACAGGTG |
| 7241 | CAAAGTGCTGGGATTACAGGTGT |
| 7242 | AAAGTGCTGGGATTACAGGTGTG |
| 7243 | AAGTGCTGGGATTACAGGTGTGA |
| 7244 | AGTGCTGGGATTACAGGTGTGAA |
| 7245 | GTGCTGGGATTACAGGTGTGAAC |
| 7246 | TGCTGGGATTACAGGTGTGAACC |
| 7247 | GCTGGGATTACAGGTGTGAACCA |
| 7248 | CTGGGATTACAGGTGTGAACCAC |

| ID | SEQUENCE |
|---|---|
| 7249 | TGGGATTACAGGTGTGAACCACT |
| 7250 | GGGATTACAGGTGTGAACCACTG |
| 7251 | GGATTACAGGTGTGAACCACTGC |
| 7252 | GATTACAGGTGTGAACCACTGCT |
| 7253 | ATTACAGGTGTGAACCACTGCTC |
| 7254 | TTACAGGTGTGAACCACTGCTCC |
| 7255 | TACAGGTGTGAACCACTGCTCCC |
| 7256 | ACAGGTGTGAACCACTGCTCCCG |
| 7257 | CAGGTGTGAACCACTGCTCCCGG |
| 7258 | AGGTGTGAACCACTGCTCCCGGC |
| 7259 | GGTGTGAACCACTGCTCCCGGCC |
| 7260 | GTGTGAACCACTGCTCCCGGCCT |
| 7261 | TGTGAACCACTGCTCCCGGCCTT |
| 7262 | GTGAACCACTGCTCCCGGCCTTG |
| 7263 | TGAACCACTGCTCCCGGCCTTGT |
| 7264 | GAACCACTGCTCCCGGCCTTGTG |
| 7265 | AACCACTGCTCCCGGCCTTGTGT |
| 7266 | ACCACTGCTCCCGGCCTTGTGTG |
| 7267 | CCACTGCTCCCGGCCTTGTGTGA |
| 7268 | CACTGCTCCCGGCCTTGTGTGAT |
| 7269 | ACTGCTCCCGGCCTTGTGTGATT |
| 7270 | CTGCTCCCGGCCTTGTGTGATTT |
| 7271 | TGCTCCCGGCCTTGTGTGATTTT |
| 7272 | GCTCCCGGCCTTGTGTGATTTTA |
| 7273 | CTCCCGGCCTTGTGTGATTTTAT |
| 7274 | TCCCGGCCTTGTGTGATTTTATC |
| 7275 | CCCGGCCTTGTGTGATTTTATCT |
| 7276 | CCGGCCTTGTGTGATTTTATCTA |
| 7277 | CGGCCTTGTGTGATTTTATCTAA |
| 7278 | GGCCTTGTGTGATTTTATCTAAG |
| 7279 | GCCTTGTGTGATTTTATCTAAGG |
| 7280 | CCTTGTGTGATTTTATCTAAGGG |
| 7281 | CTTGTGTGATTTTATCTAAGGGA |
| 7282 | TTGTGTGATTTTATCTAAGGGAC |
| 7283 | TGTGTGATTTTATCTAAGGGACT |
| 7284 | GTGTGATTTTATCTAAGGGACTT |
| 7285 | TGTGATTTTATCTAAGGGACTTA |
| 7286 | GTGATTTTATCTAAGGGACTTAA |
| 7287 | TGATTTTATCTAAGGGACTTAAG |
| 7288 | GATTTTATCTAAGGGACTTAAGC |
| 7289 | ATTTTATCTAAGGGACTTAAGCG |
| 7290 | TTTTATCTAAGGGACTTAAGCGT |
| 7291 | TTTATCTAAGGGACTTAAGCGTC |
| 7292 | TTATCTAAGGGACTTAAGCGTCC |
| 7293 | TATCTAAGGGACTTAAGCGTCCT |
| 7294 | ATCTAAGGGACTTAAGCGTCCTC |
| 7295 | TCTAAGGGACTTAAGCGTCCTCA |
| 7296 | CTAAGGGACTTAAGCGTCCTCAG |

| ID | SEQUENCE |
|---|---|
| 7297 | TAAGGGACTTAAGCGTCCTCAGG |
| 7298 | AAGGGACTTAAGCGTCCTCAGGT |
| 7299 | AGGGACTTAAGCGTCCTCAGGTC |
| 7300 | GGGACTTAAGCGTCCTCAGGTCC |
| 7301 | GGACTTAAGCGTCCTCAGGTCCT |
| 7302 | GACTTAAGCGTCCTCAGGTCCTA |
| 7303 | ACTTAAGCGTCCTCAGGTCCTAG |
| 7304 | CTTAAGCGTCCTCAGGTCCTAGG |
| 7305 | TTAAGCGTCCTCAGGTCCTAGGG |
| 7306 | TAAGCGTCCTCAGGTCCTAGGGG |
| 7307 | AAGCGTCCTCAGGTCCTAGGGGG |
| 7308 | AGCGTCCTCAGGTCCTAGGGGGT |
| 7309 | GCGTCCTCAGGTCCTAGGGGGTC |
| 7310 | CGTCCTCAGGTCCTAGGGGGTCG |
| 7311 | GTCCTCAGGTCCTAGGGGGTCGT |
| 7312 | TCCTCAGGTCCTAGGGGGTCGTG |
| 7313 | CCTCAGGTCCTAGGGGGTCGTGA |
| 7314 | CTCAGGTCCTAGGGGGTCGTGAA |
| 7315 | TCAGGTCCTAGGGGGTCGTGAAA |
| 7316 | CAGGTCCTAGGGGGTCGTGAAAC |
| 7317 | AGGTCCTAGGGGGTCGTGAAACC |
| 7318 | GGTCCTAGGGGGTCGTGAAACCA |
| 7319 | GTCCTAGGGGGTCGTGAAACCAA |
| 7320 | TCCTAGGGGGTCGTGAAACCAAA |
| 7321 | CCTAGGGGGTCGTGAAACCAAAA |
| 7322 | CTAGGGGGTCGTGAAACCAAAAC |
| 7323 | TAGGGGGTCGTGAAACCAAAACC |
| 7324 | AGGGGGTCGTGAAACCAAAACCC |
| 7325 | GGGGGTCGTGAAACCAAAACCCC |
| 7326 | GGGGTCGTGAAACCAAAACCCCA |
| 7327 | GGGTCGTGAAACCAAAACCCCAG |
| 7328 | GGTCGTGAAACCAAAACCCCAGG |
| 7329 | GTCGTGAAACCAAAACCCCAGGG |
| 7330 | TCGTGAAACCAAAACCCCAGGGA |
| 7331 | CGTGAAACCAAAACCCCAGGGAT |
| 7332 | GTGAAACCAAAACCCCAGGGATA |
| 7333 | TGAAACCAAAACCCCAGGGATAG |
| 7334 | GAAACCAAAACCCCAGGGATAGC |
| 7335 | AAACCAAAACCCCAGGGATAGCA |
| 7336 | AACCAAAACCCCAGGGATAGCAA |
| 7337 | ACCAAAACCCCAGGGATAGCAAG |
| 7338 | CCAAAACCCCAGGGATAGCAAGG |
| 7339 | CAAAACCCCAGGGATAGCAAGGG |
| 7340 | AAAACCCCAGGGATAGCAAGGGA |
| 7341 | AAACCCCAGGGATAGCAAGGGAC |
| 7342 | AACCCCAGGGATAGCAAGGGACA |
| 7343 | ACCCCAGGGATAGCAAGGGACAA |
| 7344 | CCCCAGGGATAGCAAGGGACAAT |

| ID | SEQUENCE |
|---|---|
| 7345 | CCCAGGGATAGCAAGGGACAATT |
| 7346 | CCAGGGATAGCAAGGGACAATTG |
| 7347 | CAGGGATAGCAAGGGACAATTGT |
| 7348 | AGGGATAGCAAGGGACAATTGTA |
| 7349 | GGGATAGCAAGGGACAATTGTAT |
| 7350 | GGATAGCAAGGGACAATTGTATC |
| 7351 | GATAGCAAGGGACAATTGTATCT |
| 7352 | ATAGCAAGGGACAATTGTATCTT |
| 7353 | TAGCAAGGGACAATTGTATCTTC |
| 7354 | AGCAAGGGACAATTGTATCTTCA |
| 7355 | GCAAGGGACAATTGTATCTTCAA |
| 7356 | CAAGGGACAATTGTATCTTCAAA |
| 7357 | AAGGGACAATTGTATCTTCAAAG |
| 7358 | AGGGACAATTGTATCTTCAAAGT |
| 7359 | GGGACAATTGTATCTTCAAAGTA |
| 7360 | GGACAATTGTATCTTCAAAGTAG |
| 7361 | GACAATTGTATCTTCAAAGTAGA |
| 7362 | ACAATTGTATCTTCAAAGTAGAC |
| 7363 | CAATTGTATCTTCAAAGTAGACA |
| 7364 | AATTGTATCTTCAAAGTAGACAA |
| 7365 | ATTGTATCTTCAAAGTAGACAAA |
| 7366 | TTGTATCTTCAAAGTAGACAAAT |
| 7367 | TGTATCTTCAAAGTAGACAAATG |
| 7368 | GTATCTTCAAAGTAGACAAATGG |
| 7369 | TATCTTCAAAGTAGACAAATGGC |
| 7370 | ATCTTCAAAGTAGACAAATGGCG |
| 7371 | TCTTCAAAGTAGACAAATGGCGC |
| 7372 | CTTCAAAGTAGACAAATGGCGCC |
| 7373 | TTCAAAGTAGACAAATGGCGCCG |
| 7374 | TCAAAGTAGACAAATGGCGCCGG |
| 7375 | CGCCGGGCACGGTGGCTCACGCC |
| 7376 | GCCGGGCACGGTGGCTCACGCCT |
| 7377 | CCGGGCACGGTGGCTCACGCCTG |
| 7378 | CGGGCACGGTGGCTCACGCCTGT |
| 7379 | GGGCACGGTGGCTCACGCCTGTA |
| 7380 | GGCACGGTGGCTCACGCCTGTAA |
| 7381 | GCACGGTGGCTCACGCCTGTAAT |
| 7382 | CACGGTGGCTCACGCCTGTAATC |
| 7383 | ACGGTGGCTCACGCCTGTAATCC |
| 7384 | CGGTGGCTCACGCCTGTAATCCC |
| 7385 | GGTGGCTCACGCCTGTAATCCCA |
| 7386 | GTGGCTCACGCCTGTAATCCCAG |
| 7387 | TGGCTCACGCCTGTAATCCCAGC |
| 7388 | GGCTCACGCCTGTAATCCCAGCA |
| 7389 | GCTCACGCCTGTAATCCCAGCAG |
| 7390 | CTCACGCCTGTAATCCCAGCAGT |
| 7391 | TCACGCCTGTAATCCCAGCAGTT |
| 7392 | CACGCCTGTAATCCCAGCAGTTT |

| ID | SEQUENCE |
|---|---|
| 7393 | ACGCCTGTAATCCCAGCAGTTTC |
| 7394 | CGCCTGTAATCCCAGCAGTTTCC |
| 7395 | GCCTGTAATCCCAGCAGTTTCCG |
| 7396 | CCTGTAATCCCAGCAGTTTCCGA |
| 7397 | CTGTAATCCCAGCAGTTTCCGAG |
| 7398 | TGTAATCCCAGCAGTTTCCGAGG |
| 7399 | GTAATCCCAGCAGTTTCCGAGGC |
| 7400 | TAATCCCAGCAGTTTCCGAGGCT |
| 7401 | AATCCCAGCAGTTTCCGAGGCTG |
| 7402 | ATCCCAGCAGTTTCCGAGGCTGA |
| 7403 | TCCCAGCAGTTTCCGAGGCTGAG |
| 7404 | CCCAGCAGTTTCCGAGGCTGAGG |
| 7405 | CCAGCAGTTTCCGAGGCTGAGGC |
| 7406 | CAGCAGTTTCCGAGGCTGAGGCA |
| 7407 | AGCAGTTTCCGAGGCTGAGGCAG |
| 7408 | GCAGTTTCCGAGGCTGAGGCAGG |
| 7409 | CAGTTTCCGAGGCTGAGGCAGGC |
| 7410 | AGTTTCCGAGGCTGAGGCAGGCG |
| 7411 | GTTTCCGAGGCTGAGGCAGGCGG |
| 7412 | TTTCCGAGGCTGAGGCAGGCGGC |
| 7413 | TTCCGAGGCTGAGGCAGGCGGCT |
| 7414 | TCCGAGGCTGAGGCAGGCGGCTC |
| 7415 | CCGAGGCTGAGGCAGGCGGCTCA |
| 7416 | CGAGGCTGAGGCAGGCGGCTCAC |
| 7417 | GAGGCTGAGGCAGGCGGCTCACC |
| 7418 | AGGCTGAGGCAGGCGGCTCACCT |
| 7419 | GGCTGAGGCAGGCGGCTCACCTG |
| 7420 | GCTGAGGCAGGCGGCTCACCTGA |
| 7421 | CTGAGGCAGGCGGCTCACCTGAG |
| 7422 | TGAGGCAGGCGGCTCACCTGAGG |
| 7423 | GAGGCAGGCGGCTCACCTGAGGT |
| 7424 | AGGCAGGCGGCTCACCTGAGGTC |
| 7425 | GGCAGGCGGCTCACCTGAGGTCA |
| 7426 | GCAGGCGGCTCACCTGAGGTCAG |
| 7427 | CAGGCGGCTCACCTGAGGTCAGG |
| 7428 | AGGCGGCTCACCTGAGGTCAGGA |
| 7429 | GGCGGCTCACCTGAGGTCAGGAG |
| 7430 | GCGGCTCACCTGAGGTCAGGAGT |
| 7431 | CGGCTCACCTGAGGTCAGGAGTT |
| 7432 | GGCTCACCTGAGGTCAGGAGTTG |
| 7433 | GCTCACCTGAGGTCAGGAGTTGG |
| 7434 | CTCACCTGAGGTCAGGAGTTGGA |
| 7435 | TCACCTGAGGTCAGGAGTTGGAG |
| 7436 | CACCTGAGGTCAGGAGTTGGAGA |
| 7437 | ACCTGAGGTCAGGAGTTGGAGAC |
| 7438 | CCTGAGGTCAGGAGTTGGAGACC |
| 7439 | CTGAGGTCAGGAGTTGGAGACCA |
| 7440 | TGAGGTCAGGAGTTGGAGACCAG |

| ID | SEQUENCE |
|---|---|
| 7441 | GAGGTCAGGAGTTGGAGACCAGC |
| 7442 | AGGTCAGGAGTTGGAGACCAGCC |
| 7443 | GGTCAGGAGTTGGAGACCAGCCT |
| 7444 | GTCAGGAGTTGGAGACCAGCCTG |
| 7445 | TCAGGAGTTGGAGACCAGCCTGG |
| 7446 | CAGGAGTTGGAGACCAGCCTGGC |
| 7447 | AGGAGTTGGAGACCAGCCTGGCC |
| 7448 | GGAGTTGGAGACCAGCCTGGCCA |
| 7449 | GAGTTGGAGACCAGCCTGGCCAA |
| 7450 | AGTTGGAGACCAGCCTGGCCAAC |
| 7451 | GTTGGAGACCAGCCTGGCCAACA |
| 7452 | TTGGAGACCAGCCTGGCCAACAT |
| 7453 | TGGAGACCAGCCTGGCCAACATG |
| 7454 | GGAGACCAGCCTGGCCAACATGC |
| 7455 | GAGACCAGCCTGGCCAACATGCT |
| 7456 | AGACCAGCCTGGCCAACATGCTG |
| 7457 | GACCAGCCTGGCCAACATGCTGA |
| 7458 | ACCAGCCTGGCCAACATGCTGAA |
| 7459 | CCAGCCTGGCCAACATGCTGAAA |
| 7460 | CAGCCTGGCCAACATGCTGAAAC |
| 7461 | AGCCTGGCCAACATGCTGAAACC |
| 7462 | GCCTGGCCAACATGCTGAAACCC |
| 7463 | CCTGGCCAACATGCTGAAACCCT |
| 7464 | CTGGCCAACATGCTGAAACCCTG |
| 7465 | TGGCCAACATGCTGAAACCCTGT |
| 7466 | GGCCAACATGCTGAAACCCTGTC |
| 7467 | GCCAACATGCTGAAACCCTGTCT |
| 7468 | CCAACATGCTGAAACCCTGTCTG |
| 7469 | CAACATGCTGAAACCCTGTCTGT |
| 7470 | AACATGCTGAAACCCTGTCTGTA |
| 7471 | ACATGCTGAAACCCTGTCTGTAC |
| 7472 | CATGCTGAAACCCTGTCTGTACA |
| 7473 | ATGCTGAAACCCTGTCTGTACAA |
| 7474 | TGCTGAAACCCTGTCTGTACAAA |
| 7475 | GCTGAAACCCTGTCTGTACAAAA |
| 7476 | CTGAAACCCTGTCTGTACAAAAA |
| 7477 | TGAAACCCTGTCTGTACAAAAAT |
| 7478 | GAAACCCTGTCTGTACAAAAATA |
| 7479 | AAACCCTGTCTGTACAAAAATAC |
| 7480 | AACCCTGTCTGTACAAAAATACA |
| 7481 | ACCCTGTCTGTACAAAAATACAA |
| 7482 | CCCTGTCTGTACAAAAATACAAA |
| 7483 | CCTGTCTGTACAAAAATACAAAA |
| 7484 | CTGTCTGTACAAAAATACAAAAA |
| 7485 | TGTCTGTACAAAAATACAAAAAT |
| 7486 | GTCTGTACAAAAATACAAAAATA |
| 7487 | TCTGTACAAAAATACAAAAATAG |
| 7488 | CTGTACAAAAATACAAAAATAGC |

| ID | SEQUENCE |
|---|---|
| 7489 | TGTACAAAAATACAAAAATAGCT |
| 7490 | GTACAAAAATACAAAAATAGCTG |
| 7491 | TACAAAAATACAAAAATAGCTGG |
| 7492 | ACAAAAATACAAAAATAGCTGGG |
| 7493 | CAAAAATACAAAAATAGCTGGGC |
| 7494 | AAAAATACAAAAATAGCTGGGCA |
| 7495 | AAAATACAAAAATAGCTGGGCAT |
| 7496 | AAATACAAAAATAGCTGGGCATG |
| 7497 | AATACAAAAATAGCTGGGCATGG |
| 7498 | ATACAAAAATAGCTGGGCATGGT |
| 7499 | TACAAAAATAGCTGGGCATGGTG |
| 7500 | ACAAAAATAGCTGGGCATGGTGG |
| 7501 | CAAAAATAGCTGGGCATGGTGGC |
| 7502 | AAAAATAGCTGGGCATGGTGGCG |
| 7503 | AAAATAGCTGGGCATGGTGGCGC |
| 7504 | AAATAGCTGGGCATGGTGGCGCA |
| 7505 | AATAGCTGGGCATGGTGGCGCAT |
| 7506 | ATAGCTGGGCATGGTGGCGCATG |
| 7507 | TAGCTGGGCATGGTGGCGCATGC |
| 7508 | AGCTGGGCATGGTGGCGCATGCC |
| 7509 | GCTGGGCATGGTGGCGCATGCCT |
| 7510 | CTGGGCATGGTGGCGCATGCCTG |
| 7511 | TGGGCATGGTGGCGCATGCCTGT |
| 7512 | GGGCATGGTGGCGCATGCCTGTA |
| 7513 | GGCATGGTGGCGCATGCCTGTAG |
| 7514 | GCATGGTGGCGCATGCCTGTAGT |
| 7515 | CATGGTGGCGCATGCCTGTAGTC |
| 7516 | ATGGTGGCGCATGCCTGTAGTCC |
| 7517 | TGGTGGCGCATGCCTGTAGTCCC |
| 7518 | GGTGGCGCATGCCTGTAGTCCCA |
| 7519 | GTGGCGCATGCCTGTAGTCCCAG |
| 7520 | TGGCGCATGCCTGTAGTCCCAGC |
| 7521 | GGCGCATGCCTGTAGTCCCAGCT |
| 7522 | GCGCATGCCTGTAGTCCCAGCTA |
| 7523 | CGCATGCCTGTAGTCCCAGCTAC |
| 7524 | GCATGCCTGTAGTCCCAGCTACT |
| 7525 | CATGCCTGTAGTCCCAGCTACTA |
| 7526 | ATGCCTGTAGTCCCAGCTACTAG |
| 7527 | TGCCTGTAGTCCCAGCTACTAGA |
| 7528 | GCCTGTAGTCCCAGCTACTAGAG |
| 7529 | CCTGTAGTCCCAGCTACTAGAGC |
| 7530 | CTGTAGTCCCAGCTACTAGAGCG |
| 7531 | TGTAGTCCCAGCTACTAGAGCGA |
| 7532 | GTAGTCCCAGCTACTAGAGCGAC |
| 7533 | TAGTCCCAGCTACTAGAGCGACT |
| 7534 | AGTCCCAGCTACTAGAGCGACTG |
| 7535 | GTCCCAGCTACTAGAGCGACTGA |
| 7536 | TCCCAGCTACTAGAGCGACTGAG |

| ID | SEQUENCE |
|---|---|
| 7537 | CCCAGCTACTAGAGCGACTGAGG |
| 7538 | CCAGCTACTAGAGCGACTGAGGC |
| 7539 | CAGCTACTAGAGCGACTGAGGCA |
| 7540 | AGCTACTAGAGCGACTGAGGCAG |
| 7541 | GCTACTAGAGCGACTGAGGCAGG |
| 7542 | CTACTAGAGCGACTGAGGCAGGA |
| 7543 | TACTAGAGCGACTGAGGCAGGAG |
| 7544 | ACTAGAGCGACTGAGGCAGGAGA |
| 7545 | CTAGAGCGACTGAGGCAGGAGAA |
| 7546 | TAGAGCGACTGAGGCAGGAGAAT |
| 7547 | AGAGCGACTGAGGCAGGAGAATT |
| 7548 | GAGCGACTGAGGCAGGAGAATTG |
| 7549 | AGCGACTGAGGCAGGAGAATTGC |
| 7550 | GCGACTGAGGCAGGAGAATTGCT |
| 7551 | CGACTGAGGCAGGAGAATTGCTT |
| 7552 | GACTGAGGCAGGAGAATTGCTTG |
| 7553 | ACTGAGGCAGGAGAATTGCTTGA |
| 7554 | CTGAGGCAGGAGAATTGCTTGAA |
| 7555 | TGAGGCAGGAGAATTGCTTGAAC |
| 7556 | GAGGCAGGAGAATTGCTTGAACC |
| 7557 | AGGCAGGAGAATTGCTTGAACCT |
| 7558 | GGCAGGAGAATTGCTTGAACCTG |
| 7559 | GCAGGAGAATTGCTTGAACCTGG |
| 7560 | CAGGAGAATTGCTTGAACCTGGG |
| 7561 | AGGAGAATTGCTTGAACCTGGGA |
| 7562 | GGAGAATTGCTTGAACCTGGGAG |
| 7563 | GAGAATTGCTTGAACCTGGGAGG |
| 7564 | AGAATTGCTTGAACCTGGGAGGC |
| 7565 | GAATTGCTTGAACCTGGGAGGCG |
| 7566 | AATTGCTTGAACCTGGGAGGCGG |
| 7567 | ATTGCTTGAACCTGGGAGGCGGA |
| 7568 | TTGCTTGAACCTGGGAGGCGGAG |
| 7569 | TGCTTGAACCTGGGAGGCGGAGG |
| 7570 | GCTTGAACCTGGGAGGCGGAGGT |
| 7571 | CTTGAACCTGGGAGGCGGAGGTT |
| 7572 | TTGAACCTGGGAGGCGGAGGTTG |
| 7573 | TGAACCTGGGAGGCGGAGGTTGC |
| 7574 | GAACCTGGGAGGCGGAGGTTGCA |
| 7575 | AACCTGGGAGGCGGAGGTTGCAG |
| 7576 | ACCTGGGAGGCGGAGGTTGCAGG |
| 7577 | CCTGGGAGGCGGAGGTTGCAGGG |
| 7578 | CTGGGAGGCGGAGGTTGCAGGGA |
| 7579 | TGGGAGGCGGAGGTTGCAGGGAG |
| 7580 | GGGAGGCGGAGGTTGCAGGGAGC |
| 7581 | GGAGGCGGAGGTTGCAGGGAGCC |
| 7582 | GAGGCGGAGGTTGCAGGGAGCCA |
| 7583 | AGGCGGAGGTTGCAGGGAGCCAA |
| 7584 | GGCGGAGGTTGCAGGGAGCCAAG |

| ID | SEQUENCE |
|---|---|
| 7585 | GCGGAGGTTGCAGGGAGCCAAGA |
| 7586 | CGGAGGTTGCAGGGAGCCAAGAT |
| 7587 | GGAGGTTGCAGGGAGCCAAGATG |
| 7588 | GAGGTTGCAGGGAGCCAAGATGG |
| 7589 | AGGTTGCAGGGAGCCAAGATGGC |
| 7590 | GGTTGCAGGGAGCCAAGATGGCG |
| 7591 | GTTGCAGGGAGCCAAGATGGCGC |
| 7592 | TTGCAGGGAGCCAAGATGGCGCC |
| 7593 | TGCAGGGAGCCAAGATGGCGCCA |
| 7594 | GCAGGGAGCCAAGATGGCGCCAC |
| 7595 | CAGGGAGCCAAGATGGCGCCACC |
| 7596 | AGGGAGCCAAGATGGCGCCACCG |
| 7597 | GGGAGCCAAGATGGCGCCACCGC |
| 7598 | GGAGCCAAGATGGCGCCACCGCA |
| 7599 | GAGCCAAGATGGCGCCACCGCAC |
| 7600 | AGCCAAGATGGCGCCACCGCACT |
| 7601 | GCCAAGATGGCGCCACCGCACTC |
| 7602 | CCAAGATGGCGCCACCGCACTCC |
| 7603 | CAAGATGGCGCCACCGCACTCCA |
| 7604 | AAGATGGCGCCACCGCACTCCAG |
| 7605 | AGATGGCGCCACCGCACTCCAGC |
| 7606 | GATGGCGCCACCGCACTCCAGCC |
| 7607 | ATGGCGCCACCGCACTCCAGCCT |
| 7608 | TGGCGCCACCGCACTCCAGCCTA |
| 7609 | GGCGCCACCGCACTCCAGCCTAG |
| 7610 | GCGCCACCGCACTCCAGCCTAGG |
| 7611 | CGCCACCGCACTCCAGCCTAGGT |
| 7612 | GCCACCGCACTCCAGCCTAGGTG |
| 7613 | CCACCGCACTCCAGCCTAGGTGA |
| 7614 | CACCGCACTCCAGCCTAGGTGAT |
| 7615 | ACCGCACTCCAGCCTAGGTGATA |
| 7616 | CCGCACTCCAGCCTAGGTGATAG |
| 7617 | CGCACTCCAGCCTAGGTGATAGA |
| 7618 | GCACTCCAGCCTAGGTGATAGAG |
| 7619 | CACTCCAGCCTAGGTGATAGAGT |
| 7620 | ACTCCAGCCTAGGTGATAGAGTG |
| 7621 | CTCCAGCCTAGGTGATAGAGTGA |
| 7622 | TCCAGCCTAGGTGATAGAGTGAG |
| 7623 | CCAGCCTAGGTGATAGAGTGAGA |
| 7624 | CAGCCTAGGTGATAGAGTGAGAC |
| 7625 | AGCCTAGGTGATAGAGTGAGACT |
| 7626 | GCCTAGGTGATAGAGTGAGACTC |
| 7627 | CCTAGGTGATAGAGTGAGACTCC |
| 7628 | CTAGGTGATAGAGTGAGACTCCC |
| 7629 | TAGGTGATAGAGTGAGACTCCCT |
| 7630 | AGGTGATAGAGTGAGACTCCCTC |
| 7631 | GGTGATAGAGTGAGACTCCCTCT |
| 7632 | GTGATAGAGTGAGACTCCCTCTC |

| ID | SEQUENCE |
|---|---|
| 7633 | TGATAGAGTGAGACTCCCTCTCA |
| 7634 | GATAGAGTGAGACTCCCTCTCAA |
| 7635 | ATAGAGTGAGACTCCCTCTCAAA |
| 7636 | TAGAGTGAGACTCCCTCTCAAAA |
| 7637 | AGAGTGAGACTCCCTCTCAAAAA |
| 7638 | GAGTGAGACTCCCTCTCAAAAAC |
| 7639 | AGTGAGACTCCCTCTCAAAAACA |
| 7640 | GTGAGACTCCCTCTCAAAAACAA |
| 7641 | TGAGACTCCCTCTCAAAAACAAA |
| 7642 | GAGACTCCCTCTCAAAAACAAAA |
| 7643 | AGACTCCCTCTCAAAAACAAAAC |
| 7644 | GACTCCCTCTCAAAAACAAAACA |
| 7645 | ACTCCCTCTCAAAAACAAAACAA |
| 7646 | CTCCCTCTCAAAAACAAAACAAA |
| 7647 | TCCCTCTCAAAAACAAAACAAAA |
| 7648 | CCCTCTCAAAAACAAAACAAAAC |
| 7649 | CCTCTCAAAAACAAAACAAAACA |
| 7650 | CTCTCAAAAACAAAACAAAACAA |
| 7651 | TCTCAAAAACAAAACAAAACAAA |
| 7652 | CTCAAAAACAAAACAAAACAAAA |
| 7653 | TCAAAAACAAAACAAAACAAAAA |
| 7654 | CAAAAACAAAACAAAACAAAAAA |
| 7655 | AAAAACAAAACAAAACAAAAAAA |
| 7656 | AAAACAAAACAAAACAAAAAAAT |
| 7657 | AAACAAAACAAAACAAAAAAATT |
| 7658 | AACAAAACAAAACAAAAAAATTA |
| 7659 | ACAAAACAAAACAAAAAAATTAG |
| 7660 | CAAAACAAAACAAAAAAATTAGA |
| 7661 | AAAACAAAACAAAAAAATTAGAC |
| 7662 | AAACAAAACAAAAAAATTAGACA |
| 7663 | AACAAAACAAAAAAATTAGACAA |
| 7664 | ACAAAACAAAAAAATTAGACAAA |
| 7665 | CAAAACAAAAAAATTAGACAAAT |
| 7666 | AAAACAAAAAAATTAGACAAATG |
| 7667 | AAACAAAAAAATTAGACAAATGC |
| 7668 | AACAAAAAAATTAGACAAATGCT |
| 7669 | ACAAAAAAATTAGACAAATGCTA |
| 7670 | CAAAAAAATTAGACAAATGCTAC |
| 7671 | AAAAAAATTAGACAAATGCTACA |
| 7672 | AAAAAATTAGACAAATGCTACAT |
| 7673 | AAAAATTAGACAAATGCTACATT |
| 7674 | AAAATTAGACAAATGCTACATTA |
| 7675 | AAATTAGACAAATGCTACATTAA |
| 7676 | AATTAGACAAATGCTACATTAAT |
| 7677 | ATTAGACAAATGCTACATTAATG |
| 7678 | TTAGACAAATGCTACATTAATGT |
| 7679 | TAGACAAATGCTACATTAATGTT |
| 7680 | AGACAAATGCTACATTAATGTTT |

| ID | SEQUENCE |
|---|---|
| 7681 | GACAAATGCTACATTAATGTTTG |
| 7682 | ACAAATGCTACATTAATGTTTGG |
| 7683 | CAAATGCTACATTAATGTTTGGG |
| 7684 | AAATGCTACATTAATGTTTGGGT |
| 7685 | AATGCTACATTAATGTTTGGGTG |
| 7686 | ATGCTACATTAATGTTTGGGTGG |
| 7687 | TGCTACATTAATGTTTGGGTGGT |
| 7688 | GCTACATTAATGTTTGGGTGGTC |
| 7689 | CTACATTAATGTTTGGGTGGTCA |
| 7690 | TACATTAATGTTTGGGTGGTCAG |
| 7691 | ACATTAATGTTTGGGTGGTCAGA |
| 7692 | CATTAATGTTTGGGTGGTCAGAT |
| 7693 | ATTAATGTTTGGGTGGTCAGATT |
| 7694 | TTAATGTTTGGGTGGTCAGATTC |
| 7695 | TAATGTTTGGGTGGTCAGATTCT |
| 7696 | AATGTTTGGGTGGTCAGATTCTA |
| 7697 | ATGTTTGGGTGGTCAGATTCTAC |
| 7698 | TGTTTGGGTGGTCAGATTCTACT |
| 7699 | GTTTGGGTGGTCAGATTCTACTT |
| 7700 | TTTGGGTGGTCAGATTCTACTTT |
| 7701 | TTGGGTGGTCAGATTCTACTTTG |
| 7702 | TGGGTGGTCAGATTCTACTTTGA |
| 7703 | GGGTGGTCAGATTCTACTTTGAA |
| 7704 | GGTGGTCAGATTCTACTTTGAAT |
| 7705 | GTGGTCAGATTCTACTTTGAATC |
| 7706 | TGGTCAGATTCTACTTTGAATCT |
| 7707 | GGTCAGATTCTACTTTGAATCTG |
| 7708 | GTCAGATTCTACTTTGAATCTGA |
| 7709 | TCAGATTCTACTTTGAATCTGAA |
| 7710 | CAGATTCTACTTTGAATCTGAAG |
| 7711 | AGATTCTACTTTGAATCTGAAGT |
| 7712 | GATTCTACTTTGAATCTGAAGTT |
| 7713 | ATTCTACTTTGAATCTGAAGTTT |
| 7714 | TTCTACTTTGAATCTGAAGTTTG |
| 7715 | TCTACTTTGAATCTGAAGTTTGC |
| 7716 | CTACTTTGAATCTGAAGTTTGCA |
| 7717 | TACTTTGAATCTGAAGTTTGCAG |
| 7718 | ACTTTGAATCTGAAGTTTGCAGA |
| 7719 | CTTTGAATCTGAAGTTTGCAGAT |
| 7720 | TTTGAATCTGAAGTTTGCAGATA |
| 7721 | TTGAATCTGAAGTTTGCAGATAT |
| 7722 | TGAATCTGAAGTTTGCAGATATG |
| 7723 | GAATCTGAAGTTTGCAGATATGC |
| 7724 | AATCTGAAGTTTGCAGATATGCC |
| 7725 | ATCTGAAGTTTGCAGATATGCCT |
| 7726 | TCTGAAGTTTGCAGATATGCCTA |
| 7727 | CTGAAGTTTGCAGATATGCCTAT |
| 7728 | TGAAGTTTGCAGATATGCCTATA |

| ID | SEQUENCE |
|---|---|
| 7729 | GAAGTTTGCAGATATGCCTATAG |
| 7730 | AAGTTTGCAGATATGCCTATAGA |
| 7731 | AGTTTGCAGATATGCCTATAGAT |
| 7732 | GTTTGCAGATATGCCTATAGATT |
| 7733 | TTTGCAGATATGCCTATAGATTT |
| 7734 | TTGCAGATATGCCTATAGATTTT |
| 7735 | TGCAGATATGCCTATAGATTTTT |
| 7736 | GCAGATATGCCTATAGATTTTTG |
| 7737 | CAGATATGCCTATAGATTTTTGG |
| 7738 | AGATATGCCTATAGATTTTTGGA |
| 7739 | GATATGCCTATAGATTTTTGGAG |
| 7740 | ATATGCCTATAGATTTTTGGAGT |
| 7741 | TATGCCTATAGATTTTTGGAGTT |
| 7742 | ATGCCTATAGATTTTTGGAGTTT |
| 7743 | TGCCTATAGATTTTTGGAGTTTA |
| 7744 | GCCTATAGATTTTTGGAGTTTAC |
| 7745 | CCTATAGATTTTTGGAGTTTACC |
| 7746 | CTATAGATTTTTGGAGTTTACCA |
| 7747 | TATAGATTTTTGGAGTTTACCAC |
| 7748 | ATAGATTTTTGGAGTTTACCACT |
| 7749 | TAGATTTTTGGAGTTTACCACTT |
| 7750 | AGATTTTTGGAGTTTACCACTTT |
| 7751 | GATTTTTGGAGTTTACCACTTTC |
| 7752 | ATTTTTGGAGTTTACCACTTTCT |
| 7753 | TTTTTGGAGTTTACCACTTTCTT |
| 7754 | TTTTGGAGTTTACCACTTTCTTA |
| 7755 | TTTGGAGTTTACCACTTTCTTAT |
| 7756 | TTGGAGTTTACCACTTTCTTATT |
| 7757 | TGGAGTTTACCACTTTCTTATTC |
| 7758 | GGAGTTTACCACTTTCTTATTCT |
| 7759 | GAGTTTACCACTTTCTTATTCTG |
| 7760 | AGTTTACCACTTTCTTATTCTGT |
| 7761 | GTTTACCACTTTCTTATTCTGTA |
| 7762 | TTTACCACTTTCTTATTCTGTAT |
| 7763 | TTACCACTTTCTTATTCTGTATC |
| 7764 | TACCACTTTCTTATTCTGTATCA |
| 7765 | ACCACTTTCTTATTCTGTATCAT |
| 7766 | CCACTTTCTTATTCTGTATCATT |
| 7767 | CACTTTCTTATTCTGTATCATTA |
| 7768 | ACTTTCTTATTCTGTATCATTAA |
| 7769 | CTTTCTTATTCTGTATCATTAAT |
| 7770 | TTTCTTATTCTGTATCATTAATG |
| 7771 | TTCTTATTCTGTATCATTAATGT |
| 7772 | TCTTATTCTGTATCATTAATGTA |
| 7773 | CTTATTCTGTATCATTAATGTAA |
| 7774 | TTATTCTGTATCATTAATGTAAT |
| 7775 | TATTCTGTATCATTAATGTAATA |
| 7776 | ATTCTGTATCATTAATGTAATAT |

| ID | SEQUENCE |
|---|---|
| 7777 | TTCTGTATCATTAATGTAATATT |
| 7778 | TCTGTATCATTAATGTAATATTT |
| 7779 | CTGTATCATTAATGTAATATTTT |
| 7780 | TGTATCATTAATGTAATATTTTA |
| 7781 | GTATCATTAATGTAATATTTTAA |
| 7782 | TATCATTAATGTAATATTTTAAA |
| 7783 | ATCATTAATGTAATATTTTAAAT |
| 7784 | TCATTAATGTAATATTTTAAATT |
| 7785 | CATTAATGTAATATTTTAAATTA |
| 7786 | ATTAATGTAATATTTTAAATTAC |
| 7787 | TTAATGTAATATTTTAAATTACT |
| 7788 | TAATGTAATATTTTAAATTACTA |
| 7789 | AATGTAATATTTTAAATTACTAT |
| 7790 | ATGTAATATTTTAAATTACTATA |
| 7791 | TGTAATATTTTAAATTACTATAT |
| 7792 | GTAATATTTTAAATTACTATATA |
| 7793 | TAATATTTTAAATTACTATATAT |
| 7794 | AATATTTTAAATTACTATATATG |
| 7795 | ATATTTTAAATTACTATATATGT |
| 7796 | TATTTTAAATTACTATATATGTT |
| 7797 | ATTTTAAATTACTATATATGTTA |
| 7798 | TTTTAAATTACTATATATGTTAC |
| 7799 | TTTAAATTACTATATATGTTACC |
| 7800 | TTAAATTACTATATATGTTACCA |
| 7801 | TAAATTACTATATATGTTACCAT |
| 7802 | AAATTACTATATATGTTACCATT |
| 7803 | AATTACTATATATGTTACCATTT |
| 7804 | ATTACTATATATGTTACCATTTT |
| 7805 | TTACTATATATGTTACCATTTTT |
| 7806 | TACTATATATGTTACCATTTTTC |
| 7807 | ACTATATATGTTACCATTTTTCT |
| 7808 | CTATATATGTTACCATTTTTCTG |
| 7809 | TATATATGTTACCATTTTTCTGG |
| 7810 | ATATATGTTACCATTTTTCTGGA |
| 7811 | TATATGTTACCATTTTTCTGGAT |
| 7812 | ATATGTTACCATTTTTCTGGATT |
| 7813 | TATGTTACCATTTTTCTGGATTT |
| 7814 | ATGTTACCATTTTTCTGGATTTA |
| 7815 | TGTTACCATTTTTCTGGATTTAG |
| 7816 | GTTACCATTTTTCTGGATTTAGT |
| 7817 | TTACCATTTTTCTGGATTTAGTA |
| 7818 | TACCATTTTTCTGGATTTAGTAA |
| 7819 | ACCATTTTTCTGGATTTAGTAAG |
| 7820 | CCATTTTTCTGGATTTAGTAAGA |
| 7821 | CATTTTTCTGGATTTAGTAAGAA |
| 7822 | ATTTTTCTGGATTTAGTAAGAAA |
| 7823 | TTTTTCTGGATTTAGTAAGAAAT |
| 7824 | TTTTCTGGATTTAGTAAGAAATT |

| ID | SEQUENCE |
|---|---|
| 7825 | TTTCTGGATTTAGTAAGAAATTT |
| 7826 | TTCTGGATTTAGTAAGAAATTTG |
| 7827 | TCTGGATTTAGTAAGAAATTTGC |
| 7828 | CTGGATTTAGTAAGAAATTTGCA |
| 7829 | TGGATTTAGTAAGAAATTTGCAG |
| 7830 | GGATTTAGTAAGAAATTTGCAGT |
| 7831 | GATTTAGTAAGAAATTTGCAGTT |
| 7832 | ATTTAGTAAGAAATTTGCAGTTT |
| 7833 | TTTAGTAAGAAATTTGCAGTTTT |
| 7834 | TTAGTAAGAAATTTGCAGTTTTG |
| 7835 | TAGTAAGAAATTTGCAGTTTTGG |
| 7836 | AGTAAGAAATTTGCAGTTTTGGT |
| 7837 | GTAAGAAATTTGCAGTTTTGGTT |
| 7838 | TAAGAAATTTGCAGTTTTGGTTT |
| 7839 | AAGAAATTTGCAGTTTTGGTTTG |
| 7840 | AGAAATTTGCAGTTTTGGTTTGA |
| 7841 | GAAATTTGCAGTTTTGGTTTGAT |
| 7842 | AAATTTGCAGTTTTGGTTTGATG |
| 7843 | AATTTGCAGTTTTGGTTTGATGT |
| 7844 | ATTTGCAGTTTTGGTTTGATGTA |
| 7845 | TTTGCAGTTTTGGTTTGATGTAA |
| 7846 | TTGCAGTTTTGGTTTGATGTAAC |
| 7847 | TGCAGTTTTGGTTTGATGTAACA |
| 7848 | GCAGTTTTGGTTTGATGTAACAA |
| 7849 | CAGTTTTGGTTTGATGTAACAAG |
| 7850 | AGTTTTGGTTTGATGTAACAAGG |
| 7851 | GTTTTGGTTTGATGTAACAAGGG |
| 7852 | TTTTGGTTTGATGTAACAAGGGT |
| 7853 | TTTGGTTTGATGTAACAAGGGTT |
| 7854 | TTGGTTTGATGTAACAAGGGTTT |
| 7855 | TGGTTTGATGTAACAAGGGTTTT |
| 7856 | GGTTTGATGTAACAAGGGTTTTA |
| 7857 | GTTTGATGTAACAAGGGTTTTAA |
| 7858 | TTTGATGTAACAAGGGTTTTAAT |
| 7859 | TTGATGTAACAAGGGTTTTAATG |
| 7860 | TGATGTAACAAGGGTTTTAATGT |
| 7861 | GATGTAACAAGGGTTTTAATGTA |
| 7862 | ATGTAACAAGGGTTTTAATGTAA |
| 7863 | TGTAACAAGGGTTTTAATGTAAT |
| 7864 | GTAACAAGGGTTTTAATGTAATT |
| 7865 | TAACAAGGGTTTTAATGTAATTT |
| 7866 | AACAAGGGTTTTAATGTAATTTA |
| 7867 | ACAAGGGTTTTAATGTAATTTAT |
| 7868 | CAAGGGTTTTAATGTAATTTATG |
| 7869 | AAGGGTTTTAATGTAATTTATGT |
| 7870 | AGGGTTTTAATGTAATTTATGTT |
| 7871 | GGGTTTTAATGTAATTTATGTTA |
| 7872 | GGTTTTAATGTAATTTATGTTAG |

| ID | SEQUENCE |
|---|---|
| 7873 | GTTTTAATGTAATTTATGTTAGA |
| 7874 | TTTTAATGTAATTTATGTTAGAT |
| 7875 | TTTAATGTAATTTATGTTAGATT |
| 7876 | TTAATGTAATTTATGTTAGATTT |
| 7877 | TAATGTAATTTATGTTAGATTTT |
| 7878 | AATGTAATTTATGTTAGATTTTG |
| 7879 | ATGTAATTTATGTTAGATTTTGC |
| 7880 | TGTAATTTATGTTAGATTTTGCA |
| 7881 | GTAATTTATGTTAGATTTTGCAT |
| 7882 | TAATTTATGTTAGATTTTGCATT |
| 7883 | AATTTATGTTAGATTTTGCATTT |
| 7884 | ATTTATGTTAGATTTTGCATTTT |
| 7885 | TTTATGTTAGATTTTGCATTTTT |
| 7886 | TTATGTTAGATTTTGCATTTTTT |
| 7887 | TATGTTAGATTTTGCATTTTTTT |
| 7888 | ATGTTAGATTTTGCATTTTTTTC |
| 7889 | TGTTAGATTTTGCATTTTTTTCA |
| 7890 | GTTAGATTTTGCATTTTTTTCAT |
| 7891 | TTAGATTTTGCATTTTTTTCATT |
| 7892 | TAGATTTTGCATTTTTTTCATTA |
| 7893 | AGATTTTGCATTTTTTTCATTAC |
| 7894 | GATTTTGCATTTTTTTCATTACT |
| 7895 | ATTTTGCATTTTTTTCATTACTG |
| 7896 | TTTTGCATTTTTTTCATTACTGT |
| 7897 | TTTGCATTTTTTTCATTACTGTT |
| 7898 | TTGCATTTTTTTCATTACTGTTA |
| 7899 | TGCATTTTTTTCATTACTGTTAT |
| 7900 | GCATTTTTTTCATTACTGTTATA |
| 7901 | CATTTTTTTCATTACTGTTATAT |
| 7902 | ATTTTTTTCATTACTGTTATATT |
| 7903 | TTTTTTTCATTACTGTTATATTT |
| 7904 | TTTTTTCATTACTGTTATATTTT |
| 7905 | TTTTTCATTACTGTTATATTTTA |
| 7906 | TTTTCATTACTGTTATATTTTAA |
| 7907 | TTTCATTACTGTTATATTTTAAC |
| 7908 | TTCATTACTGTTATATTTTAACC |
| 7909 | TCATTACTGTTATATTTTAACCT |
| 7910 | CATTACTGTTATATTTTAACCTG |
| 7911 | ATTACTGTTATATTTTAACCTGA |
| 7912 | TTACTGTTATATTTTAACCTGAC |
| 7913 | TACTGTTATATTTTAACCTGACT |
| 7914 | ACTGTTATATTTTAACCTGACTG |
| 7915 | CTGTTATATTTTAACCTGACTGA |
| 7916 | TGTTATATTTTAACCTGACTGAC |
| 7917 | GTTATATTTTAACCTGACTGACT |
| 7918 | TTATATTTTAACCTGACTGACTG |
| 7919 | TATATTTTAACCTGACTGACTGA |
| 7920 | ATATTTTAACCTGACTGACTGAT |

| ID | SEQUENCE |
|---|---|
| 7921 | TATTTTAACCTGACTGACTGATC |
| 7922 | ATTTTAACCTGACTGACTGATCT |
| 7923 | TTTTAACCTGACTGACTGATCTA |
| 7924 | TTTAACCTGACTGACTGATCTAA |
| 7925 | TTAACCTGACTGACTGATCTAAT |
| 7926 | TAACCTGACTGACTGATCTAATT |
| 7927 | AACCTGACTGACTGATCTAATTG |
| 7928 | ACCTGACTGACTGATCTAATTGT |
| 7929 | CCTGACTGACTGATCTAATTGTA |
| 7930 | CTGACTGACTGATCTAATTGTAT |
| 7931 | TGACTGACTGATCTAATTGTATT |
| 7932 | GACTGACTGATCTAATTGTATTA |
| 7933 | ACTGACTGATCTAATTGTATTAG |
| 7934 | CTGACTGATCTAATTGTATTAGT |
| 7935 | TGACTGATCTAATTGTATTAGTA |
| 7936 | GACTGATCTAATTGTATTAGTAT |
| 7937 | ACTGATCTAATTGTATTAGTATT |
| 7938 | CTGATCTAATTGTATTAGTATTG |
| 7939 | TGATCTAATTGTATTAGTATTGT |
| 7940 | GATCTAATTGTATTAGTATTGTG |
| 7941 | ATCTAATTGTATTAGTATTGTGA |
| 7942 | TCTAATTGTATTAGTATTGTGAA |
| 7943 | CTAATTGTATTAGTATTGTGAAT |
| 7944 | TAATTGTATTAGTATTGTGAATA |
| 7945 | AATTGTATTAGTATTGTGAATAA |
| 7946 | ATTGTATTAGTATTGTGAATAAT |
| 7947 | TTGTATTAGTATTGTGAATAATC |
| 7948 | TGTATTAGTATTGTGAATAATCA |
| 7949 | GTATTAGTATTGTGAATAATCAT |
| 7950 | TATTAGTATTGTGAATAATCATG |
| 7951 | ATTAGTATTGTGAATAATCATGT |
| 7952 | TTAGTATTGTGAATAATCATGTG |
| 7953 | TAGTATTGTGAATAATCATGTGA |
| 7954 | AGTATTGTGAATAATCATGTGAA |
| 7955 | GTATTGTGAATAATCATGTGAAA |
| 7956 | TATTGTGAATAATCATGTGAAAT |
| 7957 | ATTGTGAATAATCATGTGAAATG |
| 7958 | TTGTGAATAATCATGTGAAATGT |
| 7959 | TGTGAATAATCATGTGAAATGTT |
| 7960 | GTGAATAATCATGTGAAATGTTT |
| 7961 | TGAATAATCATGTGAAATGTTTT |
| 7962 | GAATAATCATGTGAAATGTTTTG |
| 7963 | AATAATCATGTGAAATGTTTTGA |
| 7964 | ATAATCATGTGAAATGTTTTGAG |
| 7965 | TAATCATGTGAAATGTTTTGAGA |
| 7966 | AATCATGTGAAATGTTTTGAGAC |
| 7967 | ATCATGTGAAATGTTTTGAGACA |
| 7968 | TCATGTGAAATGTTTTGAGACAG |

| ID | SEQUENCE |
|---|---|
| 7969 | CATGTGAAATGTTTTGAGACAGA |
| 7970 | ATGTGAAATGTTTTGAGACAGAG |
| 7971 | TGTGAAATGTTTTGAGACAGAGT |
| 7972 | GTGAAATGTTTTGAGACAGAGTA |
| 7973 | TGAAATGTTTTGAGACAGAGTAC |
| 7974 | GAAATGTTTTGAGACAGAGTACT |
| 7975 | AAATGTTTTGAGACAGAGTACTA |
| 7976 | AATGTTTTGAGACAGAGTACTAT |
| 7977 | ATGTTTTGAGACAGAGTACTATA |
| 7978 | TGTTTTGAGACAGAGTACTATAT |
| 7979 | GTTTTGAGACAGAGTACTATATT |
| 7980 | TTTTGAGACAGAGTACTATATTT |
| 7981 | TTTGAGACAGAGTACTATATTTG |
| 7982 | TTGAGACAGAGTACTATATTTGT |
| 7983 | TGAGACAGAGTACTATATTTGTG |
| 7984 | GAGACAGAGTACTATATTTGTGA |
| 7985 | AGACAGAGTACTATATTTGTGAA |
| 7986 | GACAGAGTACTATATTTGTGAAT |
| 7987 | ACAGAGTACTATATTTGTGAATA |
| 7988 | CAGAGTACTATATTTGTGAATAT |
| 7989 | AGAGTACTATATTTGTGAATATA |
| 7990 | GAGTACTATATTTGTGAATATAA |
| 7991 | AGTACTATATTTGTGAATATAAT |
| 7992 | GTACTATATTTGTGAATATAATT |
| 7993 | TACTATATTTGTGAATATAATTT |
| 7994 | ACTATATTTGTGAATATAATTTT |
| 7995 | CTATATTTGTGAATATAATTTTA |
| 7996 | TATATTTGTGAATATAATTTTAT |
| 7997 | ATATTTGTGAATATAATTTTATG |
| 7998 | TATTTGTGAATATAATTTTATGG |
| 7999 | ATTTGTGAATATAATTTTATGGT |
| 8000 | TTTGTGAATATAATTTTATGGTT |
| 8001 | TTGTGAATATAATTTTATGGTTT |
| 8002 | TGTGAATATAATTTTATGGTTTT |
| 8003 | GTGAATATAATTTTATGGTTTTT |
| 8004 | TGAATATAATTTTATGGTTTTTT |
| 8005 | GAATATAATTTTATGGTTTTTTT |
| 8006 | AATATAATTTTATGGTTTTTTTC |
| 8007 | ATATAATTTTATGGTTTTTTTCA |
| 8008 | TATAATTTTATGGTTTTTTTCAC |
| 8009 | ATAATTTTATGGTTTTTTTCACT |
| 8010 | TAATTTTATGGTTTTTTTCACTT |
| 8011 | AATTTTATGGTTTTTTTCACTTA |
| 8012 | ATTTTATGGTTTTTTTCACTTAG |
| 8013 | TTTTATGGTTTTTTTCACTTAGA |
| 8014 | TTTATGGTTTTTTTCACTTAGAA |
| 8015 | TTATGGTTTTTTTCACTTAGAAC |
| 8016 | TATGGTTTTTTTCACTTAGAACC |

| ID | SEQUENCE |
|---|---|
| 8017 | ATGGTTTTTTCACTTAGAACCT |
| 8018 | TGGTTTTTTCACTTAGAACCTT |
| 8019 | GGTTTTTTCACTTAGAACCTTT |
| 8020 | GTTTTTTCACTTAGAACCTTTC |
| 8021 | TTTTTTCACTTAGAACCTTTCT |
| 8022 | TTTTTCACTTAGAACCTTTCTG |
| 8023 | TTTTCACTTAGAACCTTTCTGT |
| 8024 | TTTCACTTAGAACCTTTCTGTG |
| 8025 | TTCACTTAGAACCTTTCTGTGT |
| 8026 | TCACTTAGAACCTTTCTGTGTG |
| 8027 | CACTTAGAACCTTTCTGTGTGG |
| 8028 | ACTTAGAACCTTTCTGTGTGGA |
| 8029 | CTTAGAACCTTTCTGTGTGGAA |
| 8030 | TTAGAACCTTTCTGTGTGGAAA |
| 8031 | TAGAACCTTTCTGTGTGGAAAA |
| 8032 | AGAACCTTTCTGTGTGGAAAAC |
| 8033 | GAACCTTTCTGTGTGGAAAACT |
| 8034 | AACCTTTCTGTGTGGAAAACTA |
| 8035 | ACCTTTCTGTGTGGAAAACTAA |
| 8036 | CCTTTCTGTGTGGAAAACTAAG |
| 8037 | CTTTCTGTGTGGAAAACTAAGA |
| 8038 | TTTCTGTGTGGAAAACTAAGAA |
| 8039 | TTCTGTGTGGAAAACTAAGAAA |
| 8040 | TCTGTGTGGAAAACTAAGAAAA |
| 8041 | CTGTGTGGAAAACTAAGAAAAT |
| 8042 | TGTGTGGAAAACTAAGAAAATT |
| 8043 | GTGTGGAAAACTAAGAAAATTG |
| 8044 | TGTGGAAAACTAAGAAAATTGC |
| 8045 | GTGGAAAACTAAGAAAATTGCT |
| 8046 | TGGAAAACTAAGAAAATTGCTT |
| 8047 | GGAAAACTAAGAAAATTGCTTT |
| 8048 | GAAAACTAAGAAAATTGCTTTC |
| 8049 | AAAACTAAGAAAATTGCTTTCT |
| 8050 | AAACTAAGAAAATTGCTTTCTG |
| 8051 | AACTAAGAAAATTGCTTTCTGC |
| 8052 | ACTAAGAAAATTGCTTTCTGCT |
| 8053 | CTAAGAAAATTGCTTTCTGCTG |
| 8054 | TAAGAAAATTGCTTTCTGCTGT |
| 8055 | AAGAAAATTGCTTTCTGCTGTA |
| 8056 | AGAAAATTGCTTTCTGCTGTAT |
| 8057 | GAAAATTGCTTTCTGCTGTATA |
| 8058 | AAAATTGCTTTCTGCTGTATAA |
| 8059 | AAATTGCTTTCTGCTGTATAAT |
| 8060 | AATTGCTTTCTGCTGTATAATC |
| 8061 | ATTGCTTTCTGCTGTATAATCT |
| 8062 | TTGCTTTCTGCTGTATAATCTG |
| 8063 | TGCTTTCTGCTGTATAATCTGG |
| 8064 | GCTTTCTGCTGTATAATCTGGC |

| ID | SEQUENCE |
|---|---|
| 8065 | GCTTTCTGCTGTATAATCTGGCA |
| 8066 | CTTTCTGCTGTATAATCTGGCAT |
| 8067 | TTTCTGCTGTATAATCTGGCATT |
| 8068 | TTCTGCTGTATAATCTGGCATTC |
| 8069 | TCTGCTGTATAATCTGGCATTCA |
| 8070 | CTGCTGTATAATCTGGCATTCAT |
| 8071 | TGCTGTATAATCTGGCATTCATT |
| 8072 | GCTGTATAATCTGGCATTCATTG |
| 8073 | CTGTATAATCTGGCATTCATTGT |
| 8074 | TGTATAATCTGGCATTCATTGTA |
| 8075 | GTATAATCTGGCATTCATTGTAG |
| 8076 | TATAATCTGGCATTCATTGTAGA |
| 8077 | ATAATCTGGCATTCATTGTAGAT |
| 8078 | TAATCTGGCATTCATTGTAGATT |
| 8079 | AATCTGGCATTCATTGTAGATTA |
| 8080 | ATCTGGCATTCATTGTAGATTAA |
| 8081 | TCTGGCATTCATTGTAGATTAAA |
| 8082 | CTGGCATTCATTGTAGATTAAAG |
| 8083 | TGGCATTCATTGTAGATTAAAGC |
| 8084 | GGCATTCATTGTAGATTAAAGCT |
| 8085 | GCATTCATTGTAGATTAAAGCTT |
| 8086 | CATTCATTGTAGATTAAAGCTTA |
| 8087 | ATTCATTGTAGATTAAAGCTTAT |
| 8088 | TTCATTGTAGATTAAAGCTTATT |
| 8089 | TCATTGTAGATTAAAGCTTATTT |
| 8090 | CATTGTAGATTAAAGCTTATTTT |
| 8091 | ATTGTAGATTAAAGCTTATTTTT |
| 8092 | TTGTAGATTAAAGCTTATTTTTC |
| 8093 | TGTAGATTAAAGCTTATTTTTCT |
| 8094 | GTAGATTAAAGCTTATTTTTCTG |
| 8095 | TAGATTAAAGCTTATTTTTCTGT |
| 8096 | AGATTAAAGCTTATTTTTCTGTG |
| 8097 | GATTAAAGCTTATTTTTCTGTGA |
| 8098 | ATTAAAGCTTATTTTTCTGTGAA |
| 8099 | TTAAAGCTTATTTTTCTGTGAAT |
| 8100 | TAAAGCTTATTTTTCTGTGAATA |
| 8101 | AAAGCTTATTTTTCTGTGAATAA |
| 8102 | AAGCTTATTTTTCTGTGAATAAA |
| 8103 | AGCTTATTTTTCTGTGAATAAAA |
| 8104 | GCTTATTTTTCTGTGAATAAAAC |
| 8105 | CTTATTTTTCTGTGAATAAAACG |
| 8106 | TTATTTTTCTGTGAATAAAACGT |
| 8107 | TATTTTTCTGTGAATAAAACGTA |
| 8108 | ATTTTTCTGTGAATAAAACGTAT |
| 8109 | TTTTTCTGTGAATAAAACGTATT |
| 8110 | TTTTCTGTGAATAAAACGTATTC |
| 8111 | TTTCTGTGAATAAAACGTATTCA |
| 8112 | TTCTGTGAATAAAACGTATTCAA |

| ID | SEQUENCE |
|---|---|
| 8113 | TCTGTGAATAAAACGTATTCAAT |
| 8114 | CTGTGAATAAAACGTATTCAATA |
| 8115 | TGTGAATAAAACGTATTCAATAA |
| 8116 | GTGAATAAAACGTATTCAATAAA |
| 8117 | TGAATAAAACGTATTCAATAAAA |
| 8118 | GAATAAAACGTATTCAATAAAAT |
| 8119 | AATAAAACGTATTCAATAAAATA |
| 8120 | ATAAAACGTATTCAATAAAATAC |
| 8121 | TAAAACGTATTCAATAAAATACT |
| 8122 | AAAACGTATTCAATAAAATACTA |
| 8123 | AAACGTATTCAATAAAATACTAT |
| 8124 | AACGTATTCAATAAAATACTATT |
| 8125 | ACGTATTCAATAAAATACTATTC |
| 8126 | CGTATTCAATAAAATACTATTCT |
| 8127 | GTATTCAATAAAATACTATTCTT |
| 8128 | TATTCAATAAAATACTATTCTTT |
| 8129 | ATTCAATAAAATACTATTCTTTA |
| 8130 | TTCAATAAAATACTATTCTTTAA |
| 8131 | TCAATAAAATACTATTCTTTAAA |
| 8132 | CAATAAAATACTATTCTTTAAAA |
| 8133 | AATAAAATACTATTCTTTAAAAT |
| 8134 | ATAAAATACTATTCTTTAAAATT |
| 8135 | TAAAATACTATTCTTTAAAATTA |

SIRNA SILENCING OF GENES EXPRESSED IN CANCER

CROSS-REFERENCES TO RELATED APPLICATIONS

This application claims the benefit of U.S. Provisional Patent Application Nos. 60/808,859, filed May 26, 2006, and 60/817,556 filed Jun. 28, 2006, the disclosures of which are hereby incorporated by reference in their entirety for all purposes.

REFERENCE TO A "SEQUENCE LISTING," A TABLE, OR A COMPUTER PROGRAM LISTING APPENDIX SUBMITTED ON A COMPACT DISK

The Sequence Listing written in file -69-2.APP, 4,222,976 bytes, machine format IBM-PC, MS-Windows operating system, created on Oct. 7, 2008 on duplicate copies of compact disc of the written form of the Sequence Listing, i.e., "Copy 1 of 3" and "Copy 2 of 3", and the sequence information recorded in computer readable form on compact disc, i.e., "Copy 3 of 3" for application Ser. No. 11/807,872, MacLachlan et al., siRNA SILENCING OF GENES EXPRESSED IN CANCER, is hereby incorporated by reference.

BACKGROUND OF THE INVENTION

Cell proliferation and programmed cell death play important roles in the growth and development of an organism. In proliferative diseases such as cancer, the processes of cell proliferation and/or programmed cell death are often perturbed. For example, a cancer cell may have unregulated cell division through either the overexpression of a positive regulator of the cell cycle or the loss of a negative regulator of the cell cycle, perhaps by mutation. Alternatively, a cancer cell may have lost the ability to undergo programmed cell death through the overexpression of a negative regulator of apoptosis. Therefore, there is a need to develop new therapeutic agents that will restore the processes of checkpoint control and programmed cell death to cancerous cells.

RNA interference (RNAi) is an evolutionarily conserved process in which recognition of double-stranded RNA (dsRNA) ultimately leads to posttranscriptional suppression of gene expression. This suppression is mediated by short double stranded RNA (dsRNA), also called small interfering RNA (siRNA), which induces specific degradation of mRNA through complementary base pairing. In several model systems, i.e., mostly lower order animals, this natural response has been developed into a powerful tool for the investigation of gene function (Elbashir S M, et al., *Genes Dev,* 2001, 15:188-200; Hammond S M, et al., *Nat Rev Genet.,* 2001, 2:110-119). More recently it was discovered that introducing synthetic 21-nucleotide dsRNA duplexes into mammalian cells could efficiently silence gene expression. Although the precise mechanism is still unclear, RNAi offers a new way to inactivate genes of interest. In particular, for the treatment of neoplastic disorders (cancer), RNAi provides a potential new approach to modulate (e.g., reduce) the expression of certain genes, e.g., an anti-apoptotic molecule, a growth factor, a growth factor receptor, a mitotic spindle protein, a cell cycle protein, an angiogenic factor, an oncogene, an intracellular signal transducer, a molecular chaperone, and combinations thereof.

One such target is the Eg5 gene which produces the microtubule-associated protein, Eg5 (Kapoor, T. M., et al., *J. Cell Biol.,* 2001, 154, 1125-1133; Garrett, S. et al., *Curr Biol.,* 2003, 13, R810-812; Cassimeris, L., et al., *Curr Issues Mol. Biol.,* 2003, 5, 99-112; Houliston, E., et al., *Dev. Biol.* 1994, 164, 147-159). Generally, due to the clinical success seen with antimitotics in cancer therapy (e.g. taxanes), other proteins that that are also involved in the mitotic machinery, such as Eg5, have become desirable targets as next generation anti-cancer therapeutics. The mitotic kinesin, Eg5, contains an N-terminal motor domain which generates force along the microtubule, moving Eg5 to the microtubule plus end. During interphase in most epithelial cells, the plus ends of microtubules are oriented toward the plasma membrane while the minus ends are facing toward the nucleus. Upon entry into mitosis, microtubule plus ends reorient toward the chromosomes, while the minus ends are anchored at the spindle poles, forming a bipolar spindle. The homotetrameric structure of Eg5 has its motor domains arranged at two ends of a dumbbell such that it can bind and push apart spindle microtubules and generate and outward-directed force pushing spindle poles apart (Sawin, K. E., et al., *Prod Natl. Acad. Sci. USA,* 1995, 92, 4289-4293; Kapoor, T. M., et al., *J Cell Biol.,* 2000, 150, 975-988; Gaglio, T., et al., *J Cell Biol.,* 1996, 135, 399-414). Thus, Eg5 is critical for proper spindle formation during the mitotic process. Disruption of the process leads to activation of spindle assembly checkpoint, the major cell cycle control mechanism which prevents the cell undergoing mitosis to progress to anaphase and leads to cell cycle arrest. Inhibition of the production of the Eg5 protein, which is only expressed during mitosis, results in the induction of cancer cell apoptosis through a unique mechanism. In view of the important role of Eg5 has in the mitotic process, Eg5 has become an attractive therapeutic target for rapidly dividing cells, in particular, in cancer therapy.

The first small molecule inhibitors of Eg5 was identified in a phenotype-based screen and has been termed Monastrol, because of the formation of monoastral spindles due to Eg5 inhibition seen in cells treated with Monastrol (Mayer, T. U., et al., Science, 1999, 286, 971-974). Other small molecule inhibitors of Eg5 have been discovered since and are currently under development (Sakowicz, R., et al., *Cancer Res.,* 2004, 64, 3276-3280; Hotha, S. et al., Angew Chem. Intl. Ed. Engl., 2003, 42, 2379-2382). However, recent literature publications suggest that certain cancer cell lines, e.g., HT-29 colorectal cancer cells, are resistant toward small molecule Eg5 inhibitors, and thus suggest that small molecule Eg5 inhibitors may have be of more limited clinical use than previously thought.

A second target is the EGFR gene that encodes for the epidermal growth factor receptor (EGFR), a glycoprotein with a molecular weight of 170,000 to 180,000. EGFR is an intrinsic tyrosine-specific protein kinase, which is stimulated upon epidermal growth factor (EGF) binding. The known downstream effectors of EGFR include PI3-K, RAS-RAF-MAPK P44/P42, and protein kinase C signaling pathways. EGFR signaling involved in cell growth, angiogenesis, DNA repair, and autocrine growth regulation in a wide spectrum of human cancer cells (Wakeling A E., *Curr Opin Pharmacol* 2002, 2:382-387). Therefore, it has recently emerged as an innovative target for the development of new cancer therapy. Recently, a monoclonal antibody against EGFR called cetuximab has been developed. It has shown excellent clinical effects for the treatment of lung and head and neck cancer in a clinical trial in humans (Shin et al., *Clin Cancer Res,* 2001, 7:1204-1213). Other small chemical inhibitors, such as ZD-1839 have also been developed and demonstrated antitumor effects in in vitro and in vivo (Shawver L K, et al., *Cancer Cell* 2002, 1:117-123). However, clinical use of ZD-1839 in humans has not been very successful. (Baselga *Eur J Cancer* 2001, 37:S16-22).

A third target is the XIAP (X-linked inhibitor of apoptosis protein) which is a member of the mammalian IAP gene family and encodes for the X-linked IAP (XIAP) protein. The anti-apoptotic function of XIAP is executed, at least in part, by inhibition of caspase-3 and caspase-7, two principal effectors of apoptosis. XIAP protein plays a critical role in regulating programmed cell death by suppressing activation of downstream caspase-3 and caspase-7. Interestingly, in pre-cancerous and cancerous cells, it is believed that expression or overexpression of XIAPs makes it difficult for cancer cells to eliminate themselves, instead allowing them to proliferate, metastasize and accumulate additional oncogenic mutations. Inhibition of XIAP activity using anti-sense oligonucleotides has demonstrates anti-tumor activity in human tumor xenograft animal model.

In view of the above, there is a need for compositions and methods for modulating the expression of genes involved in cancer. The present invention addresses these and other needs.

SUMMARY OF THE INVENTION

The present invention provides compositions comprising siRNA molecules that target genes expressed in cancer and methods of using such compositions to silence expression of such genes.

One embodiment of the invention provides a nucleic acid-lipid particle comprising an siRNA molecule that targets a gene expressed in cancer. In some embodiments, the gene is selected from an anti-apoptotic molecule, a growth factor, a growth factor receptor, a mitotic spindle protein, a cell cycle protein, an angiogenic factor, an oncogene, an intracellular signal transducer, a molecular chaperone, and combinations thereof. In some embodiments, the lipid portion of the particle comprises a cationic lipid and a non-cationic lipid. In some embodiments, the nucleic acid-lipid particle further comprises a conjugated lipid that prevents aggregation of the particles and/or a sterol (e.g., cholesterol).

Another embodiment of the invention provides a nucleic acid-lipid particle that targets expression of the Eg5, EGFR or XIAP gene. The nucleic acid-lipid particle comprises an siRNA molecule that silences expression of the Eg5, EGFR or XIAP gene; a cationic lipid; a non-cationic lipid; and a conjugated lipid that inhibits aggregation of particles. The siRNA molecules may comprise at least one sequence set forth in Tables 1-9 (i.e., Tables 1-2 and 7 for Eg5; Tables 3-4 and 8 for EGFR; or Tables 5-6 and 9 for XIAP). In some embodiments, nucleic acid-lipid particles comprise at least 2, 3, 4, 5, or 6 of the sequences set forth in Tables 1-2 and 7 for Eg5; Tables 3-4 and 8 for EGFR; or Tables 5-6 and 9 for XIAP. In some embodiments, The cationic lipid may be, e.g., N,N-dioleyl-N,N-dimethylammonium chloride (DODAC), N,N-distearyl-N,N-dimethylammonium bromide (DDAB), N-(1-(2,3-dioleoyloxy)propyl)-N,N,N-trimethylammonium chloride (DOTAP), N-(1-(2,3-dioleyloxy)propyl)-N,N,N-trimethylammonium chloride (DOTMA), and N,N-dimethyl-2,3-dioleyloxy)propylamine (DODMA), 1,2-DiLinoleyloxy-N,N-dimethylaminopropane (DLinDMA), and 1,2-Dilinolenyloxy-N,N-dimethylaminopropane (DLendMA), or mixtures thereof. The cationic lipid may comprise from about 2 mol % to about 60 mol %, about 5 mol % to about 45 mol %, about 5 mol % to about 15 mol %, about 30 mol % to about 50 mol % or about 40 mol % to about 50 mol % of the total lipid present in the particle.

The non-cationic lipid may be an anionic lipid or a neutral lipid including, but not limited to, a non-cationic lipid is a member selected from the group consisting of dioleoylphosphatidylethanolamine (DOPE), palmitoyloleoylphosphatidylcholine (POPC), egg phosphatidylcholine (EPC), distearoylphosphatidylcholine (DSPC), palmitoyloleoylphosphatidylglycerol (POPG), dipalmitoyl phosphatidyl ethanolamine (DPPE), dimyristoylphosphoethanolamine (DMPE), distearoyl-phosphatidyl-ethanolamine (DSPE), 16-O-monomethyl PE, 16-O-dimethyl PE, 18-1-trans PE, palmitoyloleoyl-phosphatidylethanolamine (POPE), 1-stearoyl-2-oleoyl-phosphatidyethanolamine (SOPE), 1,2-dielaidoyl-sn-glycero-3-phophoethanolamine (transDOPE), cholesterol, or mixtures thereof. The non-cationic lipid comprises from about 5 mol % to about 90 mol % or about 20 mol % to about 85 mol % of the total lipid present in the particle.

The conjugated lipid that inhibits aggregation of particles may be a polyethyleneglycol (PEG)-lipid conjugate, a polyamide (ATTA)-lipid conjugate, a cationic-polymer-lipid conjugates (CPLs), or mixtures thereof. In one preferred embodiment, the nucleic acid-lipid particles comprise either a PEG-lipid conjugate or an ATTA-lipid conjugate together with a CPL. The conjugated lipid that inhibits aggregation of particles may comprise a polyethyleneglycol-lipid including, e.g., a PEG-diacylglycerol (DAG), a PEG dialkyloxypropyl (DAA), a PEG-phospholipid, a PEG-ceramide (Cer), or mixtures thereof. The PEG-DAA conjugate may be PEG-dilauryloxypropyl (C12), a PEG-dimyristyloxypropyl (C14), a PEG-dipalmityloxypropyl (C16), and a PEG-distearyloxypropyl (C18). In some embodiments, the conjugated lipid that inhibits aggregation of particles has the formula: A-W-Y, wherein: A is a lipid moiety; W is a hydrophilic polymer; and Y is a polycationic moiety. W may be a polymer selected from the group consisting of polyethyleneglycol (PEG), polyamide, polylactic acid, polyglycolic acid, polylactic acid/polyglycolic acid copolymers or combinations thereof, said polymer having a molecular weight of about 250 to about 7000 daltons. In some embodiments, Y has at least 4 positive charges at a selected pH. In some embodiments, Y may be lysine, arginine, asparagine, glutamine, derivatives thereof and combinations thereof. The conjugated lipid that prevents aggregation of particles may be about 0 mol % to about 20 mol %, about 1 mol % to about 15 mol %, about 4 mol % to about 10 mol %, or about 2 mol % of the total lipid present in said particle.

In some embodiments, the nucleic acid-lipid particle further comprises cholesterol at, e.g., about 0 mol % to about 10 mol %, about 2 mol % to about 10 mol %, about 10 mol % to about 60 mol % or about 20 mol % to about 45 mol % of the total lipid present in the particle.

In a specific embodiment of the invention, the nucleic acid-lipid particle comprises 48% cholesterol; 10% DSPC; 2% PEG-cDMA; and 40% DLinDMA.

In some embodiments, the siRNA in the nucleic acid-lipid particle is not substantially degraded after exposure of the particle to a nuclease at 37° C. for at least 20, 30, 45, or 60 minutes; or after incubation of the particle in serum at 37° C. for at least 30, 45, or 60 minutes, 2, 3, 4, 5, 6, 7, 8, 9, 10, 12, 14, 16, 18, 20, 22, 24, 26, 28, 30, 32, 34, or 36 hours. In some embodiments, the siRNA is fully encapsulated in the nucleic acid-lipid particle. In some embodiments, the siRNA is complexed to the lipid portion of the particle.

The present invention further provides pharmaceutical compositions comprising the nucleic acid-lipid particles described herein and a pharmaceutically acceptable carrier.

The nucleic acid-lipid particles of the present invention are useful for the therapeutic delivery of nucleic acids comprising an interfering RNA sequence (i.e., an siRNA sequence that targets expression of an Eg5, EGFR or XIAP gene. In particular, it is an object of this invention to provide in vitro and in vivo methods for treatment of a disease in a mammal by downregulating or silencing the transcription and translation of a target nucleic acid sequence of interest. In these methods, an interfering RNA is formulated into a nucleic acid-lipid particle, and the particles are administered to patients requiring such treatment. Alternatively, cells are removed from a patient, the interfering RNA delivered in vitro, and reinjected into the patient. In one embodiment, the present invention provides for a method of introducing a nucleic acid into a cell by contacting a cell with a nucleic acid-lipid particle comprised of a cationic lipid, a non-cationic lipid, a conjugated lipid that inhibits aggregation, and an interfering RNA.

In one embodiment, at least 1%, 2%, 4%, 6%, 8%, 10%, 12%. 14%. 16% or 18% of the total injected dose of the nucleic acid-lipid particles is present in plasma 1, 2, 4, 6, 8, 12, 16, 18, or 24 hours after injection. In other embodiments, more than 20%, 30%, 40% and as much as 60%, 70% or 80% of the total injected dose of the nucleic acid-lipid particles is present in plasma 1, 4, 6, 8, 10, 12, 20, or 24 hours after injection. In one embodiment, the effect of an interfering RNA (e.g., downregulation of the target sequence) at a site proximal or distal to the site of administration is detectable at 12, 24, 48, 72, or 96 hours, 6, 8, 10, 12, 14, 16, 18, 19, 20, 22, 24, 26, or 28 days after administration of the nucleic acid-lipid particles. In one embodiment, downregulation of expression of the target sequence is detectable at 12, 24, 48, 72, or 96 hours, 6, 8, 10, 12, 14, 16, 18, 19, 20, 22, 24, 26, or 28 days after administration. In some embodiments, downregulation of Eg5, EGFR or XIAP gene is detected by detecting mRNA or protein levels in a biological sample from the mammal. In some embodiments, downregulation of expression of a Eg5, EGFR or XIAP sequence is detected by measuring the cell viability or the induction of apoptosis of cells in a biological sample from the mammal.

The particles are suitable for use in intravenous nucleic acid transfer as they are stable in circulation, of a size required for pharmacodynamic behavior resulting in access to extravascular sites and target cell populations. The invention also provides for pharmaceutically acceptable compositions comprising a nucleic acid-lipid particle.

Another embodiment of the present invention provides methods for in vivo delivery of interfering RNA (e.g., interfering RNA that silences expression of an Eg5, EGFR or XIAP gene). A nucleic acid-lipid particle comprising a cationic lipid, a non-cationic lipid, a conjugated lipid that inhibits aggregation of particles, and interfering RNA is administered (e.g., intravenously, intramuscularly, or subcutaneously) to a subject (e.g., a mammal such as a human or a rodent).

A further embodiment of the present invention provides a method of treating a disease or disorder in a mammalian subject. A therapeutically effective amount of a nucleic acid-lipid particle comprising a cationic lipid, a non-cationic lipid, a conjugated lipid that inhibits aggregation of particles, and interfering RNA (e.g., interfering RNA that silences expression of a Eg5, EGFR or XIAP gene) is administered to the mammalian subject (e.g., a rodent such as a mouse, a primate such as a human, a chimpanzee, or a monkey). In some embodiments, the mammalian subject has a cell proliferative disorder. In certain aspects of this embodiment, the mammalian subject has a said cell proliferative disorder is selected from the group consisting of neoplasia (cancer), hyperplasias, restenosis, cardiac hypertrophy, immune disorders and inflammation. Preferably, said cell proliferative disorder is a neoplastic disorder, i.e., cancer. In some embodiments, the cancer includes, but is not limited to papilloma, blastoglioma, Kaposi's sarcoma, melanoma, lung cancer, ovarian cancer, prostate cancer, squamous cell carcinoma, astrocytoma, head cancer, neck cancer, bladder cancer, breast cancer, lung cancer, colorectal cancer, thyroid cancer, pancreatic cancer, gastric cancer, hepatocellular carcinoma, leukemia, lymphoma, Hodgkin's disease, osteosarcoma, testicular cancer, and Burkitt's disease.

The invention further provides siRNA molecules having the sequences set forth in any one of Tables 1-9. In some embodiments, the siRNA molecules comprise modified nucleotides. The siRNA molecules comprising modified nucleotides are capable of silencing expression of a target sequence and are less immunostimulatory than a corresponding unmodified siRNA sequence. In some embodiments, less than about 20%, 15%, 10%, 5%, or 2% of the nucleotides in the siRNA comprise modified nucleotides. In some embodiments, the modified nucleotide is selected from a 2'-O-methyl (2'OMe) pyrimidine and a 2'OMe purine (e.g., a 2'OMe-guanosine, a 2'OMe-uridine, and a 2'OMe-adenosine). In some embodiments, the modified nucleotide is not 2'OMe-cytosine. In some embodiments, the modified nucleotides are present in one strand of the siRNA (e.g., in the sense strand). In some embodiments the corresponding unmodified siRNA sequence comprises at least one 5'-GU-3' motif. In some embodiments, the at least one 5'-GU-3' motif is in the sense strand of the unmodified siRNA sequence. In some embodiments, the double-stranded sequence comprises a hairpin loop structure.

The invention also provides compositions comprising the siRNA molecules described herein and a pharmaceutically acceptable carrier.

These and other embodiments of the invention are further described in the detailed description that follows.

BRIEF DESCRIPTION OF THE DRAWINGS

FIG. 5 illustrates data demonstrating certain characteristic changes seen in cell phenotype following treatment with Eg5 O/O siRNA.

FIG. 6 illustrates a list showing the sequences of various 2'-OMe modified Eg5 2263 siRNAs (SEQ ID NOS:1-3, 2, 3, 4, 2, 1, 5, 1, 6, 3, 5, 3, 6, 4, 6, 4 and 5, respectively).

FIG. 21 is Table 1 which sets forth a list of Eg5 siRNA (SEQ ID NOS:7-32).

FIG. 22 is Table 2 which sets forth an additional list of Eg5 siRNA (SEQ ID NOS:33-62).

FIG. 23 is Table 3 which sets forth a list of EGFR siRNA (SEQ ID NOS:63-92).

FIG. 24 is Table 4 which sets forth an additional list of EGFR siRNA (SEQ ID NOS:93-118).

FIG. 25 is Table 5 which sets forth a list of XIAP siRNA (SEQ ID NOS:119-145).

FIG. 26 is Table 6 which sets forth an additional list of XIAP siRNA (SEQ ID NOS:146-173).

FIG. 27 is Table 7 which sets forth an additional list of Eg5 siRNA (SEQ ID NOS:174-4977).

FIG. 28 is Table 8 which sets forth an additional list of EGFR siRNA (SEQ ID NOS:4978-10362).

FIG. 29 is Table 9 which sets forth an additional list of XIAP siRNA (SEQ ID NOS:10363-18497).

DETAILED DESCRIPTION OF THE INVENTION

I. Introduction

Figure 1:
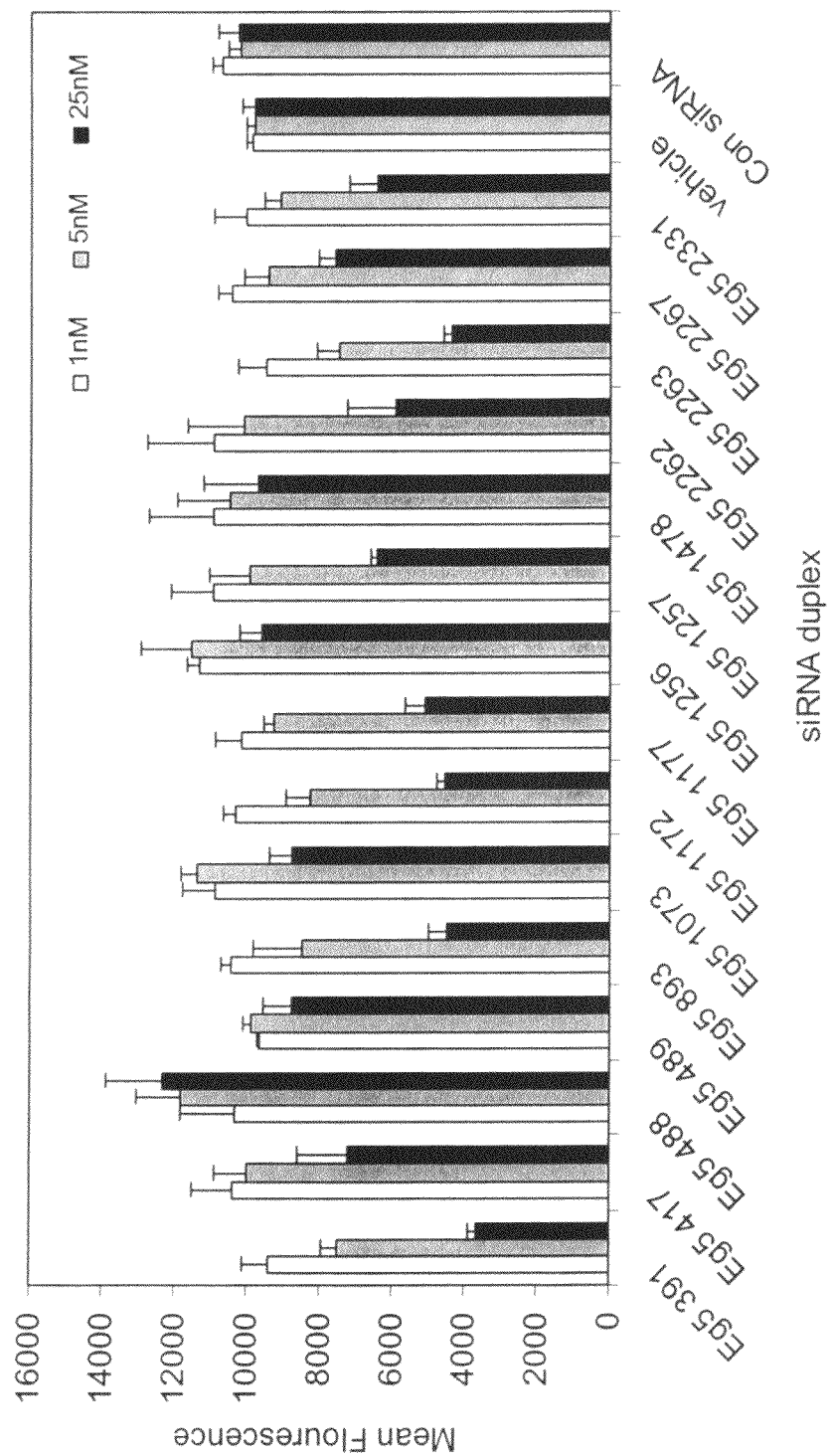
FIG. 1 illustrates data demonstrating RNAi activity of a Eg5 siRNA panel (at 1, 5, and 25 nM concentration) complexed with lipofectamine in HeLa cells (human).

The invention provides compositions and methods for treating cancer. In particular, the invention provides nucleic acid-lipid particles comprising siRNA molecules that silence genes expressed in cancer including, e.g., growth factors (e.g. epidermal growth factor ("EGF") and insulin growth factor-1 ("IGF-1")), growth factor receptors (e.g., epidermal growth factor receptor ("EGFR") and hepatocyte growth factor receptor (i.e. c-Met)), mitotic spindle proteins (e.g., kinesins such as kinesin family member 11 ("Eg5" or "KIF11"), anti-apoptotic molecules (e.g., caspase inhibitors such as XIAP and CrmA, survivin, bcl-2), cell cycle proteins (e.g., cyclin E and aurora kinase), angiogenic factors (e.g., vascular endothelial growth factor ("VEGF") and vascular endothelial growth factor receptor ("VEGFR")); oncogenes (e.g., src, fyn, ras and myc), intracellular signal transducers (e.g., mammalian target of rapamycin ("mTOR"), MAP kinase kinases ("MEK") and nuclear factor kappa-B ("NFkB")), and molecular chaperones (e.g., HSP90). The lipid portion of the nucleic acid-lipid particles comprise a cationic lipid, a non-cationic lipid, optionally a lipid that prevents aggregation of particles. It is a discovery of the invention that the nucleic acid-lipid particles described herein are particularly effective for encapsulating and delivering siRNA molecules that target cancer cells.

This invention is based in part on the discovery that silencing Eg5, EGFR and/or XIAP gene expression is an effective means to halt proliferation of rapidly dividing cells, e.g., cancer cells. Accordingly, the present invention also provides nucleic acid-lipid particles that target Eg5, EGFR and/or XIAP gene expression comprising an siRNA that silences Eg5, EGFR and/or XIAP gene expression; a cationic lipid; a non-cationic lipid; and a conjugated lipid that inhibits aggregation of particles. The invention further provides methods of silencing Eg5, EGFR or XIAP gene expression by administering the nucleic acid-lipid particles described herein to a mammalian subject. In addition, the invention provides methods of treating a subject who suffers from a cell proliferative disorder, e.g., cancer, by administering the nucleic acid-lipid particles described herein.

II. Definitions

The term "Eg5" refers to the kif11 gene product, a member in a class of kinesin-related proteins that are involved in functions related to movements of organelles, microtubules, or chromosomes along microtubules. These functions include axonal transport, microtubule sliding during nuclear fusion or division, and chromosome disjunction during meiosis and early mitosis. Eg5 appears to play a critical role in mitosis of mammalian cells. Sequences for Eg5 are set forth in, e.g., Genbank Accession Nos. NM_004523 (human) and NM_010615 (mouse).

The term "EGFR" refers to the cell surface receptor, epidermal growth factor receptor, also known as ERBB1, that is a member of the ERBB tyrosine kinase family. EGF has 3 regions: one projects outside the cell and contains the site for binding epidermal growth factor (EGF) and related growth factors; the second is embedded in the membrane; the third projects into the cytoplasm of the cell's interior. EGFR is a phosphotyrosinekinase. Binding of EGFR by EGF has a profound effect on the differentiation of specific cells in vivo and is a potent mitogenic factor for a variety of cultured cells of both ectodermal and mesodermal origin. Sequences for the EGF gene are set forth in Genbank Accession Nos. NM_005228 (human) and NM_207655 (mouse).

The term "XIAP" or "X-linked inhibitor of apoptosis" is a potent member of the inhibitor of apoptosis (IAP) family. All members of this family possess baculoviral IAP (BIR) repeats, cysteine-rich domains of approximately 80 amino acids that bind and inhibit caspases. XIAP has 3 BIR domains and a C-terminal RING zinc finger that possesses E3 ubiquitin ligase activity. The anticaspase activity of XIAP and is important in mediating apoptosis resistance in cancer cells. Sequences for XIAP are set forth in Genbank Accession Nos. NM_001167 (human) and NM_009688 (mouse).

The term "interfering RNA" or "RNAi" or "interfering RNA sequence" refers to double-stranded RNA (i.e., duplex RNA) that targets (i.e., silences, reduces, or inhibits) expression of a target gene (i.e., by mediating the degradation of mRNAs which are complementary to the sequence of the interfering RNA) when the interfering RNA is in the same cell as the target gene. Interfering RNA thus refers to the double stranded RNA formed by two complementary strands or by a single, self-complementary strand. Interfering RNA typically has substantial or complete identity to the target gene. The sequence of the interfering RNA can correspond to the full length target gene, or a subsequence thereof. Interfering RNA includes small-interfering RNA" or "siRNA," i.e., interfering RNA of about 15-60, 15-50, 15-50, or 15-40 (duplex) nucleotides in length, more typically about, 15-30, 15-25 or 19-25 (duplex) nucleotides in length, and is preferably about 20-24 or about 21-22 or 21-23 (duplex) nucleotides in length (e.g., each complementary sequence of the double stranded siRNA is 15-60, 15-50, 15-50, 15-40, 15-30, 15-25 or 19-25 nucleotides in length, preferably about 20-24 or about 21-22 or 21-23 nucleotides in length, and the double stranded siRNA is about 15-60, 15-50, 15-50, 15-40, 15-30, 15-25 or 19-25 preferably about 20-24 or about 21-22 or 21-23 base pairs in length). siRNA duplexes may comprise 3' overhangs of about 1 to about 4 nucleotides, preferably of about 2 to about 3 nucleotides and 5' phosphate termini. The siRNA can be chemically synthesized or maybe encoded by a plasmid (e.g., transcribed as sequences that automatically fold into duplexes with hairpin loops). siRNA can also be generated by cleavage of longer dsRNA (e.g., dsRNA greater than about 25 nucleotides in length) with the *E. coli* RNase III or Dicer. These enzymes process the dsRNA into biologically active siRNA (see, e.g., Yang et al., *PNAS USA* 99: 9942-7 (2002); Calegari et al., *PNAS USA* 99: 14236 (2002); Byrom et al., *Ambion TechNotes* 10(1): 4-6 (2003); Kawasaki et al., *Nucleic Acids Res.* 31: 981-7 (2003); Knight and Bass, *Science* 293: 2269-71 (2001); and Robertson et al., *J. Biol. Chem.* 243: 82 (1968)). Preferably, dsRNA are at least 50 nucleotides to about 100, 200, 300, 400 or 500 nucleotides in length. A dsRNA may be as long as 1000, 1500, 2000, 5000 nucleotides in length, or longer. The dsRNA can encode for an entire gene transcript or a partial gene transcript.

"Substantial identity" refers to a sequence that hybridizes to a reference sequence under stringent conditions, or to a sequence that has a specified percent identity over a specified region of a reference sequence.

The phrase "stringent hybridization conditions" refers to conditions under which a probe will hybridize to its target subsequence, typically in a complex mixture of nucleic acids, but to no other sequences. Stringent conditions are sequence-dependent and will be different in different circumstances. Longer sequences hybridize specifically at higher temperatures. An extensive guide to the hybridization of nucleic acids is found in Tijssen, *Techniques in Biochemistry and Molecular Biology—Hybridization with Nucleic Probes*, "Overview of principles of hybridization and the strategy of nucleic acid assays" (1993). Generally, stringent conditions are selected to be about 5-10° C. lower than the thermal melting point ($T_m$) for the specific sequence at a defined ionic strength pH. The $T_m$ is the temperature (under defined ionic strength, pH, and nucleic concentration) at which 50% of the probes complementary to the target hybridize to the target sequence at equilibrium (as the target sequences are present in excess, at $T_m$, 50% of the probes are occupied at equilibrium). Stringent conditions may also be achieved with the addition of destabilizing agents such as formamide. For selective or specific hybridization, a positive signal is at least two times background, preferably 10 times background hybridization.

Exemplary stringent hybridization conditions can be as following: 50% formamide, 5×SSC, and 1% SDS, incubating at 42° C., or, 5×SSC, 1% SDS, incubating at 65° C., with wash in 0.2×SSC, and 0.1% SDS at 65° C. For PCR, a temperature of about 36° C. is typical for low stringency amplification, although annealing temperatures may vary between about 32° C. and 48° C. depending on primer length. For high stringency PCR amplification, a temperature of about 62° C. is typical, although high stringency annealing temperatures can range from about 50° C. to about 65° C., depending on the primer length and specificity. Typical cycle conditions for both high and low stringency amplifications include a denaturation phase of 90° C.-95° C. for 30 sec-2 min., an annealing phase lasting 30 sec.-2 min., and an extension phase of about 72° C. for 1-2 min. Protocols and guidelines for low and high stringency amplification reactions are provided, e.g., in Innis et al. (1990) *PCR Protocols, A Guide to Methods and Applications*, Academic Press, Inc. N.Y.).

Nucleic acids that do not hybridize to each other under stringent conditions are still substantially identical if the polypeptides which they encode are substantially identical. This occurs, for example, when a copy of a nucleic acid is created using the maximum codon degeneracy permitted by the genetic code. In such cases, the nucleic acids typically hybridize under moderately stringent hybridization conditions. Exemplary "moderately stringent hybridization conditions" include a hybridization in a buffer of 40% formamide, 1 M NaCl, 1% SDS at 37° C., and a wash in 1×SSC at 45° C. A positive hybridization is at least twice background. Those of ordinary skill will readily recognize that alternative hybridization and wash conditions can be utilized to provide conditions of similar stringency. Additional guidelines for determining hybridization parameters are provided in numerous reference, e.g., and Current Protocols in Molecular Biology, ed. Ausubel, et al.

The terms "substantially identical" or "substantial identity," in the context of two or more nucleic acids, refer to two or more sequences or subsequences that are the same or have a specified percentage of nucleotides that are the same (i.e., at least about 60%, preferably 65%, 70%, 75%, preferably 80%, 85%, 90%, or 95% identity over a specified region), when compared and aligned for maximum correspondence over a comparison window, or designated region as measured using one of the following sequence comparison algorithms or by manual alignment and visual inspection. This definition, when the context indicates, also refers analogously to the complement of a sequence. Preferably, the substantial identity exists over a region that is at least about 5, 10, 15, 20, 25, 30, 35, 40, 45, 50, 75, or 100 nucleotides in length.

For sequence comparison, typically one sequence acts as a reference sequence, to which test sequences are compared. When using a sequence comparison algorithm, test and reference sequences are entered into a computer, subsequence coordinates are designated, if necessary, and sequence algorithm program parameters are designated. Default program parameters can be used, or alternative parameters can be designated. The sequence comparison algorithm then calculates the percent sequence identities for the test sequences relative to the reference sequence, based on the program parameters.

A "comparison window", as used herein, includes reference to a segment of any one of the number of contiguous positions selected from the group consisting of from 20 to 600, usually about 50 to about 200, more usually about 100 to about 150 in which a sequence may be compared to a reference sequence of the same number of contiguous positions after the two sequences are optimally aligned. Methods of alignment of sequences for comparison are well-known in the art. Optimal alignment of sequences for comparison can be conducted, e.g., by the local homology algorithm of Smith & Waterman, *Adv. Appl. Math.* 2:482 (1981), by the homology alignment algorithm of Needleman & Wunsch, *J. Mol. Biol.* 48:443 (1970), by the search for similarity method of Pearson & Lipman, *Proc. Nat'l. Acad. Sci. USA* 85:2444 (1988), by computerized implementations of these algorithms (GAP, BESTFIT, FASTA, and TFASTA in the Wisconsin Genetics Software Package, Genetics Computer Group, 575 Science Dr., Madison, Wis.), or by manual alignment and visual inspection (see, e.g., *Current Protocols in Molecular Biology* (Ausubel et al., eds. 1995 supplement)).

A preferred example of algorithm that is suitable for determining percent sequence identity and sequence similarity are the BLAST and BLAST 2.0 algorithms, which are described in Altschul et al., *Nuc. Acids Res.* 25:3389-3402 (1977) and Altschul et al., *J. Mol. Biol.* 215:403-410 (1990), respectively. BLAST and BLAST 2.0 are used, with the parameters described herein, to determine percent sequence identity for the nucleic acids and proteins of the invention. Software for performing BLAST analyses is publicly available through the National Center for Biotechnology Information. This algorithm involves first identifying high scoring sequence pairs (HSPs) by identifying short words of length W in the query sequence, which either match or satisfy some positive-valued threshold score T when aligned with a word of the same length in a database sequence. T is referred to as the neighborhood word score threshold (Altschul et al., supra). These initial neighborhood word hits act as seeds for initiating searches to find longer HSPs containing them. The word hits are extended in both directions along each sequence for as far as the cumulative alignment score can be increased. Cumulative scores are calculated using, for nucleotide sequences, the parameters M (reward score for a pair of matching residues; always >0) and N (penalty score for mismatching residues; always <0). For amino acid sequences, a scoring matrix is used to calculate the cumulative score. Extension of the word hits in each direction are halted when: the cumulative alignment score falls off by the quantity X from its maximum achieved value; the cumulative score goes to zero or below, due to the accumulation of one or more negative-scoring residue alignments; or the end of either sequence is reached. The BLAST algorithm parameters W, T, and X determine the sensitivity and speed of the alignment. The BLASTN program (for nucleotide sequences) uses as defaults a wordlength (W) of 11, an expectation (E) or 10, M=5, N=−4 and a comparison of both strands. For amino acid sequences, the BLASTP program uses as defaults a wordlength of 3, and expectation (E) of 10, and the BLOSUM62 scoring matrix (see Henikoff & Henikoff, *Proc. Natl. Acad. Sci. USA* 89:10915 (1989)) alignments (B) of 50, expectation (E) of 10, M=5, N=−4, and a comparison of both strands.

The BLAST algorithm also performs a statistical analysis of the similarity between two sequences (see, e.g., Karlin & Altschul, *Proc. Nat'l. Acad. Sci. USA* 90:5873-5787 (1993)). One measure of similarity provided by the BLAST algorithm is the smallest sum probability (P(N)), which provides an indication of the probability by which a match between two nucleotide or amino acid sequences would occur by chance. For example, a nucleic acid is considered similar to a reference sequence if the smallest sum probability in a comparison of the test nucleic acid to the reference nucleic acid is less than about 0.2, more preferably less than about 0.01, and most preferably less than about 0.001.

The phrase "inhibiting expression of a target gene" refers to the ability of a siRNA of the invention to silence, reduce, or inhibit expression of a target gene (e.g., an Eg5, EGFR or XIAP gene). To examine the extent of gene silencing, a test sample (e.g., a biological sample from organism of interest expressing the target gene or a sample of cells in culture expressing the target gene) is contacted with an siRNA that silences, reduces, or inhibits expression of the target gene. Expression of the target gene in the test sample is compared to expression of the target gene in a control sample (e.g., a biological sample from organism of interest expressing the target gene or a sample of cells in culture expressing the target gene) that is not contacted with the siRNA. Control samples (i.e., samples expressing the target gene) are assigned a value of 100%. Silencing, inhibition, or reduction of expression of a target gene is achieved when the value of the test sample relative to the control sample is about 95%, 90%, 85%, 80%, 75%, 70%, 65%, 60%, 55%, 50%, 45%, 40%, 35%, 30%, 25%, 20%, or 10%. Suitable assays include, e.g., examination of protein or mRNA levels using techniques known to those of skill in the art such as dot blots, northern blots, in situ hybridization, ELISA, immunoprecipitation, enzyme function, as well as phenotypic assays known to those of skill in the art.

"Nucleic acid" refers to deoxyribonucleotides or ribonucleotides and polymers thereof in single- or double-stranded form. The term encompasses nucleic acids containing known nucleotide analogs or modified backbone residues or linkages, which are synthetic, naturally occurring, and non-naturally occurring, which have similar binding properties as the reference nucleic acid, and which are metabolized in a manner similar to the reference nucleotides. Examples of such analogs include, without limitation, phosphorothioates, phosphoramidates, methyl phosphonates, chiral-methyl phosphonates, 2-O-methyl ribonucleotides, peptide-nucleic acids (PNAs).

An "effective amount" or "therapeutically effective amount" of a siRNA is an amount sufficient to produce the desired effect, e.g., a decrease in the expression of a target sequence in comparison to the normal expression level detected in the absence of the siRNA.

The term "lipid" refers to a group of organic compounds that include, but are not limited to, esters of fatty acids and are characterized by being insoluble in water, but soluble in many organic solvents. They are usually divided into at least three classes: (1) "simple lipids' which include fats and oils as well as waxes; (2) "compound lipids" which include phospholipids and glycolipids; (3) "derived lipids" such as steroids.

"Lipid vesicle" refers to any lipid composition that can be used to deliver a compound including, but not limited to, liposomes, wherein an aqueous volume is encapsulated by an amphipathic lipid bilayer; or wherein the lipids coat an interior comprising a large molecular component, such as a plasmid comprising an interfering RNA sequence, with a reduced aqueous interior; or lipid aggregates or micelles, wherein the encapsulated component is contained within a relatively disordered lipid mixture.

As used herein, "lipid encapsulated" can refer to a lipid formulation that provides a compound with full encapsulation, partial encapsulation, or both. In some embodiments, the nucleic acid is fully encapsulated in the lipid formulation (e.g., to form an SPLP, pSPLP, SNALP, or other nucleic acid-lipid particle).

As used herein, the term "cell proliferative disorder" includes disorders involving the undesired proliferation of a cell. Non-limiting examples of such disorders include neoplasias (i.e., cancer), hyperplasias, restenosis, cardiac hypertrophy, immune disorders and inflammation.

The nucleic acid-lipid particles of the present invention typically have a mean diameter of less than about 150 nm and are substantially nontoxic. In addition, the nucleic acids when present in the nucleic acid-lipid particles of the present invention are resistant in aqueous solution to degradation with a nuclease. Nucleic acid-lipid particles and their method of preparation are disclosed in U.S. Pat. No. 5,976,567, U.S. Pat. No. 5,981,501 and PCT Patent Publication No. WO 96/40964.

Various suitable cationic lipids may be used in the present invention, either alone or in combination with one or more other cationic lipid species or non-cationic lipid species.

The cationic lipids of Formula I and Formula II described herein typically carry a net positive charge at a selected pH, such as physiological pH. It has been surprisingly found that cationic lipids comprising alkyl chains with multiple sites of unsaturation, e.g., at least two or three sites of unsaturation, are particularly useful for forming lipid-nucleic acid particles with increased membrane fluidity. A number of cationic lipids and related analogs, which are also useful in the present invention, have been described in U.S. Pat. Nos. 5,208,036, 5,264,618, 5,279,833 and 5,283,185, and WO 96/10390, the disclosures of which are incorporated herein by reference.

The noncationic lipids used in the present invention can be any of a variety of neutral uncharged, zwitterionic or anionic lipids capable of producing a stable complex. They are preferably neutral, although they can alternatively be negatively charged. Examples of noncationic lipids useful in the present invention include: phospholipid-related materials, such as lecithin, phosphatidylethanolamine, lysolecithin, lysophosphatidylethanolamine, phosphatidylserine, phosphatidylinositol, sphingomyelin, cephalin, cardiolipin, phosphatidic acid, cerebrosides, dicetylphosphate, distearoylphosphatidylcholine (DSPC), dioleoylphosphatidylcholine (DOPC), dipalmitoylphosphatidylcholine (DPPC), dioleoylphosphatidylglycerol (DOPG), dipalmitoylphosphatidylglycerol (DPPG), dioleoyl-phosphatidylethanolamine (DOPE), palmitoyloleoylphosphatidylcholine (POPC), palmitoyloleoyl-phosphatidylethanolamine (POPE) and dioleoyl-phosphatidylethanolamine 4-(N-maleimidomethyl)-cyclohexane-1-carboxylate (DOPE-mal). Noncationic lipids or sterols such as cholesterol may be present. Additional nonphosphorous containing lipids are, e.g., stearylamine, dodecylamine, hexadecylamine, acetyl palmitate, glycerolricinoleate, hexadecyl stereate, isopropyl myristate, amphoteric acrylic polymers, triethanolamine-lauryl sulfate, alkyl-aryl sulfate polyethyloxylated fatty acid amides, dioctadecyldimethyl ammonium bromide and the like, diacylphosphatidylcholine, diacylphosphatidylethanolamine, ceramide, sphingomyelin, cephalin, and cerebrosides. Other lipids such as lysophosphatidylcholine and lysophosphatidylethanolamine may be present. Noncationic lipids also include polyethylene glycol-based polymers such as PEG 2000, PEG 5000 and polyethylene glycol conjugated to phospholipids or to ceramides (referred to as PEG-Cer).

In preferred embodiments, the noncationic lipids are diacylphosphatidylcholine (e.g., distearoylphosphatidylcholine, dioleoylphosphatidylcholine, dipalmitoylphosphatidylcholine and dilinoleoylphosphatidylcholine), diacylphosphatidylethanolamine (e.g. dioleoylphosphatidylethanolamine and palmitoyloleoylphosphatidylethanolamine), ceramide or sphingomyelin. The acyl groups in these lipids are preferably acyl groups derived from fatty acids having $C_{10}$-$C_{24}$ carbon chains. More preferably the acyl groups are lauroyl, myristoyl, palmitoyl, stearoyl or oleoyl. In particularly preferred embodiments, the noncationic lipid will be cholesterol, 1,2-sn-dioleoylphosphatidylethanolamine, or egg sphingomyelin (ESM).

In addition to cationic and non-cationic lipids, the nucleic acid-lipid particles (e.g., SPLPs and SNALPs of the present invention comprise bilayer stabilizing component (BSC) such as an ATTA-lipid or a PEG-lipid, such as PEG coupled to dialkyloxypropyls (PEG-DAA) (see, copending U.S. Patent Application No. 60/503,239), PEG coupled to diacylglycerol (PEG-DAG) (see, copending U.S. patent application Ser. No. 10/136,707), PEG coupled to phosphatidylethanolamine (PE) (PEG-PE), or PEG conjugated to ceramides, or a mixture thereof (see, U.S. Pat. No. 5,885,613, which is incorporated herein by reference). In one preferred embodiment, the BSC is a conjugated lipid that inhibits aggregation of the nucleic acid-lipid particles. Suitable conjugated lipids include, but are not limited to PEG-lipid conjugates, ATTA-lipid conjugates, cationic-polymer-lipid conjugates (CPLs) or mixtures thereof. In one preferred embodiment, the nucleic acid-lipid particles comprise either a PEG-lipid conjugate or an ATTA-lipid conjugate together with a CPL.

PEG is a polyethylene glycol, a linear, water-soluble polymer of ethylene PEG repeating units with two terminal hydroxyl groups. PEGs are classified by their molecular weights; for example, PEG 2000 has an average molecular weight of about 2,000 daltons, and PEG 5000 has an average molecular weight of about 5,000 daltons. PEGs are commercially available from Sigma Chemical Co. and other companies and include, for example, the following: monomethoxypolyethylene glycol (MePEG-OH), monomethoxypolyethylene glycol-succinate (MePEG-S), monomethoxypolyethylene glycol-succinimidyl succinate (MePEG-S-NHS), monomethoxypolyethylene glycol-amine (MePEG-NH$_2$), monomethoxypolyethylene glycol-tresylate (MePEG-TRES), and monomethoxypolyethylene glycol-imidazolyl-carbonyl (MePEG-IM). In addition, monomethoxypolyethyleneglycol-acetic acid (MePEG-CH$_2$COOH), is particularly useful for preparing the PEG-lipid conjugates including, e.g., PEG-DAA conjugates.

In some embodiments, the PEG has an average molecular weight of from about 1000 to about 5000 daltons, more preferably, from about 1,000 to about 3,000 daltons and, even more preferably, of about 2,000 daltons. The PEG can be optionally substituted by an alkyl, alkoxy, acyl or aryl group. PEG can be conjugated directly to the lipid or may be linked to the lipid via a linker moiety. Any linker moiety suitable for coupling the PEG to a lipid can be used including, e.g., non-ester containing linker moieties and ester-containing linker moieties.

As used herein, the term "non-ester containing linker moiety" refers to a linker moiety that does not contain a carboxylic ester bond (—OC(O)—). Suitable non-ester containing linker moieties include, but are not limited to, amido (—C(O) NH—), amino (—NR—), carbonyl (—C(O)—), carbamate (—NHC(O)O—), urea (—NHC(O)NH—), disulphide (—S—S—), ether (—O—), succinyl (—(O)CCH$_2$CH$_2$C(O)—), succinamidyl (—NHC(O)CH$_2$CH$_2$C(O)NH—), ether, disulphide, etc. as well as combinations thereof (such as a linker containing both a carbamate linker moiety and an amido linker moiety). In some embodiments, a carbamate linker is used to couple the PEG to the lipid.

In other embodiments, an ester containing linker moiety is used to couple the PEG to the lipid. Suitable ester containing linker moieties include, e.g., carbonate (—OC(O)O—), succinoyl, phosphate esters (—O—(O)POH—O—), sulfonate esters, and combinations thereof.

As used herein, the term "SNALP" refers to a stable nucleic acid-lipid particle, including SPLP. A SNALP represents a vesicle of lipids coating a reduced aqueous interior comprising a nucleic acid (e.g., ssDNA, dsDNA, ssRNA, dsRNA, siRNA, or a plasmid, including plasmids from which an interfering RNA is transcribed). As used herein, the term "SPLP" refers to a nucleic acid-lipid particle comprising a nucleic acid (e.g., a plasmid) encapsulated within a lipid vesicle. SNALPs and SPLPs typically contain a cationic lipid, a noncationic lipid, and a lipid that prevents aggregation of the particle (e.g., a PEG-lipid conjugate). SNALPs and SPLPs have systemic application as they exhibit extended circulation lifetimes following intravenous (i.v.) injection, accumulate at distal sites (e.g., sites physically separated from the administration site) and can mediate gene silencing or gene expression of a transfected nucleic acid at these distal sites. SPLPs include "pSPLP" which comprise an encapsulated condensing agent-nucleic acid complex as set forth in WO 00/03683.

The term "vesicle-forming lipid" is intended to include any amphipathic lipid having a hydrophobic moiety and a polar head group, and which by itself can form spontaneously into bilayer vesicles in water, as exemplified by most phospholipids.

The term "vesicle-adopting lipid" is intended to include any amphipathic lipid that is stably incorporated into lipid bilayers in combination with other amphipathic lipids, with its hydrophobic moiety in contact with the interior, hydrophobic region of the bilayer membrane, and its polar head group moiety oriented toward the exterior, polar surface of the membrane. Vesicle-adopting lipids include lipids that on their own tend to adopt a nonlamellar phase, yet which are capable of assuming a bilayer structure in the presence of a bilayer-stabilizing component. A typical example is DOPE (dioleoylphosphatidylethanolamine). Bilayer stabilizing components include, but are not limited to, conjugated lipids that inhibit aggregation of the SNALPs, polyamide oligomers (e.g., ATTA-lipid derivatives), peptides, proteins, detergents, lipid-derivatives, PEG-lipid derivatives such as PEG coupled to dialkyloxypropyls, PEG coupled to diacylglycerols, PEG coupled to phosphatidyl-ethanolamines, and PEG conjugated to ceramides (see, U.S. Pat. No. 5,885,613, which is incorporated herein by reference).

The term "amphipathic lipid" refers, in part, to any suitable material wherein the hydrophobic portion of the lipid material orients into a hydrophobic phase, while the hydrophilic portion orients toward the aqueous phase. Amphipathic lipids are usually the major component of a lipid vesicle. Hydrophilic characteristics derive from the presence of polar or charged groups such as carbohydrates, phosphate, carboxylic, sulfato, amino, sulfhydryl, nitro, hydroxy and other like groups. Hydrophobicity can be conferred by the inclusion of apolar groups that include, but are not limited to, long chain saturated and unsaturated aliphatic hydrocarbon groups and such groups substituted by one or more aromatic, cycloaliphatic or heterocyclic group(s). Examples of amphipathic compounds include, but are not limited to, phospholipids, aminolipids and sphingolipids. Representative examples of phospholipids include, but are not limited to, phosphatidylcholine, phosphatidylethanolamine, phosphatidylserine, phosphatidylinositol, phosphatidic acid, palmitoyloleoyl phosphatidylcholine, lysophosphatidylcholine, lysophosphatidylethanolamine, dipalmitoylphosphatidylcholine, dioleoylphosphatidylcholine, distearoylphosphatidylcholine or dilinoleoylphosphatidylcholine. Other compounds lacking in phosphorus, such as sphingolipid, glycosphingolipid families, diacylglycerols and .beta.-acyloxyacids, are also within the group designated as amphipathic lipids. Additionally, the amphipathic lipid described above can be mixed with other lipids including triglycerides and sterols.

The term "neutral lipid" refers to any of a number of lipid species that exist either in an uncharged or neutral zwitterionic form at a selected pH. At physiological pH, such lipids include, for example, diacylphosphatidylcholine, diacylphosphatidylethanolamine, ceramide, sphingomyelin, cephalin, cholesterol, cerebrosides and diacylglycerols.

The term "noncationic lipid" refers to any neutral lipid as described above as well as anionic lipids.

The term "anionic lipid" refers to any lipid that is negatively charged at physiological pH. These lipids include, but are not limited to, phosphatidylglycerol, cardiolipin, diacylphosphatidylserine, diacylphosphatidic acid, N-dodecanoyl phosphatidylethanolamines, N-succinyl phosphatidylethanolamines, N-glutarylphosphatidylethanolamines, lysylphosphatidylglycerols, palmitoyloleyolphosphatidylglycerol (POPG), and other anionic modifying groups joined to neutral lipids.

The term "cationic lipid" refers to any of a number of lipid species that carry a net positive charge at a selected pH, such as physiological pH (e.g., pH of about 7.0). As used herein, physiological pH refers to the pH of a biological fluid such as blood or lymph as well as the pH of a cellular compartment such as an endosome, an acidic endosome, or a lysosome). Such lipids include, but are not limited to, N,N-dioleyl-N,N-dimethylammonium chloride ("DODAC"); N-(2,3-dioleyloxy)propyl)-N,N,N-trimethylammonium chloride ("DOTMA"); N,N-distearyl-N,N-dimethylammonium bromide ("DDAB"); N-(2,3-dioleoyloxy)propyl)-N,N,N-trimethylammonium chloride ("DOTAP"); 3-(N—(N',N'-dimethylaminoethane)-carbamoyl)cholesterol ("DC-Chol"); N-(1,2-dimyristyloxyprop-3-yl)-N,N-dimethyl-N-hydroxyethyl ammonium bromide ("DMRIE"); 1,2-DiLinoleyloxy-N,N-dimethylaminopropane (DLinDMA); and 1,2-Dilinolenyloxy-N,N-dimethylaminopropane (DLenDMA). The following lipids are cationic and have a positive charge at below physiological pH or at physiological pH: DODAP, DODMA, DLinDMA and the like.

The term "hydrophobic lipid" refers to compounds having apolar groups that include, but are not limited to, long chain saturated and unsaturated aliphatic hydrocarbon groups and such groups optionally substituted by one or more aromatic, cycloaliphatic or heterocyclic group(s). Suitable examples include, but are not limited to, diacylglycerol, dialkylglycerol, N-N-dialkylamino, 1,2-diacyloxy-3-aminopropane and 1,2-dialkyl-3-aminopropane.

The term "fusogenic" refers to the ability of a liposome, an SNALP or other drug delivery system to fuse with membranes of a cell. The membranes can be either the plasma membrane or membranes surrounding organelles, e.g., endosome, nucleus, etc.

The term "diacylglycerol" refers to a compound having 2-fatty acyl chains, R$^1$ and R$^2$, both of which have independdently between 2 and 30 carbons bonded to the 1- and 2-position of glycerol by ester linkages. The acyl groups can be saturated or have varying degrees of unsaturation. Diacylglycerols have the following general formula:

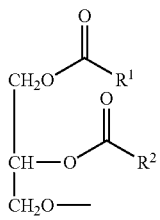
(III)

The term "dialkyloxypropyl" refers to a compound having 2-alkyl chains, $R^1$ and $R^2$, both of which have independently between 2 and 30 carbons. The alkyl groups can be saturated or have varying degrees of unsaturation. Dialkyloxypropyls have the following general formula:

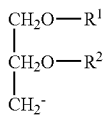
(IV)

The term "ATTA" or "polyamide" refers to, but is not limited to, compounds disclosed in U.S. Pat. Nos. 6,320,017 and 6,586,559, both of which are incorporated herein by reference. These compounds include a compound having the formula

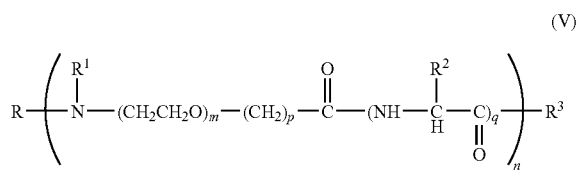
(V)

wherein: R is a member selected from the group consisting of hydrogen, alkyl and acyl; $R^1$ is a member selected from the group consisting of hydrogen and alkyl; or optionally, R and $R^1$ and the nitrogen to which they are bound form an azido moiety; $R^2$ is a member of the group selected from hydrogen, optionally substituted alkyl, optionally substituted aryl and a side chain of an amino acid; $R^3$ is a member selected from the group consisting of hydrogen, halogen, hydroxy, alkoxy, mercapto, hydrazino, amino and $NR^4R^5$, wherein $R^4$ and $R^5$ are independently hydrogen or alkyl; n is 4 to 80; m is 2 to 6; p is 1 to 4; and q is 0 or 1. It will be apparent to those of skill in the art that other polyamides can be used in the compounds of the present invention.

The term "nucleic acid" or "polynucleotide" refers to a polymer containing at least two ribonucleotides (e.g. deoxy or ribo) in either single- or double-stranded form. Unless specifically limited, the terms encompasses nucleic acids containing known analogues of natural nucleotides that have similar binding properties as the reference nucleic acid and are metabolized in a manner similar to naturally occurring nucleotides. Unless otherwise indicated, a particular nucleic acid sequence also implicitly encompasses conservatively modified variants thereof (e.g., degenerate codon substitutions), alleles, orthologs, SNPs, and complementary sequences as well as the sequence explicitly indicated. Specifically, degenerate codon substitutions may be achieved by generating sequences in which the third position of one or more selected (or all) codons is substituted with mixed-base and/or deoxyinosine residues (Batzer et al., *Nucleic Acid Res.* 19:5081 (1991); Ohtsuka et al., *J. Biol. Chem.* 260:2605-2608 (1985); and Cassol et al. (1992); Rossolini et al., *Mol. Cell. Probes* 8:91-98 (1994)). "Nucleotides" contain a sugar deoxyribose (DNA) or ribose (RNA), a base, and a phosphate group. Nucleotides are linked together through the phosphate groups. "Bases" include purines and pyrimidines, which further include natural compounds adenine, thymine, guanine, cytosine, uracil, inosine, and natural analogs, and synthetic derivatives of purines and pyrimidines, which include, but are not limited to, modifications which place new reactive groups such as, but not limited to, amines, alcohols, thiols, carboxylates, and alkylhalides. DNA may be in the form of antisense, plasmid DNA, parts of a plasmid DNA, pre-condensed DNA, product of a polymerase chain reaction (PCR), vectors (P1, PAC, BAC, YAC, artificial chromosomes), expression cassettes, chimeric sequences, chromosomal DNA, or derivatives of these groups. The term nucleic acid is used interchangeably with gene, cDNA, mRNA encoded by a gene, and an interfering RNA molecule.

The term "gene" refers to a nucleic acid (e.g., DNA or RNA) sequence that comprises partial length or entire length coding sequences necessary for the production of a polypeptide or precursor (e.g., Eg5, EGFR or XIAP).

"Gene product," as used herein, refers to a product of a gene such as an RNA transcript.

As used herein, the term "aqueous solution" refers to a composition comprising in whole, or in part, water.

As used herein, the term "organic lipid solution" refers to a composition comprising in whole, or in part, an organic solvent having a lipid.

"Distal site," as used herein, refers to a physically separated site, which is not limited to an adjacent capillary bed, but includes sites broadly distributed throughout an organism.

"Serum-stable" in relation to nucleic acid-lipid particles means that the particle is not significantly degraded after exposure to a serum or nuclease assay that would significantly degrade free DNA. Suitable assays include, for example, a standard serum assay or a DNAse assay such as those described in the Examples below.

"Fully encapsulated" in relation to nucleic acid-lipid particles means that the nucleic acid portion of the particle is serum stable and is not accessible to a fluorescent dye (e.g., such as RiboGreen™). In contrast to a nucleic acid that forms a complex with the lipid vehicle (e.g., a liposome or multilammelar vesicle), a nucleic acid fully encapsulated in the lipid portion of a particle does not fluoresce in the presence of a fluorescent dye.

"Systemic delivery," as used herein, refers to delivery that leads to a broad biodistribution of a compound within an organism. Some techniques of administration can lead to the systemic delivery of certain compounds, but not others. Systemic delivery means that a useful, preferably therapeutic, amount of a compound is exposed to most parts of the body. To obtain broad biodistribution generally requires a blood lifetime such that the compound is not rapidly degraded or cleared (such as by first pass organs (liver, lung, etc.) or by rapid, nonspecific cell binding) before reaching a disease site distal to the site of administration. Systemic delivery of nucleic acid-lipid particles can be by any means known in the art including, for example, intravenous, subcutaneous, intraperitoneal, In some embodiments, systemic delivery of nucleic acid-lipid particles is by intravenous delivery.

"Local delivery" as used herein refers to delivery of a compound directly to a target site within an organism. For example, a compound can be locally delivered by direct injection into a disease site such as a tumor or other target site such as a site of inflammation or a target organ such as the liver, heart, pancreas, kidney, and the like.

III. Carrier Systems Containing siRNA

In one aspect, the present invention provides carrier systems containing the siRNA molecules described herein. In some embodiments, the carrier system is a lipid-based carrier system such as a stabilized nucleic acid-lipid particle (e.g., SNALP or SPLP), cationic lipid or liposome nucleic acid complexes (i.e., lipoplexes), a liposome, a micelle, a virosome, or a mixture thereof. In other embodiments, the carrier system is a polymer-based carrier system such as a cationic polymer-nucleic acid complex (i.e., polyplex). In additional embodiments, the carrier system is a cyclodextrin-based carrier system such as a cyclodextrin polymer-nucleic acid complex. In further embodiments, the carrier system is a protein-based carrier system such as a cationic peptide-nucleic acid complex. Preferably, the carrier system is a stabilized nucleic acid-lipid particle such as a SNALP or SPLP. One skilled in the art will appreciate that the siRNA molecules of the present invention can also be delivered as naked siRNA.

IV. Stable Nucleic Acid-Lipid Particles (SNALPs) and Properties Thereof

The stable nucleic acid-lipid particles or, alternatively, SNALPs typically comprise an siRNA molecule that targets expression of a gene expressed in cancer (e.g., an Eg5, EGFR or XIAP gene), a cationic lipid (e.g., a cationic lipid of Formula I or II), a noncationic lipid and a bilayer stabilizing component (i.e., a conjugated lipid that inhibits aggregation of the SNALPs) The nucleic acid-lipid particles may comprise at least 1, 2, 3, 4, 5, or more of the sequences set forth in Tables 1-9.

The SNALPs of the present invention typically have a mean diameter of about 50 nm to about 150 nm, more typically about 60 nm to about 130 nm, more typically about 70 nm to about 110 nm, most typically about 70 to about 90 nm and are substantially nontoxic. In addition, the nucleic acids present in the SNALPs of the present invention are resistant in aqueous solution to degradation with a nuclease.

In one embodiment, the present invention provides stabilized nucleic acid-lipid particles (SPLPs or SNALPs) and other lipid-based carrier systems (e.g., a liposome, a micelle, a virosome, a lipid-nucleic acid particle, a nucleic acid complex and mixtures thereof) containing cationic lipids. The lipid-nucleic acid particles of the present invention typically comprise a nucleic acid, a cationic lipid, a non-cationic lipid and a PEG-lipid conjugate. The cationic lipid typically comprises from about 2 mol % to about 60 mol %, from about 5 mol % to about 50 mol %, from about 10 mol % to about 45 mol %, from about 20 mol % to about 40 mol %, or from about 30 mol % to about 40 mol % of the total lipid present in said particle. The non-cationic lipid typically comprises from about 5 mol % to about 90 mol %, from about 10 mol % to about 85 mol %, from about 20 mol % to about 80 mol %, from about 30 mol % to about 70 mol %, from about 40 mol % to about 60 mol % or about 48 mol % of the total lipid present in said particle. The PEG-lipid conjugate typically comprises from about 0.5 mol % to about 20 mol %, from about 1.5 mol % to about 18 mol %, from about 4 mol % to about 15 mol %, from about 5 mol % to about 12 mol %, or about 2 mol % of the total lipid present in said particle. The nucleic acid-lipid particles of the present invention may further comprise cholesterol. If present, the cholesterol typically comprises from about 0 mol % to about 10 mol %, about 2 mol % to about 10 mol %, about 10 mol % to about 60 mol %, from about 12 mol % to about 58 mol %, from about 20 mol % to about 55 mol %, or about 48 mol % of the total lipid present in said particle. It will be readily apparent to one of skill in the art that the proportions of the components of the nucleic acid-lipid particles may be varied. In a specific formulation, the total lipid in the nucleic acid-lipid particle comprises 48 mol % cholesterol; 10 mol % DSPC; 2 mol % PEG-cDMA; and 40 mol % DLinDMA of the total lipid present in said particle.

A. Cationic Lipids

Various suitable cationic lipids may be used in the present invention, either alone or in combination with one or more other cationic lipid species or neutral lipid species.

Suitable cationic lipids include, for example, DLinDMA, DLenDMA, DODAC, DOTMA, DDAB, DOTAP, DOSPA, DOGS, DC-Chol and DMRIE, or combinations thereof. A number of these lipids and related analogs, which are also useful in the present invention, have been described in U.S. Pat. Nos. 5,208,036, 5,264,618, 5,279,833, 5,283,185, 5,753, 613 and 5,785,992. Additionally, a number of commercial preparations of cationic lipids are available and can be used in the present invention. These include, for example, LIPOFECTIN® (commercially available cationic liposomes comprising DOTMA and DOPE, from GIBCO/BRL, Grand Island, N.Y., USA); LIPOFECTAMINE® (commercially available cationic liposomes comprising DOSPA and DOPE, from GIBCO/BRL); and TRANSFECTAM® (commercially available cationic liposomes comprising DOGS from Promega Corp., Madison, Wis., USA). In addition, cationic lipids of Formula I and Formula II can be used in the present invention. Cationic lipids of Formula I and II have the following structures:

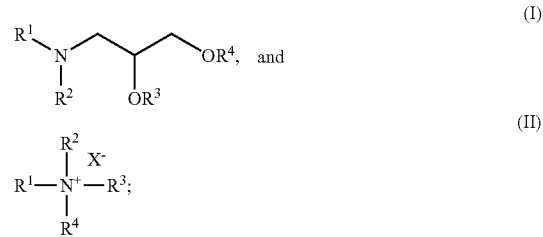

wherein $R^1$ and $R^2$ are independently selected and are H or $C_1$-$C_3$ alkyls. $R^3$ and $R^4$ are independently selected and are alkyl groups having from about 10 to about 20 carbon atoms; at least one of $R^3$ and $R^4$ comprises at least two sites of unsaturation. In one embodiment, $R^3$ and $R^4$ are both the same, i.e., $R^3$ and $R^4$ are both linoleyl (C18), etc. In another embodiment, $R^3$ and $R^4$ are different, i.e., $R^3$ is myristyl (C14) and $R^4$ is linoleyl (C18). In some embodiments, the cationic lipids of the present invention are symmetrical, i.e., $R^3$ and $R^4$ are both the same. In another preferred embodiment, both $R^3$ and $R^4$ comprise at least two sites of unsaturation. In some embodiments, $R^3$ and $R^4$ are independently selected from dodecadienyl, tetradecadienyl, hexadecadienyl, linoleyl, and icosadienyl. In some embodiments, $R^3$ and $R^4$ are both linoleyl. In some embodiments, $R^3$ and $R^4$ comprise at least three sites of unsaturation and are independently selected from, e.g., dodecatrienyl, tetradectrienyl, hexadecatrienyl, linolenyl, and icosatrienyl.

The cationic lipids of Formula I and Formula II described herein typically carry a net positive charge at a selected pH, such as physiological pH. It has been surprisingly found that cationic lipids comprising alkyl chains with multiple sites of unsaturation, e.g., at least two or three sites of unsaturation, are particularly useful for forming lipid-nucleic acid particles with increased membrane fluidity. A number of cationic lipids and related analogs, which are also useful in the present invention, have been described in U.S. Pat. Nos. 5,208,036, 5,264,618, 5,279,833 and 5,283,185, and WO 96/10390.

Additional suitable cationic lipids include, e.g., dioctadecyldimethylammonium ("DODMA"), Distearyldimethylammonium ("DSDMA"), N,N-dioleyl-N,N-dimethylammonium chloride ("DODAC"); N-(2,3-dioleyloxy)propyl)-N,N,N-trimethylammonium chloride ("DOTMA"); N,N-distearyl-N,N-dimethylammonium bromide ("DDAB"); N-(2,3-dioleoyloxy)propyl)-N,N,N-trimethylammonium chloride ("DOTAP"); 3-(N—(N',N'-dimethylaminoethane)-carbamoyl)cholesterol ("DC-Chol") and N-(1,2-dimyristyloxyprop-3-yl)-N,N-dimethyl-N-hydroxyethyl ammonium bromide ("DMRIE"). A number of these lipids and related analogs, which are also useful in the present invention, have been described in U.S. Pat. Nos. 5,208,036, 5,264,618, 5,279,833, 5,283,185, 5,753,613 and 5,785,992.

B. Non-Cationic Lipids

The noncationic lipids used in the present invention can be any of a variety of neutral uncharged, zwitterionic or anionic lipids capable of producing a stable complex. They are preferably neutral, although they can alternatively be negatively charged. Examples of noncationic lipids useful in the present invention include: phospholipid-related materials, such as lecithin, phosphatidylethanolamine, lysolecithin, lysophosphatidylethanolamine, phosphatidylserine, phosphatidylinositol, sphingomyelin, cephalin, cardiolipin, phosphatidic acid, cerebrosides, dicetylphosphate, distearoylphosphatidylcholine (DSPC), dioleoylphosphatidylcholine (DOPC), dipalmitoylphosphatidylcholine (DPPC), dioleoylphosphatidylglycerol (DOPG), dipalmitoylphosphatidylglycerol (DPPG), dioleoyl-phosphatidylethanolamine (DOPE), palmitoyloleoylphosphatidylcholine (POPC), palmitoyloleoyl-phosphatidylethanolamine (POPE) and dioleoyl-phosphatidylethanolamine 4-(N-maleimidomethyl)-cyclohexane-1-carboxylate (DOPE-mal), dipalmitoyl phosphatidyl ethanolamine (DPPE), dimyristoylphosphoethanolamine (DMPE), distearoyl-phosphatidyl-ethanolamine (DSPE), 16-O-monomethyl PE, 16-O-dimethyl PE, 18-1-trans PE, 1-stearoyl-2-oleoyl-phosphatidyethanolamine (SOPE), and 1,2-dielaidoyl-sn-glycero-3-phophoethanolamine (trans-DOPE). Noncationic lipids or sterols such as cholesterol may be present. Additional nonphosphorous containing lipids are, e.g., stearylamine, dodecylamine, hexadecylamine, acetyl palmitate, glycerolricinoleate, hexadecyl stereate, isopropyl myristate, amphoteric acrylic polymers, triethanolamine-lauryl sulfate, alkyl-aryl sulfate polyethyloxylated fatty acid amides, dioctadecyldimethyl ammonium bromide and the like, diacylphosphatidylcholine, diacylphosphatidylethanolamine, ceramide, sphingomyelin, cephalin, and cerebrosides. Other lipids such as lysophosphatidylcholine and lysophosphatidylethanolamine may be present. Noncationic lipids also include polyethylene glycol-based polymers such as PEG 2000, PEG 5000 and polyethylene glycol conjugated to phospholipids or to ceramides (referred to as PEG-Cer).

In preferred embodiments, the noncationic lipids are diacylphosphatidylcholine (e.g., distearoylphosphatidylcholine, dioleoylphosphatidylcholine, dipalmitoylphosphatidylcholine and dilinoleoylphosphatidylcholine), diacylphosphatidylethanolamine (e.g., dioleoylphosphatidylethanolamine and palmitoyloleoylphosphatidylethanolamine), ceramide or sphingomyelin. The acyl groups in these lipids are preferably acyl groups derived from fatty acids having $C_{10}$-$C_{24}$ carbon chains. More preferably the acyl groups are lauroyl, myristoyl, palmitoyl, stearoyl or oleoyl. In particularly preferred embodiments, the noncationic lipid will be cholesterol, 1,2-sn-dioleoylphosphatidylethanolamine, or egg sphingomyelin (ESM).

C. Bilayer Stabilizing Component

In addition to cationic and non-cationic lipids, the nucleic acid-lipid particles (e.g., SNALPs and SPLPs) of the present invention comprise bilayer stabilizing component (BSC) such as an ATTA-lipid or a PEG-lipid, such as PEG coupled to dialkyloxypropyls (PEG-DAA) as described in, e.g., WO 05/026372, PEG coupled to diacylglycerol (PEG-DAG) as described in, e.g., U.S. Patent Publication Nos. 20030077829 and 2005008689), PEG coupled to phosphatidylethanolamine (PE) (PEG-PE), or PEG conjugated to ceramides, or a mixture thereof (see, U.S. Pat. No. 5,885,613). In one preferred embodiment, the BSC is a conjugated lipid that inhibits aggregation of the nucleic acid-lipid particles. Suitable conjugated lipids include, but are not limited to PEG-lipid conjugates, ATTA-lipid conjugates, cationic-polymer-lipid conjugates (CPLs) or mixtures thereof. In one preferred embodiment, the nucleic acid-lipid particles comprise either a PEG-lipid conjugate or an ATTA-lipid conjugate together with a CPL.

PEG is a polyethylene glycol, a linear, water-soluble polymer of ethylene PEG repeating units with two terminal hydroxyl groups. PEGs are classified by their molecular weights; for example, PEG 2000 has an average molecular weight of about 2,000 daltons, and PEG 5000 has an average molecular weight of about 5,000 daltons. PEGs are commercially available from Sigma Chemical Co. and other companies and include, for example, the following: monomethoxypolyethylene glycol (MePEG-OH), monomethoxypolyethylene glycol-succinate (MePEG-S), monomethoxypolyethylene glycol-succinimidyl succinate (MePEG-S-NHS), monomethoxypolyethylene glycol-amine (MePEG-NH$_2$), monomethoxypolyethylene glycol-tresylate (MePEG-TRES), and monomethoxypolyethylene glycol-imidazolyl-carbonyl (MePEG-IM). In addition, monomethoxypolyethyleneglycol-acetic acid (MePEG-CH$_2$COOH), is particularly useful for preparing the PEG-lipid conjugates including, e.g., PEG-DAA conjugates.

In some embodiments, the PEG has an average molecular weight of from about 550 daltons to about 10,000 daltons, more preferably of about 750 daltons to about 5,000 daltons, more preferably of about 1,000 daltons to about 5,000 daltons, more preferably of about 1,500 daltons to about 3,000 daltons and, even more preferably, of about 2,000 daltons, or about 750 daltons. The PEG can be optionally substituted by an alkyl, alkoxy, acyl or aryl group. PEG can be conjugated directly to the lipid or may be linked to the lipid via a linker moiety. Any linker moiety suitable for coupling the PEG to a lipid can be used including, e.g., non-ester containing linker moieties and ester-containing linker moieties. In some embodiments, the linker moiety is a non-ester containing linker moiety. As used herein, the term "non-ester containing linker moiety" refers to a linker moiety that does not contain a carboxylic ester bond (—OC(O)—). Suitable non-ester containing linker moieties include, but are not limited to, amido (—C(O)NH—), amino (—NR—), carbonyl (—C(O)—), carbamate (—NHC(O)O—), urea (—NHC(O)NH—), disulphide (—S—S—), ether (—O—), succinyl (—(O)CCH₂CH₂C(O)—), succinamidyl (—NHC(O)CH₂CH₂C(O)NH—), ether, disulphide, etc. as well as combinations thereof (such as a linker containing both a carbamate linker moiety and an amido linker moiety). In some embodiments, a carbamate linker is used to couple the PEG to the lipid.

In other embodiments, an ester containing linker moiety is used to couple the PEG to the lipid. Suitable ester containing linker moieties include, e.g., carbonate (—OC(O)O—), succinoyl, phosphate esters (—O—(O)POH—O—), sulfonate esters, and combinations thereof.

Phosphatidylethanolamines having a variety of acyl chain groups of varying chain lengths and degrees of saturation can be conjugated to polyethyleneglycol to form the bilayer stabilizing component. Such phosphatidylethanolamines are commercially available, or can be isolated or synthesized using conventional techniques known to those of skilled in the art. Phosphatidylethanolamines containing saturated or unsaturated fatty acids with carbon chain lengths in the range of $C_{10}$ to $C_{20}$ are preferred. Phosphatidylethanolamines with mono- or diunsaturated fatty acids and mixtures of saturated and unsaturated fatty acids can also be used. Suitable phosphatidylethanolamines include, but are not limited to, the following: dimyristoylphosphatidylethanolamine (DMPE), dipalmitoylphosphatidylethanolamine (DPPE), dioleoylphosphatidylethanolamine (DOPE) and distearoylphosphatidylethanolamine (DSPE).

In some embodiments, the PEG-lipid is a PEG-DAA conjugate has the following formula:

(VI)

In Formula VI, $R^1$ and $R^2$ are independently selected and are alkyl groups having from about 10 to about 22 carbon atoms. The long-chain alkyl groups can be saturated or unsaturated. Suitable alkyl groups include, but are not limited to, lauryl (C12), myristyl (C14), palmityl (C16), stearyl (C18) and icosyl (C20). In some embodiments, $R^1$ and $R^2$ are the same, i.e., $R^1$ and $R^2$ are both myristyl (i.e., dimyristyl), $R^1$ and $R^2$ are both stearyl (i.e., distearyl), etc. In some embodiments, the alkyl groups are saturated.

In Formula VI above, "PEG" is a polyethylene glycol having an average molecular weight ranging of about 550 daltons to about 10,000 daltons, about 750 daltons to about 5,000 daltons, about 1,000 daltons to about 5,000 daltons, about 1,500 daltons to about 3,000 daltons, about 2,000 daltons, or about 750 daltons. The PEG can be optionally substituted with alkyl, alkoxy, acyl or aryl. In some embodiments, the terminal hydroxyl group is substituted with a methoxy or methyl group.

In Formula VI, above, "L" is a non-ester containing linker moiety or an ester containing linker moiety. In some embodiments, L is a non-ester containing linker moiety. Suitable non-ester containing linkers include, but not limited to, an amido linker moiety, an amino linker moiety, a carbonyl linker moiety, a carbamate linker moiety, a urea linker moiety, an ether linker moiety, a disulphide linker moiety, a succinamidyl linker moiety and combinations thereof. In some embodiments, the non-ester containing linker moiety is a carbamate linker moiety (i.e., a PEG-C-DAA conjugate), an amido linker moiety (i.e., a PEG-A-DAA conjugate), or a succinamidyl linker moiety (i.e., a PEG-S-DAA conjugate).

The PEG-DAA conjugates are synthesized using standard techniques and reagents known to those of skill in the art. It will be recognized that the PEG-DAA conjugates will contain various amide, amine, ether, thio, carbamate and urea linkages. Those of skill in the art will recognize that methods and reagents for forming these bonds are well known and readily available. See, e.g., March, ADVANCED ORGANIC CHEMISTRY (Wiley 1992), Larock, COMPREHENSIVE ORGANIC TRANSFORMATIONS (VCH 1989); and Fumiss, VOGEL'S TEXTBOOK OF PRACTICAL ORGANIC CHEMISTRY 5th ed. (Longman 1989). It will also be appreciated that any functional groups present may require protection and deprotection at different points in the synthesis of the PEG-DAA conjugates. Those of skill in the art will recognize that such techniques are well known. See, e.g., Green and Wuts, PROTECTIVE GROUPS IN ORGANIC SYNTHESIS (Wiley 1991).

In some embodiments, the PEG-DAA conjugate is a dilauryloxypropyl (C12)-PEG conjugate, dimyristyloxypropyl (C14)-PEG conjugate, a dipalmitoyloxypropyl (C16)-PEG conjugate or a disteryloxypropyl (C18)-PEG conjugate. Those of skill in the art will readily appreciate that other dialkyloxypropyls can be used in the PEG-DAA conjugates of the present invention.

In addition to the foregoing, it will be readily apparent to those of skill in the art that other hydrophilic polymers can be used in place of PEG. Examples of suitable polymers that can be used in place of PEG include, but are not limited to, polyvinylpyrrolidone, polymethyloxazoline, polyethyloxazoline, polyhydroxypropyl methacrylamide, polymethacrylamide and polydimethylacrylamide, polylactic acid, polyglycolic acid, and derivatized celluloses, such as hydroxymethylcellulose or hydroxyethylcellulose.

In addition to the foregoing components, the SNALPs and SPLPs of the present invention can further comprise cationic poly(ethylene glycol) (PEG) lipids, or CPLs, that have been designed for insertion into lipid bilayers to impart a positive charge(see, Chen, et al., *Bioconj. Chem.* 11:433-437 (2000)). Suitable SPLPs and SPLP-CPLs for use in the present invention, and methods of making and using SPLPs and SPLP-CPLs, are disclosed, e.g., in U.S. Pat. No. 6,852,334 and WO 00/62813. Cationic polymer lipids (CPLs) useful in the present invention have the following architectural features: (1) a lipid anchor, such as a hydrophobic lipid, for incorporating the CPLs into the lipid bilayer; (2) a hydrophilic spacer, such as a polyethylene glycol, for linking the lipid anchor to a cationic head group; and (3) a polycationic moiety, such as a naturally occurring amino acid, to produce a protonizable cationic head group.

Suitable CPL include compounds of Formula VII:

(VII)

wherein A, W and Y are as described below.

With reference to Formula VII, "A" is a lipid moiety such as an amphipathic lipid, a neutral lipid or a hydrophobic lipid that acts as a lipid anchor. Suitable lipid examples include vesicle-forming lipids or vesicle adopting lipids and include, but are not limited to, diacylglycerolyls, dialkylglycerolyls, N-N-dialkylaminos, 1,2-diacyloxy-3-aminopropanes and 1,2-dialkyl-3-aminopropanes.

"W" is a polymer or an oligomer, such as a hydrophilic polymer or oligomer. Typically, the hydrophilic polymer is a biocompatable polymer that is nonimmunogenic or possesses low inherent immunogenicity. Alternatively, the hydrophilic polymer can be weakly antigenic if used with appropriate adjuvants. Suitable nonimmunogenic polymers include, but are not limited to, PEG, polyamides, polylactic acid, polyglycolic acid, polylactic acid/polyglycolic acid copolymers and combinations thereof. In some embodiments, the polymer has a molecular weight of about 250 to about 7000 daltons.

"Y" is a polycationic moiety. The term polycationic moiety refers to a compound, derivative, or functional group having a positive charge, typically at least 2 positive charges at a selected pH, typically physiological pH. Suitable polycationic moieties include basic amino acids and their derivatives such as arginine, asparagine, glutamine, lysine and histidine; spermine; spermidine; cationic dendrimers; polyamines; polyamine sugars; and amino polysaccharides. The polycationic moieties can be linear, such as linear tetralysine, branched or dendrimeric in structure. Polycationic moieties have between about 2 to about 15 positive charges, between about 2 to about 12 positive charges, or between about 2 to about 8 positive charges at selected pH values. The selection of which polycationic moiety to employ may be determined by the type of liposome application which is desired.

The charges on the polycationic moieties can be either distributed around the entire liposome moiety, or alternatively, they can be a discrete concentration of charge density in one particular area of the liposome moiety e.g., a charge spike. If the charge density is distributed on the liposome, the charge density can be equally distributed or unequally distributed. All variations of charge distribution of the polycationic moiety are encompassed by the present invention.

The lipid "A," and the nonimmunogenic polymer "W," can be attached by various methods and preferably, by covalent attachment. Methods known to those of skill in the art can be used for the covalent attachment of "A" and "W." Suitable linkages include, but are not limited to, amide, amine, carboxyl, carbonate, carbamate, ester and hydrazone linkages. It will be apparent to those skilled in the art that "A" and "W" must have complementary functional groups to effectuate the linkage. The reaction of these two groups, one on the lipid and the other on the polymer, will provide the desired linkage. For example, when the lipid is a diacylglycerol and the terminal hydroxyl is activated, for instance with NHS and DCC, to form an active ester, and is then reacted with a polymer which contains an amino group, such as with a polyamide (see, U.S. Pat. Nos. 6,320,017 and 6,586,559), an amide bond will form between the two groups.

In certain instances, the polycationic moiety can have a ligand attached, such as a targeting ligand or a chelating moiety for complexing calcium. Preferably, after the ligand is attached, the cationic moiety maintains a positive charge. In certain instances, the ligand that is attached has a positive charge. Suitable ligands include, but are not limited to, a compound or device with a reactive functional group and include lipids, amphipathic lipids, carrier compounds, bioaffinity compounds, biomaterials, biopolymers, biomedical devices, analytically detectable compounds, therapeutically active compounds, enzymes, peptides, proteins, antibodies, immune stimulators, radiolabels, fluorogens, biotin, drugs, haptens, DNA, RNA, polysaccharides, liposomes, virosomes, micelles, immunoglobulins, functional groups, other targeting moieties, or toxins.

D. Nucleic Acid Component

The nucleic acid component of the present invention comprises an interfering RNA that silences (e.g., partially or completely inhibits) expression of a gene of interest (e.g., an Eg5, EGFR and/or XIAP gene). An interfering RNA can be provided in several forms. For example an interfering RNA can be provided as one or more isolated small-interfering RNA (siRNA) duplexes, longer double-stranded RNA (dsRNA) or as siRNA or dsRNA transcribed from a transcriptional cassette in a DNA plasmid. The interfering RNA can be administered alone or in combination with the administration of conventional agents used to treat the disease or disorder associated with the gene of interest including, e.g., cancer. Genes of interest include, but are not limited to, genes associated with viral infection and survival, genes associated with liver and kidney diseases and disorders, genes associated with tumorigenesis and cell transformation, angiogenic genes, immunomodulator genes, such as those associated with inflammatory and autoimmune responses, ligand receptor genes, and genes associated with neurodegenerative disorders.

E. siRNAs

The siRNAs of the invention are capable of silencing expression of a target sequence such as, e.g., Eg5, EGFR or XIAP mRNA. Suitable siRNA sequences are set forth in, e.g., Tables 1-2 and 7 for Eg5; Tables 3-4 and 9 for EGFR; or Tables 5-6 and 9 for XIAP. For any of the sequences set forth in the Tables above, thymines (i.e., T) can substituted with uracil ("U") and uracil can be substituted with ("T"). In some embodiments, the siRNA are about 15 to 30 nucleotides in length.

1. Selecting siRNA Sequences

Suitable siRNA sequences can be identified using any means known in the art. Typically, the methods described in Elbashir et al., *Nature,* 411:494-498 (2001) and Elbashir et al., *EMBO J,* 20:6877-6888 (2001) are combined with rational design rules set forth in Reynolds et al., *Nature Biotech.,* 22:326-330 (2004).

Generally, the nucleotide sequence 3' of the AUG start codon of a transcript from the target gene of interest is scanned for dinucleotide sequences (e.g., AA, NA, CC, GG, or UU, wherein N=C, G, or U) (see, e.g., Elbashir et al., *EMBO J,* 20:6877-6888 (2001)). The nucleotides immediately 3' to the dinucleotide sequences are identified as potential siRNA sequences (i.e., a target sequence or a sense strand sequence). Typically, the 19, 21, 23, 25, 27, 29, 31, 33, 35, or more nucleotides immediately 3' to the dinucleotide sequences are identified as potential siRNA sequences. In some embodiments, the dinucleotide sequence is an AA or NA sequence and the 19 nucleotides immediately 3' to the AA or NA dinucleotide are identified as a potential siRNA sequences. siRNA sequences are usually spaced at different positions along the length of the target gene. To further enhance silencing efficiency of the siRNA sequences, potential siRNA sequences may be analyzed to identify sites that do not contain regions of homology to other coding sequences, e.g., in the target cell or organism. For example, a suitable siRNA sequence of about 21 base pairs typically will not have more than 16-17 contiguous base pairs of homology to coding sequences in the target cell or organism. If the siRNA sequences are to be expressed from an RNA Pol III promoter, siRNA sequences lacking more than 4 contiguous A's or T's are selected.

Once a potential siRNA sequence has been identified, the sequence can be analyzed using a variety of criteria known in the art. For example, to enhance their silencing efficiency, the siRNA sequences may be analyzed by a rational design algorithm to identify sequences that have one or more of the following features: (1) G/C content of about 25% to about 60% G/C; (2) at least 3 A/Us at positions 15-19 of the sense strand; (3) no internal repeats; (4) an A at position 19 of the sense strand; (5) an A at position 3 of the sense strand; (6) a U at position 10 of the sense strand; (7) no G/C at position 19 of the sense strand; and (8) no G at position 13 of the sense strand. siRNA design tools that incorporate algorithms that assign suitable values of each of these features are useful for selection of siRNA. One of skill in the art will appreciate that sequences with one or more of the foregoing characteristics may be selected for further analysis and testing as potential siRNA sequences.

Additionally, potential siRNA target sequences with one or more of the following criteria can often be eliminated as siRNA: (1) sequences comprising a stretch of 4 or more of the same base in a row; (2) sequences comprising homopolymers of Gs (i.e., to reduce possible non-specific effects due to structural characteristics of these polymers; (3) sequences comprising triple base motifs (e.g., GGG, CCC, AAA, or TTT); (4) sequences comprising stretches of 7 or more G/Cs in a row; and (5) sequences comprising direct repeats of 4 or more bases within the candidates resulting in internal foldback structures. However, one of skill in the art will appreciate that sequences with one or more of the foregoing characteristics may still be selected for further analysis and testing as potential siRNA sequences.

In some embodiments, potential siRNA target sequences may be further analyzed based on siRNA duplex asymmetry as described in, e.g., Khvorova et al., *Cell*, 115:209-216 (2003); and Schwarz et al., *Cell*, 115:199-208 (2003). In other embodiments, potential siRNA target sequences may be further analyzed based on secondary structure at the mRNA target site as described in, e.g., Luo et al., *Biophys. Res. Commun.*, 318:303-310 (2004). For example, mRNA secondary structure can be modeled using the Mfold algorithm to select siRNA sequences which favor accessibility at the mRNA target site where less secondary structure in the form of base-pairing and stem-loops is present.

Once a potential siRNA sequence has been identified, the sequence can be analyzed for the presence of any immunostimulatory properties, e.g., using an in vitro cytokine assay or an in vivo animal model. Motifs in the sense and/or antisense strand of the siRNA sequence such as GU-rich motifs (e.g., 5'-GU-3',5'-UGU-3',5'-GUGU-3',5'-UGUGU-3', etc.) can also provide an indication of whether the sequence may be immunostimulatory. Once an siRNA molecule is found to be immunostimulatory, it can then be modified to decrease its immunostimulatory properties as described herein. As a non-limiting example, an siRNA sequence can be contacted with a mammalian responder cell under conditions such that the cell produces a detectable immune response to determine whether the siRNA is an immunostimulatory or a non-immunostimulatory siRNA. The mammalian responder cell may be from a naïve mammal (i.e., a mammal that has not previously been in contact with the siRNA sequence). The mammalian responder cell may be, e.g., a peripheral blood mononuclear cell (PBMC), a macrophage, and the like. The detectable immune response may comprise production of a cytokine or growth factor such as, e.g., TNF-α, IFN-α, IFN-β, IFN-γ, IL-6, IL-12, or a combination thereof. An siRNA molecule identified as being immunostimulatory can then be modified to decrease its immunostimulatory properties by replacing at least one of the nucleotides on the sense and/or antisense strand with modified nucleotides. For example, less than about 30% (e.g., less than about 30%, 25%, 20%, 15%, 10%, or 5%) of the nucleotides in the double-stranded region of the siRNA duplex can be replaced with modified nucleotides such as 2'OMe nucleotides. The modified siRNA can then be contacted with a mammalian responder cell as described above to confirm that its immunostimulatory properties have been reduced or abrogated.

Suitable in vitro assays for detecting an immune response include, but are not limited to, the double monoclonal antibody sandwich immunoassay technique of David et al. (U.S. Pat. No. 4,376,110); monoclonal-polyclonal antibody sandwich assays (Wide et al., in Kirkham and Hunter, eds., *Radioimmunoassay Methods*, E. and S. Livingstone, Edinburgh (1970)); the "Western blot" method of Gordon et al. (U.S. Pat. No. 4,452,901); immunoprecipitation of labeled ligand (Brown et al., *J. Biol. Chem.*, 255:4980-4983 (1980)); enzyme-linked immunosorbent assays (ELISA) as described, for example, by Raines et al., *J. Biol. Chem.*, 257:5154-5160 (1982); immunocytochemical techniques, including the use of fluorochromes (Brooks et al., *Clin. Exp. Immunol.*, 39:477 (1980)); and neutralization of activity (Bowen-Pope et al., *Proc. Natl. Acad. Sci. USA*, 81:2396-2400 (1984)). In addition to the immunoassays described above, a number of other immunoassays are available, including those described in U.S. Pat. Nos. 3,817,827; 3,850,752; 3,901,654; 3,935,074; 3,984,533; 3,996,345; 4,034,074; and 4,098,876.

A non-limiting example of an in vivo model for detecting an immune response includes an in vivo mouse cytokine induction assay that can be performed as follows: (1) siRNA can be administered by standard intravenous injection in the lateral tail vein; (2) blood can be collected by cardiac puncture about 6 hours after administration and processed as plasma for cytokine analysis; and (3) cytokines can be quantified using sandwich ELISA kits according to the manufacturer's instructions (e.g., mouse and human IFN-α (PBL Biomedical; Piscataway, N.J.); human IL-6 and TNF-α (eBioscience; San Diego, Calif.); and mouse IL-6, TNF-α, and IFN-γ (BD Biosciences; San Diego, Calif.)).

Monoclonal antibodies that specifically bind cytokines and growth factors are commercially available from multiple sources and can be generated using methods known in the art (see, e.g., Kohler and Milstein, *Nature*, 256: 495-497 (1975); and Harlow and Lane, ANTIBODIES, A LABORATORY MANUAL, Cold Spring Harbor Publication, New York (1999)). Generation of monoclonal antibodies has been previously described and can be accomplished by any means known in the art (see, e.g., Buhring et al. in Hybridoma, Vol. 10, No. 1, pp. 77-78 (1991)). In some methods, the monoclonal antibody is labeled (e.g., with any composition detectable by spectroscopic, photochemical, biochemical, electrical, optical, chemical means, and the like) to facilitate detection.

F. Generating siRNA Molecules siRNA molecules can be provided in several forms including, e.g., as one or more isolated small-interfering RNA (siRNA) duplexes, as longer double-stranded RNA (dsRNA), or as siRNA or dsRNA transcribed from a transcriptional cassette in a DNA plasmid. The siRNA sequences may have overhangs (e.g., 3' or 5' overhangs as described in Elbashir et al., *Genes Dev.*, 15:188 (2001) or Nykänen et al., *Cell*, 107: 309 (2001)), or may lack overhangs (i.e., have blunt ends).

An RNA population can be used to provide long precursor RNAs, or long precursor RNAs that have substantial or complete identity to a selected target sequence can be used to make the siRNA. The RNAs can be isolated from cells or tissue, synthesized, and/or cloned according to methods well known to those of skill in the art. The RNA can be a mixed population (obtained from cells or tissue, transcribed from cDNA, subtracted, selected, etc.), or can represent a single target sequence. RNA can be naturally occurring (e.g., isolated from tissue or cell samples), synthesized in vitro (e.g., using T7 or SP6 polymerase and PCR products or a cloned cDNA), or chemically synthesized.

To form a long dsRNA, for synthetic RNAs, the complement is also transcribed in vitro and hybridized to form a dsRNA. If a naturally occurring RNA population is used, the RNA complements are also provided (e.g., to form dsRNA for digestion by *E. coli* RNAse III or Dicer), e.g., by transcribing cDNAs corresponding to the RNA population, or by using RNA polymerases. The precursor RNAs are then hybridized to form double stranded RNAs for digestion. The dsRNAs can be directly administered to a subject or can be digested in vitro prior to administration.

Alternatively, one or more DNA plasmids encoding one or more siRNA templates are used to provide siRNA. siRNA can be transcribed as sequences that automatically fold into duplexes with hairpin loops from DNA templates in plasmids having RNA polymerase III transcriptional units, for example, based on the naturally occurring transcription units for small nuclear RNA U6 or human RNase P RNA H1 (see, Brummelkamp et al., *Science*, 296:550 (2002); Donzé et al., *Nucleic Acids Res.*, 30:e46 (2002); Paddison et al., *Genes Dev.*, 16:948 (2002); Yu et al., *Proc. Natl. Acad. Sci. USA*, 99:6047 (2002); Lee et al., *Nat. Biotech.*, 20:500 (2002); Miyagishi et al., *Nat. Biotech.*, 20:497 (2002); Paul et al., *Nat. Biotech.*, 20:505 (2002); and Sui et al., *Proc. Natl. Acad. Sci. USA*, 99:5515 (2002)). Typically, a transcriptional unit or cassette will contain an RNA transcript promoter sequence, such as an H1-RNA or a U6 promoter, operably linked to a template for transcription of a desired siRNA sequence and a termination sequence, comprised of 2-3 uridine residues and a polythymidine (T5) sequence (polyadenylation signal) (Brummelkamp et al., supra). The selected promoter can provide for constitutive or inducible transcription. Compositions and methods for DNA-directed transcription of RNA interference molecules is described in detail in U.S. Pat. No. 6,573,099. The transcriptional unit is incorporated into a plasmid or DNA vector from which the interfering RNA is transcribed. Plasmids suitable for in vivo delivery of genetic material for therapeutic purposes are described in detail in U.S. Pat. Nos. 5,962,428 and 5,910,488. The selected plasmid can provide for transient or stable delivery of a target cell. It will be apparent to those of skill in the art that plasmids originally designed to express desired gene sequences can be modified to contain a transcriptional unit cassette for transcription of siRNA.

Methods for isolating RNA, synthesizing RNA, hybridizing nucleic acids, making and screening cDNA libraries, and performing PCR are well known in the art (see, e.g., Gubler and Hoffman, *Gene* 25:263-269 (1983); Sambrook et al., supra; Ausubel et al., supra), as are PCR methods (see, U.S. Pat. Nos. 4,683,195 and 4,683,202; *PCR Protocols: A Guide to Methods and Applications* (Innis et al., eds, 1990)). Expression libraries are also well known to those of skill in the art. Additional basic texts disclosing the general methods of use in this invention include Sambrook et al., *Molecular Cloning, A Laboratory Manual* (2nd ed. 1989); Kriegler, *Gene Transfer and Expression: A Laboratory Manual* (1990); and *Current Protocols in Molecular Biology* (Ausubel et al., eds., 1994).

Preferably, siRNA molecules are chemically synthesized. The single-stranded molecules that comprise the siRNA molecule can be synthesized using any of a variety of techniques known in the art, such as those described in Usman et al., *J. Am. Chem. Soc.*, 109:7845 (1987); Scaringe et al., *Nuc. Acids Res.*, 18:5433 (1990); Wincott et al., *Nucl. Acids Res.*, 23:2677-2684 (1995); and Wincott et al., *Methods Mol. Bio.*, 74:59 (1997). The synthesis of the single-stranded molecules makes use of common nucleic acid protecting and coupling groups, such as dimethoxytrityl at the 5'-end and phosphoramidites at the 3'-end. As a non-limiting example, small scale syntheses can be conducted on an Applied Biosystems synthesizer using a 0.2 µmol scale protocol with a 2.5 min coupling step for 2'-O-methylated nucleotides. Alternatively, syntheses at the 0.2 µmol scale can be performed on a 96-well plate synthesizer from Protogene (Palo Alto, Calif.). However, a larger or smaller scale of synthesis is also within the scope of the present invention. Suitable reagents for synthesis of the siRNA single-stranded molecules, methods for RNA deprotection, and methods for RNA purification are known to those of skill in the art.

The siRNA molecules can also be synthesized via a tandem synthesis technique, wherein both strands are synthesized as a single continuous fragment or strand separated by a cleavable linker that is subsequently cleaved to provide separate fragments or strands that hybridize to form the siRNA duplex. The linker can be a polynucleotide linker or a non-nucleotide linker. The tandem synthesis of siRNA can be readily adapted to both multiwell/multiplate synthesis platforms as well as large scale synthesis platforms employing batch reactors, synthesis columns, and the like. Alternatively, the siRNA molecules can be assembled from two distinct single-stranded molecules, wherein one strand comprises the sense strand and the other comprises the antisense strand of the siRNA. For example, each strand can be synthesized separately and joined together by hybridization or ligation following synthesis and/or deprotection. In certain other instances, the siRNA molecules can be synthesized as a single continuous fragment, where the self-complementary sense and antisense regions hybridize to form an siRNA duplex having hairpin secondary structure.

C. Modifying siRNA Sequences

In certain aspects, the siRNA molecules of the present invention comprise a duplex having two strands and at least one modified nucleotide in the double-stranded region, wherein each strand is about 15 to about 60 nucleotides in length. Advantageously, the modified siRNA is less immunostimulatory than a corresponding unmodified siRNA sequence, but retains the capability of silencing the expression of a target sequence.

Examples of modified nucleotides suitable for use in the present invention include, but are not limited to, ribonucleotides having a 2'-O-methyl (2'OMe), 2'-deoxy-2'-fluoro (2° F.), 2'-deoxy, 5-C-methyl, 2'-O-(2-methoxyethyl) (MOE), 4'-thio, 2'-amino, or 2'-C-allyl group. Modified nucleotides having a Northern conformation such as those described in, e.g., Saenger, *Principles of Nucleic Acid Structure*, Springer-Verlag Ed. (1984), are also suitable for use in the siRNA molecules of the present invention. Such modified nucleotides include, without limitation, locked nucleic acid (LNA) nucleotides (e.g., 2'-O, 4'-C-methylene-(D-ribofuranosyl) nucleotides), 2'-O-(2-methoxyethyl) (MOE) nucleotides, 2'-methyl-thio-ethyl nucleotides, 2'-deoxy-2'-fluoro (2° F.) nucleotides, 2'-deoxy-2'-chloro (2'Cl) nucleotides, and 2'-azido nucleotides. In certain instances, the siRNA molecules of the present invention include one or more G-clamp nucleotides. A G-clamp nucleotide refers to a modified cytosine analog wherein the modifications confer the ability to hydrogen bond both Watson-Crick and Hoogsteen faces of a complementary guanine nucleotide within a duplex (see, e.g., Lin et al., *J. Am. Chem. Soc.*, 120:8531-8532 (1998)). In addition, nucleotides having a nucleotide base analog such as, for example, C-phenyl, C-naphthyl, other aromatic derivatives, inosine, azole carboxamides, and nitroazole derivatives such as 3-nitropyrrole, 4-nitroindole, 5-nitroindole, and 6-nitroindole (see, e.g., Loakes, *Nucl. Acids Res.,* 29:2437-2447 (2001)) can be incorporated into the siRNA molecules of the present invention.

In certain embodiments, the siRNA molecules of the present invention further comprise one or more chemical modifications such as terminal cap moieties, phosphate backbone modifications, and the like. Examples of terminal cap moieties include, without limitation, inverted deoxy abasic residues, glyceryl modifications, 4',5'-methylene nucleotides, 1-(β-D-erythrofuranosyl) nucleotides, 4'-thio nucleotides, carbocyclic nucleotides, 1,5-anhydrohexitol nucleotides, L-nucleotides, α-nucleotides, modified base nucleotides, threo-pentofuranosyl nucleotides, acyclic 3',4'-seco nucleotides, acyclic 3,4-dihydroxybutyl nucleotides, acyclic 3,5-dihydroxypentyl nucleotides, 3'-3'-inverted nucleotide moieties, 3'-3'-inverted abasic moieties, 3'-2'-inverted nucleotide moieties, 3'-2'-inverted abasic moieties, 5'-5'-inverted nucleotide moieties, 5'-5'-inverted abasic moieties, 3'-5'-inverted deoxy abasic moieties, 5'-amino-alkyl phosphate, 1,3-diamino-2-propyl phosphate, 3-aminopropyl phosphate, 6-aminohexyl phosphate, 1,2-aminododecyl phosphate, hydroxypropyl phosphate, 1,4-butanediol phosphate, 3'-phosphoramidate, 5'-phosphoramidate, hexylphosphate, aminohexyl phosphate, 3'-phosphate, 5'-amino, 3'-phosphorothioate, 5'-phosphorothioate, phosphorodithioate, and bridging or non-bridging methylphosphonate or 5'-mercapto moieties (see, e.g., U.S. Pat. No. 5,998,203; Beaucage et al., *Tetrahedron* 49:1925 (1993)). Non-limiting examples of phosphate backbone modifications (i.e., resulting in modified internucleotide linkages) include phosphorothioate, phosphorodithioate, methylphosphonate, phosphotriester, morpholino, amidate, carbamate, carboxymethyl, acetamidate, polyamide, sulfonate, sulfonamide, sulfamate, formacetal, thioformacetal, and alkylsilyl substitutions (see, e.g., Hunziker et al., *Nucleic Acid Analogues: Synthesis and Properties, in Modern Synthetic Methods,* VCH, 331-417 (1995); Mesmaeker et al., *Novel Backbone Replacements for Oligonucleotides, in Carbohydrate Modifications in Antisense Research,* ACS, 24-39 (1994)). Such chemical modifications can occur at the 5'-end and/or 3'-end of the sense strand, antisense strand, or both strands of the siRNA.

In some embodiments, the sense and/or antisense strand can further comprise a 3'-terminal overhang having about 1 to about 4 (e.g., 1, 2, 3, or 4) 2'-deoxy ribonucleotides and/or any combination of modified and unmodified nucleotides. Additional examples of modified nucleotides and types of chemical modifications that can be introduced into the modified siRNA molecules of the present invention are described, e.g., in UK Patent No. GB 2,397,818 B and U.S. Patent Publication Nos. 20040192626 and 20050282188.

The siRNA molecules of the present invention can optionally comprise one or more non-nucleotides in one or both strands of the siRNA. As used herein, the term "non-nucleotide" refers to any group or compound that can be incorporated into a nucleic acid chain in the place of one or more nucleotide units, including sugar and/or phosphate substitutions, and allows the remaining bases to exhibit their activity. The group or compound is abasic in that it does not contain a commonly recognized nucleotide base such as adenosine, guanine, cytosine, uracil, or thymine and therefore lacks a base at the 1'-position.

In other embodiments, chemical modification of the siRNA comprises attaching a conjugate to the siRNA molecule. The conjugate can be attached at the 5'- and/or 3'-end of the sense and/or antisense strand of the siRNA via a covalent attachment such as, e.g., a biodegradable linker. The conjugate can also be attached to the siRNA, e.g., through a carbamate group or other linking group (see, e.g., U.S. Patent Publication Nos. 20050074771, 20050043219, and 20050158727). In certain instances, the conjugate is a molecule that facilitates the delivery of the siRNA into a cell. Examples of conjugate molecules suitable for attachment to the siRNA of the present invention include, without limitation, steroids such as cholesterol, glycols such as polyethylene glycol (PEG), human serum albumin (HSA), fatty acids, carotenoids, terpenes, bile acids, folates (e.g., folic acid, folate analogs and derivatives thereof), sugars (e.g., galactose, galactosamine, N-acetyl galactosamine, glucose, mannose, fructose, fucose, etc.), phospholipids, peptides, ligands for cellular receptors capable of mediating cellular uptake, and combinations thereof (see, e.g., U.S. Patent Publication Nos. 20030130186, 20040110296, and 20040249178; U.S. Pat. No. 6,753,423). Other examples include the lipophilic moiety, vitamin, polymer, peptide, protein, nucleic acid, small molecule, oligosaccharide, carbohydrate cluster, intercalator, minor groove binder, cleaving agent, and cross-linking agent conjugate molecules described in U.S. Patent Publication Nos. 20050119470 and 20050107325. Yet other examples include the 2'-O-alkyl amine, 2'-O-alkoxyalkyl amine, polyamine, C5-cationic modified pyrimidine, cationic peptide, guanidinium group, amidininium group, cationic amino acid conjugate molecules described in U.S. Patent Publication No. 20050153337. Additional examples include the hydrophobic group, membrane active compound, cell penetrating compound, cell targeting signal, interaction modifier, and steric stabilizer conjugate molecules described in U.S. Patent Publication No. 20040167090. Further examples include the conjugate molecules described in U.S. Patent Publication No. 20050239739. The type of conjugate used and the extent of conjugation to the siRNA molecule can be evaluated for improved pharmacokinetic profiles, bioavailability, and/or stability of the siRNA while retaining RNAi activity. As such, one skilled in the art can screen siRNA molecules having various conjugates attached thereto to identify ones having improved properties and RNAi activity using any of a variety of well-known in vitro cell culture or in vivo animal models.

V. Additional Carrier Systems

Non-limiting examples of additional lipid-based carrier systems suitable for use in the present invention include lipoplexes (see, e.g., U.S. Patent Publication No. 20030203865; and Zhang et al., *J. Control Release,* 100:165-180 (2004)), pH-sensitive lipoplexes (see, e.g., U.S. Patent Publication No. 20020192275), reversibly masked lipoplexes (see, e.g., U.S. Patent Publication Nos. 20030180950), cationic lipid-based compositions (see, e.g., U.S. Pat. No. 6,756,054; and U.S. Patent Publication No. 20050234232), cationic liposomes (see, e.g., U.S. Patent Publication Nos. 20030229040, 20020160038, and 20020012998; U.S. Pat. No. 5,908,635; and PCT Publication No. WO 01/72283), anionic liposomes (see, e.g., U.S. Patent Publication No. 20030026831), pH-sensitive liposomes (see, e.g., U.S. Patent Publication No. 20020192274; and AU 2003210303), antibody-coated liposomes (see, e.g., U.S. Patent Publication No. 20030108597; and PCT Publication No. WO 00/50008), cell-type specific liposomes (see, e.g., U.S. Patent Publication No. 20030198664), liposomes containing nucleic acid and peptides (see, e.g., U.S. Pat. No. 6,207,456), liposomes containing lipids derivatized with releasable hydrophilic polymers (see, e.g., U.S. Patent Publication No. 20030031704), lipid-entrapped nucleic acid (see, e.g., PCT Publication Nos. WO 03/057190 and WO 03/059322), lipid-encapsulated nucleic acid (see, e.g., U.S. Patent Publication No. 20030129221; and U.S. Pat. No. 5,756,122), other liposomal compositions (see, e.g., U.S. Patent Publication Nos. 20030035829 and 20030072794; and U.S. Pat. No. 6,200,599), stabilized mixtures of liposomes and emulsions (see, e.g., EP1304160), emulsion compositions (see, e.g., U.S. Pat. No. 6,747,014), and nucleic acid micro-emulsions (see, e.g., U.S. Patent Publication No. 20050037086).

Examples of polymer-based carrier systems suitable for use in the present invention include, but are not limited to, cationic polymer-nucleic acid complexes (i.e., polyplexes). To form a polyplex, a nucleic acid (e.g., siRNA) is typically complexed with a cationic polymer having a linear, branched, star, or dendritic polymeric structure that condenses the nucleic acid into positively charged particles capable of interacting with anionic proteoglycans at the cell surface and entering cells by endocytosis. In some embodiments, the polyplex comprises nucleic acid (e.g., siRNA) complexed with a cationic polymer such as polyethylenimine (PEI) (see, e.g., U.S. Pat. No. 6,013,240; commercially available from Qbiogene, Inc. (Carlsbad, Calif.) as In vivo jetPEI™, a linear form of PEI), polypropylenimine (PPI), polyvinylpyrrolidone (PVP), poly-L-lysine (PLL), diethylaminoethyl (DEAE)-dextran, poly(β-amino ester) (PAE) polymers (see, e.g., Lynn et al., *J. Am. Chem. Soc.*, 123:8155-8156 (2001)), chitosan, polyamidoamine (PAMAM) dendrimers (see, e.g., Kukowska-Latallo et al., *Proc. Natl. Acad. Sci. USA*, 93:4897-4902 (1996)), porphyrin (see, e.g., U.S. Pat. No. 6,620,805), polyvinylether (see, e.g., U.S. Patent Publication No. 20040156909), polycyclic amidinium (see, e.g., U.S. Patent Publication No. 20030220289), other polymers comprising primary amine, imine, guanidine, and/or imidazole groups (see, e.g., U.S. Pat. No. 6,013,240; PCT Publication No. WO/9602655; PCT Publication No. WO95/21931; Zhang et al., *J. Control Release*, 100:165-180 (2004); and Tiera et al., *Curr. Gene Ther.*, 6:59-71 (2006)), and a mixture thereof. In other embodiments, the polyplex comprises cationic polymer-nucleic acid complexes as described in U.S. Patent Publication Nos. 20060211643, 20050222064, 20030125281, and 20030185890, and PCT Publication No. WO 03/066069; biodegradable poly(β-amino ester) polymer-nucleic acid complexes as described in U.S. Patent Publication No. 20040071654; microparticles containing polymeric matrices as described in U.S. Patent Publication No. 20040142475; other microparticle compositions as described in U.S. Patent Publication No. 20030157030; condensed nucleic acid complexes as described in U.S. Patent Publication No. 20050123600; and nanocapsule and microcapsule compositions as described in AU 2002358514 and PCT Publication No. WO 02/096551.

In certain instances, the nucleic acid (e.g., siRNA) may be complexed with cyclodextrin or a polymer thereof. Non-limiting examples of cyclodextrin-based carrier systems include the cyclodextrin-modified polymer-nucleic acid complexes described in U.S. Patent Publication No. 20040087024; the linear cyclodextrin copolymer-nucleic acid complexes described in U.S. Pat. Nos. 6,509,323, 6,884,789, and 7,091,192; and the cyclodextrin polymer-complexing agent-nucleic acid complexes described in U.S. Pat. No. 7,018,609. In certain other instances, the nucleic acid (e.g., siRNA) may be complexed with a peptide or polypeptide. An example of a protein-based carrier system includes, but is not limited to, the cationic oligopeptide-nucleic acid complex described in PCT Publication No. WO95/21931.

VI. Preparation of SNALPs

The present invention provides a method of preparing serum-stable nucleic acid-lipid particles in which the siRNA, plasmid or other nucleic acid is encapsulated in a lipid bilayer and is protected from degradation. The particles made by the methods of this invention typically have a size of about 50 nm to about 150 nm, about 60 nm to about 130 nm, about 70 nm to about 110 nm, or about 70 to about 90 nm. The particles can be formed by any method known in the art including, but not limited to: a continuous mixing method, a detergent dialysis method, or a modification of a reverse-phase method which utilizes organic solvents to provide a single phase during mixing of the components.

In preferred embodiments, the cationic lipids are lipids of Formula I and II or combinations thereof. In other preferred embodiments, the noncationic lipids are ESM, DOPE, DOPC, DPPE, DMPE, 16:0 Monomethyl Phosphatidylethanolamine, 16:0 Dimethyl Phosphatidylethanolamine, 18:1 Trans Phosphatidylethanolamine, 18:0 18:1 Phosphatidylethanolamine (SOPE), 1,2-dielaidoyl-sn-glycero-3-phophoethanolamine (transDOPE), 16:0 18:1 Phosphatidylethanolamine, DSPE, polyethylene glycol-based polymers (e.g., PEG 2000, PEG 5000, PEG-modified diacylglycerols, or PEG-modified dialkyloxypropyls), distearoylphosphatidylcholine (DSPC), cholesterol, or combinations thereof. In still other preferred embodiments, the organic solvents are methanol, chloroform, methylene chloride, ethanol, diethyl ether or combinations thereof.

In a particularly preferred embodiment, the nucleic acid is an siRNA molecule; the cationic lipid is a lipid of Formula I or II or combinations thereof; the noncationic lipid is ESM, DOPE, PEG-DAAs, distearoylphosphatidylcholine (DSPC), cholesterol, or combinations thereof (e.g. DSPC and PEG-DAAs); and the organic solvent is methanol, chloroform, methylene chloride, ethanol, diethyl ether or combinations thereof.

In a particularly preferred embodiment, the present invention provides for nucleic acid-lipid particles produced via a continuous mixing method, e.g., process that includes providing an aqueous solution comprising a nucleic acid such as an siRNA or a plasmid, in a first reservoir, and providing an organic lipid solution in a second reservoir, and mixing the aqueous solution with the organic lipid solution such that the organic lipid solution mixes with the aqueous solution so as to substantially instantaneously produce a liposome encapsulating the nucleic acid (e.g., siRNA). This process and the apparatus for carrying this process is described in detail in U.S. Patent Publication No. 20040142025.

The action of continuously introducing lipid and buffer solutions into a mixing environment, such as in a mixing chamber, causes a continuous dilution of the lipid solution with the buffer solution, thereby producing a liposome substantially instantaneously upon mixing. As used herein, the phrase "continuously diluting a lipid solution with a buffer solution" (and variations) generally means that the lipid solution is diluted sufficiently rapidly in a hydration process with sufficient force to effectuate vesicle generation. By mixing the aqueous solution comprising a nucleic acid with the organic lipid solution, the organic lipid solution undergoes a continuous stepwise dilution in the presence of the buffer solution (i.e., aqueous solution) to produce a nucleic acid-lipid particle.

In another embodiment, the present invention provides for nucleic acid-lipid particles produced via a direct dilution process that includes forming a liposome solution and immediately and directly introducing the liposome solution into a collection vessel containing a controlled amount of dilution buffer. In preferred aspects, the collection vessel includes one or more elements configured to stir the contents of the collection vessel to facilitate dilution. In one aspect, the amount of dilution buffer present in the collection vessel is substantially equal to the volume of liposome solution introduced thereto. As an example, liposome solution in 45% ethanol when introduced into the collection vessel containing an equal volume of aqueous solution will advantageously yield smaller particles in about 22.5%, about 20%, or about 15% ethanol.

In even another embodiment, the present invention provides for nucleic acid-lipid particles produced via a direct dilution process in which a third reservoir containing dilution buffer is fluidly coupled to a second mixing region. In this embodiment, the liposome solution formed in a first mixing region is immediately and directly mixed with dilution buffer in the second mixing region. In preferred aspects, the second mixing region includes a T-connector arranged so that the liposome solution and the dilution buffer flows meet as opposing 180° flows, however, connectors providing shallower angles can be used, e.g., 27° to about 180°. A pump mechanism delivers a controllable flow of buffer to the second mixing region. In one aspect, the flow rate of dilution buffer provided to the second mixing region is controlled to be substantially equal to the flow rate of liposome solution introduced thereto from the first mixing region. This embodiment advantageously allows for more control of the flow of dilution buffer mixing with the liposome solution in the second mixing region, and therefore also the concentration of liposome solution in buffer throughout the second mixing process. Such control of the dilution buffer flow rate advantageously allows for small particle size formation at reduced concentrations.

These processes and the apparati for carrying these direct dilution processes is described in detail in U.S. Provisional Patent Application No. 60/703,380 filed Jul. 27, 2005 (Systems and Methods for Manufacturing Liposomes, which is incorporated herein by reference.

The serum-stable nucleic acid-lipid particles formed using the continuous mixing method typically have a size of from about 50 nm to about 150 nm, about 100 nm to about 130 nm, about 110 nm to about 115 nm, about 65 nm to about 95 nm, or about 50 nm to about 75 nm. The particles thus formed do not aggregate and are optionally sized to achieve a uniform particle size.

In some embodiments, the particles are formed using detergent dialysis. Without intending to be bound by any particular mechanism of formation, a plasmid or other nucleic acid (e.g., siRNA) is contacted with a detergent solution of cationic lipids to form a coated nucleic acid complex. These coated nucleic acids can aggregate and precipitate. However, the presence of a detergent reduces this aggregation and allows the coated nucleic acids to react with excess lipids (typically, non-cationic lipids) to form particles in which the plasmid or other nucleic acid is encapsulated in a lipid bilayer. Thus, the present invention provides a method for the preparation of serum-stable nucleic acid-lipid particles, comprising:

(a) combining a nucleic acid with cationic lipids in a detergent solution to form a coated nucleic acid-lipid complex;
(b) contacting non-cationic lipids with the coated nucleic acid-lipid complex to form a detergent solution comprising a nucleic acid-lipid complex and non-cationic lipids; and
(c) dialyzing the detergent solution of step (b) to provide a solution of serum-stable nucleic acid-lipid particles, wherein the nucleic acid is encapsulated in a lipid bilayer and the particles are serum-stable and have a size of from about 50 to about 150 nm.

An initial solution of coated nucleic acid-lipid complexes is formed by combining the nucleic acid with the cationic lipids in a detergent solution.

In these embodiments, the detergent solution is preferably an aqueous solution of a neutral detergent having a critical micelle concentration of 15-300 mM, more preferably 20-50 mM. Examples of suitable detergents include, for example, N,N'-((octanoylimino)-bis-(trimethylene))-bis-(D-gluconamide) (BIGCHAP); BRIJ 35; Deoxy-BIGCHAP; dodecylpoly(ethylene glycol) ether; Tween 20; Tween 40; Tween 60; Tween 80; Tween 85; Mega 8; Mega 9; Zwittergent® 3-08; Zwittergent® 3-10; Triton X-405; hexyl-, heptyl-, octyl- and nonyl-β-D-glucopyranoside; and heptylthioglucopyranoside; with octyl β-D-glucopyranoside and Tween-20 being the most preferred. The concentration of detergent in the detergent solution is typically about 100 mM to about 2 M, preferably from about 200 mM to about 1.5 M.

The cationic lipids and nucleic acids will typically be combined to produce a charge ratio (+/−) of about 1:1 to about 20:1, in a ratio of about 1:1 to about 12:1, or in a ratio of about 2:1 to about 6:1. Additionally, the overall concentration of nucleic acid in solution will typically be from about 25 µg/mL to about 1 mg/mL, from about 25 µg/mL to about 200 µg/mL, or from about 50 µg/mL to about 100 µg/mL. The combination of nucleic acids and cationic lipids in detergent solution is kept, typically at room temperature, for a period of time which is sufficient for the coated complexes to form. Alternatively, the nucleic acids and cationic lipids can be combined in the detergent solution and warmed to temperatures of up to about 37° C., about 50° C., about 60° C., or about 70° C. For nucleic acids which are particularly sensitive to temperature, the coated complexes can be formed at lower temperatures, typically down to about 4° C.

In some embodiments, the nucleic acid to lipid ratios (mass/mass ratios) in a formed nucleic acid-lipid particle will range from about 0.01 to about 0.2, from about 0.03 to about 0.01 or about 0.01 to about 0.08. The ratio of the starting materials also falls within this range. In another preferred embodiment, the nucleic acid-lipid particle preparation uses about 400 µg nucleic acid per 10 mg total lipid or a nucleic acid to lipid ratio of about 0.01 to about 0.08 or about 0.04, which corresponds to 1.25 mg of total lipid per 50 µg of nucleic acid.

The detergent solution of the coated nucleic acid-lipid complexes is then contacted with non-cationic lipids to provide a detergent solution of nucleic acid-lipid complexes and non-cationic lipids. The non-cationic lipids which are useful in this step include, diacylphosphatidylcholine, diacylphosphatidylethanolamine, ceramide, sphingomyelin, cephalin, cardiolipin, and cerebrosides. In preferred embodiments, the non-cationic lipids are diacylphosphatidylcholine, diacylphosphatidylethanolamine, ceramide or sphingomyelin. The acyl groups in these lipids are preferably acyl groups derived from fatty acids having $C_{10}$-$C_{24}$ carbon chains. More preferably the acyl groups are lauroyl, myristoyl, palmitoyl, stearoyl or oleoyl. In particularly preferred embodiments, the non-cationic lipid will be 1,2-sn-dioleoylphosphatidylethanolamine (DOPE), palmitoyl oleoyl phosphatidylcholine (POPC), egg phosphatidylcholine (EPC), distearoylphosphatidylcholine (DSPC), cholesterol, or a mixture thereof. In the most preferred embodiments, the nucleic acid-lipid particles will be fusogenic particles with enhanced properties in vivo and the non-cationic lipid will be DSPC or DOPE. In addition, the nucleic acid-lipid particles of the present invention may further comprise cholesterol. In other preferred embodiments, the non-cationic lipids will further comprise polyethylene glycol-based polymers such as PEG 2000, PEG 5000 and polyethylene glycol conjugated to a diacylglycerol, a ceramide or a phospholipid, as described in U.S. Pat. No. 5,820,873 and U.S. Patent Publication No. 20030077829. In further preferred embodiments, the non-cationic lipids will further comprise polyethylene glycol-based polymers such as PEG 2000, PEG 5000 and polyethylene glycol conjugated to a dialkyloxypropyl.

Following formation of the detergent solution of nucleic acid-lipid complexes and non-cationic lipids, the detergent is removed, preferably by dialysis. The removal of the detergent results in the formation of a lipid-bilayer which surrounds the nucleic acid providing serum-stable nucleic acid-lipid particles which have a size of from about 50 nm to about 150 nm, more typically about 60 nm to about 130 nm, more typically about 70 nm to about 110 nm, most typically about 70 to about 90 nm. The particles thus formed do not aggregate and are optionally sized to achieve a uniform particle size.

The serum-stable nucleic acid-lipid particles can be sized by any of the methods available for sizing liposomes. The sizing may be conducted in order to achieve a desired size range and relatively narrow distribution of particle sizes.

Several techniques are available for sizing the particles to a desired size. One sizing method, used for liposomes and equally applicable to the present particles is described in U.S. Pat. No. 4,737,323. Sonicating a particle suspension either by bath or probe sonication produces a progressive size reduction down to particles of less than about 50 nm in size. Homogenization is another method which relies on shearing energy to fragment larger particles into smaller ones. In a typical homogenization procedure, particles are recirculated through a standard emulsion homogenizer until selected particle sizes, typically between about 60 and 80 nm, are observed. In both methods, the particle size distribution can be monitored by conventional laser-beam particle size discrimination, or QELS.

Extrusion of the particles through a small-pore polycarbonate membrane or an asymmetric ceramic membrane is also an effective method for reducing particle sizes to a relatively well-defined size distribution. Typically, the suspension is cycled through the membrane one or more times until the desired particle size distribution is achieved. The particles may be extruded through successively smaller-pore membranes, to achieve a gradual reduction in size.

In another group of embodiments, the present invention provides a method for the preparation of serum-stable nucleic acid-lipid particles, comprising:
(a) preparing a mixture comprising cationic lipids and non-cationic lipids in an organic solvent;
(b) contacting an aqueous solution of nucleic acid with said mixture in step (a) to provide a clear single phase; and
(c) removing said organic solvent to provide a suspension of nucleic acid-lipid particles, wherein said nucleic acid is encapsulated in a lipid bilayer, and said particles are stable in serum and have a size of from about 50 to about 150 nm.

The nucleic acids (or plasmids), cationic lipids and non-cationic lipids which are useful in this group of embodiments are as described for the detergent dialysis methods above.

The selection of an organic solvent will typically involve consideration of solvent polarity and the ease with which the solvent can be removed at the later stages of particle formation. The organic solvent, which is also used as a solubilizing agent, is in an amount sufficient to provide a clear single phase mixture of nucleic acid and lipids. Suitable solvents include, but are not limited to, chloroform, dichloromethane, diethylether, cyclohexane, cyclopentane, benzene, toluene, methanol, or other aliphatic alcohols such as propanol, isopropanol, butanol, tert-butanol, iso-butanol, pentanol and hexanol. Combinations of two or more solvents may also be used in the present invention.

Contacting the nucleic acid with the organic solution of cationic and non-cationic lipids is accomplished by mixing together a first solution of nucleic acid, which is typically an aqueous solution, and a second organic solution of the lipids. One of skill in the art will understand that this mixing can take place by any number of methods, for example by mechanical means such as by using vortex mixers.

After the nucleic acid has been contacted with the organic solution of lipids, the organic solvent is removed, thus forming an aqueous suspension of serum-stable nucleic acid-lipid particles. The methods used to remove the organic solvent will typically involve evaporation at reduced pressures or blowing a stream of inert gas (e.g., nitrogen or argon) across the mixture.

The serum-stable nucleic acid-lipid particles thus formed will typically be sized from about 50 nm to about 150 nm, more typically about 60 nm to about 130 nm, more typically about 70 nm to about 100 nm, most typically about 70 to about 90 nm. To achieve further size reduction or homogeneity of size in the particles, sizing can be conducted as described above.

In other embodiments, the methods will further comprise adding nonlipid polycations which are useful to effect the delivery to cells using the present compositions. Examples of suitable nonlipid polycations include, but are limited to, hexadimethrine bromide (sold under the brandname POLYBRENE®, from Aldrich Chemical Co., Milwaukee, Wis., USA) or other salts of heaxadimethrine. Other suitable polycations include, for example, salts of poly-L-ornithine, poly-L-arginine, poly-L-lysine, poly-D-lysine, polyallylamine and polyethyleneimine.

In certain embodiments, the formation of the nucleic acid-lipid particles can be carried out either in a mono-phase system (e.g., a Bligh and Dyer monophase or similar mixture of aqueous and organic solvents) or in a two-phase system with suitable mixing.

When formation of the complexes is carried out in a mono-phase system, the cationic lipids and nucleic acids are each dissolved in a volume of the mono-phase mixture. Combination of the two solutions provides a single mixture in which the complexes form. Alternatively, the complexes can form in two-phase mixtures in which the cationic lipids bind to the nucleic acid (which is present in the aqueous phase), and "pull" it into the organic phase.

In another embodiment, the present invention provides a method for the preparation of nucleic acid-lipid particles, comprising:
(a) contacting nucleic acids with a solution comprising non-cationic lipids and a detergent to form a nucleic acid-lipid mixture;
(b) contacting cationic lipids with the nucleic acid-lipid mixture to neutralize a portion of the negative charge of the nucleic acids and form a charge-neutralized mixture of nucleic acids and lipids; and
(c) removing the detergent from the charge-neutralized mixture to provide the nucleic acid-lipid particles in which the nucleic acids are protected from degradation.

In one group of embodiments, the solution of non-cationic lipids and detergent is an aqueous solution. Contacting the nucleic acids with the solution of non-cationic lipids and detergent is typically accomplished by mixing together a first solution of nucleic acids and a second solution of the lipids and detergent. One of skill in the art will understand that this mixing can take place by any number of methods, for example, by mechanical means such as by using vortex mixers. Preferably, the nucleic acid solution is also a detergent solution. The amount of non-cationic lipid which is used in the present method is typically determined based on the amount of cationic lipid used, and is typically of from about 0.2 to 5 times the amount of cationic lipid, preferably from about 0.5 to about 2 times the amount of cationic lipid used.

In some embodiments, the nucleic acids are precondensed as described in, e.g., U.S. patent application Ser. No. 09/744,103.

The nucleic acid-lipid mixture thus formed is contacted with cationic lipids to neutralize a portion of the negative charge which is associated with the nucleic acids (or other polyanionic materials) present. The amount of cationic lipids used will typically be sufficient to neutralize at least 50% of the negative charge of the nucleic acid. Preferably, the negative charge will be at least 70% neutralized, more preferably at least 90% neutralized. Cationic lipids which are useful in the present invention, include, for example, DLinDMA and, DLenDMA. These lipids and related analogs have been described in U.S. patent application Ser. No. 11/148,430, filed Jun. 7, 2005.

Contacting the cationic lipids with the nucleic acid-lipid mixture can be accomplished by any of a number of techniques, preferably by mixing together a solution of the cationic lipid and a solution containing the nucleic acid-lipid mixture. Upon mixing the two solutions (or contacting in any other manner), a portion of the negative charge associated with the nucleic acid is neutralized. Nevertheless, the nucleic acid remains in an uncondensed state and acquires hydrophilic characteristics.

After the cationic lipids have been contacted with the nucleic acid-lipid mixture, the detergent (or combination of detergent and organic solvent) is removed, thus forming the nucleic acid-lipid particles. The methods used to remove the detergent will typically involve dialysis. When organic solvents are present, removal is typically accomplished by evaporation at reduced pressures or by blowing a stream of inert gas (e.g., nitrogen or argon) across the mixture.

The particles thus formed will typically be sized from about 50 nm to several microns, more typically about 50 nm to about 150 nm, more typically about 60 nm to about 130 nm, more typically about 70 nm to about 110 nm, most typically about 70 to about 90 nm. To achieve further size reduction or homogeneity of size in the particles, the nucleic acid-lipid particles can be sonicated, filtered or subjected to other sizing techniques which are used in liposomal formulations and are known to those of skill in the art.

In other embodiments, the methods will further comprise adding nonlipid polycations which are useful to effect the lipofection of cells using the present compositions. Examples of suitable nonlipid polycations include, hexadimethrine bromide (sold under the brandname POLYBRENE®, from Aldrich Chemical Co., Milwaukee, Wis., USA) or other salts of hexadimethrine. Other suitable polycations include, for example, salts of poly-L-ornithine, poly-L-arginine, poly-L-lysine, poly-D-lysine, polyallylamine and polyethyleneimine. Addition of these salts is preferably after the particles have been formed.

In another aspect, the present invention provides methods for the preparation of nucleic acid-lipid particles, comprising:
  (a) contacting an amount of cationic lipids with nucleic acids in a solution; the solution comprising from about 15-35% water and about 65-85% organic solvent and the amount of cationic lipids being sufficient to produce a +/−charge ratio of from about 0.85 to about 2.0, to provide a hydrophobic nucleic acid-lipid complex;
  (b) contacting the hydrophobic, nucleic acid-lipid complex in solution with non-cationic lipids, to provide a nucleic acid-lipid mixture; and
  (c) removing the organic solvents from the nucleic acid-lipid mixture to provide nucleic acid-lipid particles in which the nucleic acids are protected from degradation.

The nucleic acids, non-cationic lipids, cationic lipids and organic solvents which are useful in this aspect of the invention are the same as those described for the methods above which used detergents. In one group of embodiments, the solution of step (a) is a mono-phase. In another group of embodiments, the solution of step (a) is two-phase.

In preferred embodiments, the non-cationic lipids are ESM, DOPE, DOPC, polyethylene glycol-based polymers (e.g., PEG 2000, PEG 5000, PEG-modified diacylglycerols, or PEG-modified dialkyloxypropyls), distearoylphosphatidylcholine (DSPC), DPPE, DMPE, 16:0 Monomethyl Phosphatidylethanolamine, 16:0 Dimethyl Phosphatidylethanolamine, 18:1 Trans Phosphatidylethanolamine, 18:0 18:1 Phosphatidylethanolamine (SOPE), 1,2-dielaidoyl-sn-glycero-3-phophoethanolamine (transDOPE), 16:0 18:1 Phosphatidylethanolamine, DSPE, cholesterol, or combinations thereof. In still other preferred embodiments, the organic solvents are methanol, chloroform, methylene chloride, ethanol, diethyl ether or combinations thereof.

In one embodiment, the nucleic acid is a plasmid from which an interfering RNA is transcribed; the cationic lipid is DLinDMA, DLenDMA, DODAC, DDAB, DOTMA, DOSPA, DMRIE, DOGS or combinations thereof; the non-cationic lipid is ESM, DOPE, DAG-PEGs, distearoylphosphatidylcholine (DSPC), DPPE, DMPE, 16:0 Monomethyl Phosphatidylethanolamine, 16:0 Dimethyl Phosphatidylethanolamine, 18:1 Trans Phosphatidylethanolamine, 18:0 18:1 Phosphatidylethanolamine (SOPE), 1,2-dielaidoyl-sn-glycero-3-phophoethanolamine (transDOPE), 16:0 18:1 Phosphatidylethanolamine DSPE, cholesterol, or combinations thereof (e.g. DSPC and PEG-DAA); and the organic solvent is methanol, chloroform, methylene chloride, ethanol, diethyl ether or combinations thereof.

As above, contacting the nucleic acids with the cationic lipids is typically accomplished by mixing together a first solution of nucleic acids and a second solution of the lipids, preferably by mechanical means such as by using vortex mixers. The resulting mixture contains complexes as described above. These complexes are then converted to particles by the addition of non-cationic lipids and the removal of the organic solvent. The addition of the non-cationic lipids is typically accomplished by simply adding a solution of the non-cationic lipids to the mixture containing the complexes. A reverse addition can also be used. Subsequent removal of organic solvents can be accomplished by methods known to those of skill in the art and also described above.

The amount of non-cationic lipids which is used in this aspect of the invention is typically an amount of from about 0.2 to about 15 times the amount (on a mole basis) of cationic lipids which was used to provide the charge-neutralized nucleic acid-lipid complex. Preferably, the amount is from about 0.5 to about 9 times the amount of cationic lipids used.

In yet another aspect, the present invention provides nucleic acid-lipid particles which are prepared by the methods described above. In these embodiments, the nucleic acid-lipid particles are either net charge neutral or carry an overall charge which provides the particles with greater gene lipofection activity. Preferably, the nucleic acid component of the particles is a nucleic acid which interferes with the production of an undesired protein. In some embodiments, the nucleic acid comprises an interfering RNA, the non-cationic lipid is egg sphingomyelin and the cationic lipid is DLinDMA or DLenDMA. In some embodiments, the nucleic acid comprises an interfering RNA, the non-cationic lipid is a mixture of DSPC and cholesterol, and the cationic lipid is DLinDMA or DLenDMA. In other preferred embodiments, the non-cationic lipid may further comprise cholesterol.

A variety of general methods for making SNALP-CPLs (CPL-containing SNALPs) are discussed herein. Two general techniques include "post-insertion" technique, that is, insertion of a CPL into for example, a pre-formed SNALP, and the "standard" technique, wherein the CPL is included in the lipid mixture during for example, the SNALP formation steps. The post-insertion technique results in SNALPs having CPLs mainly in the external face of the SNALP bilayer membrane, whereas standard techniques provide SNALPs having CPLs on both internal and external faces. The method is especially useful for vesicles made from phospholipids (which can contain cholesterol) and also for vesicles containing PEG-lipids (such as PEG-DAAs and PEG-DAGs). Methods of making SNALP-CPL, are taught, for example, in U.S. Pat. Nos. 5,705,385, 6,586,410, 5,981,501 6,534,484; 6,852,334; U.S. Patent Publication No. 20020072121; and WO 00/62813.

VII. Kits

The present invention also provides nucleic acid-lipid particles in kit form. The kit will typically be comprised of a container which is compartmentalized for holding the various elements of the nucleic acid-lipid particles. The kit will contain the compositions of the present inventions, preferably in dehydrated form, with instructions for their rehydration and administration. In still other embodiments, the particles and/or compositions comprising the particles will have a targeting moiety attached to the surface of the particle. Methods of attaching targeting moieties (e.g., antibodies, proteins) to lipids (such as those used in the present particles) are known to those of skill in the art.

VIII. Administration of Nucleic Acid-Lipid Particles

Once formed, the serum-stable nucleic acid-lipid particles of the present invention are useful for the introduction of nucleic acids (i.e., siRNA that silences expression of gene expressed in cancer such as an Eg5, EGFR and/or XIAP gene) into cells. Accordingly, the present invention also provides methods for introducing a nucleic acids (e.g., a plasmid or and siRNA) into a cell. The methods are carried out in vitro or in vivo by first forming the particles as described above and then contacting the particles with the cells for a period of time sufficient for delivery of the nucleic acid to the cell to occur.

The nucleic acid-lipid particles of the present invention can be adsorbed to almost any cell type with which they are mixed or contacted. Once adsorbed, the particles can either be endocytosed by a portion of the cells, exchange lipids with cell membranes, or fuse with the cells. Transfer or incorporation of the nucleic acid portion of the particle can take place via any one of these pathways. In particular, when fusion takes place, the particle membrane is integrated into the cell membrane and the contents of the particle combine with the intracellular fluid.

The nucleic acid-lipid particles of the present invention can be administered either alone or in mixture with a physiologically-acceptable carrier (such as physiological saline or phosphate buffer) selected in accordance with the route of administration and standard pharmaceutical practice. Generally, normal saline will be employed as the pharmaceutically acceptable carrier. Other suitable carriers include, e.g., water, buffered water, 0.4% saline, 0.3% glycine, and the like, including glycoproteins for enhanced stability, such as albumin, lipoprotein, globulin, etc.

The pharmaceutical carrier is generally added following particle formation. Thus, after the particle is formed, the particle can be diluted into pharmaceutically acceptable carriers such as normal saline.

The concentration of particles in the pharmaceutical formulations can vary widely, i.e., from less than about 0.05%, usually at or at least about 2-5% to as much as 10 to 30% by weight and will be selected primarily by fluid volumes, viscosities, etc., in accordance with the particular mode of administration selected. For example, the concentration may be increased to lower the fluid load associated with treatment. This may be particularly desirable in patients having atherosclerosis-associated congestive heart failure or severe hypertension. Alternatively, particles composed of irritating lipids may be diluted to low concentrations to lessen inflammation at the site of administration.

The pharmaceutical compositions of the present invention may be sterilized by conventional, well known sterilization techniques. Aqueous solutions can be packaged for use or filtered under aseptic conditions and lyophilized, the lyophilized preparation being combined with a sterile aqueous solution prior to administration. The compositions can contain pharmaceutically acceptable auxiliary substances as required to approximate physiological conditions, such as pH adjusting and buffering agents, tonicity adjusting agents and the like, for example, sodium acetate, sodium lactate, sodium chloride, potassium chloride, and calcium chloride. Additionally, the particle suspension may include lipid-protective agents which protect lipids against free-radical and lipid-peroxidative damages on storage. Lipophilic free-radical quenchers, such as alphatocopherol and water-soluble iron-specific chelators, such as ferrioxamine, are suitable.

The nucleic acid-lipid particles can be incorporated into a broad range of topical dosage forms including, but not limited to, gels, oils, emulsions, topical creams, pastes, ointments, lotions and the like.

A. In Vivo Administration

Systemic delivery for in vivo therapy, i.e., delivery of a therapeutic nucleic acid to a distal target cell via body systems such as the circulation, has been achieved using nucleic acid-lipid particles such as those disclosed in WO 96/40964 and U.S. Pat. Nos. 5,705,385, 5,976,567, 5,981,501 and 6,410,328. This latter format provides a fully encapsulated nucleic acid-lipid particle that protects the nucleic acid from nuclease degradation in serum, is nonimmunogenic, is small in size and is suitable for repeat dosing.

For in vivo administration, administration can be in any manner known in the art, e.g., by injection, oral administration, inhalation (e.g., intransal or intratracheal), transdermal application, or rectal administration. Administration can be accomplished via single or divided doses. The pharmaceutical compositions can be administered parenterally, i.e., intraarticularly, intravenously, intraperitoneally, subcutaneously, intramuscularly, or intratumorally. In some embodiments, the pharmaceutical compositions are administered intravenously or intraperitoneally by a bolus injection (see, e.g., Stadler, et al., U.S. Pat. No. 5,286,634) or by pump infusion. Intracellular nucleic acid delivery has also been discussed in Straubringer, et al., *Methods Enzymol*, Academic Press, New York. 101:512 (1983); Mannino, et al., *Biotechniques* 6:682 (1988); Nicolau, et al., *Crit. Rev. Ther. Drug Carrier Syst.* 6:239 (1989), and Behr, *Acc. Chem. Res.* 26:274 (1993). Still other methods of administering lipid based therapeutics are described in, for example, Rahman et al., U.S. Pat.

No. 3,993,754; Sears, U.S. Pat. No. 4,145,410; Papahadjopoulos et al., U.S. Pat. No. 4,235,871; Schneider, U.S. Pat. No. 4,224,179; Lenk et al., U.S. Pat. No. 4,522,803; and Fountain et al., U.S. Pat. No. 4,588,578. The lipid nucleic acid particles can be administered by direct injection at the site of disease or by injection at a site distal from the site of disease (see, e.g., Culver, HUMAN GENE THERAPY, MaryAnn Liebert, Inc., Publishers, New York. pp. 70-71 (1994)).

The compositions of the present invention, either alone or in combination with other suitable components, can be made into aerosol formulations (i.e., they can be "nebulized") to be administered via inhalation (e.g., intranasally or intratracheally) (see, Brigham, et al., *Am. J. Sci.* 298(4):278 (1989)). Aerosol formulations can be placed into pressurized acceptable propellants, such as dichlorodifluoromethane, propane, nitrogen, and the like.

Formulations suitable for parenteral administration, such as, for example, by intraarticular (in the joints), intravenous, intramuscular, intradermal, intraperitoneal, and subcutaneous routes, include aqueous and non-aqueous, isotonic sterile injection solutions, which can contain antioxidants, buffers, bacteriostats, and solutes that render the formulation isotonic with the blood of the intended recipient, and aqueous and non-aqueous sterile suspensions that can include suspending agents, solubilizers, thickening agents, stabilizers, and preservatives. In the practice of this invention, compositions can be administered, for example, by intravenous infusion, orally, topically, intraperitoneally, intravesically or intrathecally.

Formulations suitable for oral administration can consist of (a) liquid solutions, such as an effective amount of the packaged nucleic acid suspended in diluents, such as water, saline or PEG 400; (b) capsules, sachets or tablets, each containing a predetermined amount of the active ingredient, as liquids, solids, granules or gelatin; (c) suspensions in an appropriate liquid; and (d) suitable emulsions. Tablet forms can include one or more of lactose, sucrose, mannitol, sorbitol, calcium phosphates, corn starch, potato starch, microcrystalline cellulose, gelatin, colloidal silicon dioxide, talc, magnesium stearate, stearic acid, and other excipients, colorants, fillers, binders, diluents, buffering agents, moistening agents, preservatives, flavoring agents, dyes, disintegrating agents, and pharmaceutically compatible carriers. Lozenge forms can comprise the active ingredient in a flavor, e.g., sucrose, as well as pastilles comprising the active ingredient in an inert base, such as gelatin and glycerin or sucrose and acacia emulsions, gels, and the like containing, in addition to the active ingredient, carriers known in the art.

Generally, when administered intravenously, the nucleic acid-lipid formulations are formulated with a suitable pharmaceutical carrier. Many pharmaceutically acceptable carriers may be employed in the compositions and methods of the present invention. Suitable formulations for use in the present invention are found, for example, in REMINGTON'S PHARMACEUTICAL SCIENCES, Mack Publishing Company, Philadelphia, Pa., 17th ed. (1985). A variety of aqueous carriers may be used, for example, water, buffered water, 0.4% saline, 0.3% glycine, and the like, and may include glycoproteins for enhanced stability, such as albumin, lipoprotein, globulin, etc. Generally, normal buffered saline (135-150 mM NaCl) will be employed as the pharmaceutically acceptable carrier, but other suitable carriers will suffice. These compositions can be sterilized by conventional liposomal sterilization techniques, such as filtration. The compositions may contain pharmaceutically acceptable auxiliary substances as required to approximate physiological conditions, such as pH adjusting and buffering agents, tonicity adjusting agents, wetting agents and the like, for example, sodium acetate, sodium lactate, sodium chloride, potassium chloride, calcium chloride, sorbitan monolaurate, triethanolamine oleate, etc. These compositions can be sterilized using the techniques referred to above or, alternatively, they can be produced under sterile conditions. The resulting aqueous solutions may be packaged for use or filtered under aseptic conditions and lyophilized, the lyophilized preparation being combined with a sterile aqueous solution prior to administration.

The methods of the present invention may be practiced in a variety of hosts. Preferred hosts include mammalian species, such as primates (e.g., humans and chimpanzees as well as other nonhuman primates), canines, felines, equines, bovines, ovines, caprines, rodents (e.g., rats and mice), lagomorphs, and swine.

The amount of particles administered will depend upon the ratio of nucleic acid to lipid; the particular nucleic acid used, the disease state being diagnosed; the age, weight, and condition of the patient and the judgment of the clinician; but will generally be between about 0.01 and about 50 mg per kilogram of body weight; preferably between about 0.1 and about 5 mg/kg of body weight or about $10^8$-$10^{10}$ particles per injection.

B. Combination Therapy

In some embodiments, the nucleic acid-lipid particles described herein are administered in combination with a second therapeutic agent for treating or preventing cancer. For example, the nucleic acid-lipid particles may be administered in conjunction with any of the standard treatments for cancer including, but not limited to, chemotherapeutic agents including, e.g., alitretinoin, altretamine, anastrozole, azathioprine, bicalutamide, busulfan, capecitabine, carboplatin, cisplatin, cyclophosphamide, cytarabine, doxorubicin, epirubicin, etoposide, exemestane, finasteride, fluorouracil, fulvestrant, gemtuzumab, ozogamicin, hydroxyurea, ibritumomab, idarubicin, ifosfamide, imatinib, letrozole, megestrol acetate, methotrexate, mifepristone, paclitaxel, rituximab, tamoxifen, temozolomide, tretinoin, triptorelin, vincristine, or vinorelbine, and radiation treatment.

The nucleic acid-lipid particles and the second therapeutic agent may be administered simultaneously or sequentially. For example, the nucleic acid-lipid particles may be administered first, followed by the second therapeutic agent. Alternatively, the second therapeutic agent may be administered first, followed by the nucleic acid-lipid particles. In some cases, the nucleic acid-lipid particles and the second therapeutic agent are administered in the same formulation. In other cases the nucleic acid-lipid particles and nucleic acids and the second therapeutic agent are administered in different formulations.

C. Cells for Delivery of Interfering RNA

The compositions and methods of the present invention are used to treat a wide variety of cell types, in vivo and in vitro. Suitable cells include, e.g., hematopoietic precursor (stem) cells, fibroblasts, keratinocytes, hepatocytes, endothelial cells, skeletal and smooth muscle cells, osteoblasts, neurons, quiescent lymphocytes, terminally differentiated cells, slow or noncycling primary cells, parenchymal cells, lymphoid cells, epithelial cells, bone cells, and the like.

In vivo delivery of nucleic acid-lipid particles encapsulating an interfering RNA is particularly suited for targeting tumor cells of any cell type. In vivo studies show that SNALP's accumulate at tumor sites and predominantly transfect tumor cells. See, Fenske, et al., *Methods Enzymol*, Academic Press, New York 346:36 (2002). The methods and compositions can be employed with cells of a wide variety of vertebrates, including mammals, and especially those of veterinary importance, e.g., canine, feline, equine, bovine, ovine, caprine, rodent, lagomorph, swine, etc., in addition to human cell populations.

To the extent that tissue culture of cells may be required, it is well known in the art. Freshney (1994) (Culture of Animal Cells, a Manual of Basic Technique, third edition Wiley-Liss, New York), Kuchler et al. (1977) Biochemical Methods in Cell Culture and Virology, Kuchler, R. J., Dowden, Hutchinson and Ross, Inc., and the references cited therein provides a general guide to the culture of cells. Cultured cell systems often will be in the form of monolayers of cells, although cell suspensions are also used.

D. Detection of SNALPs

In some embodiments, the nucleic acid-lipid particles are detectable in the subject 8, 12, 24, 48, 60, 72, or 96 hours, 6, 8, 10, 12, 14, 16, 18, 19, 22, 24, 25, or 28 days after administration of the particles. The presence of the particles can be detected in the cells, tissues, or other biological samples from the subject. The particles may be detected, e.g., by direct detection of the particles, detection of the interfering RNA sequence, detection of the target sequence of interest (i.e., by detecting expression or reduced expression of the Eg5, EGFR and/or XIAP sequence of interest), detection of a target protein of interest (e.g., by detecting expression or reduced expression of Eg5, EGFR and/or XIAP protein), detection of a compound modulated directly or indirectly by the Eg5, EGFR and/or XIAP (e.g., tubulin, phosphor-histones, P13 kinase-AKT, STATS, caspases) or by detection of apoptosis and cell viability in the subject or a combination thereof.

1. Detection of Particles

Nucleic acid-lipid particles can be detected using any methods known in the art. For example, a label can be coupled directly or indirectly to a component of the SNALP or other lipid-based carrier system using methods well known in the art. A wide variety of labels can be used, with the choice of label depending on sensitivity required, ease of conjugation with the SNALP component, stability requirements, and available instrumentation and disposal provisions. Suitable labels include, but are not limited to, spectral labels, such as fluorescent dyes (e.g., fluorescein and derivatives, such as fluorescein isothiocyanate (FITC) and Oregon Green™; rhodamine and derivatives, such Texas red, tetrarhodimine isothiocynate (TRITC), etc., digoxigenin, biotin, phycoerythrin, AMCA, CyDyes™, and the like; radiolabels, such as $^3$H, $^{125}$I, $^{35}$S, $^{14}$C, $^{32}$P, $^{33}$P, etc.; enzymes, such as horse radish peroxidase, alkaline phosphatase, etc.; spectral colorimetric labels, such as colloidal gold or colored glass or plastic beads, such as polystyrene, polypropylene, latex, etc. The label can be detected using any means known in the art.

2. Detection of Nucleic Acids

Nucleic acids (i.e., siRNA that silence expression of an Eg5, EGFR and/or XIAP gene) are detected and quantified herein by any of a number of means well known to those of skill in the art. The detection of nucleic acids proceeds by well known methods such as Southern analysis, northern analysis, gel electrophoresis, PCR, radiolabeling, scintillation counting, and affinity chromatography. Additional analytic biochemical methods such as spectrophotometry, radiography, electrophoresis, capillary electrophoresis, high performance liquid chromatography (HPLC), thin layer chromatography (TLC), hyperdiffusion chromatography, may also be employed The selection of a nucleic acid hybridization format is not critical. A variety of nucleic acid hybridization formats are known to those skilled in the art. For example, common formats include sandwich assays and competition or displacement assays. Hybridization techniques are generally described in "Nucleic Acid Hybridization, A Practical Approach," Ed. Hames, B. D. and Higgins, S. J., IRL Press, 1985.

The sensitivity of the hybridization assays may be enhanced through use of a nucleic acid amplification system which multiplies the target nucleic acid being detected. In vitro amplification techniques suitable for amplifying sequences for use as molecular probes or for generating nucleic acid fragments for subsequent subcloning are known. Examples of techniques sufficient to direct persons of skill through such in vitro amplification methods, including the polymerase chain reaction (PCR) the ligase chain reaction (LCR), Qβ-replicase amplification and other RNA polymerase mediated techniques (e.g., NASBA™) are found in Sambrook, et al., In *Molecular Cloning. A Laboratory Manual*, Cold Spring Harbor Laboratory Press, 2000, and Ausubel et al., SHORT PROTOCOLS IN MOLECULAR BIOLOGY, eds., Current Protocols, a joint venture between Greene Publishing Associates, Inc. and John Wiley & Sons, Inc., (2002), as well as Mullis et al. (1987), U.S. Pat. No. 4,683,202; PCR Protocols A Guide to Methods and Applications (Innis et al. eds) Academic Press Inc. San Diego, Calif. (1990) (Innis); Arnheim & Levinson (Oct. 1, 1990), *C&EN* 36; The *Journal Of NIH Research*, 3:81 (1991); (Kwoh et al., *Proc. Natl. Acad. Sci. USA*, 86:1173 (1989); Guatelli et al., *Proc. Natl. Acad. Sci. USA*, 87:1874 (1990); Lomell et al., *J. Clin. Chem.*, 35:1826 (1989); Landegren et al., *Science*, 241:1077 (1988); Van Brunt, *Biotechnology*, 8:291 (1990); Wu and Wallace, *Gene*, 4:560 (1989); Barringer et al., *Gene*, 89:117 (1990), and Sooknanan and Malek, *Biotechnology*, 13:563 (1995). Improved methods of cloning in vitro amplified nucleic acids are described in Wallace et al., U.S. Pat. No. 5,426,039. Other methods described in the art are the nucleic acid sequence based amplification (NASBA™, Cangene, Mississauga, Ontario) and Q Beta Replicase systems. These systems can be used to directly identify mutants where the PCR or LCR primers are designed to be extended or ligated only when a select sequence is present. Alternatively, the select sequences can be generally amplified using, for example, nonspecific PCR primers and the amplified target region later probed for a specific sequence indicative of a mutation.

Oligonucleotides for use as probes, e.g., in in vitro amplification methods, for use as gene probes, or as inhibitor components are typically synthesized chemically according to the solid phase phosphoramidite triester method described by Beaucage and Caruthers, *Tetrahedron Letts.*, 22(20):1859 1862 (1981), e.g., using an automated synthesizer, as described in Needham VanDevanter et al., *Nucleic Acids Res.*, 12:6159 (1984). Purification of oligonucleotides, where necessary, is typically performed by either native acrylamide gel electrophoresis or by anion exchange HPLC as described in Pearson and Regnier, *J. Chrom.*, 255:137 149 (1983). The sequence of the synthetic oligonucleotides can be verified using the chemical degradation method of Maxam and Gilbert (1980) in Grossman and Moldave (eds.) Academic Press, New York, *Methods in Enzymology*, 65:499.

An alternative means for determining the level of transcription is in situ hybridization. In situ hybridization assays are well known and are generally described in Angerer et al., *Methods Enzymol.*, 152:649 (1987). In an in situ hybridization assay cells are fixed to a solid support, typically a glass slide. If DNA is to be probed, the cells are denatured with heat or alkali. The cells are then contacted with a hybridization solution at a moderate temperature to permit annealing of specific probes that are labeled. The probes are preferably labeled with radioisotopes or fluorescent reporters.

E. Detection of an Immune Response

An immune response to induced by the siRNA (i.e., siRNA that silence expression of an Eg5, EGFR and/or XIAP gene) described herein can be long-lived and can be detected long after administration of the siRNA or nucleic acid-lipid particles containing the siRNA. An immune response to the siRNA can be detected by using immunoassays that detect the presence or absence of cytokines and growth factors e.g., produced by responder cells.

Suitable immunoassays include the double monoclonal antibody sandwich immunoassay technique of David et al. (U.S. Pat. No. 4,376,110); monoclonal-polyclonal antibody sandwich assays (Wide et al., in Kirkham and Hunter, eds., *Radioimmunoassay Methods*, E. and S. Livingstone, Edinburgh (1970)); the "western blot" method of Gordon et al. (U.S. Pat. No. 4,452,901); immunoprecipitation of labeled ligand (Brown et al. (1980) *J. Biol. Chem.* 255:4980-4983); enzyme-linked immunosorbent assays (ELISA) as described, for example, by Raines et al. (1982) *J. Biol. Chem.* 257:5154-5160; immunocytochemical techniques, including the use of fluorochromes (Brooks et al. (1980) *Clin. Exp. Immunol.* 39:477); and neutralization of activity (Bowen-Pope et al. (1984) *Proc. Natl. Acad. Sci. USA* 81:2396-2400). In addition to the immunoassays described above, a number of other immunoassays are available, including those described in U.S. Pat. Nos. 3,817,827; 3,850,752; 3,901,654; 3,935,074; 3,984,533; 3,996,345; 4,034,074; and 4,098,876. Monoclonal antibodies that specifically bind cytokines and growth factors (e.g., II-6, IL-12, TNF-α, IFN-α, and IFN-γ can be generated using methods known in the art (see, e.g., Kohler and Milstein, *Nature* 256: 495-497 (1975) and Harlow and Lane, ANTIBODIES, A LABORATORY MANUAL, Cold Spring Harbor Publication, New York (1999)). Generation of monoclonal antibodies has been previously described and can be accomplished by any means known in the art. (Buhring et al. in Hybridoma 1991, Vol. 10, No. 1, pp. 77-78). For example, an animal such as a guinea pig or rat, preferably a mouse is immunized with an immunogenic polypeptide, the antibody-producing cells, preferably splenic lymphocytes, are collected and fused to a stable, immortalized cell line, preferably a myeloma cell line, to produce hybridoma cells which are then isolated and cloned. (U.S. Pat. No. 6,156,882). In some methods, the monoclonal antibody is labeled to facilitate detection.

The invention will be described in greater detail by way of specific examples. The following examples are offered for illustrative purposes, and are not intended to limit the invention in any manner. Those of skill in the art will readily recognize a variety of noncritical parameters which can be changed or modified to yield essentially the same results.

EXAMPLES

The following examples are provided to illustrate, but not to limit the claimed invention.

Example 1

Materials and Methods siRNA:

All siRNA used in these studies were chemically synthesized by Protiva Biotherapeutics (Burnaby, BC), University of Calgary (Calgary, AB) or Dharmacon Inc. (Lafayette, Colo.). siRNA were desalted and annealed using standard procedures.

Lipid Encapsulation of siRNA:

Unless otherwise indicated, siRNAs were encapsulated into liposomes composed of the following lipids: synthetic cholesterol (Sigma, St. Louis, Mo.), the phospholipid DSPC (1,2-distearoyl-sn-glycero-3-phosphocholine; Avanti Polar Lipids, Alabaster, Ala.), the PEG-lipid PEG-cDMA (3-N-[(-Methoxy poly(ethylene glycol)2000)carbamoyl]-1,2-dimyrestyloxy-propylamine), and the cationic lipid DLinDMA (1,2-Dilinoleyloxy-3-(N,N-dimethyl)aminopropane) in the molar ratios 48:10:2:40 respectively. In other words, unless otherwise indicated, siRNA's were encapsulated in to liposomes of the following SNALP formulation: 2% PEG-cDMA, 40% DLinDMA, 10% DSPC, 48% cholesterol. For vehicle controls, empty liposomes with identical lipid composition were formed in the absence of siRNA.

Serum Nuclease Protection Assay:

Unmodified naked or lipid encapsulated siRNA (0.25 mg/ml) were incubated in 50% mouse serum at 37° C. At the times indicated, aliquots were taken directly into gel loading buffer containing 0.1% SDS and frozen in liquid nitrogen. After the final timepoint, siRNA samples were run on a non-denaturing 20% polyacrylamide TBE gel and visualized by ethidium bromide staining. To confirm that nuclease protection of siRNA was conferred by lipid encapsulation, 0.1% Triton-X100 was added to disrupt lipid bilayer integrity immediately prior to incubation with serum.

RiboGreen™ Assay:

Equal volumes of diluted RiboGreen™ and SNALP are combined so that the final concentration of siRNA is ~167 ng/mL. 30 µl of a 10% Triton X-100 solution is added to the RiboGreen™/SNALP mixture and the resulting solution is incubated at room temperature for at least 2 minutes. Fluorescence measurements are taken at an appropriate wavelength before and after the addition of triton X-100 to determine the amount of encapsulated siRNA (see, e.g., Muriaux et al., *PNAS USA* 98(9): 5246-5251 (2001)).

In Vivo Cytokine Induction:

Animal studies were completed in accordance with the Canadian Council on Animal Care guidelines following approval by the local Animal Care and Use Committee at Protiva Biotherapeutics. 6-8 week old CD1 ICR mice (Harlan; Indianapolis, Ind.) were subjected to a three week quarantine and acclimation period prior to use. Encapsulated siRNA formulations were administered by standard intravenous injection in the lateral tail vein in 0.2 ml PBS. Blood was collected by cardiac puncture 6 h after administration and processed as plasma for cytokine analysis. In RNAi efficacy experiments, plasma was collected from 50 µl test bleeds 6 h after initial siRNA administration.

Cytokine ELISA:

All cytokines were quantified using sandwich ELISA kits according to manufacturers instructions. These were mouse and human IFN-α (PBL Biomedical; Piscataway, N.J.), human IL-6 and TNF-α (eBioscience; San Diego, Calif.), and mouse IL-6, TNF-α, and IFN-γ (BD Biosciences; San Diego, Calif.); and Mouse IFN-α and IFN-β (BD Biosciences, San Diego, Calif.).

Cell Viability Assay:

Cell viability of in vitro cell cultures was assessed using the commercial reagent CellTiter Blue (Promega Corp. Madison, Wis.), a resazurin dye that is reduced by metabolically active cells to the fluorogenic product resorufin. Various cancer cell lines were cultured in vitro using standard tissue culture techniques. 48-72 hours after treatment with siRNA formulations or small molecule drugs, CellTiter Blue reagent was added to the culture to quantify the metabolic activity of the cells—a measure of cell viability.

Target mRNA Quantitation:

The QuantiGene branched DNA assay (Genospectra) was used to quantify the reduction of target mRNA in cell cultures treated with SNALP. Cell lysates were prepared according to the manufacturer's instructions and used directly for Eg5 (kif11) and GAPDH mRNA quantification. The ratio of Eg5 to GAPDH mRNA was calculated for each cell culture and data expressed relative to the vehicle treated control cells. Specific probe sets used for detection of mRNA were designed by Genospectra to target the following regions: for the Eg5 mRNA, positions 4188-4882 of accession NM_004523; for GAPDH mRNA, positions 1-1303 of accession NM-002046.

Antibody Assay:

An ELISA was developed to detect IgM and IgG antibodies against the PEG-lipid and other lipid components of SNALP using a method described in Judge et al in Molecular Therapy (2006). 13(2) pp. 328-337.10 µg of PEG-cDSA was added in 20 µL 100% ethanol to 96 well plates containing PVDF membranes (Millipore Corp. Bedford, Mass.). PEG-cDSA coated membranes were allowed to completely air dry for 2 hours before blocking for 1 h with 10% FBS in PBS. 100 uL of serially diluted serum samples in blocking buffer were then applied in duplicate wells for 1 h and washed 4 times with 1% FBS in PBS. Plate bound antibodies were detected with HRP-conjugated goat anti-IgM Fcµ, or IgG Fcγ. Bound enzyme was developed with TMB substrate, stopped with 2N sulphuric acid, then read in a spectrophotometer at 450 nm (minus 570 nm).

Apoptosis/Caspase 3/7 Assay

The level of Caspase 3 and 7 enzyme activity in siRNA treated cells was assessed using the commercial reagent Apo-ONE (Promega Corp. Madison, Wis.). This assay is based on the specific enzymatic cleavage of the Caspase 3/7 substrate (Z-DEVD)2-Rhodamine 110 to a fluorogenic product and is used to quantify the level of apoptosis in cultured cells. The relative level of Caspase 3/7 activity was assessed in a number of cancer cell lines at 24-48 hours after treatment with siRNA formulations.

Example 2

Selection of Candidate Eg5, EGFR or XIAP siRNA with Specificity to Mouse and Human Targets Candidate Eg5, EGFR or XIAP sequences were identified by scanning Eg5 (Genbank Accession Nos. NM_004523 and NM_010615), EGFR (Genbank Accession Nos. NM_005228 and NM_207655), and XIAP (Genbank Accession Nos. NM_001167 and NM_009688) sequences to identify AA dinucleotide motifs and the 19 nucleotides 3' of the motif. The following candidate sequences were eliminated: (1) sequences comprising a stretch of 4 or more of the same base in a row; (2) sequences comprising homopolymers of Gs; (3) sequences comprising triple base motifs (GGG, CCC, AAA, or TTT); and (4) sequences comprising stretches of 7 or more G/Cs in a row.

Reynold's Rational Design criteria was then applied to the remaining candidate sequences to identify sequences with 5 or more of the following criteria:
1. 30%-52% GC content;
2. At least 3 A/Us at positions 15-19 (sense);
3. Absence of internal repeats;
4. A at position 19 (sense);
5. A at position 3 (sense);
6. U at position 10 (sense);
7. No G/C at position 19 (sense); and
8. No G at position 13 (sense).

Only results with a score of 6 or more in the Stockholm rules (see, Chalk, Wahlestedt, and Sonnhammer method described in Chalk et al., *Biochem. Biophys. Res. Commun.*, 319:264-274 (2004)) were retained.

Next, sequences with a high score from, e.g., Classification tree method or Chalk, Wahlestedt, and Sonnhammer method, were retained.

Next, sequences with a score of 3 or more based on the rules of Amarzguioui and Prydz, *Biochem. Biophys. Res. Commun.*, 316:1050-1058 (2004), were retained.

Next, sequences with thermodynamics >0 were eliminated.

Finally, BLASTn was used to compare the sequences with the mouse and human databases and sequences with homology to 15-16 contiguous bp from the center of the target sequence (bp 3-18) against any relevant gene were eliminated. The candidate sequences are shown in Tables 1-9.

The candidate sequences are shown in Tables 1-9.

Example 3 siRNA Targeting the Kinesin Eg5 can Inhibit the Growth of Cancer Cells

Figure 2:
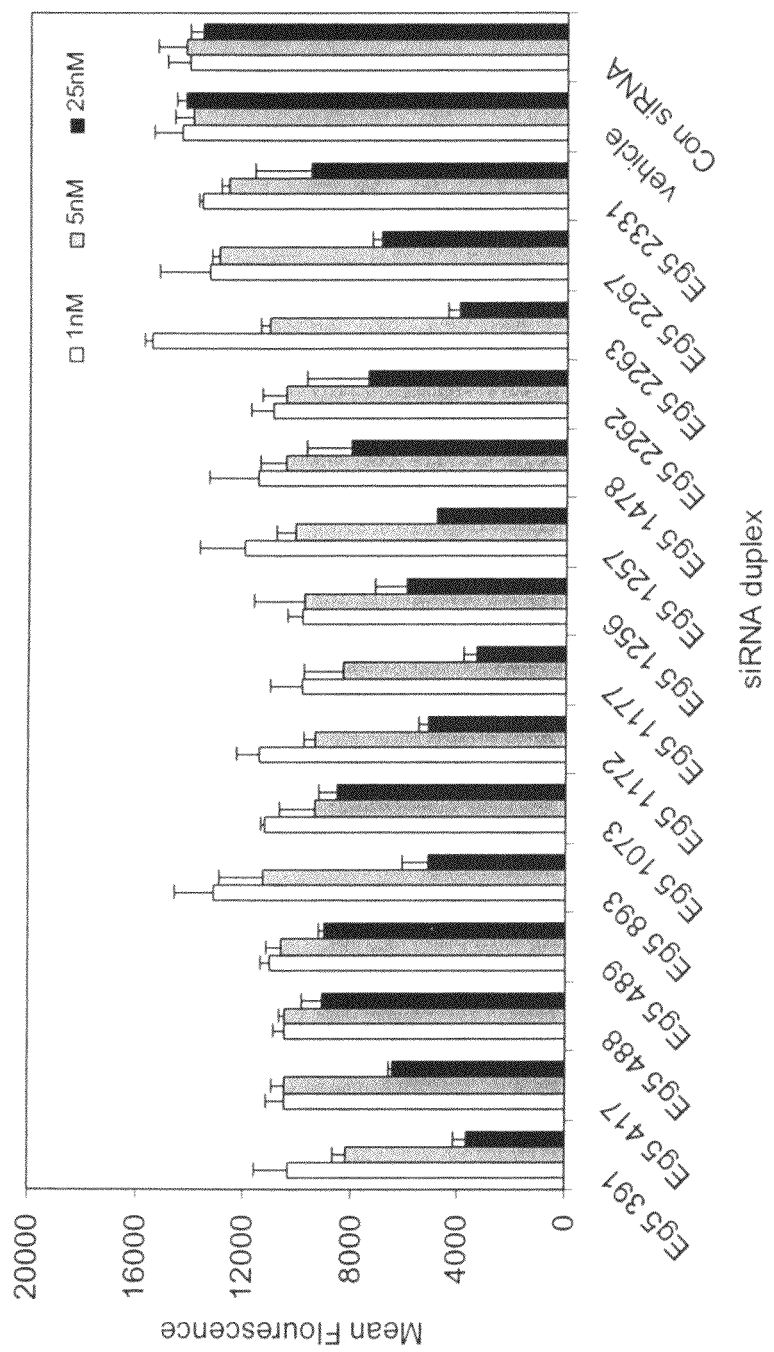
FIG. 2 illustrates data demonstrating RNAi activity of a Eg5 siRNA panel (at 1, 5, and 25 nM concentration) complexed with lipofectamine in Neuro2A cells (mouse).

A panel of siRNA sequences, including Eg5 2263, were evaluated for their antiproliferative effects against cancer cells. Eg5 2263 was previously described in the literature (see, Weil et al. 2002, *BioTechniques* 33:1244-1248) but the authors do not describe its use as a therapeutic or anti-cancer agent. The RNAi activity of the Eg5 siRNA panel were screened in vitro with HeLa cells (human; FIG. 1) and Neuro2A cells (mouse; FIG. 2) using a cell viability assay. The cells were treated with 1, 5, or 25 nM siRNA complexed with lipofectamine. Viability of the cell cultures were measured 48 h after treatment and expressed as mean fluorescence units as shown in FIGS. 1 and 2.

Example 4 siRNA Formulated as SNALP are Potent Inhibitors of Cell Growth In Vitro

Figure 3:
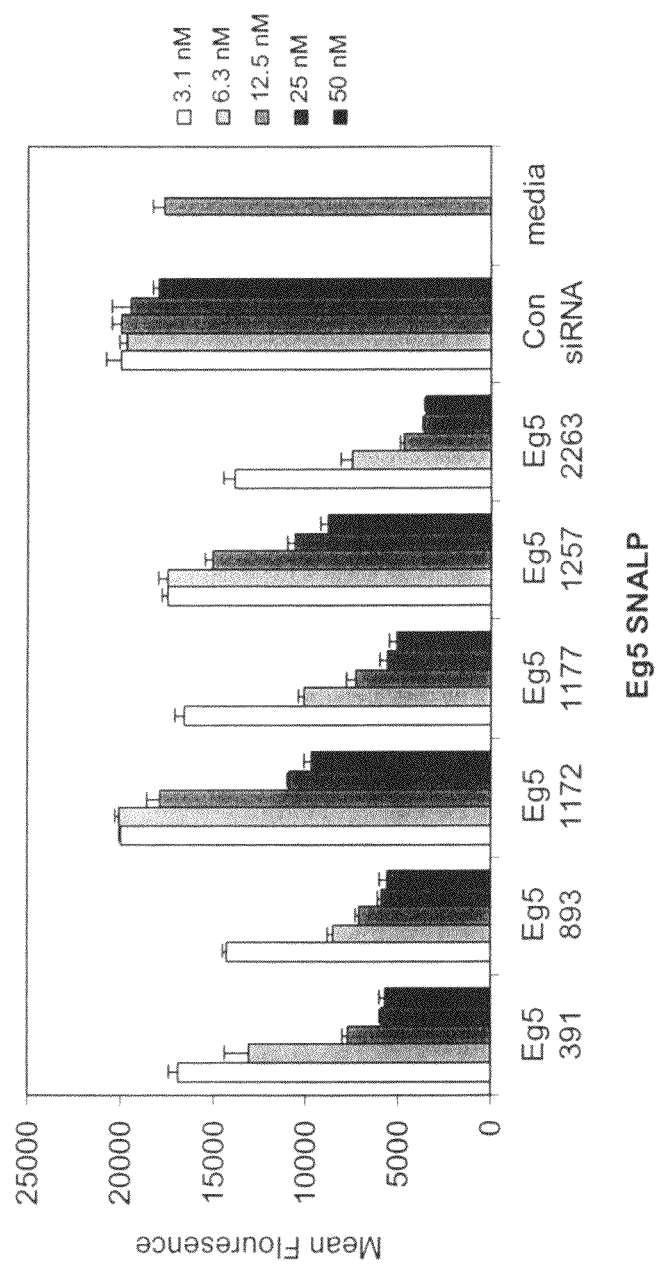
FIG. 3 illustrates data demonstrating RNAi activity of selected SNALP formulated Eg5 siRNA sequences in Neuro2A cells.

Various Eg5 siRNAs were formulated as SNALP (SNALP formulation: 2% PEG-cDMA, 40% DLinDMA, 10% DSPC, 48% cholesterol) and evaluated for their inhibitory effects on cell growth in vitro. The cells (i.e., Neuro2A cells) were treated with various SNALP formulated Eg5 siRNAs, at different concentrations i.e. 3.1 nM, 6.3 nM, 12.5 nM, 25 nM and 50 nM, and their effect on cell viability was evaluated (FIG. 3). Viability of cell cultures is expressed as mean fluorescence units.

Example 5

Dose Dependent Silencing of Eg5 mRNA in Human HepG2 Cell by Eg5 SNALP

Figure 4:
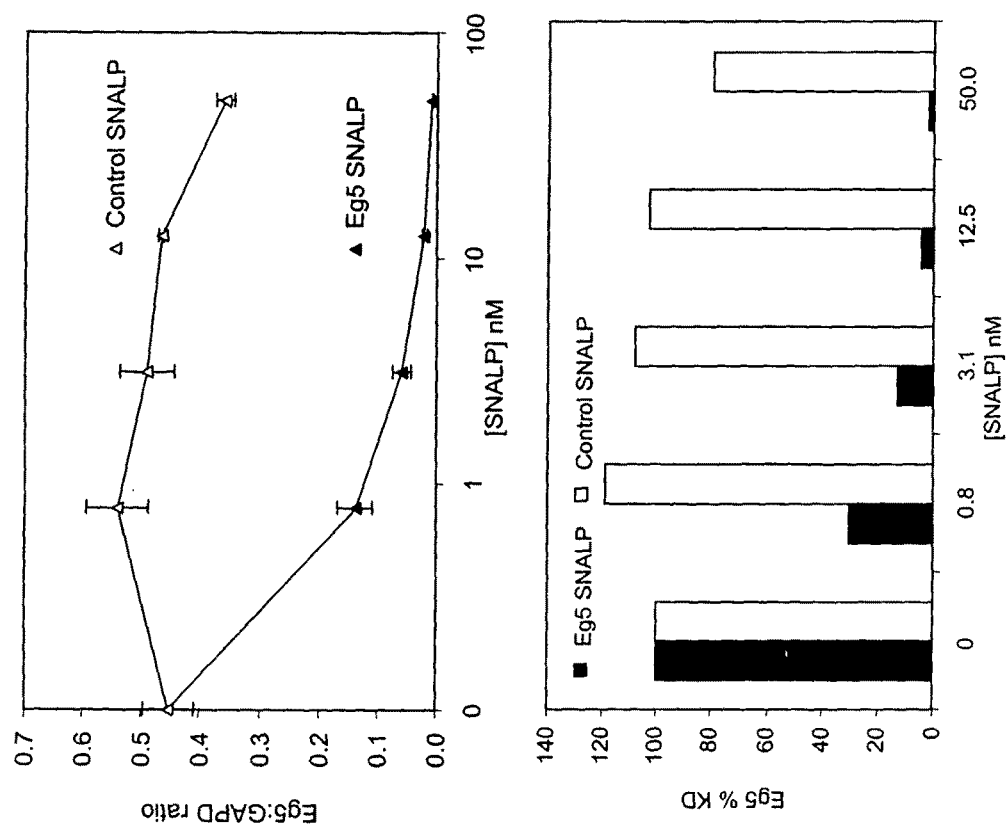
FIG. 4 illustrates data demonstrating that that the potent effects of Eg5 2263 U/U SNALP on cell viability is due to the silencing of Eg5 protein. Top panel: Eg5:GAPD mRNA ratios, bottom panel: Percent knockdown of Eg5 mRNA versus non-treated cells.

Human hepatocellular HepG2 cells were treated with either Eg5 2263 SNALP (SNALP formulation: 2% PEG-cDMA, 40% DLinDMA, 10% DSPC, 48% cholesterol) or control (i.e., a non-targeting siRNA) SNALP. Eg5 mRNA levels were measured after 48 h by a branched DNA assay. The results are shown in FIG. 4: Top Panel—Eg5:GAPD mRNA ratios; Bottom panel—% knockdown of Eg5 mRNA versus non-treated cells. The results confirm that the potent effects of Eg5 SNALP on cell viability is due to the silencing of Eg5 RNA.

Example 6

Cell Phenotype Changes Following Treatment with Eg5 siRNA

Control siRNA treated HeLa cells and Eg5 siRNA treated HeLa cells were analyzed by immunohistological staining (DAPI (DNA), blue; tubulin, green). The staining results showed that the control cells demonstrated typical mitotic phenotypes, while the Eg5 siRNA treated HeLa cells induced aberrant cell mitosis characterized by monoastral spindle formation due to Eg5 inhibition (FIG. 5).

Example 7

Anti-Proliferative Activity of Chemically Modified Eg5 2273 siRNA's

Figure 7:
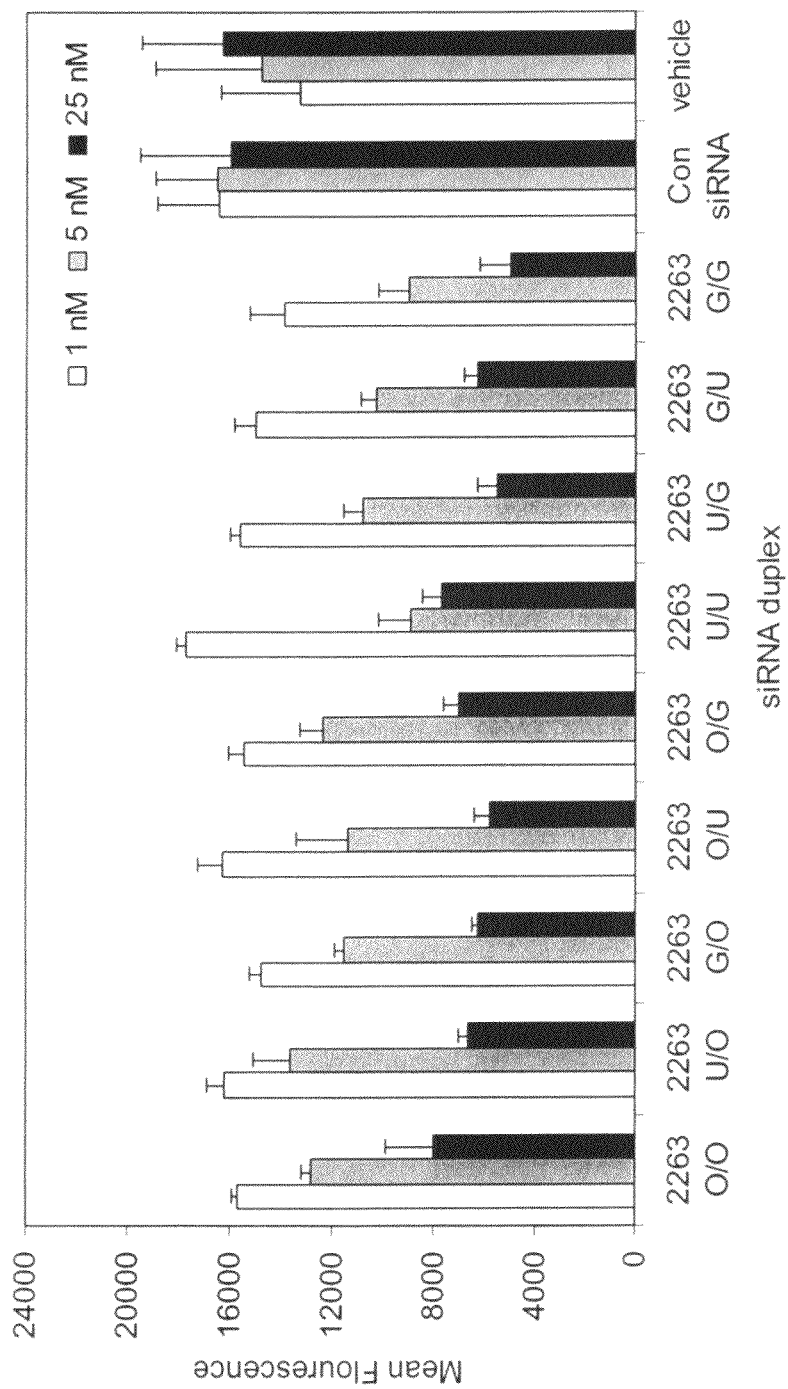
FIG. 7 illustrates data demonstrating the activity of 2'-OMe modified Eg5 2263 siRNAs in HeLa cells (human).
Figure 8:
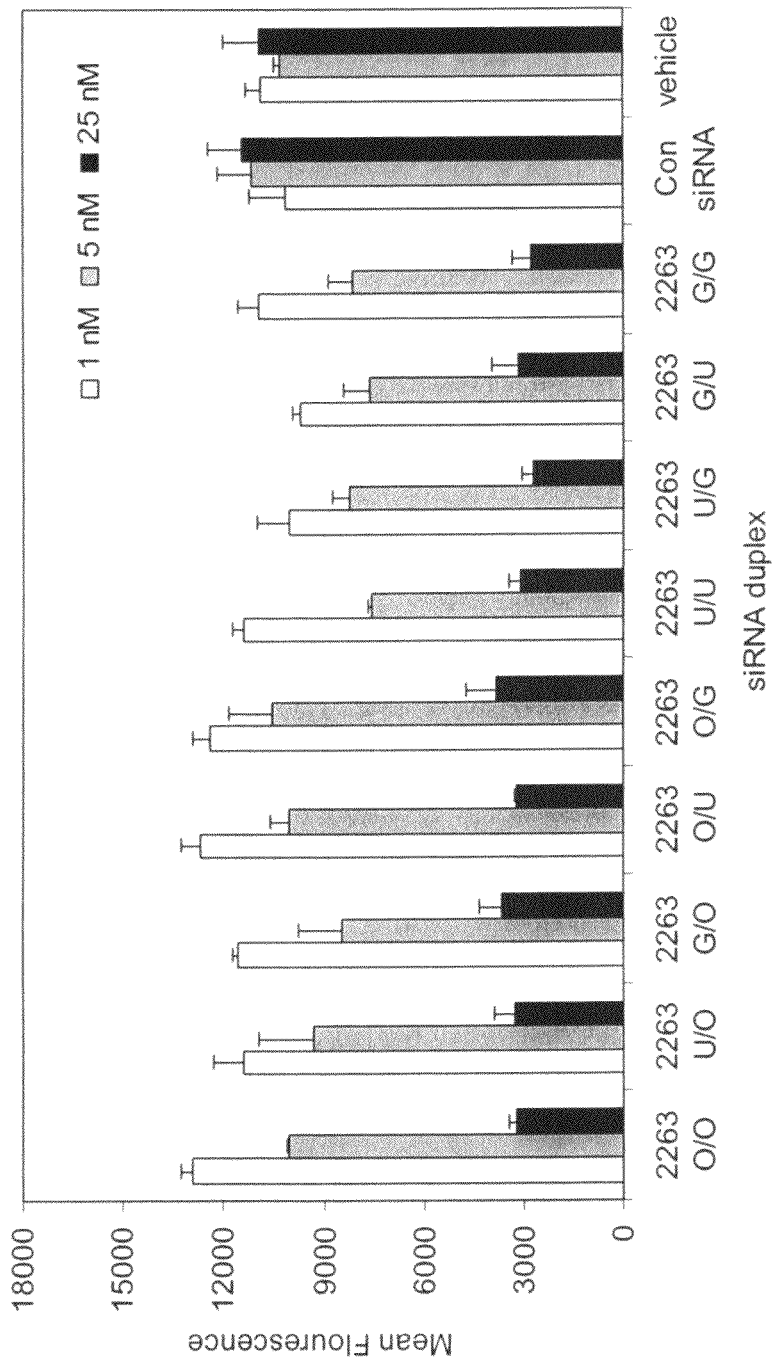
FIG. 8 illustrates data demonstrating the activity of 2'-OMe modified Eg5 2263 siRNAs in Neuro2A cells (mouse).

A panel (8 total) of 2'-OMe modified siRNAs of Eg5 2263 siRNA sequence was prepared and their RNAi activity was evaluated in HeLa human cells or Neuro2A mouse cells. The modifications involved introducing 2'-OMe guanosine or 2'-OMe uridine at selected positions in the sense or antisense strand the sequence modification are shown in (FIG. 6). The modified Eg5 2263 siRNAs incorporated less than 20% of chemically modified nucleosides. Anti-proliferative activity was evaluated in a cell viability bioassay (FIGS. 7, HeLa human cells; and FIG. 8 Neuro2A mouse cells). Cell viability of cell cultures was measured 48 hours after treatment and expressed as mean fluorescence units.

Example 8

In Vivo Cytokine Induction by Chemically Modified Eg5 2263 SNALP

Figure 9:
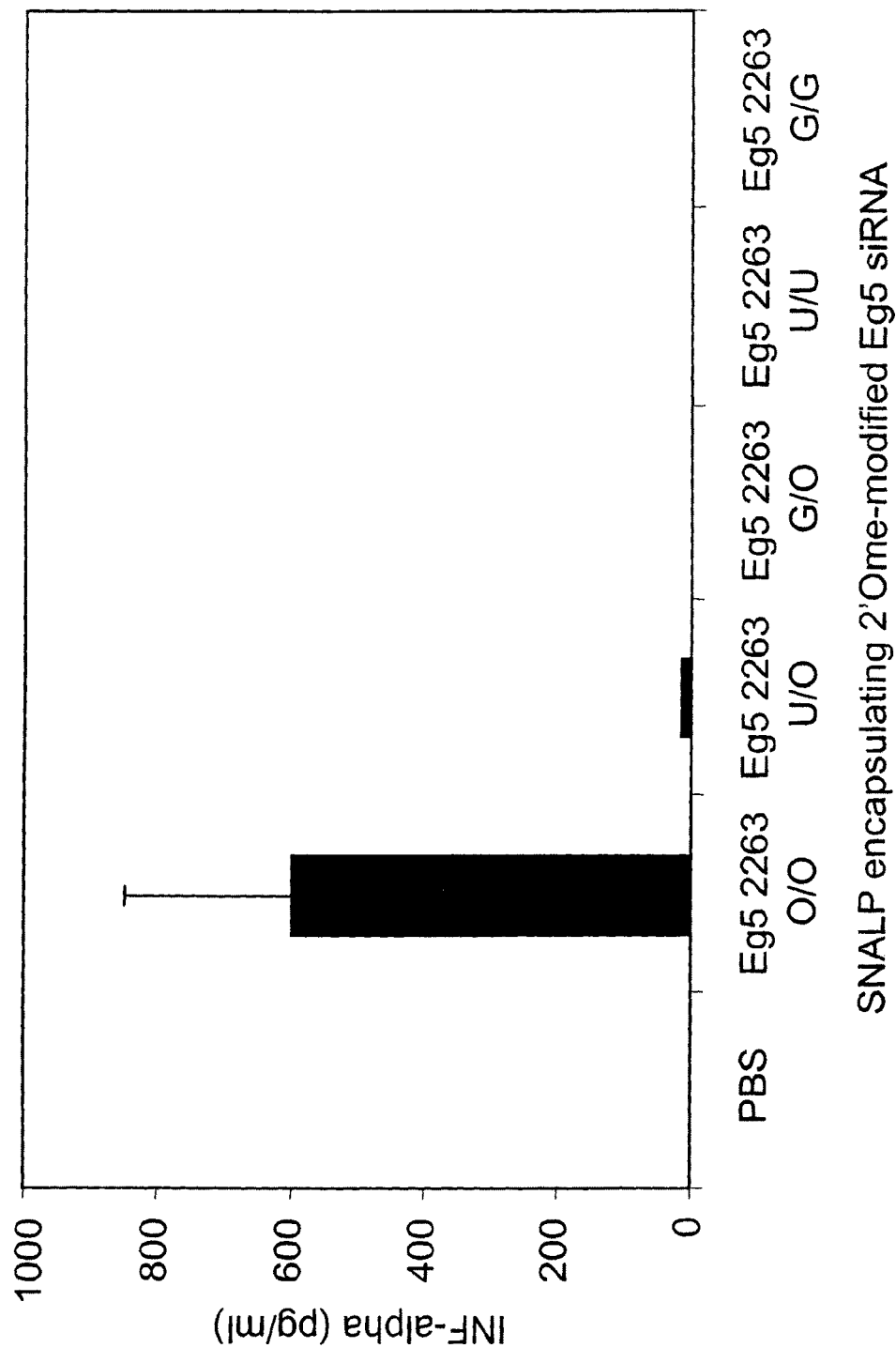
FIG. 9 illustrates data demonstrating the Interferon induction activity for various 2'-OMe modified Eg5 2263 siRNAs, (i.e., U/O, G/O, U/U, G/G) in a SNALP formulation.

Unmodified Eg5 2263 siRNA and certain 2'-OMe modified variants thereof (i.e., U/O, G/O, U/U and G/G) were formulated into SNALP (SNALP formulation: 2% PEG-cDMA, 40% DLinDMA, 10% DSPC, 48% cholesterol). These SNALP formulations were tested in vivo in to look for the induction of an immune response, e.g., cytokine induction. Balb/c mice (n=3/treatment group) were injected with 40 ug of the SNALP formulation and samples were collected 6 h post treatment with SNALP and tested for Interferon-alpha by ELISA assay. The results show that 2'-OMe modifications to Eg5 2263 siRNA abrogate Interferon induction associated with systemic administration of the native (unmodified) duplex (FIG. 9).

Example 9

Antibody Response Against the Delivery Vehicle for siRNA with Selectively 2'-OMe Modified Eg5 2263

Figure 10:
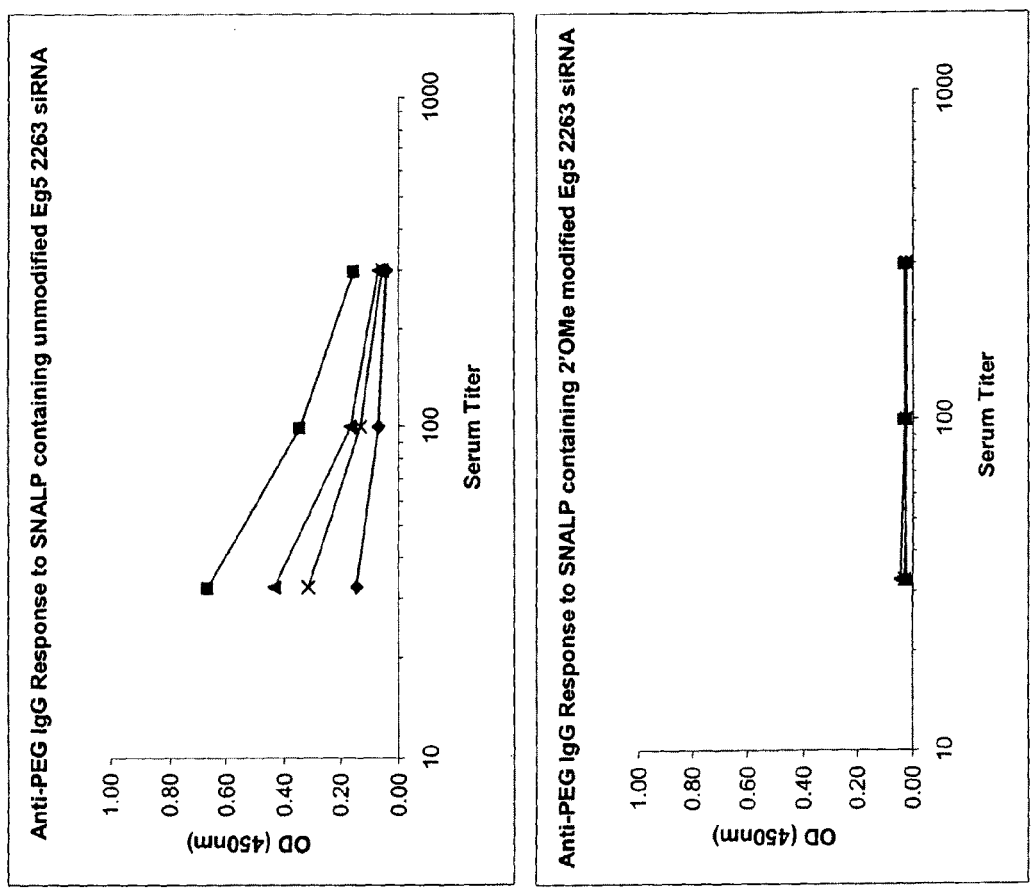
FIG. 10 illustrates data demonstrating the antibody response against the delivery vehicle for 2'-OMe modified Eg5 2663 U/U SNALP as compared to an unmodified Eg5 siRNA.

Unmodified Eg5 2263 siRNA and a 2'-OMe modified variant thereof (i.e., Eg5 2263 U/U siRNA) were formulated into SNALP (SNALP formulation: 2% PEG-cDMA, 40% DLinDMA, 10% DSPC, 48% cholesterol) and tested in vivo in mice (protocol: 3×2 mg/kg daily; serum assayed on day 10) to look for the induction of an immune response against the delivery vehicle (PEG). The results show that selective 2'-OMe modification to Eg5 2263 siRNA (e.g. U/U modified) abrogates the antibody response against the delivery vehicle that is associated with systemic administration of the native (unmodified) duplex. (FIG. 10). In FIG. 10, the top panel show PEG antibody levels in individual mice treated with unmodified Eg5 SNALP or with U/U modified Eg5 SNALP.

Example 10

The Anti-Cancer Activity of Eg5 U/U SNALP in a Range of Cancer Cell Lines

Figure 11:
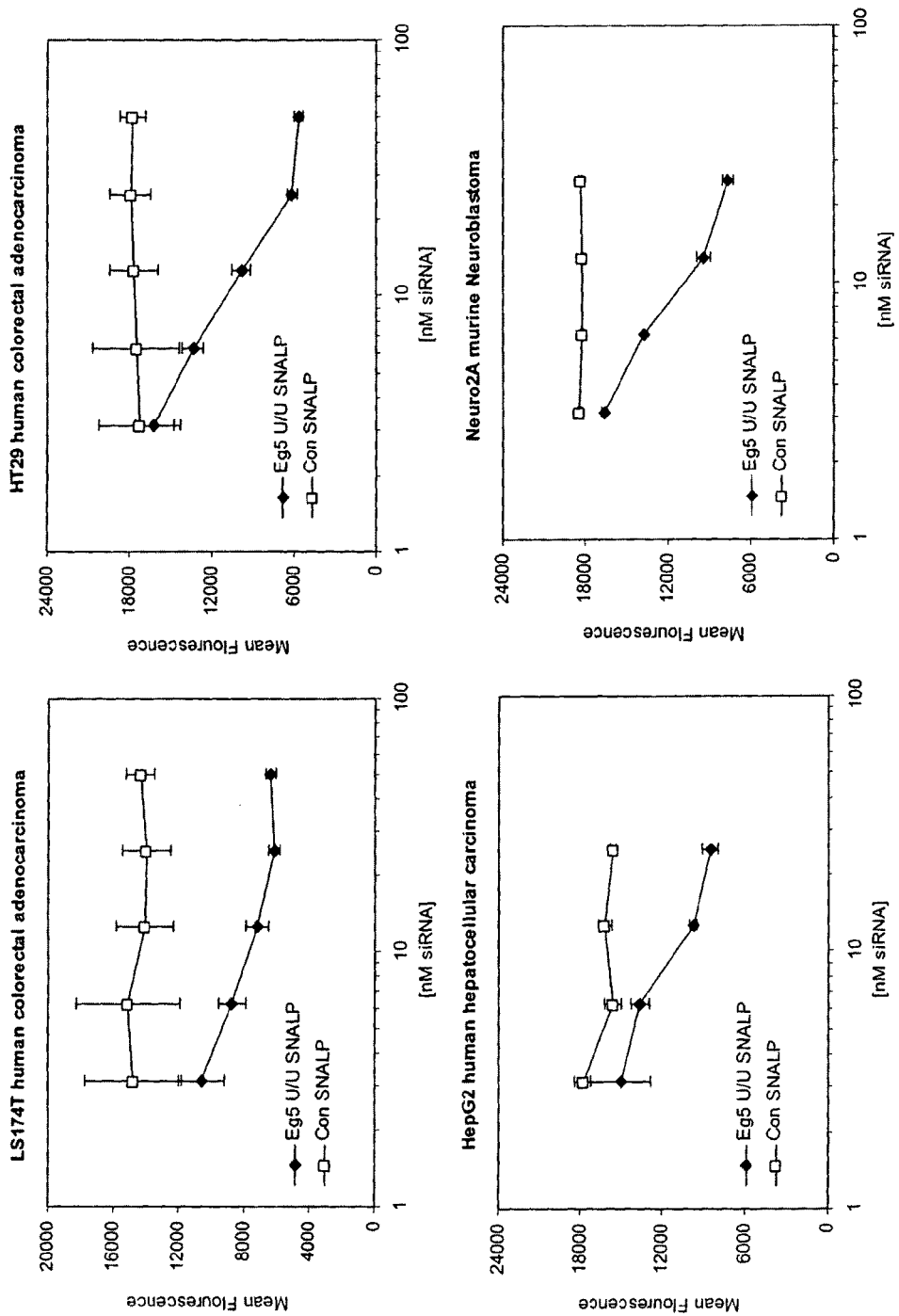
FIG. 11 illustrates data demonstrating the RNAi activity of 2'-OMe modified Eg5 2263 U/U SNALP against a range of tumor cells.
Figure 12:
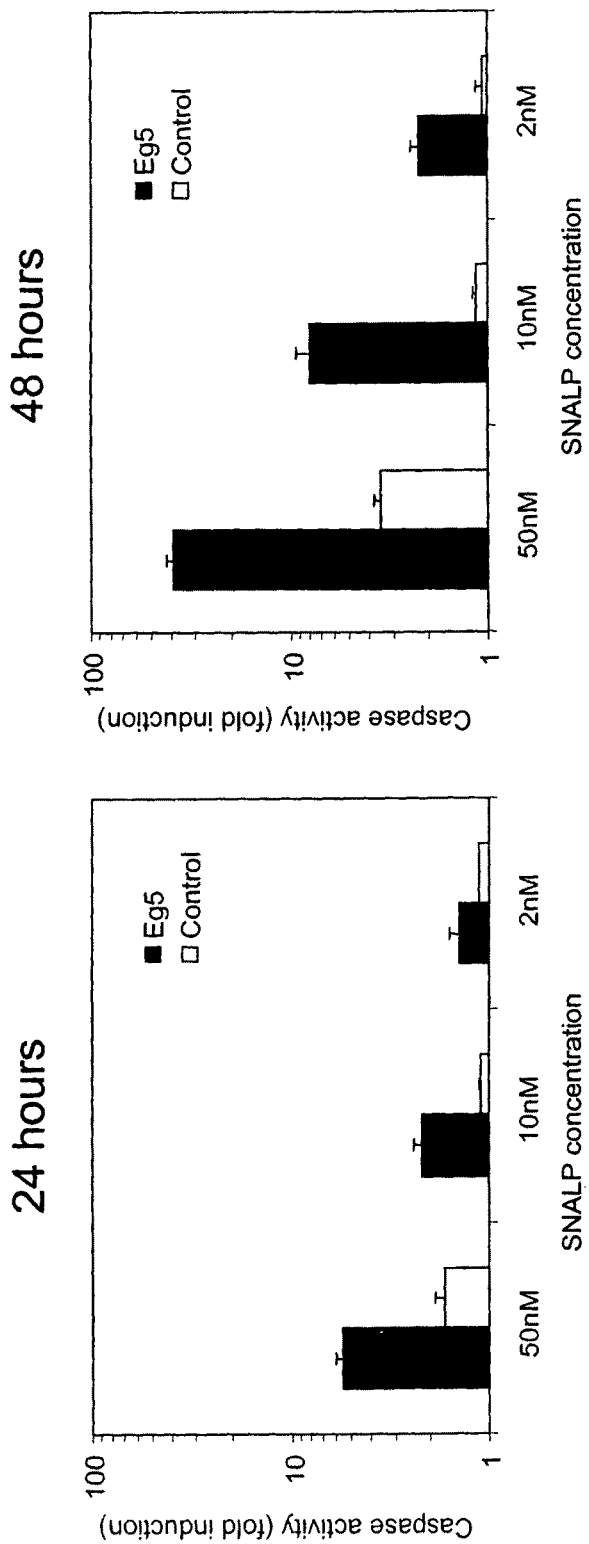
FIG. 12 illustrates data demonstrating the induction of apoptosis by Eg5 2263 U/U SNALP in human hepatocellular carcinoma cells.
Figure 13:
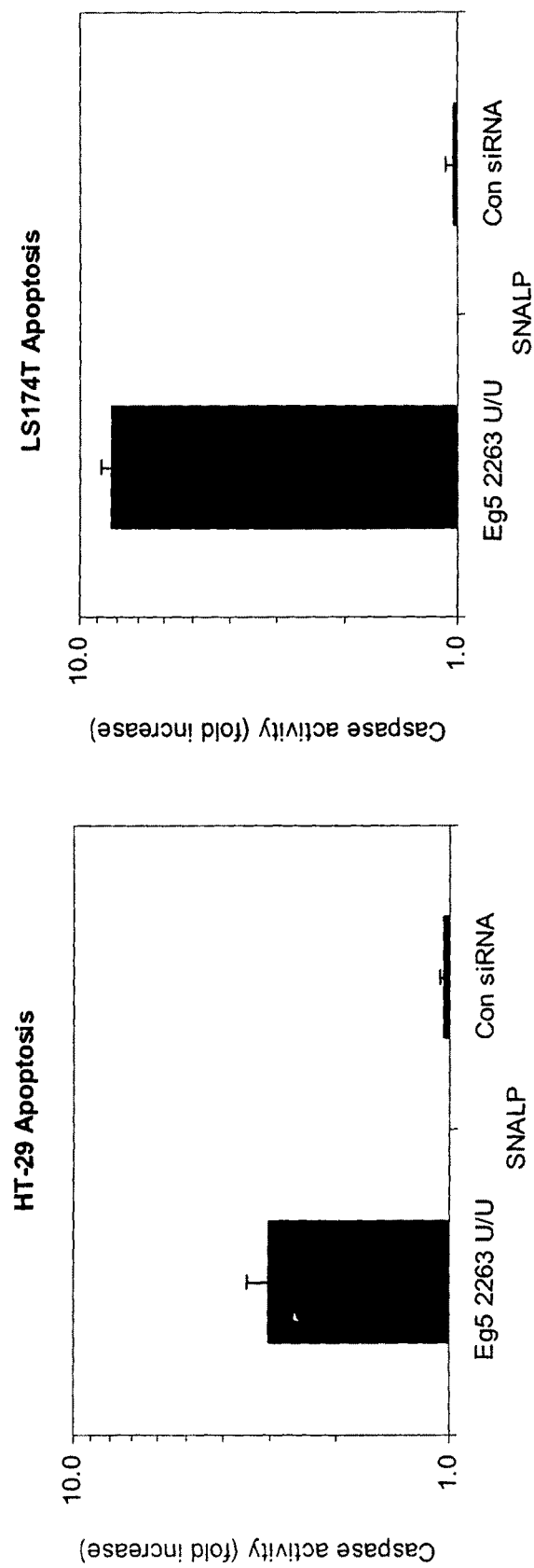
FIG. 13 illustrates data demonstrating the induction of apoptosis by Eg5 2263 U/U SNALP in human colorectal cancer cells.

The anti-cancer activity of Eg5 U/U SNALP was demonstrated against a range of cancer cell lines. Activity against the cell lines was monitored by a cell viability assay, and by an apoptosis assay as measured by Caspase 3/7 activation. Eg5 U/U SNALP specificity is confirmed by comparison with control SNALP containing non-targeting siRNA. FIG. 11 illustrates a decrease in cell viability in all cell lines tested after treatment with Eg5 U/U SNALP as compared to control. Upper left panel: LS174T human colorectal adenocarcinoma; Upper right panel: HT29 human colorectal adenocarcinoma; lower left panel: HepG2 human hepatocellular carcinoma; Lower right panel; Neuro2A murine Neuroblastoma. The induction of apoptosis by Eg5 SNALP U/U modified siRNA, as measured by Caspase 3/7 activity, was measured in human hepatocellular carcinoma cells and human colorectal cancer cells after 24 hours and after 48 hours. The Caspase 3/7 activity is expressed as fold induction over media only treated cells. FIG. 12 illustrates that apoptosis induction in human hepatocarcinoma cells is increased in Eg5 2263 U/U SNALP as compared to control siRNA. FIG. 13 illustrates that apoptosis induction is increased in Eg5 2263 U/U SNALP in human colorectal cancer cells (HT-29 and LS 174T) as compared to control.

Example 11

Comparison Between Eg5 2263 U/U SNALP Vs. Small Molecule Eg5 Inhibitor Drug

Figure 14:
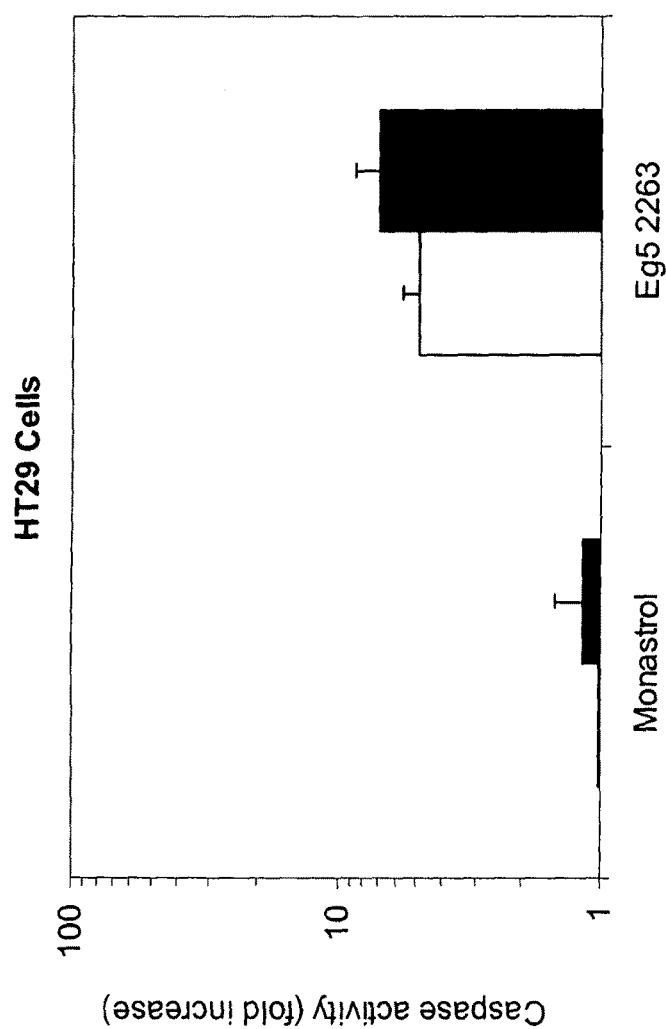
FIG. 14 illustrates data comparing the induction of apoptosis by Eg5 2263 U/U SNALP with a small molecule Eg5 inhibitor in human colorectal cells.
Figure 15:
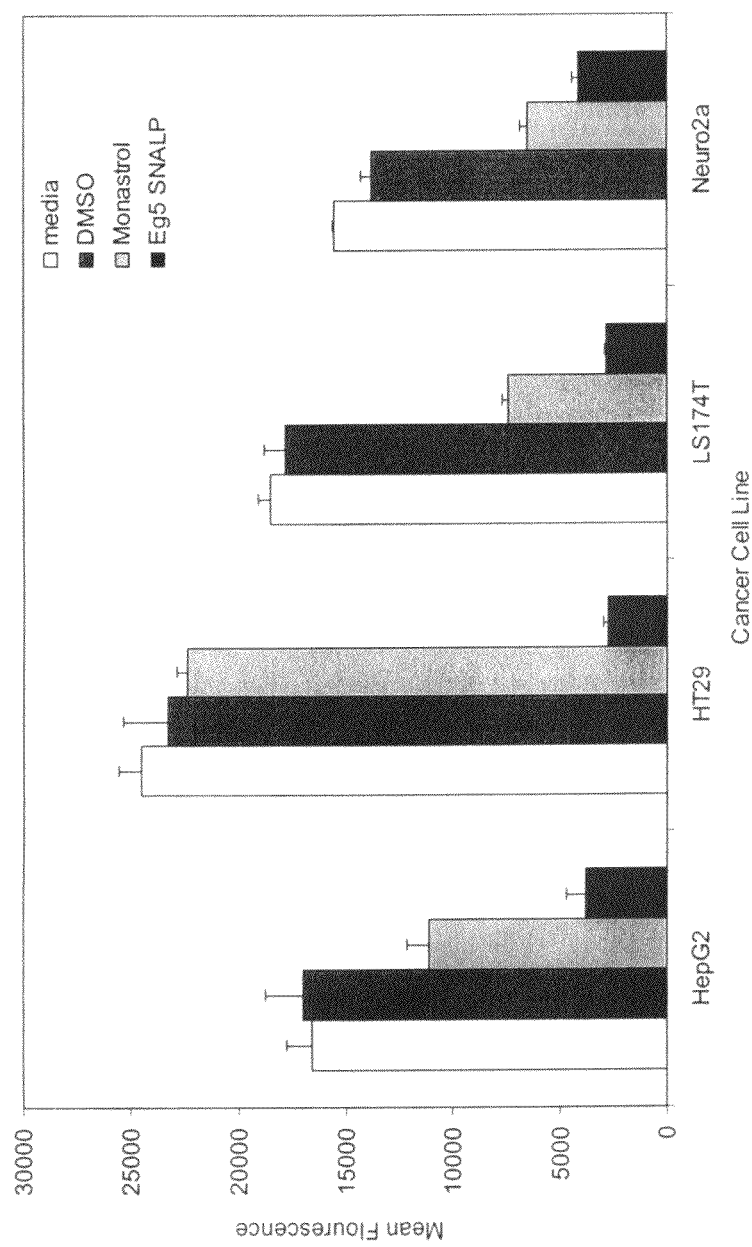
FIG. 15 illustrates data comparing the RNAi activity of Eg5 2263 U/U SNALP vs. a small molecule Eg5 inhibitor in a variety of cancer cells.

There are currently several small molecule Eg5 inhibitors under clinical evaluation. Recent publications indicate that certain cancer cell lines (e.g., HT-29 colorectal adenocarcinoma cells) are resistant to apoptosis induction by small molecule Eg5 inhibitors. A comparison of apoptosis activity, via a comparison of Caspase 3/7 induction activity, in HT-29 colorectal adenocarcinoma cells (a small molecule Eg5 inhibitor resistant cell type) after treatment with a small molecule Eg5 inhibitor (i.e, Monastrol at 50 or 100 uM concentration), or with Eg5 2263 U/U SNALP (at 25 or 50 nM concentration) demonstrates that cells lines that are resistant to small molecule Eg5 inhibitors are highly sensitive to Eg5 SNALP (FIG. 14). A comparison of Eg5 2263 U/U SNALP with the small molecule Eg5 inhibitor, monastrol, in the inhibition of various cancer cell lines, as measure by cell viability assays, demonstrates that Eg5 2263 U/U SNALP is superior at inhibiting cell growth in these cancer cell lines than monastrol (FIG. 15). The results of these experiments shows that SNALP can confer advantages over conventional small molecule drugs as anti-cancer agents.

Example 12

Serum Nuclease Protection Assay

Figure 16:
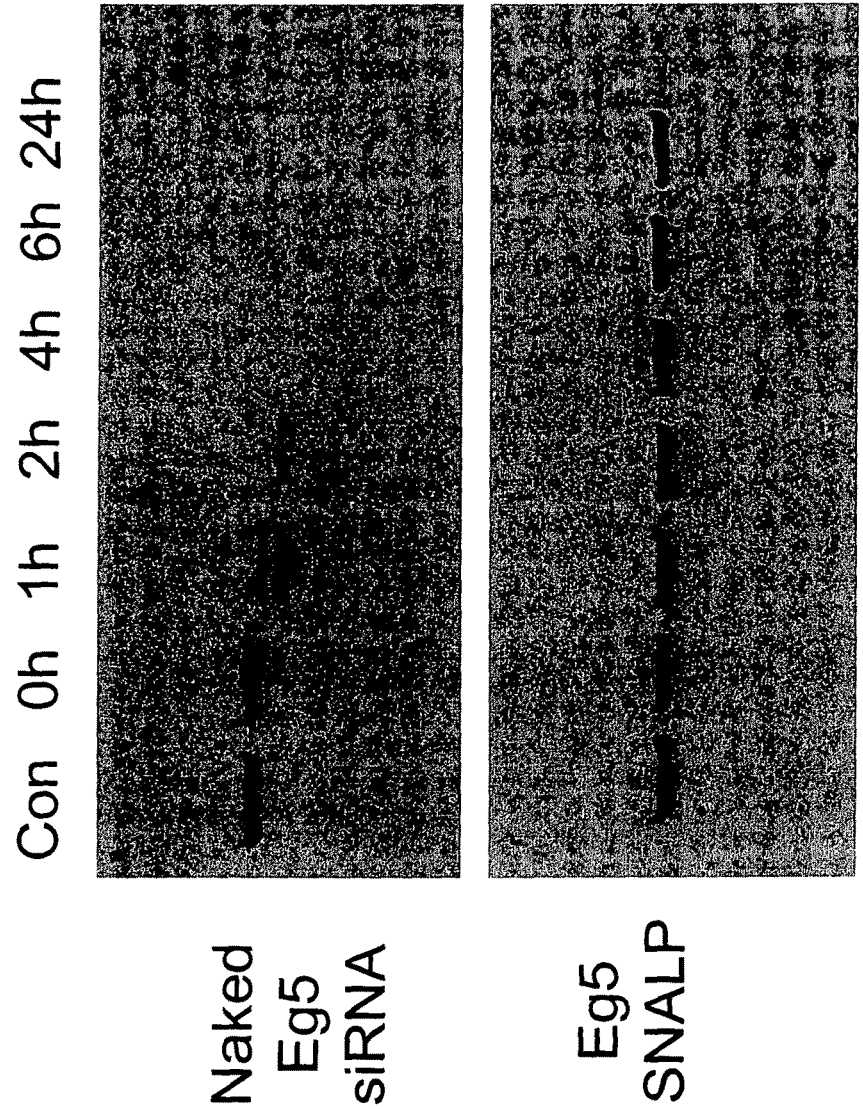
FIG. 16 illustrates data demonstrating the stability of naked Eg5 siRNA and SNALP encapsulated Eg5 O/O siRNA toward serum nuclease degradation.

Naked Eg5 siRNA and SNALP encapsulated Eg5 siRNA were subjected to serum nuclease degradation. The result in the serum nuclease protection assay (presented in FIG. 16)

Example 13

In Vivo Activity of Eg5 SNALP in Tumor Bearing Mice

Figure 17:
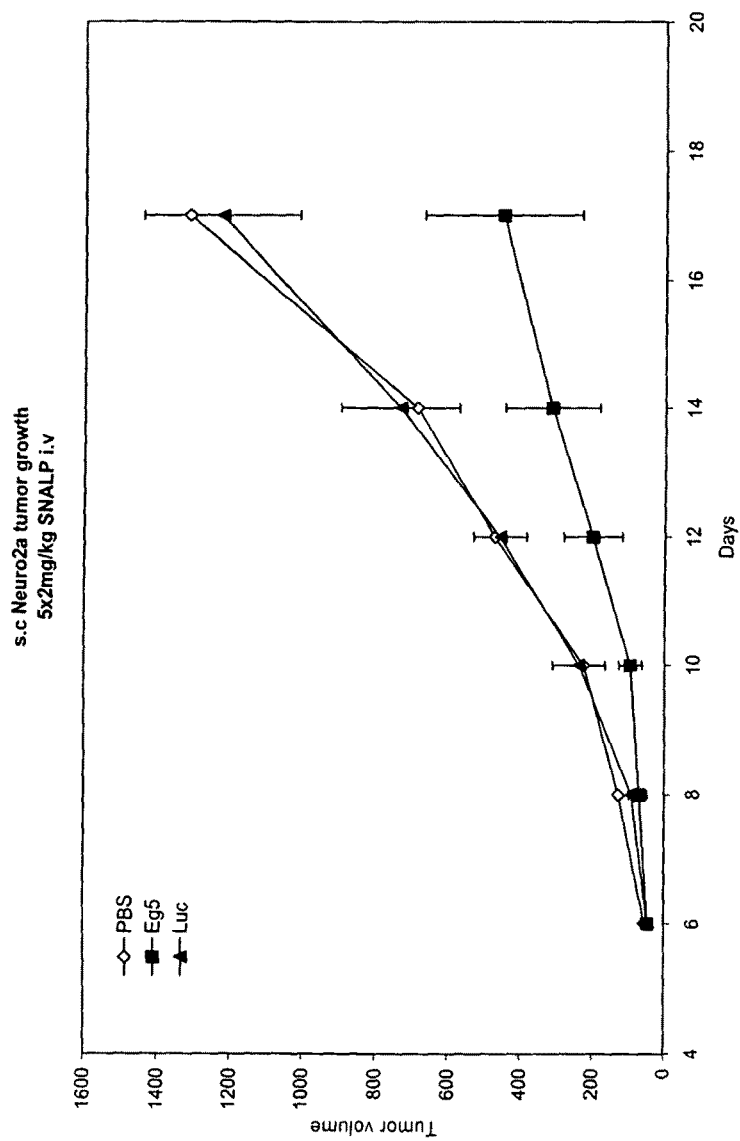
FIG. 17 illustrates data demonstrating in vivo s.c. tumor growth of Neuro2A after treatment with Eg5 2263 U/U SNALP.
Figure 18:
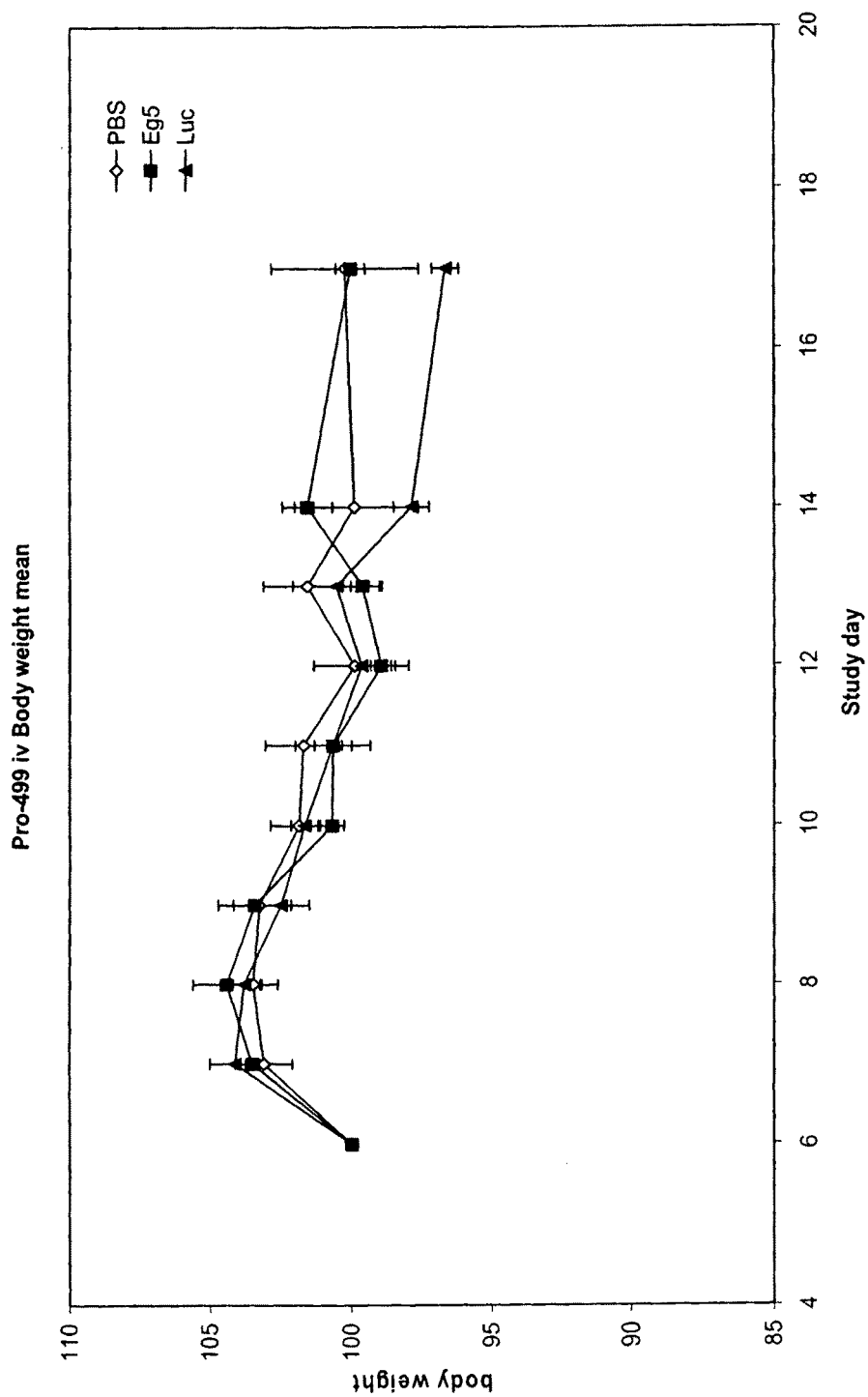
FIG. 18 illustrates data demonstrating that in vivo dosing with Eg5 2263 U/U SNALP in mice bearing s.c. Neuro2A tumors is well tolerated.

Anti-tumor effects of Eg5 2263 U/U SNALP (2% PEG-cDSA, 40% DLinDMA, 10% DSPC, 48% cholesterol), as compared to SNALP containing control siRNA (Luc), was evaluated in a subcutaneous model in mice. A/J mice bearing s.c. Neuro2A tumors were treated with SNALP at 5×2 mg/kg daily (d6-10) by i.v. administration. Tumors were measured by calipers and recorded as tumor volume. The results of this study demonstrates that Eg5 2263 U/U SNALP exerts a specific anti-tumor effect in a s.c. tumor model (FIG. 17). Additionally, therapeutic dosing is well tolerated in tumor-bearing mice (FIG. 18).

Example 14

In Vivo Activity of Eg5 SNALP in Tumor Bearing Mice

Figure 19:
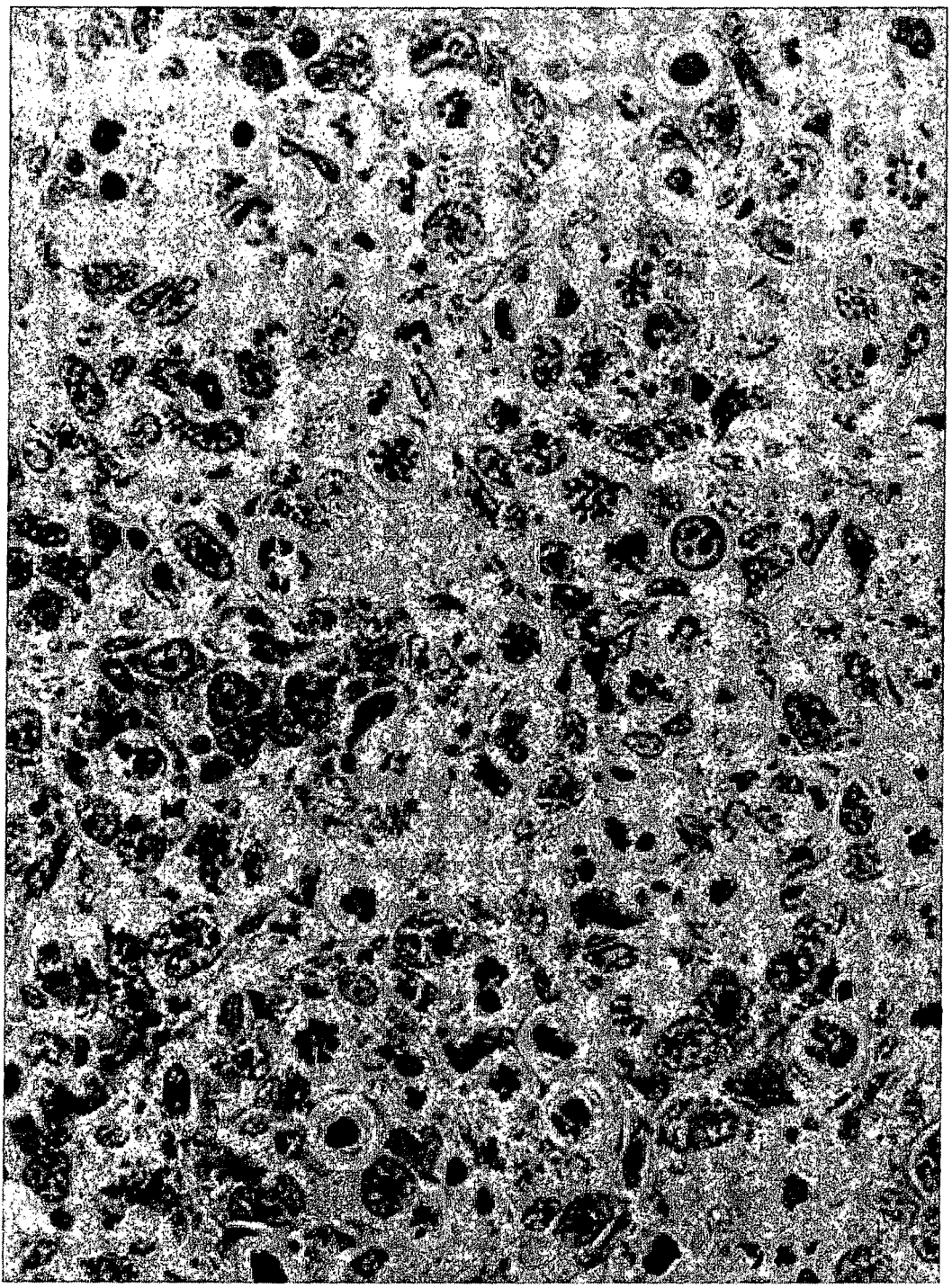
FIG. 19 illustrates data showing that the tumor histopathology of the intrahepatic Neuro2A tumor that was treated with Eg5 2263 U/U SNALP.
Figure 20:
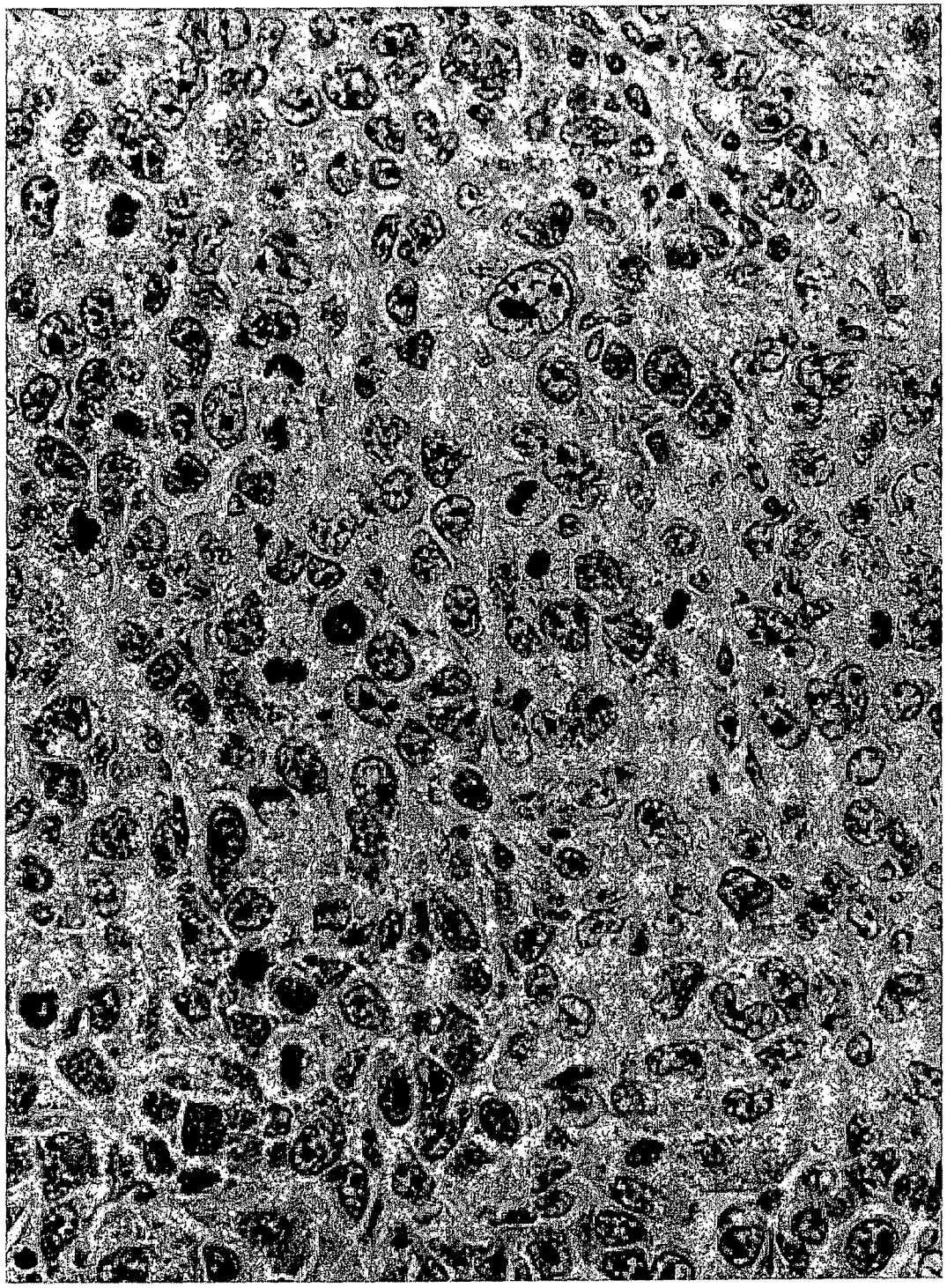
FIG. 20 illustrates data showing the tumor histopathology of the intrahepatic Neuro2A tumor that was treated with control SNALP

Anti-tumor effects of Eg5 2263 U/U SNALP (2% PEG-cDMA, 40% DLinDMA, 10% DSPC, 48% cholesterol), as compared to SNALP containing control siRNA (Luc), was evaluated in an intrahepatic tumor model in mice. In this study, A/J mice were seeded with 100,000 Neuro2A cells by intrahepatic injection. On day 12, the mice were treated with Eg5 2263 U/U SNALP (n=6) or control siRNA (Luc SNALP; n=5). The mice were dosed at 3 mg/kg at t=0 h and at t=6 h, for a cumulative dosage of 6 mg/kg. The livers were collected 30 h after the first dose (d13), and formalin-fixed for conventional histology. The tissues were processed and stained with H&E. Tumor histology showed that Eg5 2263 U/U SNALP treated mice induced extensive phenotypic changes (e.g., aberrant mitosis and apoptosis) in the intrahepatic tumor cells, which is characteristic of Eg5 inhibition, as compared to control treated subjects. FIG. 19 shows the tumor histopathology of the intrahepatic Neuro2A tumor that was treated with Eg5 2263 U/U SNALP. Histology shows numerous tumor cells with atypical mitotic figures and apoptotic bodies characteristic of Eg5 inhibition. FIG. 20 shows the tumor histopathology of the intrahepatic Neuro2A tumor that was treated with control SNALP. Histology results shows numerous tumor cells with normal mitotic figures.

Example 15

In Vitro Activity of EGFr siRNA

Figure 30:
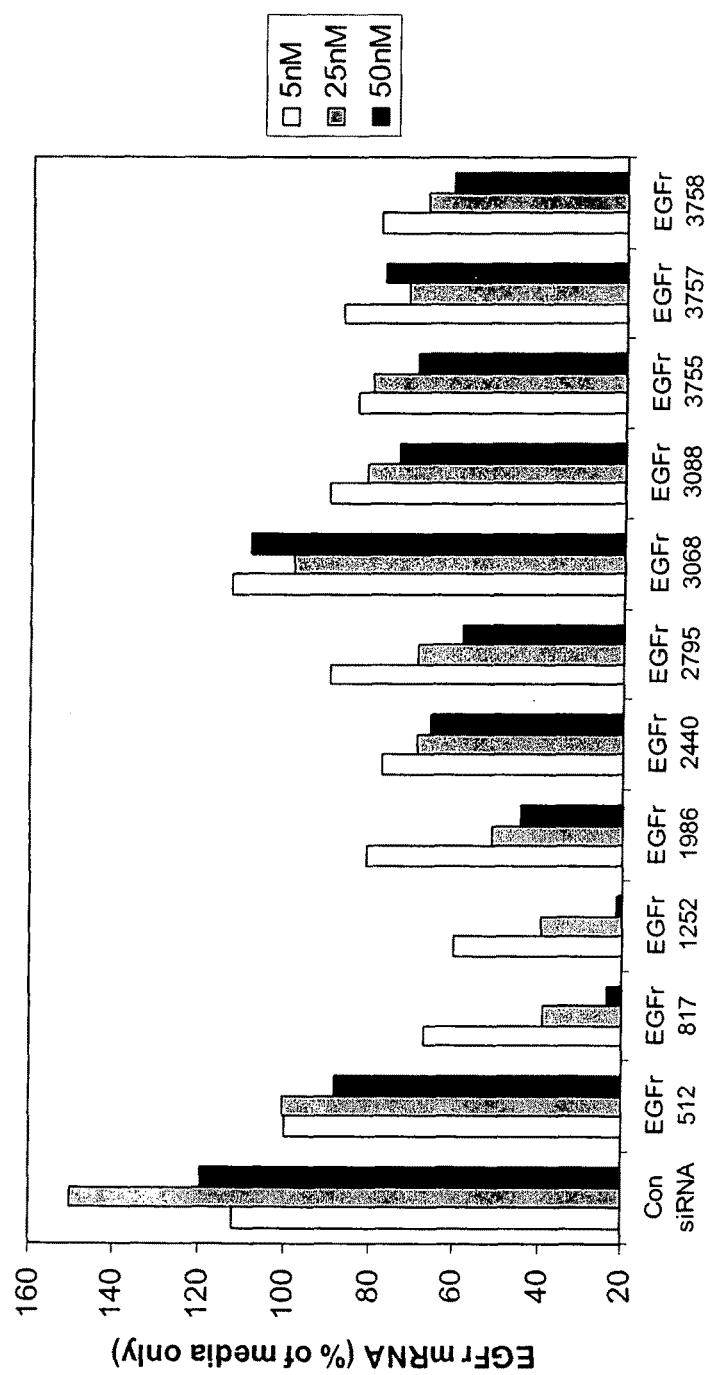
FIG. 30 illustrates data showing in vitro silencing of EGFR mRNA by the panels of EGFR siRNA sequences set forth in Tables 3 and 4.

A431 carcinoma cells were treated with increasing concentrations of lipofectamine complexed EGFr or non-targeting control siRNA. EGFr mRNA levels were quantitated by branched DNA assay after 48 h culture. EGFr mRNA values are expressed as % of media treated cells. As shown in FIG. 30, EGFr sequences 817 and 1252 and 1986 displayed the greatest levels of mRNA silencing.

Figure 31:
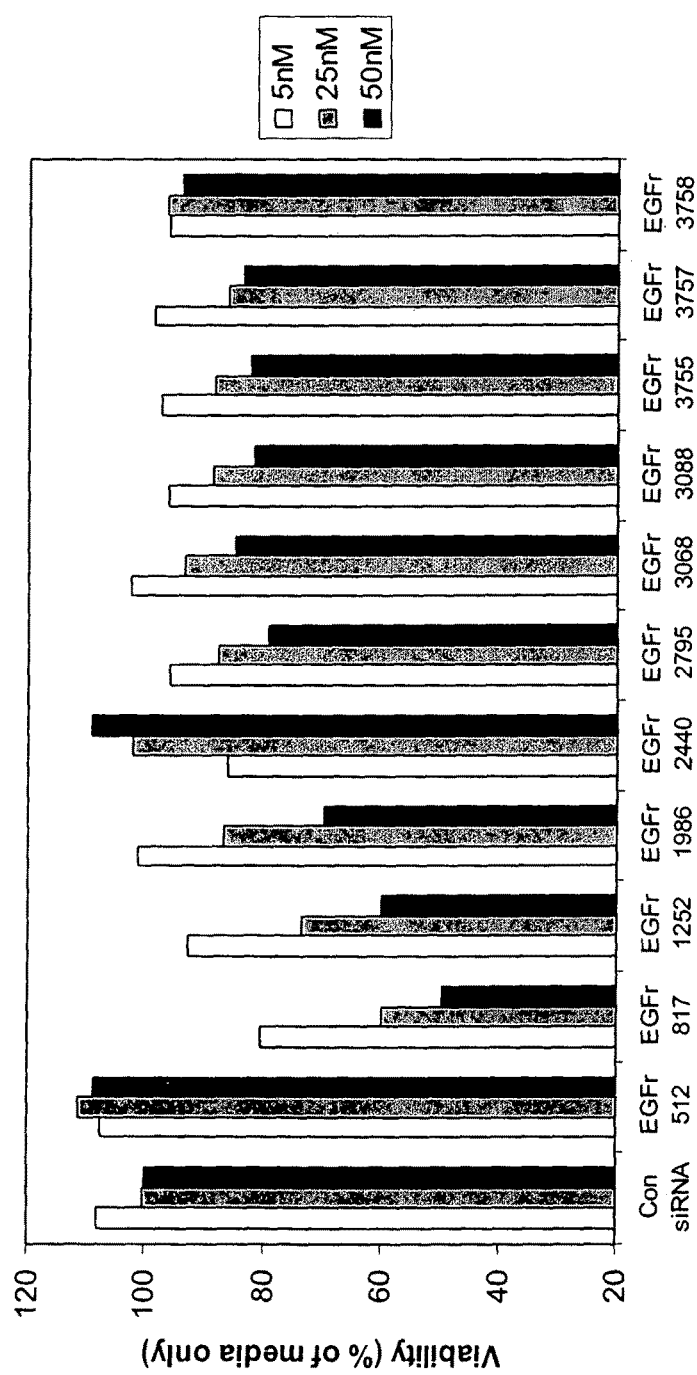
FIG. 31 illustrates data showing the silencing of EGFR mRNA correlates with a decrease in tumor cell viability.

Cell viability was also quantitated by CellTiter Blue fluorescence assay after 48 h culture. inability scores are expressed as % of media treated cells. As shown in FIG. 31, EGFr sequences 817 and 1252 and 1986 that displayed the greatest levels of mRNA silencing also show the most significant effects on cell viability.

Example 16

In Vitro Activity of EGFr siRNA

Figure 32:
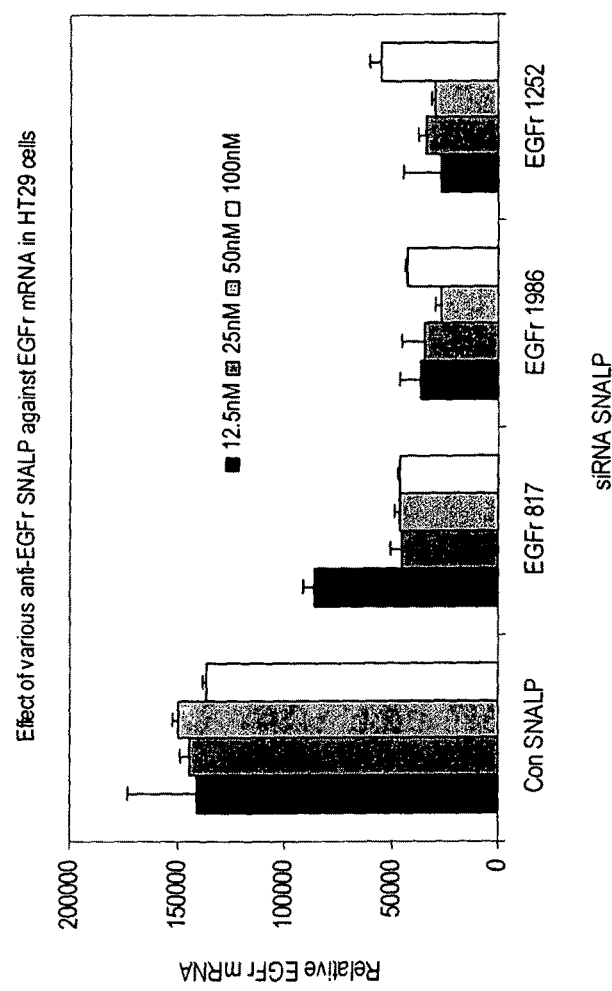
FIG. 32 illustrates data showing in vitro silencing of EGFR mRNA by EGFR SNALP.

HT-29 tumor cells were treated with increasing concentrations of EGFr sequences 817 and 1252 and 1986 siRNA sequences or a non-targeting control siRNA formulated in SNALP. EGFr mRNA levels were measured 48 h after SNALP treatment by bDNA assay. As shown in FIG. 32, EGFr sequences 817 and 1252 and 1986 siRNA formulated in SNALP silence EGFR siRNA.

Example 17

In Vitro Activity of XIAP SNALP

Figure 33:
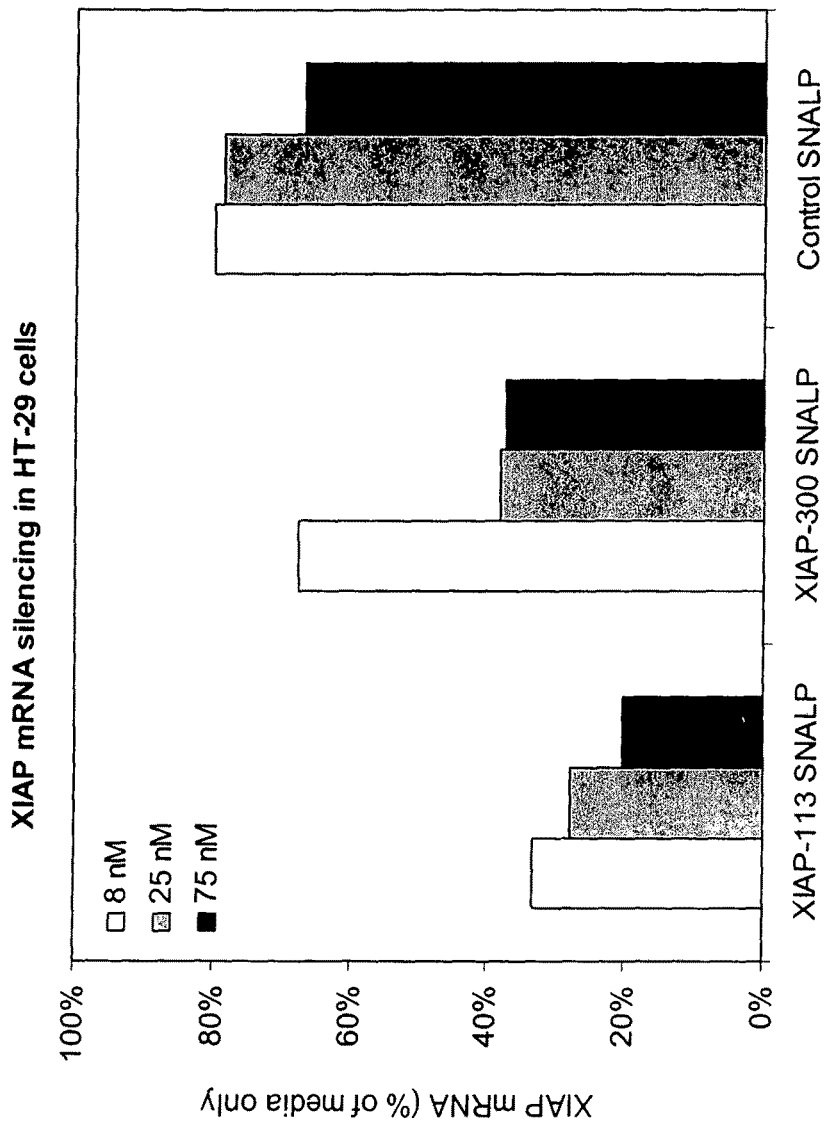
FIG. 33 illustrates data showing in vitro silencing of XIAP mRNA by XIAP SNALP.

SNALP containing XIAP-113, XIAP-300 or non-targeting control siRNA were applied to HT-29 cells in vitro at various concentrations. 48 h later, XIAP mRNA levels were measured by bDNA assay and expressed as % of media treated cells. As shown in FIG. 33, XIAP-113 SNALP causes significant, dose-dependent decreases in XIAP mRNA levels

Example 18

In Vitro Activity of XIAP SNALP

Figure 34:
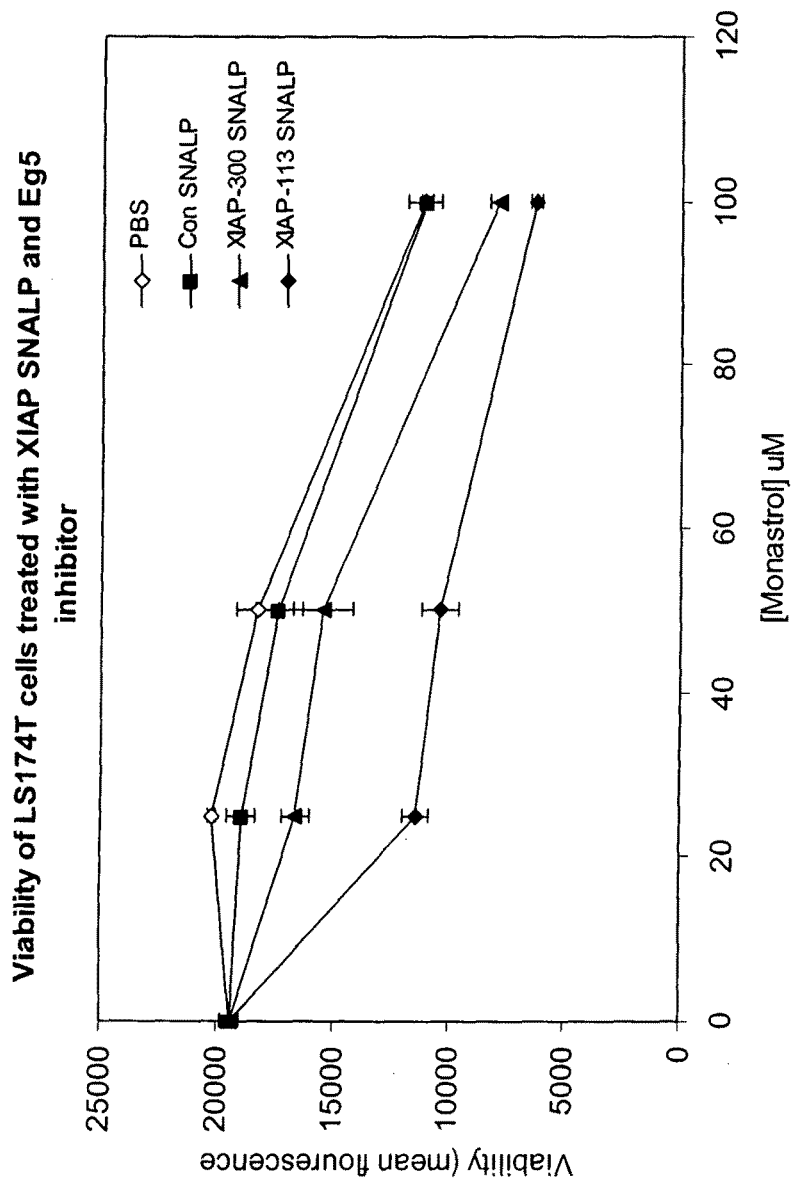
FIG. 34 illustrates data showing the cells treated with XIAP SNALP are sensitized to Eg5 inhibitors.

SNALP containing XIAP-113, XIAP-300 or non-targeting control siRNA were applied to LS174T colon adenocarcinoma cells in vitro at 35 nM siRNA. Cells were then treated with monastrol, a small molecule inhibitor of Eg5. Viability of cell cultures was assessed after 48 h. As shown in FIG. 34, XIAP-113 and -300 SNALP sensitize human colon cancer cells to the cytotoxic effects of the Eg5 inhibitor. Degree of sensitization correlates with the relative potency of mRNA silencing by these SNALP

Example 19

In Vitro Activity of Eg5 SNALP in in Combination with XIAP SNALP

Figure 35:
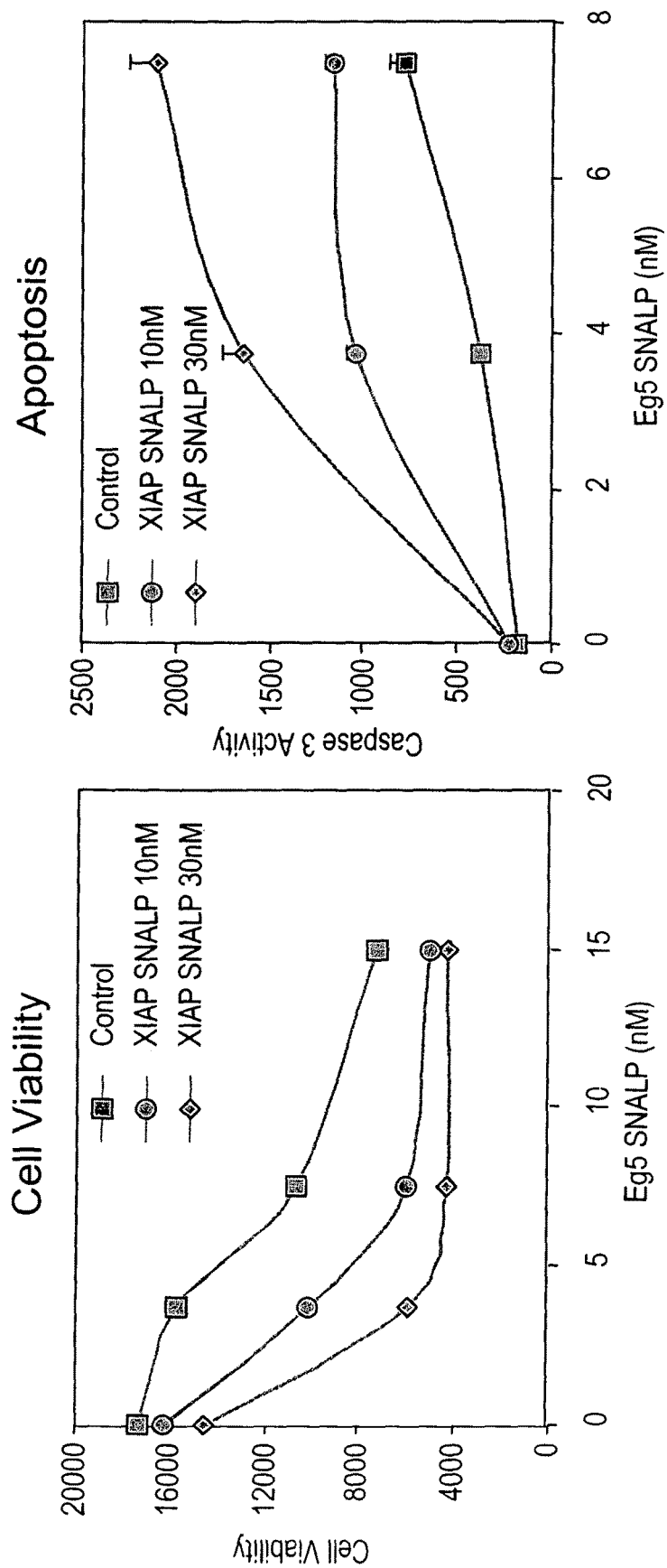
FIG. 35 illustrates data showing that silencing of XIAP mRNA with XIAP SNALP sensitizes tumor cells to killing by Eg5 SNALP.

HT29 colon cancer cells were co-cultured with 10 nM or 30 nM XIAP-113 SNALP plus increasing concentrations of Eg5 2263 SNALP. Cell viability and caspase 3/7 activity were assayed after 48 h culture. As shown in FIG. 35, co-administration of XIAP SNALP sensitizes HT29 cells to killing by Eg5 SNALP, as demonstrated by significant increases in the level of apoptosis and corresponding decrease in cell viability in the cultures.

It is to be understood that the above description is intended to be illustrative and not restrictive. Many embodiments will be apparent to those of skill in the art upon reading the above description. The scope of the invention should, therefore, be determined not with reference to the above description, but should instead be determined with reference to the appended claims, along with the full scope of equivalents to which such claims are entitled. The disclosures of all articles and references, including patent applications, patents, PCT publications, and Accession Nos. are incorporated herein by reference for all purposes.

SEQUENCE LISTING (18497 sequences)

SEQ ID NO: 1 - DNA, 21 bp, Artificial Sequence
  mitotic kinesin microtubule-associated protein Eg5 2263 siRNA sense
  Description of Combined DNA/RNA Molecule:mitotic kinesin microtubule-associated protein Eg5 2263 siRNA sense
cugaagaccugaagacaautt

SEQ ID NO: 2 - DNA, 21 bp, Artificial Sequence
  mitotic kinesin microtubule-associated protein Eg5 2263 siRNA antisense
  Description of Combined DNA/RNA Molecule:mitotic kinesin microtubule-associated protein Eg5 2263 siRNA antisense
auugucuucaggucuucagtt

SEQ ID NO: 3 - DNA, 21 bp, Artificial Sequence
  mitotic kinesin microtubule-associated protein Eg5 2263 siRNA sense modified by 2'-OMe
  Description of Combined DNA/RNA Molecule:mitotic kinesin microtubule-associated protein Eg5 2263 siRNA sense modified by 2'-OMe
  modified_base (1)...(21): um
cngaagaccngaagacaantt

SEQ ID NO: 4 - DNA, 21 bp, Artificial Sequence
  mitotic kinesin microtubule-associated protein Eg5 2263 siRNA sense modified by 2'-OMe
  Description of Combined DNA/RNA Molecule:mitotic kinesin microtubule-associated protein Eg5 2263 siRNA sense modified by 2'-OMe
  modified_base (1)...(21): gm
cunaanaccunaanacaautt

SEQ ID NO: 5 - DNA, 21 bp, Artificial Sequence
  mitotic kinesin microtubule-associated protein Eg5 2263 siRNA antisense modified by 2'-OMe
  Description of Combined DNA/RNA Molecule:mitotic kinesin microtubule-associated protein Eg5 2263 siRNA antisense modified by 2'-OMe
  modified_base (1)...(21): um
auugucuncaggncuncagtt

SEQ ID NO: 6 - DNA, 21 bp, Artificial Sequence
  mitotic kinesin microtubule-associated protein Eg5 2263 siRNA antisense modified by 2'-OMe
  Description of Combined DNA/RNA Molecule:mitotic kinesin microtubule-associated protein Eg5 2263 siRNA antisense modified by 2'-OMe
  modified_base (1)...(21): gm
auunucuucagnucuucantt

SEQ ID NO: 7 - RNA, 19 nt, Artificial Sequence
  mitotic kinesin microtubule-associated protein Eg5 (Kif11) siRNA sense strand
uccaggugguggugagaug

SEQ ID NO: 8 - RNA, 19 nt, Artificial Sequence
  mitotic kinesin microtubule-associated protein Eg5 (Kif11) siRNA sense strand
ggugguggugagaugcaga

SEQ ID NO: 9 - RNA, 19 nt, Artificial Sequence
  mitotic kinesin microtubule-associated protein Eg5 (Kif11) siRNA sense strand
uaugguguuuggagcaucu

SEQ ID NO: 10 - RNA, 19 nt, Artificial Sequence
  mitotic kinesin microtubule-associated protein Eg5 (Kif11) siRNA sense strand
ugguguuuggagcaucuac

SEQ ID NO: 11 - RNA, 19 nt, Artificial Sequence
  mitotic kinesin microtubule-associated protein Eg5 (Kif11) siRNA sense strand
uguuuaccgaaguguuguu

SEQ ID NO: 12 - RNA, 19 nt, Artificial Sequence
  mitotic kinesin microtubule-associated protein Eg5 (Kif11) siRNA sense strand
aguguuguuuguccaauuc

SEQ ID NO: 13 - RNA, 19 nt, Artificial Sequence
  mitotic kinesin microtubule-associated protein Eg5 (Kif11) siRNA sense strand
guguuguuuguccaauucu

SEQ ID NO: 14 - DNA, 19 bp, Artificial Sequence
  mitotic kinesin microtubule-associated protein Eg5 (Kif11) siRNA sense strand
tgaaguuauuaugggcuau

SEQ ID NO: 15 - RNA, 19 nt, Artificial Sequence
  mitotic kinesin microtubule-associated protein Eg5 (Kif11) siRNA sense strand
aguuauuaugggcuauaau

SEQ ID NO: 16 - RNA, 19 nt, Artificial Sequence
  mitotic kinesin microtubule-associated protein Eg5 (Kif11) siRNA sense strand
guuauuaugggcuauaauu

SEQ ID NO: 17 - RNA, 19 nt, Artificial Sequence
  mitotic kinesin microtubule-associated protein Eg5 (Kif11) siRNA sense strand
aggugaaaggucaccuaau

SEQ ID NO: 18 - RNA, 19 nt, Artificial Sequence
  mitotic kinesin microtubule-associated protein Eg5 (Kif11) siRNA sense strand
ggugaaaggucaccuaaug

SEQ ID NO: 19 - RNA, 19 nt, Artificial Sequence
  mitotic kinesin microtubule-associated protein Eg5 (Kif11) siRNA sense strand
uggagaagagcuuguuaaa

SEQ ID NO: 20 - RNA, 19 nt, Artificial Sequence
  mitotic kinesin microtubule-associated protein Eg5 (Kif11) siRNA sense strand
ucgagaaucuaaacuaacu

SEQ ID NO: 21 - RNA, 19 nt, Artificial Sequence
  mitotic kinesin microtubule-associated protein Eg5 (Kif11) siRNA sense strand
gaaucuaaacuaacuagaa

SEQ ID NO: 22 - RNA, 19 nt, Artificial Sequence
  mitotic kinesin microtubule-associated protein Eg5 (Kif11) siRNA sense strand
ggaaacucugaguacauug

SEQ ID NO: 23 - RNA, 19 nt, Artificial Sequence
  mitotic kinesin microtubule-associated protein Eg5 (Kif11) siRNA sense strand
acucugaguacauuggaau

SEQ ID NO: 24 - RNA, 19 nt, Artificial Sequence
  mitotic kinesin microtubule-associated protein Eg5 (Kif11) siRNA sense strand
cucugaguacauuggaaua

SEQ ID NO: 25 - RNA, 19 nt, Artificial Sequence
  mitotic kinesin microtubule-associated protein Eg5 (Kif11) siRNA sense strand
agcucuuauuaaggaguau

SEQ ID NO: 26 - RNA, 19 nt, Artificial Sequence
  mitotic kinesin microtubule-associated protein Eg5 (Kif11) siRNA sense strand
gcucuuauuaaggaguaua

SEQ ID NO: 27 - RNA, 19 nt, Artificial Sequence
  mitotic kinesin microtubule-associated protein Eg5 (Kif11) siRNA sense strand
acuugaccaguguaaaucu

SEQ ID NO: 28 - RNA, 19 nt, Artificial Sequence
  mitotic kinesin microtubule-associated protein Eg5 (Kif11) siRNA sense strand
guguaaaucugaccugcaa

SEQ ID NO: 29 - RNA, 19 nt, Artificial Sequence
  mitotic kinesin microtubule-associated protein Eg5 (Kif11) siRNA sense strand
acugaagaccugaagacaa

SEQ ID NO: 30 - RNA, 19 nt, Artificial Sequence
  mitotic kinesin microtubule-associated protein Eg5 (Kif11) siRNA sense strand
cugaagaccugaagacaau

SEQ ID NO: 31 - RNA, 19 nt, Artificial Sequence
  mitotic kinesin microtubule-associated protein Eg5 (Kif11) siRNA sense strand
agaccugaagacaauaaag

SEQ ID NO: 32 - RNA, 19 nt, Artificial Sequence
  mitotic kinesin microtubule-associated protein Eg5 (Kif11) siRNA sense strand
gagagauucugugcuuugg

SEQ ID NO: 33 - DNA, 21 bp, Artificial Sequence
  mitotic kinesin microtubule-associated protein Eg5 (Kif11) siRNA sense
  Description of Combined DNA/RNA Molecule:mitotic kinesin microtubule-associated protein Eg5 (Kif11) siRNA sense
guguuguuuguccaauucutt

SEQ ID NO: 34 - DNA, 21 bp, Artificial Sequence
  mitotic kinesin microtubule-associated protein Eg5 (Kif11) siRNA antisense
  Description of Combined DNA/RNA Molecule:mitotic kinesin microtubule-associated protein Eg5 (Kif11) siRNA antisense
agaauuggacaaacaacactt

SEQ ID NO: 35 - DNA, 21 bp, Artificial Sequence
  mitotic kinesin microtubule-associated  protein Eg5 (Kif11) siRNA sense
  Description of Combined DNA/RNA Molecule:mitotic kinesin microtubule-associated protein Eg5 (Kif11) siRNA sense
guuauuaugggcuauaauutt

SEQ ID NO: 36 - DNA, 21 bp, Artificial Sequence
  mitotic kinesin microtubule-associated protein Eg5 (Kif11) siRNA antisense
  Description of Combined DNA/RNA Molecule:mitotic kinesin microtubule-associated protein Eg5 (Kif11) siRNA antisense
aauuauagcccauaauaactt

SEQ ID NO: 37 - DNA, 21 bp, Artificial Sequence
  mitotic kinesin microtubule-associated  protein Eg5 (Kif11) siRNA sense
  Description of Combined DNA/RNA Molecule:mitotic kinesin microtubule-associated protein Eg5 (Kif11) siRNA sense
aggugaaaggucaccuaautt

SEQ ID NO: 38 - DNA, 21 bp, Artificial Sequence
  mitotic kinesin microtubule-associated protein Eg5 (Kif11) siRNA antisense
  Description of Combined DNA/RNA Molecule:mitotic kinesin microtubule-associated protein Eg5 (Kif11) siRNA antisense
auuaggugaccuuucaccutt

SEQ ID NO: 39 - DNA, 21 bp, Artificial Sequence
  mitotic kinesin microtubule-associated protein Eg5 (Kif11) siRNA sense
  Description of Combined DNA/RNA Molecule:mitotic kinesin microtubule-associated protein Eg5 (Kif11) siRNA sense
ggugaaaggucaccuaaugtt

SEQ ID NO: 40 - DNA, 21 bp, Artificial Sequence
  mitotic kinesin microtubule-associated protein Eg5 (Kif11) siRNA antisense
  Description of Combined DNA/RNA Molecule:mitotic kinesin microtubule-associated protein Eg5 (Kif11) siRNA antisense
cauuaggugaccuuucacctt

SEQ ID NO: 41 - DNA, 21 bp, Artificial Sequence
  mitotic kinesin microtubule-associated protein Eg5 (Kif11) siRNA sense
  Description of Combined DNA/RNA Molecule:mitotic kinesin microtubule-associated protein Eg5 (Kif11) siRNA sense
uggagaagagcuuguuaaatt

SEQ ID NO: 42 - DNA, 21 bp, Artificial Sequence
  mitotic kinesin microtubule-associated protein Eg5 (Kif11) siRNA antisense
  Description of Combined DNA/RNA Molecule:mitotic kinesin microtubule-associated protein Eg5 (Kif11) siRNA antisense
uuuaacaagcucuucuccatt

SEQ ID NO: 43 - DNA, 21 bp, Artificial Sequence
  mitotic kinesin microtubule-associated protein Eg5 (Kif11) siRNA sense
  Description of Combined DNA/RNA Molecule:mitotic kinesin microtubule-associated protein Eg5 (Kif11) siRNA sense
ucgagaaucuaaacuaacutt

SEQ ID NO: 44 - DNA, 21 bp, Artificial Sequence
  mitotic kinesin microtubule-associated protein Eg5 (Kif11) siRNA antisense
  Description of Combined DNA/RNA Molecule:mitotic kinesin microtubule-associated protein Eg5 (Kif11) siRNA antisense
aguuaguuuagauucucgatt

SEQ ID NO: 45 - DNA, 21 bp, Artificial Sequence
  mitotic kinesin microtubule-associated protein Eg5 (Kif11) siRNA sense
  Description of Combined DNA/RNA Molecule:mitotic kinesin microtubule-associated protein Eg5 (Kif11) siRNA sense
ggaaacucugaguacauugtt

SEQ ID NO: 46 - DNA, 21 bp, Artificial Sequence
  mitotic kinesin microtubule-associated protein Eg5 (Kif11) siRNA antisense
  Description of Combined DNA/RNA Molecule:mitotic kinesin microtubule-associated protein Eg5 (Kif11) siRNA antisense
caauguacucagaguuucctt

SEQ ID NO: 47 - DNA, 21 bp, Artificial Sequence
  mitotic kinesin microtubule-associated protein Eg5 (Kif11) siRNA sense
  Description of Combined DNA/RNA Molecule:mitotic kinesin microtubule-associated protein Eg5 (Kif11) siRNA sense
cucugaguacauuggaauatt

SEQ ID NO: 48 - DNA, 21 bp, Artificial Sequence
  mitotic kinesin microtubule-associated  protein Eg5 (Kif11) siRNA antisense
  Description of Combined DNA/RNA Molecule:mitotic kinesin microtubule-associated protein Eg5 (Kif11) siRNA antisense
uauuccaauguacucagagtt

SEQ ID NO: 49 - DNA, 21 bp, Artificial Sequence
  mitotic kinesin microtubule-associated protein Eg5 (Kif11) siRNA sense
  Description of Combined DNA/RNA Molecule:mitotic kinesin microtubule-associated protein Eg5 (Kif11) siRNA sense
agcucuuauuaaggaguautt

SEQ ID NO: 50 - DNA, 21 bp, Artificial Sequence
  mitotic kinesin microtubule-associated  protein Eg5 (Kif11) siRNA antisense
  Description of Combined DNA/RNA Molecule:mitotic kinesin microtubule-associated protein Eg5 (Kif11) siRNA antisense
auacuccuuaauaagagcutt

SEQ ID NO: 51 - DNA, 21 bp, Artificial Sequence
  mitotic kinesin microtubule-associated protein Eg5 (Kif11) siRNA sense
  Description of Combined DNA/RNA Molecule:mitotic kinesin microtubule-associated protein Eg5 (Kif11) siRNA sense
gcucuuauuaaggaguauatt

SEQ ID NO: 52 - DNA, 21 bp, Artificial Sequence
  mitotic kinesin microtubule-associated protein Eg5 (Kif11) siRNA antisense
  Description of Combined DNA/RNA Molecule:mitotic kinesin microtubule-associated protein Eg5 (Kif11) siRNA antisense
uauacuccuuaauaagagctt

SEQ ID NO: 53 - DNA, 21 bp, Artificial Sequence
  mitotic kinesin microtubule-associated protein Eg5 (Kif11) siRNA sense
  Description of Combined DNA/RNA Molecule:mitotic kinesin microtubule-associated protein Eg5 (Kif11) siRNA sense
acuugaccaguguaaaucutt

SEQ ID NO: 54 - DNA, 21 bp, Artificial Sequence
  mitotic kinesin microtubule-associated protein Eg5 (Kif11) siRNA antisense
  Description of Combined DNA/RNA Molecule:mitotic kinesin microtubule-associated protein Eg5 (Kif11) siRNA antisense
agauuuacacuggucaagutt

SEQ ID NO: 55 - DNA, 21 bp, Artificial Sequence
  mitotic kinesin microtubule-associated protein Eg5 (Kif11) siRNA sense
  Description of Combined DNA/RNA Molecule:mitotic kinesin microtubule-associated protein Eg5 (Kif11) siRNA sense
acugaagaccugaagacaatt

SEQ ID NO: 56 - DNA, 21 bp, Artificial Sequence
  mitotic kinesin microtubule-associated protein Eg5 (Kif11) siRNA antisense
  Description of Combined DNA/RNA Molecule:mitotic kinesin microtubule-associated protein Eg5 (Kif11) siRNA antisense
uugucuucaggucuucagutt

SEQ ID NO: 57 - DNA, 21 bp, Artificial Sequence
  mitotic kinesin microtubule-associated protein Eg5 (Kif11) siRNA sense
  Description of Combined DNA/RNA Molecule:mitotic kinesin microtubule-associated protein Eg5 (Kif11) siRNA sense
cugaagaccugaagacaautt

SEQ ID NO: 58 - DNA, 21 bp, Artificial Sequence
  mitotic kinesin microtubule-associated protein Eg5 (Kif11) siRNA antisense
  Description of Combined DNA/RNA Molecule:mitotic kinesin microtubule-associated protein Eg5 (Kif11) siRNA antisense
auugucuucaggucuucagtt

SEQ ID NO: 59 - DNA, 21 bp, Artificial Sequence
  mitotic kinesin microtubule-associated protein Eg5 (Kif11) siRNA sense
  Description of Combined DNA/RNA Molecule:mitotic kinesin microtubule-associated protein Eg5 (Kif11) siRNA sense
agaccugaagacaauaaagtt

SEQ ID NO: 60 - DNA, 21 bp, Artificial Sequence
  mitotic kinesin microtubule-associated protein Eg5 (Kif11) siRNA antisense
  Description of Combined DNA/RNA Molecule:mitotic kinesin microtubule-associated protein Eg5 (Kif11) siRNA antisense
cuuuauugucuucaggucutt

SEQ ID NO: 61 - DNA, 21 bp, Artificial Sequence
  mitotic kinesin microtubule-associated  protein Eg5 (Kif11) siRNA sense
  Description of Combined DNA/RNA Molecule:mitotic kinesin microtubule-associated protein Eg5 (Kif11) siRNA antisense
gagagauucugugcuuuggtt

SEQ ID NO: 62 - DNA, 21 bp, Artificial Sequence
  mitotic kinesin microtubule-associated protein Eg5 (Kif11) siRNA antisense
  Description of Combined DNA/RNA Molecule:mitotic kinesin microtubule-associated protein Eg5 (Kif11) siRNA antisense
ccaaagcacagaaucucuctt

SEQ ID NO: 63 - DNA, 21 bp, Artificial Sequence
  epidermal growth factor receptor (EGFR), ERBB1 phosphotyrosine kinase siRNA sense strand target
  Description of Combined DNA/RNA Molecule:epidermal growth factor receptor (EGFR), ERBB1 phosphotyrosine kinase siRNA sense strand target
uguccucauugcccucaactt

SEQ ID NO: 64 - DNA, 21 bp, Artificial Sequence
  epidermal growth factor receptor (EGFR), ERBB1 phosphotyrosine kinase siRNA sense strand target
  Description of Combined DNA/RNA Molecule:epidermal growth factor receptor (EGFR), ERBB1 phosphotyrosine kinase siRNA sense strand target
guccucauugcccucaacatt

SEQ ID NO: 65 - DNA, 21 bp, Artificial Sequence
  epidermal growth factor receptor (EGFR), ERBB1 phosphotyrosine kinase siRNA sense strand target
  Description of Combined DNA/RNA Molecule:epidermal growth factor receptor (EGFR), ERBB1 phosphotyrosine kinase siRNA sense strand target
uccucauugcccucaacactt

SEQ ID NO: 66 - DNA, 21 bp, Artificial Sequence
  epidermal growth factor receptor (EGFR), ERBB1 phosphotyrosine kinase siRNA sense strand target
  Description of Combined DNA/RNA Molecule:epidermal growth factor receptor (EGFR), ERBB1 phosphotyrosine kinase siRNA sense strand target
ugauccaagcugucccaautt

SEQ ID NO: 67 - DNA, 21 bp, Artificial Sequence
  epidermal growth factor receptor (EGFR), ERBB1 phosphotyrosine kinase siRNA sense strand target
  Description of Combined DNA/RNA Molecule:epidermal growth factor receptor (EGFR), ERBB1 phosphotyrosine kinase siRNA sense strand target
gauccaagcugucccaaugtt

SEQ ID NO: 68 - DNA, 21 bp, Artificial Sequence
  epidermal growth factor receptor (EGFR), ERBB1 phosphotyrosine kinase siRNA sense strand target
  Description of Combined DNA/RNA Molecule:epidermal growth factor receptor (EGFR), ERBB1 phosphotyrosine kinase siRNA sense strand target
gagaggagaacugccagaatt

SEQ ID NO: 69 - DNA, 21 bp, Artificial Sequence
  epidermal growth factor receptor (EGFR), ERBB1 phosphotyrosine kinase siRNA sense strand target
  Description of Combined DNA/RNA Molecule:epidermal growth factor receptor (EGFR), ERBB1 phosphotyrosine kinase siRNA sense strand target
agaggagaacugccagaaatt

SEQ ID NO: 70 - DNA, 21 bp, Artificial Sequence
  epidermal growth factor receptor (EGFR), ERBB1 phosphotyrosine kinase siRNA sense strand target
  Description of Combined DNA/RNA Molecule:epidermal growth factor receptor (EGFR), ERBB1 phosphotyrosine kinase siRNA sense strand target
cccagugacugcugccacatt

SEQ ID NO: 71 - DNA, 21 bp, Artificial Sequence
  epidermal growth factor receptor (EGFR), ERBB1 phosphotyrosine kinase siRNA sense strand target
  Description of Combined DNA/RNA Molecule:epidermal growth factor receptor (EGFR), ERBB1 phosphotyrosine kinase siRNA sense strand target
ccagugacugcugccacaatt

SEQ ID NO: 72 - DNA, 21 bp, Artificial Sequence
  epidermal growth factor receptor (EGFR), ERBB1 phosphotyrosine kinase siRNA sense strand target
  Description of Combined DNA/RNA Molecule:epidermal growth factor receptor (EGFR), ERBB1 phosphotyrosine kinase siRNA sense strand target
guguguaacggaauagguatt

SEQ ID NO: 73 - DNA, 21 bp, Artificial Sequence
  epidermal growth factor receptor (EGFR), ERBB1 phosphotyrosine kinase siRNA sense strand target
  Description of Combined DNA/RNA Molecule:epidermal growth factor receptor (EGFR), ERBB1 phosphotyrosine kinase siRNA sense strand target
ccagugugcccacuacauutt

SEQ ID NO: 74 - DNA, 21 bp, Artificial Sequence
  epidermal growth factor receptor (EGFR), ERBB1 phosphotyrosine kinase siRNA sense strand target
  Description of Combined DNA/RNA Molecule:epidermal growth factor receptor (EGFR), ERBB1 phosphotyrosine kinase siRNA sense strand target
cagugugcccacuacauugtt

SEQ ID NO: 75 - DNA, 21 bp, Artificial Sequence
  epidermal growth factor receptor (EGFR), ERBB1 phosphotyrosine kinase siRNA sense strand target
  Description of Combined DNA/RNA Molecule:epidermal growth factor receptor (EGFR), ERBB1 phosphotyrosine kinase siRNA sense strand target
agugugcccacuacauugatt

SEQ ID NO: 76 - DNA, 21 bp, Artificial Sequence
  epidermal growth factor receptor (EGFR), ERBB1 phosphotyrosine kinase siRNA sense strand target
  Description of Combined DNA/RNA Molecule:epidermal growth factor receptor (EGFR), ERBB1 phosphotyrosine kinase siRNA sense strand target
ggaucccagaaggugagaatt

SEQ ID NO: 77 - DNA, 21 bp, Artificial Sequence
  epidermal growth factor receptor (EGFR), ERBB1 phosphotyrosine kinase siRNA sense strand target
  Description of Combined DNA/RNA Molecule:epidermal growth factor receptor (EGFR), ERBB1 phosphotyrosine kinase siRNA sense strand target
gaucccagaaggugagaaatt

SEQ ID NO: 78 - DNA, 21 bp, Artificial Sequence
  epidermal growth factor receptor (EGFR), ERBB1 phosphotyrosine kinase siRNA sense strand target
  Description of Combined DNA/RNA Molecule:epidermal growth factor receptor (EGFR), ERBB1 phosphotyrosine kinase siRNA sense strand target
aucccagaaggugagaaagtt

SEQ ID NO: 79 - DNA, 21 bp, Artificial Sequence
  epidermal growth factor receptor (EGFR), ERBB1 phosphotyrosine kinase siRNA sense strand target
  Description of Combined DNA/RNA Molecule:epidermal growth factor receptor (EGFR), ERBB1 phosphotyrosine kinase siRNA sense strand target
ucccagaaggugagaaagutt

SEQ ID NO: 80 - DNA, 21 bp, Artificial Sequence
  epidermal growth factor receptor (EGFR), ERBB1 phosphotyrosine kinase siRNA sense strand target
  Description of Combined DNA/RNA Molecule:epidermal growth factor receptor (EGFR), ERBB1 phosphotyrosine kinase siRNA sense strand target
gcaugucaagaucacagautt

SEQ ID NO: 81 - DNA, 21 bp, Artificial Sequence
  epidermal growth factor receptor (EGFR), ERBB1 phosphotyrosine kinase siRNA sense strand target
  Description of Combined DNA/RNA Molecule:epidermal growth factor receptor (EGFR), ERBB1 phosphotyrosine kinase siRNA sense strand target
caugucaagaucacagauutt

SEQ ID NO: 82 - DNA, 21 bp, Artificial Sequence
  epidermal growth factor receptor (EGFR), ERBB1 phosphotyrosine kinase siRNA sense strand target
  Description of Combined DNA/RNA Molecule:epidermal growth factor receptor (EGFR), ERBB1 phosphotyrosine kinase siRNA sense strand target
augucaagaucacagauuutt

SEQ ID NO: 83 - DNA, 21 bp, Artificial Sequence
  epidermal growth factor receptor (EGFR), ERBB1 phosphotyrosine kinase siRNA sense strand target
  Description of Combined DNA/RNA Molecule:epidermal growth factor receptor (EGFR), ERBB1 phosphotyrosine kinase siRNA sense strand target
gugccuaucaaguggauggtt

SEQ ID NO: 84 - DNA, 21 bp, Artificial Sequence
  epidermal growth factor receptor (EGFR), ERBB1 phosphotyrosine kinase siRNA sense strand target
  Description of Combined DNA/RNA Molecule:epidermal growth factor receptor (EGFR), ERBB1 phosphotyrosine kinase siRNA sense strand target
ucgaugucuacaugaucautt

SEQ ID NO: 85 - DNA, 21 bp, Artificial Sequence
  epidermal growth factor receptor (EGFR), ERBB1 phosphotyrosine kinase siRNA sense strand target
  Description of Combined DNA/RNA Molecule:epidermal growth factor receptor (EGFR), ERBB1 phosphotyrosine kinase siRNA sense strand target
uggucaagugcuggaugautt

SEQ ID NO: 86 - DNA, 21 bp, Artificial Sequence
  epidermal growth factor receptor (EGFR), ERBB1 phosphotyrosine kinase siRNA sense strand target
  Description of Combined DNA/RNA Molecule:epidermal growth factor receptor (EGFR), ERBB1 phosphotyrosine kinase siRNA sense strand target
ggucaagugcuggaugauatt

SEQ ID NO: 87 - DNA, 21 bp, Artificial Sequence
  epidermal growth factor receptor (EGFR), ERBB1 phosphotyrosine kinase siRNA sense strand target
  Description of Combined DNA/RNA Molecule:epidermal growth factor receptor (EGFR), ERBB1 phosphotyrosine kinase siRNA sense strand target
gucaagugcuggaugauagtt

SEQ ID NO: 88 - DNA, 21 bp, Artificial Sequence
  epidermal growth factor receptor (EGFR), ERBB1 phosphotyrosine kinase siRNA sense strand target
  Description of Combined DNA/RNA Molecule:epidermal growth factor receptor (EGFR), ERBB1 phosphotyrosine kinase siRNA sense strand target
gggaugaaagaaugcauuutt

SEQ ID NO: 89 - DNA, 21 bp, Artificial Sequence
  epidermal growth factor receptor (EGFR), ERBB1 phosphotyrosine kinase siRNA sense strand target
  Description of Combined DNA/RNA Molecule:epidermal growth factor receptor (EGFR), ERBB1 phosphotyrosine kinase siRNA sense strand target
ggaugaaagaaugcauuugtt

SEQ ID NO: 90 - DNA, 21 bp, Artificial Sequence
  epidermal growth factor receptor (EGFR), ERBB1 phosphotyrosine kinase siRNA sense strand target
  Description of Combined DNA/RNA Molecule:epidermal growth factor receptor (EGFR), ERBB1 phosphotyrosine kinase siRNA sense strand target
cugacuaccagcaggacuutt

SEQ ID NO: 91 - DNA, 21 bp, Artificial Sequence
  epidermal growth factor receptor (EGFR), ERBB1 phosphotyrosine kinase siRNA sense strand target
  Description of Combined DNA/RNA Molecule:epidermal growth factor receptor (EGFR), ERBB1 phosphotyrosine kinase siRNA sense strand target
gacuaccagcaggacuucutt

SEQ ID NO: 92 - DNA, 21 bp, Artificial Sequence
  epidermal growth factor receptor (EGFR), ERBB1 phosphotyrosine kinase siRNA sense strand target
  Description of Combined DNA/RNA Molecule:epidermal growth factor receptor (EGFR), ERBB1 phosphotyrosine kinase siRNA sense strand target
acuaccagcaggacuucuutt

SEQ ID NO: 93 - DNA, 21 bp, Artificial Sequence
  epidermal growth factor receptor (EGFR), ERBB1 phosphotyrosine kinase siRNA sense
  Description of Combined DNA/RNA Molecule:epidermal growth factor receptor (EGFR), ERBB1 phosphotyrosine kinase siRNA sense
guccucauugcccucaacatt

SEQ ID NO: 94 - DNA, 21 bp, Artificial Sequence
  epidermal growth factor receptor (EGFR), ERBB1 phosphotyrosine kinase siRNA antisense
  Description of Combined DNA/RNA Molecule:epidermal growth factor receptor (EGFR), ERBB1 phosphotyrosine kinase siRNA antisense
uguugagggcaaugaggactt

SEQ ID NO: 95 - DNA, 21 bp, Artificial Sequence
  epidermal growth factor receptor (EGFR), ERBB1 phosphotyrosine kinase siRNA sense
  Description of Combined DNA/RNA Molecule:epidermal growth factor receptor (EGFR), ERBB1 phosphotyrosine kinase siRNA sense
uccucauugcccucaacactt

SEQ ID NO: 96 - DNA, 21 bp, Artificial Sequence
  epidermal growth factor receptor (EGFR), ERBB1 phosphotyrosine kinase siRNA antisense
  Description of Combined DNA/RNA Molecule:epidermal growth factor receptor (EGFR), ERBB1 phosphotyrosine kinase siRNA antisense
guguugagggcaaugaggatt

SEQ ID NO: 97 - DNA, 21 bp, Artificial Sequence
  epidermal growth factor receptor (EGFR), ERBB1 phosphotyrosine kinase siRNA sense
  Description of Combined DNA/RNA Molecule:epidermal growth factor receptor (EGFR), ERBB1 phosphotyrosine kinase siRNA sense
ugauccaagcugucccaautt

SEQ ID NO: 98 - DNA, 21 bp, Artificial Sequence
  epidermal growth factor receptor (EGFR), ERBB1 phosphotyrosine kinase siRNA antisense
  Description of Combined DNA/RNA Molecule:epidermal growth factor receptor (EGFR), ERBB1 phosphotyrosine kinase siRNA antisense
auugggacagcuuggaucatt

SEQ ID NO: 99 - DNA, 21 bp, Artificial Sequence
  epidermal growth factor receptor (EGFR), ERBB1 phosphotyrosine kinase siRNA sense
  Description of Combined DNA/RNA Molecule:epidermal growth factor receptor (EGFR), ERBB1 phosphotyrosine kinase siRNA sense
gauccaagcugucccaaugtt

SEQ ID NO: 100 - DNA, 21 bp, Artificial Sequence
  epidermal growth factor receptor (EGFR), ERBB1 phosphotyrosine kinase siRNA antisense
  Description of Combined DNA/RNA Molecule:epidermal growth factor receptor (EGFR), ERBB1 phosphotyrosine kinase siRNA antisense
cauugggacagcuuggauctt

SEQ ID NO: 101 - DNA, 21 bp, Artificial Sequence
  epidermal growth factor receptor (EGFR), ERBB1 phosphotyrosine kinase siRNA sense
  Description of Combined DNA/RNA Molecule:epidermal growth factor receptor (EGFR), ERBB1 phosphotyrosine kinase siRNA sense
guguguaacggaauagguatt

SEQ ID NO: 102 - DNA, 21 bp, Artificial Sequence
  epidermal growth factor receptor (EGFR), ERBB1 phosphotyrosine kinase siRNA antisense
  Description of Combined DNA/RNA Molecule:epidermal growth factor receptor (EGFR), ERBB1 phosphotyrosine kinase siRNA antisense
uaccuauuccguuacacactt

SEQ ID NO: 103 - DNA, 21 bp, Artificial Sequence
  epidermal growth factor receptor (EGFR), ERBB1 phosphotyrosine kinase siRNA sense
  Description of Combined DNA/RNA Molecule:epidermal growth factor receptor (EGFR), ERBB1 phosphotyrosine kinase siRNA sense
ccagugugcccacuacauutt

SEQ ID NO: 104 - DNA, 21 bp, Artificial Sequence
  epidermal growth factor receptor (EGFR), ERBB1 phosphotyrosine kinase siRNA antisense
  Description of Combined DNA/RNA Molecule:epidermal growth factor receptor (EGFR), ERBB1 phosphotyrosine kinase siRNA antisense
aauguagugggcacacuggtt

SEQ ID NO: 105 - DNA, 21 bp, Artificial Sequence
  epidermal growth factor receptor (EGFR), ERBB1 phosphotyrosine kinase siRNA sense
  Description of Combined DNA/RNA Molecule:epidermal growth factor receptor (EGFR), ERBB1 phosphotyrosine kinase siRNA sense
aucccagaaggugagaaagtt

SEQ ID NO: 106 - DNA, 21 bp, Artificial Sequence
  epidermal growth factor receptor (EGFR), ERBB1 phosphotyrosine kinase siRNA antisense
  Description of Combined DNA/RNA Molecule:epidermal growth factor receptor (EGFR), ERBB1 phosphotyrosine kinase siRNA antisense
cuuucucaccuucugggautt

SEQ ID NO: 107 - DNA, 21 bp, Artificial Sequence
  epidermal growth factor receptor (EGFR), ERBB1 phosphotyrosine kinase siRNA sense
  Description of Combined DNA/RNA Molecule:epidermal growth factor receptor (EGFR), ERBB1 phosphotyrosine kinase siRNA sense
augucaagaucacagauuutt

SEQ ID NO: 108 - DNA, 21 bp, Artificial Sequence
  epidermal growth factor receptor (EGFR), ERBB1 phosphotyrosine kinase siRNA antisense
  Description of Combined DNA/RNA Molecule:epidermal growth factor receptor (EGFR), ERBB1 phosphotyrosine kinase siRNA antisense
aaaucugugaucuugacautt

SEQ ID NO: 109 - DNA, 21 bp, Artificial Sequence
  epidermal growth factor receptor (EGFR), ERBB1 phosphotyrosine kinase siRNA sense
  Description of Combined DNA/RNA Molecule:epidermal growth factor receptor (EGFR), ERBB1 phosphotyrosine kinase siRNA sense
ucgaugucuacaugaucautt

SEQ ID NO: 110 - DNA, 21 bp, Artificial Sequence
  epidermal growth factor receptor (EGFR), ERBB1 phosphotyrosine kinase siRNA antisense
  Description of Combined DNA/RNA Molecule:epidermal growth factor receptor (EGFR), ERBB1 phosphotyrosine kinase siRNA antisense
augaucauguagacaucgatt

SEQ ID NO: 111 - DNA, 21 bp, Artificial Sequence
  epidermal growth factor receptor (EGFR), ERBB1 phosphotyrosine kinase siRNA sense
  Description of Combined DNA/RNA Molecule:epidermal growth factor receptor (EGFR), ERBB1 phosphotyrosine kinase siRNA sense
gucaagugcuggaugauagtt

SEQ ID NO: 112 - DNA, 21 bp, Artificial Sequence
  epidermal growth factor receptor (EGFR), ERBB1 phosphotyrosine kinase siRNA antisense
  Description of Combined DNA/RNA Molecule:epidermal growth factor receptor (EGFR), ERBB1 phosphotyrosine kinase siRNA antisense
cuaucauccagcacuugactt

SEQ ID NO: 113 - DNA, 21 bp, Artificial Sequence
  epidermal growth factor receptor (EGFR), ERBB1 phosphotyrosine kinase siRNA sense
  Description of Combined DNA/RNA Molecule:epidermal growth factor receptor (EGFR), ERBB1 phosphotyrosine kinase siRNA sense
cugacuaccagcaggacuutt

SEQ ID NO: 114 - DNA, 21 bp, Artificial Sequence
  epidermal growth factor receptor (EGFR), ERBB1 phosphotyrosine kinase siRNA antisense
  Description of Combined DNA/RNA Molecule:epidermal growth factor receptor (EGFR), ERBB1 phosphotyrosine kinase siRNA antisense
aaguccugcugguagucagtt

SEQ ID NO: 115 - DNA, 21 bp, Artificial Sequence
  epidermal growth factor receptor (EGFR), ERBB1 phosphotyrosine kinase siRNA sense
  Description of Combined DNA/RNA Molecule:epidermal growth factor receptor (EGFR), ERBB1 phosphotyrosine kinase siRNA sense
gacuaccagcaggacuucutt

SEQ ID NO: 116 - DNA, 21 bp, Artificial Sequence
  epidermal growth factor receptor (EGFR), ERBB1 phosphotyrosine kinase siRNA antisense
  Description of Combined DNA/RNA Molecule:epidermal growth factor receptor (EGFR), ERBB1 phosphotyrosine kinase siRNA antisense
agaaguccugcugguaguctt

SEQ ID NO: 117 - DNA, 21 bp, Artificial Sequence
  epidermal growth factor receptor (EGFR), ERBB1 phosphotyrosine kinase siRNA sense
  Description of Combined DNA/RNA Molecule:epidermal growth factor receptor (EGFR), ERBB1 phosphotyrosine kinase siRNA sense
acuaccagcaggacuucuutt

SEQ ID NO: 118 - DNA, 21 bp, Artificial Sequence
  epidermal growth factor receptor (EGFR), ERBB1 phosphotyrosine kinase siRNA antisense
  Description of Combined DNA/RNA Molecule:epidermal growth factor receptor (EGFR), ERBB1 phosphotyrosine kinase siRNA antisense
aagaaguccugcugguagutt

SEQ ID NO: 119 - DNA, 21 bp, Artificial Sequence
  X-linked inhibitor of apoptosis (XIAP) siRNA sense strand target
  Description of Combined DNA/RNA Molecule:X-linked inhibitor of apoptosis (XIAP) siRNA sense strand target
aagguggacaaguccuauutt

SEQ ID NO: 120 - DNA, 21 bp, Artificial Sequence
  X-linked inhibitor of apoptosis (XIAP) siRNA sense strand target
  Description of Combined DNA/RNA Molecule:X-linked inhibitor of apoptosis (XIAP) siRNA sense strand target
agguggacaaguccuauuutt

SEQ ID NO: 121 - DNA, 21 bp, Artificial Sequence
  X-linked inhibitor of apoptosis (XIAP) siRNA sense strand target
  Description of Combined DNA/RNA Molecule:X-linked inhibitor of apoptosis (XIAP) siRNA sense strand target
gaauuuguagaagaguuuatt

SEQ ID NO: 122 - DNA, 21 bp, Artificial Sequence
  X-linked inhibitor of apoptosis (XIAP) siRNA sense strand target
  Description of Combined DNA/RNA Molecule:X-linked inhibitor of apoptosis (XIAP) siRNA sense strand target
uuuguagaagaguuuaauatt

SEQ ID NO: 123 - DNA, 21 bp, Artificial Sequence
  X-linked inhibitor of apoptosis (XIAP) siRNA sense strand target
  Description of Combined DNA/RNA Molecule:X-linked inhibitor of apoptosis (XIAP) siRNA sense strand target
guagaagaguuuaauagautt

SEQ ID NO: 124 - DNA, 21 bp, Artificial Sequence
  X-linked inhibitor of apoptosis (XIAP) siRNA sense strand target
  Description of Combined DNA/RNA Molecule:X-linked inhibitor of apoptosis (XIAP) siRNA sense strand target
agaagaguuuaauagauuatt

SEQ ID NO: 125 - DNA, 21 bp, Artificial Sequence
  X-linked inhibitor of apoptosis (XIAP) siRNA sense strand target
  Description of Combined DNA/RNA Molecule:X-linked inhibitor of apoptosis (XIAP) siRNA sense strand target
gaagaguuuaauagauuaatt

SEQ ID NO: 126 - DNA, 21 bp, Artificial Sequence
  X-linked inhibitor of apoptosis (XIAP) siRNA sense strand target
  Description of Combined DNA/RNA Molecule:X-linked inhibitor of apoptosis (XIAP) siRNA sense strand target
aagaguuuaauagauuaaatt

SEQ ID NO: 127 - DNA, 21 bp, Artificial Sequence
  X-linked inhibitor of apoptosis (XIAP) siRNA sense strand target
  Description of Combined DNA/RNA Molecule:X-linked inhibitor of apoptosis (XIAP) siRNA sense strand target
gugguaguccuguuucagctt

SEQ ID NO: 128 - DNA, 21 bp, Artificial Sequence
  X-linked inhibitor of apoptosis (XIAP) siRNA sense strand target
  Description of Combined DNA/RNA Molecule:X-linked inhibitor of apoptosis (XIAP) siRNA sense strand target
aguccuguuucagcaucaatt

SEQ ID NO: 129 - DNA, 21 bp, Artificial Sequence
  X-linked inhibitor of apoptosis (XIAP) siRNA sense strand target
  Description of Combined DNA/RNA Molecule:X-linked inhibitor of apoptosis (XIAP) siRNA sense strand target
guccuguuucagcaucaactt

SEQ ID NO: 130 - DNA, 21 bp, Artificial Sequence
  X-linked inhibitor of apoptosis (XIAP) siRNA sense strand target
  Description of Combined DNA/RNA Molecule:X-linked inhibitor of apoptosis (XIAP) siRNA sense strand target
uccuguuucagcaucaacatt

SEQ ID NO: 131 - DNA, 21 bp, Artificial Sequence
  X-linked inhibitor of apoptosis (XIAP) siRNA sense strand target
  Description of Combined DNA/RNA Molecule:X-linked inhibitor of apoptosis (XIAP) siRNA sense strand target
cccaaauugcagauuuauctt

SEQ ID NO: 132 - DNA, 21 bp, Artificial Sequence
  X-linked inhibitor of apoptosis (XIAP) siRNA sense strand target
  Description of Combined DNA/RNA Molecule:X-linked inhibitor of apoptosis (XIAP) siRNA sense strand target
uagugccacgcagucuacatt

SEQ ID NO: 133 - DNA, 21 bp, Artificial Sequence
  X-linked inhibitor of apoptosis (XIAP) siRNA sense strand target
  Description of Combined DNA/RNA Molecule:X-linked inhibitor of apoptosis (XIAP) siRNA sense strand target
gaguucugauaggaauuuctt

SEQ ID NO: 134 - DNA, 21 bp, Artificial Sequence
  X-linked inhibitor of apoptosis (XIAP) siRNA sense strand target
  Description of Combined DNA/RNA Molecule:X-linked inhibitor of apoptosis (XIAP) siRNA sense strand target
ugauaggaauuucccaaautt

SEQ ID NO: 135 - DNA, 21 bp, Artificial Sequence
  X-linked inhibitor of apoptosis (XIAP) siRNA sense strand target
  Description of Combined DNA/RNA Molecule:X-linked inhibitor of apoptosis (XIAP) siRNA sense strand target
gauaggaauuucccaaauutt

SEQ ID NO: 136 - DNA, 21 bp, Artificial Sequence
  X-linked inhibitor of apoptosis (XIAP) siRNA sense strand target
  Description of Combined DNA/RNA Molecule:X-linked inhibitor of apoptosis (XIAP) siRNA sense strand target
uaggaauuucccaaauucatt

SEQ ID NO: 137 - DNA, 21 bp, Artificial Sequence
  X-linked inhibitor of apoptosis (XIAP) siRNA sense strand target
  Description of Combined DNA/RNA Molecule:X-linked inhibitor of apoptosis (XIAP) siRNA sense strand target
aggaauuucccaaauucaatt

SEQ ID NO: 138 - DNA, 21 bp, Artificial Sequence
  X-linked inhibitor of apoptosis (XIAP) siRNA sense strand target
  Description of Combined DNA/RNA Molecule:X-linked inhibitor of apoptosis (XIAP) siRNA sense strand target
gcuugcaagagcuggauuutt

SEQ ID NO: 139 - DNA, 21 bp, Artificial Sequence
  X-linked inhibitor of apoptosis (XIAP) siRNA sense strand target
  Description of Combined DNA/RNA Molecule:X-linked inhibitor of apoptosis (XIAP) siRNA sense strand target
guacugaagagcagcuaagtt

SEQ ID NO: 140 - DNA, 21 bp, Artificial Sequence
  X-linked inhibitor of apoptosis (XIAP) siRNA sense strand target
  Description of Combined DNA/RNA Molecule:X-linked inhibitor of apoptosis (XIAP) siRNA sense strand target
aaucuguauggauagaaautt

SEQ ID NO: 141 - DNA, 21 bp, Artificial Sequence
  X-linked inhibitor of apoptosis (XIAP) siRNA sense strand target
  Description of Combined DNA/RNA Molecule:X-linked inhibitor of apoptosis (XIAP) siRNA sense strand target
aucuguauggauagaaauatt

SEQ ID NO: 142 - DNA, 21 bp, Artificial Sequence
  X-linked inhibitor of apoptosis (XIAP) siRNA sense strand target
  Description of Combined DNA/RNA Molecule:X-linked inhibitor of apoptosis (XIAP) siRNA sense strand target
ucuguauggauagaaauautt

SEQ ID NO: 143 - DNA, 21 bp, Artificial Sequence
  X-linked inhibitor of apoptosis (XIAP) siRNA sense strand target
  Description of Combined DNA/RNA Molecule:X-linked inhibitor of apoptosis (XIAP) siRNA sense strand target
cuguauggauagaaauauutt

SEQ ID NO: 144 - DNA, 21 bp, Artificial Sequence
  X-linked inhibitor of apoptosis (XIAP) siRNA sense strand target
  Description of Combined DNA/RNA Molecule:X-linked inhibitor of apoptosis (XIAP) siRNA sense strand target
uggauagaaauauugcuautt

SEQ ID NO: 145 - DNA, 21 bp, Artificial Sequence
  X-linked inhibitor of apoptosis (XIAP) siRNA sense strand target
  Description of Combined DNA/RNA Molecule:X-linked inhibitor of apoptosis (XIAP) siRNA sense strand target
ggauagaaauauugcuauctt

SEQ ID NO: 146 - DNA, 21 bp, Artificial Sequence
  X-linked inhibitor of apoptosis (XIAP) siRNA sense
  Description of Combined DNA/RNA Molecule:X-linked inhibitor of apoptosis (XIAP) siRNA sense
gaauuuguagaagaguuuatt

SEQ ID NO: 147 - DNA, 21 bp, Artificial Sequence
  X-linked inhibitor of apoptosis (XIAP) siRNA antisense
  Description of Combined DNA/RNA Molecule:X-linked inhibitor of apoptosis (XIAP) siRNA antisense
uaaacucuucuacaaauuctt

SEQ ID NO: 148 - DNA, 21 bp, Artificial Sequence
  X-linked inhibitor of apoptosis (XIAP) siRNA sense
  Description of Combined DNA/RNA Molecule:X-linked inhibitor of apoptosis (XIAP) siRNA sense
gaagaguuuaauagauuaatt

SEQ ID NO: 149 - DNA, 21 bp, Artificial Sequence
  X-linked inhibitor of apoptosis (XIAP) siRNA antisense
  Description of Combined DNA/RNA Molecule:X-linked inhibitor of apoptosis (XIAP) siRNA antisense
uuaaucuauuaaacucuuctt

SEQ ID NO: 150 - DNA, 21 bp, Artificial Sequence
  X-linked inhibitor of apoptosis (XIAP) siRNA sense
  Description of Combined DNA/RNA Molecule:X-linked inhibitor of apoptosis (XIAP) siRNA sense
aagaguuuaauagauuaaatt

SEQ ID NO: 151 - DNA, 21 bp, Artificial Sequence
  X-linked inhibitor of apoptosis (XIAP) siRNA antisense
  Description of Combined DNA/RNA Molecule:X-linked inhibitor of apoptosis (XIAP) siRNA antisense
uuuaaucuauuaaacucuutt

SEQ ID NO: 152 - DNA, 21 bp, Artificial Sequence
  X-linked inhibitor of apoptosis (XIAP) siRNA sense
  Description of Combined DNA/RNA Molecule:X-linked inhibitor of apoptosis (XIAP) siRNA sense
gugguaguccuguuucagctt

SEQ ID NO: 153 - DNA, 21 bp, Artificial Sequence
  X-linked inhibitor of apoptosis (XIAP) siRNA antisense
  Description of Combined DNA/RNA Molecule:X-linked inhibitor of apoptosis (XIAP) siRNA antisense
gcugaaacaggacuaccactt

SEQ ID NO: 154 - DNA, 21 bp, Artificial Sequence
  X-linked inhibitor of apoptosis (XIAP) siRNA sense
  Description of Combined DNA/RNA Molecule:X-linked inhibitor of apoptosis (XIAP) siRNA sense
uccuguuucagcaucaacatt

SEQ ID NO: 155 - DNA, 21 bp, Artificial Sequence
  X-linked inhibitor of apoptosis (XIAP) siRNA antisense
  Description of Combined DNA/RNA Molecule:X-linked inhibitor of apoptosis (XIAP) siRNA antisense
uguugaugcugaaacaggatt

SEQ ID NO: 156 - DNA, 21 bp, Artificial Sequence
  X-linked inhibitor of apoptosis (XIAP) siRNA sense
  Description of Combined DNA/RNA Molecule:X-linked inhibitor of apoptosis (XIAP) siRNA sense
cccaaauugcagauuuauctt

SEQ ID NO: 157 - DNA, 21 bp, Artificial Sequence
  X-linked inhibitor of apoptosis (XIAP) siRNA antisense
  Description of Combined DNA/RNA Molecule:X-linked inhibitor of apoptosis (XIAP) siRNA antisense
gauaaaucugcaauuugggtt

SEQ ID NO: 158 - DNA, 21 bp, Artificial Sequence
  X-linked inhibitor of apoptosis (XIAP) siRNA sense
  Description of Combined DNA/RNA Molecule:X-linked inhibitor of apoptosis (XIAP) siRNA sense
uagugccacgcagucuacatt

SEQ ID NO: 159 - DNA, 21 bp, Artificial Sequence
  X-linked inhibitor of apoptosis (XIAP) siRNA antisense
  Description of Combined DNA/RNA Molecule:X-linked inhibitor of apoptosis (XIAP) siRNA antisense
uguagacugcguggcacuatt

SEQ ID NO: 160 - DNA, 21 bp, Artificial Sequence
  X-linked inhibitor of apoptosis (XIAP) siRNA sense
  Description of Combined DNA/RNA Molecule:X-linked inhibitor of apoptosis (XIAP) siRNA sense
gaguucugauaggaauuuctt

SEQ ID NO: 161 - DNA, 21 bp, Artificial Sequence
  X-linked inhibitor of apoptosis (XIAP) siRNA antisense
  Description of Combined DNA/RNA Molecule:X-linked inhibitor of apoptosis (XIAP) siRNA antisense
gaaauuccuaucagaacuctt

SEQ ID NO: 162 - DNA, 21 bp, Artificial Sequence
  X-linked inhibitor of apoptosis (XIAP) siRNA sense
  Description of Combined DNA/RNA Molecule:X-linked inhibitor of apoptosis (XIAP) siRNA sense
uaggaauuucccaaauucatt

SEQ ID NO: 163 - DNA, 21 bp, Artificial Sequence
  X-linked inhibitor of apoptosis (XIAP) siRNA antisense
  Description of Combined DNA/RNA Molecule:X-linked inhibitor of apoptosis (XIAP) siRNA antisense
ugaauuugggaaauuccuatt

SEQ ID NO: 164 - DNA, 21 bp, Artificial Sequence
  X-linked inhibitor of apoptosis (XIAP) siRNA sense
  Description of Combined DNA/RNA Molecule:X-linked inhibitor of apoptosis (XIAP) siRNA sense
aggaauuucccaaauucaatt

SEQ ID NO: 165 - DNA, 21 bp, Artificial Sequence
  X-linked inhibitor of apoptosis (XIAP) siRNA antisense
  Description of Combined DNA/RNA Molecule:X-linked inhibitor of apoptosis (XIAP) siRNA antisense
uugaauuugggaaauuccutt

SEQ ID NO: 166 - DNA, 21 bp, Artificial Sequence
  X-linked inhibitor of apoptosis (XIAP) siRNA sense
  Description of Combined DNA/RNA Molecule:X-linked inhibitor of apoptosis (XIAP) siRNA sense
gcuugcaagagcuggauuutt

SEQ ID NO: 167 - DNA, 21 bp, Artificial Sequence
  X-linked inhibitor of apoptosis (XIAP) siRNA antisense
  Description of Combined DNA/RNA Molecule:X-linked inhibitor of apoptosis (XIAP) siRNA antisense
aaauccagcucuugcaagctt

SEQ ID NO: 168 - DNA, 21 bp, Artificial Sequence
  X-linked inhibitor of apoptosis (XIAP) siRNA sense
  Description of Combined DNA/RNA Molecule:X-linked inhibitor of apoptosis (XIAP) siRNA sense
guacugaagagcagcuaagtt

SEQ ID NO: 169 - DNA, 21 bp, Artificial Sequence
  X-linked inhibitor of apoptosis (XIAP) siRNA antisense
  Description of Combined DNA/RNA Molecule:X-linked inhibitor of apoptosis (XIAP) siRNA antisense
cuuagcugcucuucaguactt

SEQ ID NO: 170 - DNA, 21 bp, Artificial Sequence
  X-linked inhibitor of apoptosis (XIAP) siRNA sense
  Description of Combined DNA/RNA Molecule:X-linked inhibitor of apoptosis (XIAP) siRNA sense
uggauagaaauauugcuautt

SEQ ID NO: 171 - DNA, 21 bp, Artificial Sequence
  X-linked inhibitor of apoptosis (XIAP) siRNA antisense
  Description of Combined DNA/RNA Molecule:X-linked inhibitor of apoptosis (XIAP) siRNA antisense
auagcaauauuucuauccatt

SEQ ID NO: 172 - DNA, 21 bp, Artificial Sequence
  X-linked inhibitor of apoptosis (XIAP) siRNA sense
  Description of Combined DNA/RNA Molecule:X-linked inhibitor of apoptosis (XIAP) siRNA sense
ggauagaaauauugcuauctt

SEQ ID NO: 173 - DNA, 21 bp, Artificial Sequence
  X-linked inhibitor of apoptosis (XIAP) siRNA antisense
  Description of Combined DNA/RNA Molecule:X-linked inhibitor of apoptosis (XIAP) siRNA antisense
gauagcaauauuucuaucctt

SEQ ID NO: 174 - DNA, 23 bp, Artificial Sequence
  mitotic kinesin microtubule-associated protein Eg5 (Kif11) siRNA
acctgcgtgcagtcggtcctcca

SEQ ID NO: 175 - DNA, 23 bp, Artificial Sequence
  mitotic kinesin microtubule-associated protein Eg5 (Kif11) siRNA
cctgcgtgcagtcggtcctccag

SEQ ID NO: 176 - DNA, 23 bp, Artificial Sequence
  mitotic kinesin microtubule-associated protein Eg5 (Kif11) siRNA
ctgcgtgcagtcggtcctccagg

SEQ ID NO: 177 - DNA, 23 bp, Artificial Sequence
  mitotic kinesin microtubule-associated protein Eg5 (Kif11) siRNA
tgcgtgcagtcggtcctccaggc

SEQ ID NO: 178 - DNA, 23 bp, Artificial Sequence
  mitotic kinesin microtubule-associated protein Eg5 (Kif11) siRNA
gcgtgcagtcggtcctccaggcc

SEQ ID NO: 179 - DNA, 23 bp, Artificial Sequence
  mitotic kinesin microtubule-associated protein Eg5 (Kif11) siRNA
cgtgcagtcggtcctccaggcca

SEQ ID NO: 180 - DNA, 23 bp, Artificial Sequence
  mitotic kinesin microtubule-associated protein Eg5 (Kif11) siRNA
gtgcagtcggtcctccaggccac

SEQ ID NO: 181 - DNA, 23 bp, Artificial Sequence
  mitotic kinesin microtubule-associated protein Eg5 (Kif11) siRNA
tgcagtcggtcctccaggccacg

SEQ ID NO: 182 - DNA, 23 bp, Artificial Sequence
  mitotic kinesin microtubule-associated protein Eg5 (Kif11) siRNA
gcagtcggtcctccaggccacgc

SEQ ID NO: 183 - DNA, 23 bp, Artificial Sequence
  mitotic kinesin microtubule-associated protein Eg5 (Kif11) siRNA
cagtcggtcctccaggccacgca

SEQ ID NO: 184 - DNA, 23 bp, Artificial Sequence
  mitotic kinesin microtubule-associated protein Eg5 (Kif11) siRNA
agtcggtcctccaggccacgcag

SEQ ID NO: 185 - DNA, 23 bp, Artificial Sequence
  mitotic kinesin microtubule-associated protein Eg5 (Kif11) siRNA
gtcggtcctccaggccacgcagc

SEQ ID NO: 186 - DNA, 23 bp, Artificial Sequence
  mitotic kinesin microtubule-associated protein Eg5 (Kif11) siRNA
tcggtcctccaggccacgcagcg

SEQ ID NO: 187 - DNA, 23 bp, Artificial Sequence
  mitotic kinesin microtubule-associated protein Eg5 (Kif11) siRNA
cggtcctccaggccacgcagcgc

SEQ ID NO: 188 - DNA, 23 bp, Artificial Sequence
  mitotic kinesin microtubule-associated protein Eg5 (Kif11) siRNA
ggtcctccaggccacgcagcgcc

SEQ ID NO: 189 - DNA, 23 bp, Artificial Sequence
  mitotic kinesin microtubule-associated protein Eg5 (Kif11) siRNA
gtcctccaggccacgcagcgccc

SEQ ID NO: 190 - DNA, 23 bp, Artificial Sequence
  mitotic kinesin microtubule-associated protein Eg5 (Kif11) siRNA
tcctccaggccacgcagcgcccg

SEQ ID NO: 191 - DNA, 23 bp, Artificial Sequence
  mitotic kinesin microtubule-associated protein Eg5 (Kif11) siRNA
cctccaggccacgcagcgcccga

SEQ ID NO: 192 - DNA, 23 bp, Artificial Sequence
  mitotic kinesin microtubule-associated protein Eg5 (Kif11) siRNA
ctccaggccacgcagcgcccgag

SEQ ID NO: 193 - DNA, 23 bp, Artificial Sequence
  mitotic kinesin microtubule-associated protein Eg5 (Kif11) siRNA
tccaggccacgcagcgcccgaga

SEQ ID NO: 194 - DNA, 23 bp, Artificial Sequence
  mitotic kinesin microtubule-associated protein Eg5 (Kif11) siRNA
ccaggccacgcagcgcccgagag

SEQ ID NO: 195 - DNA, 23 bp, Artificial Sequence
  mitotic kinesin microtubule-associated protein Eg5 (Kif11) siRNA
caggccacgcagcgcccgagagt

SEQ ID NO: 196 - DNA, 23 bp, Artificial Sequence
  mitotic kinesin microtubule-associated protein Eg5 (Kif11) siRNA
aggccacgcagcgcccgagagta

SEQ ID NO: 197 - DNA, 23 bp, Artificial Sequence
  mitotic kinesin microtubule-associated protein Eg5 (Kif11) siRNA
ggccacgcagcgcccgagagtac

SEQ ID NO: 198 - DNA, 23 bp, Artificial Sequence
  mitotic kinesin microtubule-associated protein Eg5 (Kif11) siRNA
gccacgcagcgcccgagagtacc

SEQ ID NO: 199 - DNA, 23 bp, Artificial Sequence
  mitotic kinesin microtubule-associated protein Eg5 (Kif11) siRNA
ccacgcagcgcccgagagtacca

SEQ ID NO: 200 - DNA, 23 bp, Artificial Sequence
  mitotic kinesin microtubule-associated protein Eg5 (Kif11) siRNA
cacgcagcgcccgagagtaccag

SEQ ID NO: 201 - DNA, 23 bp, Artificial Sequence
  mitotic kinesin microtubule-associated protein Eg5 (Kif11) siRNA
acgcagcgcccgagagtaccagg

SEQ ID NO: 202 - DNA, 23 bp, Artificial Sequence
  mitotic kinesin microtubule-associated protein Eg5 (Kif11) siRNA
cgcagcgcccgagagtaccaggg

SEQ ID NO: 203 - DNA, 23 bp, Artificial Sequence
  mitotic kinesin microtubule-associated protein Eg5 (Kif11) siRNA
gcagcgcccgagagtaccaggga

SEQ ID NO: 204 - DNA, 23 bp, Artificial Sequence
  mitotic kinesin microtubule-associated protein Eg5 (Kif11) siRNA
cagcgcccgagagtaccagggag

SEQ ID NO: 205 - DNA, 23 bp, Artificial Sequence
  mitotic kinesin microtubule-associated protein Eg5 (Kif11) siRNA
agcgcccgagagtaccagggaga

SEQ ID NO: 206 - DNA, 23 bp, Artificial Sequence
  mitotic kinesin microtubule-associated protein Eg5 (Kif11) siRNA
gcgcccgagagtaccagggagac

SEQ ID NO: 207 - DNA, 23 bp, Artificial Sequence
  mitotic kinesin microtubule-associated protein Eg5 (Kif11) siRNA
cgcccgagagtaccagggagact

SEQ ID NO: 208 - DNA, 23 bp, Artificial Sequence
  mitotic kinesin microtubule-associated protein Eg5 (Kif11) siRNA
gcccgagagtaccagggagactc

SEQ ID NO: 209 - DNA, 23 bp, Artificial Sequence
  mitotic kinesin microtubule-associated protein Eg5 (Kif11) siRNA
cccgagagtaccagggagactcc

SEQ ID NO: 210 - DNA, 23 bp, Artificial Sequence
  mitotic kinesin microtubule-associated protein Eg5 (Kif11) siRNA
ccgagagtaccagggagactccg

SEQ ID NO: 211 - DNA, 23 bp, Artificial Sequence
  mitotic kinesin microtubule-associated protein Eg5 (Kif11) siRNA
cgagagtaccagggagactccgg

SEQ ID NO: 212 - DNA, 23 bp, Artificial Sequence
  mitotic kinesin microtubule-associated protein Eg5 (Kif11) siRNA
gagagtaccagggagactccggc

SEQ ID NO: 213 - DNA, 23 bp, Artificial Sequence
  mitotic kinesin microtubule-associated protein Eg5 (Kif11) siRNA
agagtaccagggagactccggcc

SEQ ID NO: 214 - DNA, 23 bp, Artificial Sequence
  mitotic kinesin microtubule-associated protein Eg5 (Kif11) siRNA
gagtaccagggagactccggccc

SEQ ID NO: 215 - DNA, 23 bp, Artificial Sequence
  mitotic kinesin microtubule-associated protein Eg5 (Kif11) siRNA
agtaccagggagactccggcccc

SEQ ID NO: 216 - DNA, 23 bp, Artificial Sequence
  mitotic kinesin microtubule-associated protein Eg5 (Kif11) siRNA
gtaccagggagactccggcccct

SEQ ID NO: 217 - DNA, 23 bp, Artificial Sequence
  mitotic kinesin microtubule-associated protein Eg5 (Kif11) siRNA
taccagggagactccggcccctg

SEQ ID NO: 218 - DNA, 23 bp, Artificial Sequence
  mitotic kinesin microtubule-associated protein Eg5 (Kif11) siRNA
accagggagactccggcccctgt

SEQ ID NO: 219 - DNA, 23 bp, Artificial Sequence
  mitotic kinesin microtubule-associated protein Eg5 (Kif11) siRNA
ccagggagactccggcccctgtc

SEQ ID NO: 220 - DNA, 23 bp, Artificial Sequence
  mitotic kinesin microtubule-associated protein Eg5 (Kif11) siRNA
cagggagactccggcccctgtcg

SEQ ID NO: 221 - DNA, 23 bp, Artificial Sequence
  mitotic kinesin microtubule-associated protein Eg5 (Kif11) siRNA
agggagactccggcccctgtcgg

SEQ ID NO: 222 - DNA, 23 bp, Artificial Sequence
  mitotic kinesin microtubule-associated protein Eg5 (Kif11) siRNA
gggagactccggcccctgtcggc

SEQ ID NO: 223 - DNA, 23 bp, Artificial Sequence
  mitotic kinesin microtubule-associated protein Eg5 (Kif11) siRNA
ggagactccggcccctgtcggcg

SEQ ID NO: 224 - DNA, 23 bp, Artificial Sequence
  mitotic kinesin microtubule-associated protein Eg5 (Kif11) siRNA
gagactccggcccctgtcggcgc

SEQ ID NO: 225 - DNA, 23 bp, Artificial Sequence
  mitotic kinesin microtubule-associated protein Eg5 (Kif11) siRNA
agactccggcccctgtcggcgcc

SEQ ID NO: 226 - DNA, 23 bp, Artificial Sequence
  mitotic kinesin microtubule-associated protein Eg5 (Kif11) siRNA
gactccggcccctgtcggcgcca

SEQ ID NO: 227 - DNA, 23 bp, Artificial Sequence
  mitotic kinesin microtubule-associated protein Eg5 (Kif11) siRNA
actccggcccctgtcggcgccaa

SEQ ID NO: 228 - DNA, 23 bp, Artificial Sequence
  mitotic kinesin microtubule-associated protein Eg5 (Kif11) siRNA
ctccggcccctgtcggcgccaag

SEQ ID NO: 229 - DNA, 23 bp, Artificial Sequence
  mitotic kinesin microtubule-associated protein Eg5 (Kif11) siRNA
tccggcccctgtcggcgccaagc

SEQ ID NO: 230 - DNA, 23 bp, Artificial Sequence
  mitotic kinesin microtubule-associated protein Eg5 (Kif11) siRNA
ccggcccctgtcggcgccaagcc

SEQ ID NO: 231 - DNA, 23 bp, Artificial Sequence
  mitotic kinesin microtubule-associated protein Eg5 (Kif11) siRNA
cggcccctgtcggcgccaagccc

SEQ ID NO: 232 - DNA, 23 bp, Artificial Sequence
  mitotic kinesin microtubule-associated protein Eg5 (Kif11) siRNA
ggcccctgtcggcgccaagcccc

SEQ ID NO: 233 - DNA, 23 bp, Artificial Sequence
  mitotic kinesin microtubule-associated protein Eg5 (Kif11) siRNA
gcccctgtcggcgccaagcccct

SEQ ID NO: 234 - DNA, 23 bp, Artificial Sequence
  mitotic kinesin microtubule-associated protein Eg5 (Kif11) siRNA
cccctgtcggcgccaagcccctc

SEQ ID NO: 235 - DNA, 23 bp, Artificial Sequence
  mitotic kinesin microtubule-associated protein Eg5 (Kif11) siRNA
ccctgtcggcgccaagcccctcc

SEQ ID NO: 236 - DNA, 23 bp, Artificial Sequence
  mitotic kinesin microtubule-associated protein Eg5 (Kif11) siRNA
cctgtcggcgccaagcccctccg

SEQ ID NO: 237 - DNA, 23 bp, Artificial Sequence
  mitotic kinesin microtubule-associated protein Eg5 (Kif11) siRNA
ctgtcggcgccaagcccctccgc

SEQ ID NO: 238 - DNA, 23 bp, Artificial Sequence
  mitotic kinesin microtubule-associated protein Eg5 (Kif11) siRNA
tgtcggcgccaagcccctccgcc

SEQ ID NO: 239 - DNA, 23 bp, Artificial Sequence
  mitotic kinesin microtubule-associated protein Eg5 (Kif11) siRNA
gtcggcgccaagcccctccgccc

SEQ ID NO: 240 - DNA, 23 bp, Artificial Sequence
  mitotic kinesin microtubule-associated protein Eg5 (Kif11) siRNA
tcggcgccaagcccctccgcccc

SEQ ID NO: 241 - DNA, 23 bp, Artificial Sequence
  mitotic kinesin microtubule-associated protein Eg5 (Kif11) siRNA
cggcgccaagcccctccgcccct

SEQ ID NO: 242 - DNA, 23 bp, Artificial Sequence
  mitotic kinesin microtubule-associated protein Eg5 (Kif11) siRNA
ggcgccaagcccctccgcccctc

SEQ ID NO: 243 - DNA, 23 bp, Artificial Sequence
  mitotic kinesin microtubule-associated protein Eg5 (Kif11) siRNA
gcgccaagcccctccgcccctca

SEQ ID NO: 244 - DNA, 23 bp, Artificial Sequence
  mitotic kinesin microtubule-associated protein Eg5 (Kif11) siRNA
cgccaagcccctccgcccctcac

SEQ ID NO: 245 - DNA, 23 bp, Artificial Sequence
  mitotic kinesin microtubule-associated protein Eg5 (Kif11) siRNA
gccaagcccctccgcccctcaca

SEQ ID NO: 246 - DNA, 23 bp, Artificial Sequence
  mitotic kinesin microtubule-associated protein Eg5 (Kif11) siRNA
ccaagcccctccgcccctcacag

SEQ ID NO: 247 - DNA, 23 bp, Artificial Sequence
  mitotic kinesin microtubule-associated protein Eg5 (Kif11) siRNA
caagcccctccgcccctcacagc

SEQ ID NO: 248 - DNA, 23 bp, Artificial Sequence
  mitotic kinesin microtubule-associated protein Eg5 (Kif11) siRNA
aagcccctccgcccctcacagcg

SEQ ID NO: 249 - DNA, 23 bp, Artificial Sequence
  mitotic kinesin microtubule-associated protein Eg5 (Kif11) siRNA
agcccctccgcccctcacagcgc

SEQ ID NO: 250 - DNA, 23 bp, Artificial Sequence
  mitotic kinesin microtubule-associated protein Eg5 (Kif11) siRNA
gcccctccgcccctcacagcgcc

SEQ ID NO: 251 - DNA, 23 bp, Artificial Sequence
  mitotic kinesin microtubule-associated protein Eg5 (Kif11) siRNA
cccctccgcccctcacagcgccc

SEQ ID NO: 252 - DNA, 23 bp, Artificial Sequence
  mitotic kinesin microtubule-associated protein Eg5 (Kif11) siRNA
ccctccgcccctcacagcgccca

SEQ ID NO: 253 - DNA, 23 bp, Artificial Sequence
  mitotic kinesin microtubule-associated protein Eg5 (Kif11) siRNA
cctccgcccctcacagcgcccag

SEQ ID NO: 254 - DNA, 23 bp, Artificial Sequence
  mitotic kinesin microtubule-associated protein Eg5 (Kif11) siRNA
ctccgcccctcacagcgcccagg

SEQ ID NO: 255 - DNA, 23 bp, Artificial Sequence
  mitotic kinesin microtubule-associated protein Eg5 (Kif11) siRNA
tccgcccctcacagcgcccaggt

SEQ ID NO: 256 - DNA, 23 bp, Artificial Sequence
  mitotic kinesin microtubule-associated protein Eg5 (Kif11) siRNA
ccgcccctcacagcgcccaggtc

SEQ ID NO: 257 - DNA, 23 bp, Artificial Sequence
  mitotic kinesin microtubule-associated protein Eg5 (Kif11) siRNA
cgcccctcacagcgcccaggtcc

SEQ ID NO: 258 - DNA, 23 bp, Artificial Sequence
  mitotic kinesin microtubule-associated protein Eg5 (Kif11) siRNA
gcccctcacagcgcccaggtccg

SEQ ID NO: 259 - DNA, 23 bp, Artificial Sequence
  mitotic kinesin microtubule-associated protein Eg5 (Kif11) siRNA
cccctcacagcgcccaggtccgc

SEQ ID NO: 260 - DNA, 23 bp, Artificial Sequence
  mitotic kinesin microtubule-associated protein Eg5 (Kif11) siRNA
ccctcacagcgcccaggtccgcg

SEQ ID NO: 261 - DNA, 23 bp, Artificial Sequence
  mitotic kinesin microtubule-associated protein Eg5 (Kif11) siRNA
cctcacagcgcccaggtccgcgg

SEQ ID NO: 262 - DNA, 23 bp, Artificial Sequence
  mitotic kinesin microtubule-associated protein Eg5 (Kif11) siRNA
ctcacagcgcccaggtccgcggc

SEQ ID NO: 263 - DNA, 23 bp, Artificial Sequence
  mitotic kinesin microtubule-associated protein Eg5 (Kif11) siRNA
tcacagcgcccaggtccgcggcc

SEQ ID NO: 264 - DNA, 23 bp, Artificial Sequence
  mitotic kinesin microtubule-associated protein Eg5 (Kif11) siRNA
gccgggccttgattttttggcgg

SEQ ID NO: 265 - DNA, 23 bp, Artificial Sequence
  mitotic kinesin microtubule-associated protein Eg5 (Kif11) siRNA
ccgggccttgattttttggcggg

SEQ ID NO: 266 - DNA, 23 bp, Artificial Sequence
  mitotic kinesin microtubule-associated protein Eg5 (Kif11) siRNA
cgggccttgattttttggcgggg

SEQ ID NO: 267 - DNA, 23 bp, Artificial Sequence
  mitotic kinesin microtubule-associated protein Eg5 (Kif11) siRNA
gggccttgattttttggcgggga

SEQ ID NO: 268 - DNA, 23 bp, Artificial Sequence
  mitotic kinesin microtubule-associated protein Eg5 (Kif11) siRNA
ggccttgattttttggcggggac

SEQ ID NO: 269 - DNA, 23 bp, Artificial Sequence
  mitotic kinesin microtubule-associated protein Eg5 (Kif11) siRNA
gccttgattttttggcggggacc

SEQ ID NO: 270 - DNA, 23 bp, Artificial Sequence
  mitotic kinesin microtubule-associated protein Eg5 (Kif11) siRNA
ccttgattttttggcggggaccg

SEQ ID NO: 271 - DNA, 23 bp, Artificial Sequence
  mitotic kinesin microtubule-associated protein Eg5 (Kif11) siRNA
cttgattttttggcggggaccgt

SEQ ID NO: 272 - DNA, 23 bp, Artificial Sequence
  mitotic kinesin microtubule-associated protein Eg5 (Kif11) siRNA
atggcgtcgcagccaaattcgtc

SEQ ID NO: 273 - DNA, 23 bp, Artificial Sequence
  mitotic kinesin microtubule-associated protein Eg5 (Kif11) siRNA
tggcgtcgcagccaaattcgtct

SEQ ID NO: 274 - DNA, 23 bp, Artificial Sequence
  mitotic kinesin microtubule-associated protein Eg5 (Kif11) siRNA
ggcgtcgcagccaaattcgtctg

SEQ ID NO: 275 - DNA, 23 bp, Artificial Sequence
  mitotic kinesin microtubule-associated protein Eg5 (Kif11) siRNA
gcgtcgcagccaaattcgtctgc

SEQ ID NO: 276 - DNA, 23 bp, Artificial Sequence
  mitotic kinesin microtubule-associated protein Eg5 (Kif11) siRNA
cgtcgcagccaaattcgtctgcg

SEQ ID NO: 277 - DNA, 23 bp, Artificial Sequence
  mitotic kinesin microtubule-associated protein Eg5 (Kif11) siRNA
gtcgcagccaaattcgtctgcga

SEQ ID NO: 278 - DNA, 23 bp, Artificial Sequence
  mitotic kinesin microtubule-associated protein Eg5 (Kif11) siRNA
tcgcagccaaattcgtctgcgaa

SEQ ID NO: 279 - DNA, 23 bp, Artificial Sequence
  mitotic kinesin microtubule-associated protein Eg5 (Kif11) siRNA
cgcagccaaattcgtctgcgaag

SEQ ID NO: 280 - DNA, 23 bp, Artificial Sequence
  mitotic kinesin microtubule-associated protein Eg5 (Kif11) siRNA
gcagccaaattcgtctgcgaaga

SEQ ID NO: 281 - DNA, 23 bp, Artificial Sequence
  mitotic kinesin microtubule-associated protein Eg5 (Kif11) siRNA
cagccaaattcgtctgcgaagaa

SEQ ID NO: 282 - DNA, 23 bp, Artificial Sequence
  mitotic kinesin microtubule-associated protein Eg5 (Kif11) siRNA
agccaaattcgtctgcgaagaag

SEQ ID NO: 283 - DNA, 23 bp, Artificial Sequence
  mitotic kinesin microtubule-associated protein Eg5 (Kif11) siRNA
gccaaattcgtctgcgaagaaga

SEQ ID NO: 284 - DNA, 23 bp, Artificial Sequence
  mitotic kinesin microtubule-associated protein Eg5 (Kif11) siRNA
ccaaattcgtctgcgaagaagaa

SEQ ID NO: 285 - DNA, 23 bp, Artificial Sequence
  mitotic kinesin microtubule-associated protein Eg5 (Kif11) siRNA
caaattcgtctgcgaagaagaaa

SEQ ID NO: 286 - DNA, 23 bp, Artificial Sequence
  mitotic kinesin microtubule-associated protein Eg5 (Kif11) siRNA
aaattcgtctgcgaagaagaaag

SEQ ID NO: 287 - DNA, 23 bp, Artificial Sequence
  mitotic kinesin microtubule-associated protein Eg5 (Kif11) siRNA
aattcgtctgcgaagaagaaaga

SEQ ID NO: 288 - DNA, 23 bp, Artificial Sequence
  mitotic kinesin microtubule-associated protein Eg5 (Kif11) siRNA
attcgtctgcgaagaagaaagag

SEQ ID NO: 289 - DNA, 23 bp, Artificial Sequence
  mitotic kinesin microtubule-associated protein Eg5 (Kif11) siRNA
ttcgtctgcgaagaagaaagagg

SEQ ID NO: 290 - DNA, 23 bp, Artificial Sequence
  mitotic kinesin microtubule-associated protein Eg5 (Kif11) siRNA
tcgtctgcgaagaagaaagagga

SEQ ID NO: 291 - DNA, 23 bp, Artificial Sequence
  mitotic kinesin microtubule-associated protein Eg5 (Kif11) siRNA
cgtctgcgaagaagaaagaggag

SEQ ID NO: 292 - DNA, 23 bp, Artificial Sequence
  mitotic kinesin microtubule-associated protein Eg5 (Kif11) siRNA
gtctgcgaagaagaaagaggaga

SEQ ID NO: 293 - DNA, 23 bp, Artificial Sequence
  mitotic kinesin microtubule-associated protein Eg5 (Kif11) siRNA
tctgcgaagaagaaagaggagaa

SEQ ID NO: 294 - DNA, 23 bp, Artificial Sequence
  mitotic kinesin microtubule-associated protein Eg5 (Kif11) siRNA
ctgcgaagaagaaagaggagaag

SEQ ID NO: 295 - DNA, 23 bp, Artificial Sequence
  mitotic kinesin microtubule-associated protein Eg5 (Kif11) siRNA
tgcgaagaagaaagaggagaagg

SEQ ID NO: 296 - DNA, 23 bp, Artificial Sequence
  mitotic kinesin microtubule-associated protein Eg5 (Kif11) siRNA
gcgaagaagaaagaggagaaggg

SEQ ID NO: 297 - DNA, 23 bp, Artificial Sequence
  mitotic kinesin microtubule-associated protein Eg5 (Kif11) siRNA
cgaagaagaaagaggagaagggg

SEQ ID NO: 298 - DNA, 23 bp, Artificial Sequence
  mitotic kinesin microtubule-associated protein Eg5 (Kif11) siRNA
gaagaagaaagaggagaagggga

SEQ ID NO: 299 - DNA, 23 bp, Artificial Sequence
  mitotic kinesin microtubule-associated protein Eg5 (Kif11) siRNA
aagaagaaagaggagaaggggaa

SEQ ID NO: 300 - DNA, 23 bp, Artificial Sequence
  mitotic kinesin microtubule-associated protein Eg5 (Kif11) siRNA
agaagaaagaggagaaggggaag

SEQ ID NO: 301 - DNA, 23 bp, Artificial Sequence
  mitotic kinesin microtubule-associated protein Eg5 (Kif11) siRNA
gaagaaagaggagaaggggaaga

SEQ ID NO: 302 - DNA, 23 bp, Artificial Sequence
  mitotic kinesin microtubule-associated protein Eg5 (Kif11) siRNA
aagaaagaggagaaggggaagaa

SEQ ID NO: 303 - DNA, 23 bp, Artificial Sequence
  mitotic kinesin microtubule-associated protein Eg5 (Kif11) siRNA
agaaagaggagaaggggaagaac

SEQ ID NO: 304 - DNA, 23 bp, Artificial Sequence
  mitotic kinesin microtubule-associated protein Eg5 (Kif11) siRNA
gaaagaggagaaggggaagaaca

SEQ ID NO: 305 - DNA, 23 bp, Artificial Sequence
  mitotic kinesin microtubule-associated protein Eg5 (Kif11) siRNA
aaagaggagaaggggaagaacat

SEQ ID NO: 306 - DNA, 23 bp, Artificial Sequence
  mitotic kinesin microtubule-associated protein Eg5 (Kif11) siRNA
aagaggagaaggggaagaacatc

SEQ ID NO: 307 - DNA, 23 bp, Artificial Sequence
  mitotic kinesin microtubule-associated protein Eg5 (Kif11) siRNA
agaggagaaggggaagaacatcc

SEQ ID NO: 308 - DNA, 23 bp, Artificial Sequence
  mitotic kinesin microtubule-associated protein Eg5 (Kif11) siRNA
gaggagaaggggaagaacatcca

SEQ ID NO: 309 - DNA, 23 bp, Artificial Sequence
  mitotic kinesin microtubule-associated protein Eg5 (Kif11) siRNA
aggagaaggggaagaacatccag

SEQ ID NO: 310 - DNA, 23 bp, Artificial Sequence
  mitotic kinesin microtubule-associated protein Eg5 (Kif11) siRNA
ggagaaggggaagaacatccagg

SEQ ID NO: 311 - DNA, 23 bp, Artificial Sequence
  mitotic kinesin microtubule-associated protein Eg5 (Kif11) siRNA
gagaaggggaagaacatccaggt

SEQ ID NO: 312 - DNA, 23 bp, Artificial Sequence
  mitotic kinesin microtubule-associated protein Eg5 (Kif11) siRNA
agaaggggaagaacatccaggtg

SEQ ID NO: 313 - DNA, 23 bp, Artificial Sequence
  mitotic kinesin microtubule-associated protein Eg5 (Kif11) siRNA
gaaggggaagaacatccaggtgg

SEQ ID NO: 314 - DNA, 23 bp, Artificial Sequence
  mitotic kinesin microtubule-associated protein Eg5 (Kif11) siRNA
aaggggaagaacatccaggtggt

SEQ ID NO: 315 - DNA, 23 bp, Artificial Sequence
  mitotic kinesin microtubule-associated protein Eg5 (Kif11) siRNA
aggggaagaacatccaggtggtg

SEQ ID NO: 316 - DNA, 23 bp, Artificial Sequence
  mitotic kinesin microtubule-associated protein Eg5 (Kif11) siRNA
ggggaagaacatccaggtggtgg

SEQ ID NO: 317 - DNA, 23 bp, Artificial Sequence
  mitotic kinesin microtubule-associated protein Eg5 (Kif11) siRNA
gggaagaacatccaggtggtggt

SEQ ID NO: 318 - DNA, 23 bp, Artificial Sequence
  mitotic kinesin microtubule-associated protein Eg5 (Kif11) siRNA
ggaagaacatccaggtggtggtg

SEQ ID NO: 319 - DNA, 23 bp, Artificial Sequence
  mitotic kinesin microtubule-associated protein Eg5 (Kif11) siRNA
gaagaacatccaggtggtggtga

SEQ ID NO: 320 - DNA, 23 bp, Artificial Sequence
  mitotic kinesin microtubule-associated protein Eg5 (Kif11) siRNA
aagaacatccaggtggtggtgag

SEQ ID NO: 321 - DNA, 23 bp, Artificial Sequence
  mitotic kinesin microtubule-associated protein Eg5 (Kif11) siRNA
agaacatccaggtggtggtgaga

SEQ ID NO: 322 - DNA, 23 bp, Artificial Sequence
  mitotic kinesin microtubule-associated protein Eg5 (Kif11) siRNA
gaacatccaggtggtggtgagat

SEQ ID NO: 323 - DNA, 23 bp, Artificial Sequence
  mitotic kinesin microtubule-associated protein Eg5 (Kif11) siRNA
aacatccaggtggtggtgagatg

SEQ ID NO: 324 - DNA, 23 bp, Artificial Sequence
  mitotic kinesin microtubule-associated protein Eg5 (Kif11) siRNA
acatccaggtggtggtgagatgc

SEQ ID NO: 325 - DNA, 23 bp, Artificial Sequence
  mitotic kinesin microtubule-associated protein Eg5 (Kif11) siRNA
catccaggtggtggtgagatgca

SEQ ID NO: 326 - DNA, 23 bp, Artificial Sequence
  mitotic kinesin microtubule-associated protein Eg5 (Kif11) siRNA
atccaggtggtggtgagatgcag

SEQ ID NO: 327 - DNA, 23 bp, Artificial Sequence
  mitotic kinesin microtubule-associated protein Eg5 (Kif11) siRNA
tccaggtggtggtgagatgcaga

SEQ ID NO: 328 - DNA, 23 bp, Artificial Sequence
  mitotic kinesin microtubule-associated protein Eg5 (Kif11) siRNA
ccaggtggtggtgagatgcagac

SEQ ID NO: 329 - DNA, 23 bp, Artificial Sequence
  mitotic kinesin microtubule-associated protein Eg5 (Kif11) siRNA
caggtggtggtgagatgcagacc

SEQ ID NO: 330 - DNA, 23 bp, Artificial Sequence
  mitotic kinesin microtubule-associated protein Eg5 (Kif11) siRNA
aggtggtggtgagatgcagacca

SEQ ID NO: 331 - DNA, 23 bp, Artificial Sequence
  mitotic kinesin microtubule-associated protein Eg5 (Kif11) siRNA
ggtggtggtgagatgcagaccat

SEQ ID NO: 332 - DNA, 23 bp, Artificial Sequence
  mitotic kinesin microtubule-associated protein Eg5 (Kif11) siRNA
gtggtggtgagatgcagaccatt

SEQ ID NO: 333 - DNA, 23 bp, Artificial Sequence
  mitotic kinesin microtubule-associated protein Eg5 (Kif11) siRNA
tggtggtgagatgcagaccattt

SEQ ID NO: 334 - DNA, 23 bp, Artificial Sequence
  mitotic kinesin microtubule-associated protein Eg5 (Kif11) siRNA
ggtggtgagatgcagaccattta

SEQ ID NO: 335 - DNA, 23 bp, Artificial Sequence
  mitotic kinesin microtubule-associated protein Eg5 (Kif11) siRNA
gtggtgagatgcagaccatttaa

SEQ ID NO: 336 - DNA, 23 bp, Artificial Sequence
  mitotic kinesin microtubule-associated protein Eg5 (Kif11) siRNA
tggtgagatgcagaccatttaat

SEQ ID NO: 337 - DNA, 23 bp, Artificial Sequence
  mitotic kinesin microtubule-associated protein Eg5 (Kif11) siRNA
ggtgagatgcagaccatttaatt

SEQ ID NO: 338 - DNA, 23 bp, Artificial Sequence
  mitotic kinesin microtubule-associated protein Eg5 (Kif11) siRNA
gtgagatgcagaccatttaattt

SEQ ID NO: 339 - DNA, 23 bp, Artificial Sequence
  mitotic kinesin microtubule-associated protein Eg5 (Kif11) siRNA
tgagatgcagaccatttaatttg

SEQ ID NO: 340 - DNA, 23 bp, Artificial Sequence
  mitotic kinesin microtubule-associated protein Eg5 (Kif11) siRNA
gagatgcagaccatttaatttgg

SEQ ID NO: 341 - DNA, 23 bp, Artificial Sequence
  mitotic kinesin microtubule-associated protein Eg5 (Kif11) siRNA
agatgcagaccatttaatttggc

SEQ ID NO: 342 - DNA, 23 bp, Artificial Sequence
  mitotic kinesin microtubule-associated protein Eg5 (Kif11) siRNA
gatgcagaccatttaatttggca

SEQ ID NO: 343 - DNA, 23 bp, Artificial Sequence
  mitotic kinesin microtubule-associated protein Eg5 (Kif11) siRNA
atgcagaccatttaatttggcag

SEQ ID NO: 344 - DNA, 23 bp, Artificial Sequence
  mitotic kinesin microtubule-associated protein Eg5 (Kif11) siRNA
tgcagaccatttaatttggcaga

SEQ ID NO: 345 - DNA, 23 bp, Artificial Sequence
  mitotic kinesin microtubule-associated protein Eg5 (Kif11) siRNA
gcagaccatttaatttggcagag

SEQ ID NO: 346 - DNA, 23 bp, Artificial Sequence
  mitotic kinesin microtubule-associated protein Eg5 (Kif11) siRNA
cagaccatttaatttggcagagc

SEQ ID NO: 347 - DNA, 23 bp, Artificial Sequence
  mitotic kinesin microtubule-associated protein Eg5 (Kif11) siRNA
agaccatttaatttggcagagcg

SEQ ID NO: 348 - DNA, 23 bp, Artificial Sequence
  mitotic kinesin microtubule-associated protein Eg5 (Kif11) siRNA
gaccatttaatttggcagagcgg

SEQ ID NO: 349 - DNA, 23 bp, Artificial Sequence
  mitotic kinesin microtubule-associated protein Eg5 (Kif11) siRNA
accatttaatttggcagagcgga

SEQ ID NO: 350 - DNA, 23 bp, Artificial Sequence
  mitotic kinesin microtubule-associated protein Eg5 (Kif11) siRNA
ccatttaatttggcagagcggaa

SEQ ID NO: 351 - DNA, 23 bp, Artificial Sequence
  mitotic kinesin microtubule-associated protein Eg5 (Kif11) siRNA
catttaatttggcagagcggaaa

SEQ ID NO: 352 - DNA, 23 bp, Artificial Sequence
  mitotic kinesin microtubule-associated protein Eg5 (Kif11) siRNA
atttaatttggcagagcggaaag

SEQ ID NO: 353 - DNA, 23 bp, Artificial Sequence
  mitotic kinesin microtubule-associated protein Eg5 (Kif11) siRNA
tttaatttggcagagcggaaagc

SEQ ID NO: 354 - DNA, 23 bp, Artificial Sequence
  mitotic kinesin microtubule-associated protein Eg5 (Kif11) siRNA
ttaatttggcagagcggaaagct

SEQ ID NO: 355 - DNA, 23 bp, Artificial Sequence
  mitotic kinesin microtubule-associated protein Eg5 (Kif11) siRNA
taatttggcagagcggaaagcta

SEQ ID NO: 356 - DNA, 23 bp, Artificial Sequence
  mitotic kinesin microtubule-associated protein Eg5 (Kif11) siRNA
aatttggcagagcggaaagctag

SEQ ID NO: 357 - DNA, 23 bp, Artificial Sequence
  mitotic kinesin microtubule-associated protein Eg5 (Kif11) siRNA
atttggcagagcggaaagctagc

SEQ ID NO: 358 - DNA, 23 bp, Artificial Sequence
  mitotic kinesin microtubule-associated protein Eg5 (Kif11) siRNA
tttggcagagcggaaagctagcg

SEQ ID NO: 359 - DNA, 23 bp, Artificial Sequence
  mitotic kinesin microtubule-associated protein Eg5 (Kif11) siRNA
ttggcagagcggaaagctagcgc

SEQ ID NO: 360 - DNA, 23 bp, Artificial Sequence
  mitotic kinesin microtubule-associated protein Eg5 (Kif11) siRNA
tggcagagcggaaagctagcgcc

SEQ ID NO: 361 - DNA, 23 bp, Artificial Sequence
  mitotic kinesin microtubule-associated protein Eg5 (Kif11) siRNA
ggcagagcggaaagctagcgccc

SEQ ID NO: 362 - DNA, 23 bp, Artificial Sequence
  mitotic kinesin microtubule-associated protein Eg5 (Kif11) siRNA
gcagagcggaaagctagcgccca

SEQ ID NO: 363 - DNA, 23 bp, Artificial Sequence
  mitotic kinesin microtubule-associated protein Eg5 (Kif11) siRNA
cagagcggaaagctagcgcccat

SEQ ID NO: 364 - DNA, 23 bp, Artificial Sequence
  mitotic kinesin microtubule-associated protein Eg5 (Kif11) siRNA
agagcggaaagctagcgcccatt

SEQ ID NO: 365 - DNA, 23 bp, Artificial Sequence
  mitotic kinesin microtubule-associated protein Eg5 (Kif11) siRNA
gagcggaaagctagcgcccattc

SEQ ID NO: 366 - DNA, 23 bp, Artificial Sequence
  mitotic kinesin microtubule-associated protein Eg5 (Kif11) siRNA
agcggaaagctagcgcccattca

SEQ ID NO: 367 - DNA, 23 bp, Artificial Sequence
  mitotic kinesin microtubule-associated protein Eg5 (Kif11) siRNA
gcggaaagctagcgcccattcaa

SEQ ID NO: 368 - DNA, 23 bp, Artificial Sequence
  mitotic kinesin microtubule-associated protein Eg5 (Kif11) siRNA
cggaaagctagcgcccattcaat

SEQ ID NO: 369 - DNA, 23 bp, Artificial Sequence
  mitotic kinesin microtubule-associated protein Eg5 (Kif11) siRNA
ggaaagctagcgcccattcaata

SEQ ID NO: 370 - DNA, 23 bp, Artificial Sequence
  mitotic kinesin microtubule-associated protein Eg5 (Kif11) siRNA
gaaagctagcgcccattcaatag

SEQ ID NO: 371 - DNA, 23 bp, Artificial Sequence
  mitotic kinesin microtubule-associated protein Eg5 (Kif11) siRNA
aaagctagcgcccattcaatagt

SEQ ID NO: 372 - DNA, 23 bp, Artificial Sequence
  mitotic kinesin microtubule-associated protein Eg5 (Kif11) siRNA
aagctagcgcccattcaatagta

SEQ ID NO: 373 - DNA, 23 bp, Artificial Sequence
  mitotic kinesin microtubule-associated protein Eg5 (Kif11) siRNA
agctagcgcccattcaatagtag

SEQ ID NO: 374 - DNA, 23 bp, Artificial Sequence
  mitotic kinesin microtubule-associated protein Eg5 (Kif11) siRNA
gctagcgcccattcaatagtaga

SEQ ID NO: 375 - DNA, 23 bp, Artificial Sequence
  mitotic kinesin microtubule-associated protein Eg5 (Kif11) siRNA
ctagcgcccattcaatagtagaa

SEQ ID NO: 376 - DNA, 23 bp, Artificial Sequence
  mitotic kinesin microtubule-associated protein Eg5 (Kif11) siRNA
tagcgcccattcaatagtagaat

SEQ ID NO: 377 - DNA, 23 bp, Artificial Sequence
  mitotic kinesin microtubule-associated protein Eg5 (Kif11) siRNA
agcgcccattcaatagtagaatg

SEQ ID NO: 378 - DNA, 23 bp, Artificial Sequence
  mitotic kinesin microtubule-associated protein Eg5 (Kif11) siRNA
gcgcccattcaatagtagaatgt

SEQ ID NO: 379 - DNA, 23 bp, Artificial Sequence
  mitotic kinesin microtubule-associated protein Eg5 (Kif11) siRNA
cgcccattcaatagtagaatgtg

SEQ ID NO: 380 - DNA, 23 bp, Artificial Sequence
  mitotic kinesin microtubule-associated protein Eg5 (Kif11) siRNA
gcccattcaatagtagaatgtga

SEQ ID NO: 381 - DNA, 23 bp, Artificial Sequence
  mitotic kinesin microtubule-associated protein Eg5 (Kif11) siRNA
cccattcaatagtagaatgtgat

SEQ ID NO: 382 - DNA, 23 bp, Artificial Sequence
  mitotic kinesin microtubule-associated protein Eg5 (Kif11) siRNA
ccattcaatagtagaatgtgatc

SEQ ID NO: 383 - DNA, 23 bp, Artificial Sequence
  mitotic kinesin microtubule-associated protein Eg5 (Kif11) siRNA
cattcaatagtagaatgtgatcc

SEQ ID NO: 384 - DNA, 23 bp, Artificial Sequence
  mitotic kinesin microtubule-associated protein Eg5 (Kif11) siRNA
attcaatagtagaatgtgatcct

SEQ ID NO: 385 - DNA, 23 bp, Artificial Sequence
  mitotic kinesin microtubule-associated protein Eg5 (Kif11) siRNA
ttcaatagtagaatgtgatcctg

SEQ ID NO: 386 - DNA, 23 bp, Artificial Sequence
  mitotic kinesin microtubule-associated protein Eg5 (Kif11) siRNA
tcaatagtagaatgtgatcctgt

SEQ ID NO: 387 - DNA, 23 bp, Artificial Sequence
  mitotic kinesin microtubule-associated protein Eg5 (Kif11) siRNA
caatagtagaatgtgatcctgta

SEQ ID NO: 388 - DNA, 23 bp, Artificial Sequence
  mitotic kinesin microtubule-associated protein Eg5 (Kif11) siRNA
aatagtagaatgtgatcctgtac

SEQ ID NO: 389 - DNA, 23 bp, Artificial Sequence
  mitotic kinesin microtubule-associated protein Eg5 (Kif11) siRNA
atagtagaatgtgatcctgtacg

SEQ ID NO: 390 - DNA, 23 bp, Artificial Sequence
  mitotic kinesin microtubule-associated protein Eg5 (Kif11) siRNA
tagtagaatgtgatcctgtacga

SEQ ID NO: 391 - DNA, 23 bp, Artificial Sequence
  mitotic kinesin microtubule-associated protein Eg5 (Kif11) siRNA
agtagaatgtgatcctgtacgaa

SEQ ID NO: 392 - DNA, 23 bp, Artificial Sequence
  mitotic kinesin microtubule-associated protein Eg5 (Kif11) siRNA
gtagaatgtgatcctgtacgaaa

SEQ ID NO: 393 - DNA, 23 bp, Artificial Sequence
  mitotic kinesin microtubule-associated protein Eg5 (Kif11) siRNA
tagaatgtgatcctgtacgaaaa

SEQ ID NO: 394 - DNA, 23 bp, Artificial Sequence
  mitotic kinesin microtubule-associated protein Eg5 (Kif11) siRNA
agaatgtgatcctgtacgaaaag

SEQ ID NO: 395 - DNA, 23 bp, Artificial Sequence
  mitotic kinesin microtubule-associated protein Eg5 (Kif11) siRNA
gaatgtgatcctgtacgaaaaga

SEQ ID NO: 396 - DNA, 23 bp, Artificial Sequence
  mitotic kinesin microtubule-associated protein Eg5 (Kif11) siRNA
aatgtgatcctgtacgaaaagaa

SEQ ID NO: 397 - DNA, 23 bp, Artificial Sequence
  mitotic kinesin microtubule-associated protein Eg5 (Kif11) siRNA
atgtgatcctgtacgaaaagaag

SEQ ID NO: 398 - DNA, 23 bp, Artificial Sequence
  mitotic kinesin microtubule-associated protein Eg5 (Kif11) siRNA
tgtgatcctgtacgaaaagaagt

SEQ ID NO: 399 - DNA, 23 bp, Artificial Sequence
  mitotic kinesin microtubule-associated protein Eg5 (Kif11) siRNA
gtgatcctgtacgaaaagaagtt

SEQ ID NO: 400 - DNA, 23 bp, Artificial Sequence
  mitotic kinesin microtubule-associated protein Eg5 (Kif11) siRNA
tgatcctgtacgaaaagaagtta

SEQ ID NO: 401 - DNA, 23 bp, Artificial Sequence
  mitotic kinesin microtubule-associated protein Eg5 (Kif11) siRNA
gatcctgtacgaaaagaagttag

SEQ ID NO: 402 - DNA, 23 bp, Artificial Sequence
  mitotic kinesin microtubule-associated protein Eg5 (Kif11) siRNA
atcctgtacgaaaagaagttagt

SEQ ID NO: 403 - DNA, 23 bp, Artificial Sequence
  mitotic kinesin microtubule-associated protein Eg5 (Kif11) siRNA
tcctgtacgaaaagaagttagtg

SEQ ID NO: 404 - DNA, 23 bp, Artificial Sequence
  mitotic kinesin microtubule-associated protein Eg5 (Kif11) siRNA
cctgtacgaaaagaagttagtgt

SEQ ID NO: 405 - DNA, 23 bp, Artificial Sequence
  mitotic kinesin microtubule-associated protein Eg5 (Kif11) siRNA
ctgtacgaaaagaagttagtgta

SEQ ID NO: 406 - DNA, 23 bp, Artificial Sequence
  mitotic kinesin microtubule-associated protein Eg5 (Kif11) siRNA
tgtacgaaaagaagttagtgtac

SEQ ID NO: 407 - DNA, 23 bp, Artificial Sequence
  mitotic kinesin microtubule-associated protein Eg5 (Kif11) siRNA
gtacgaaaagaagttagtgtacg

SEQ ID NO: 408 - DNA, 23 bp, Artificial Sequence
  mitotic kinesin microtubule-associated protein Eg5 (Kif11) siRNA
tacgaaaagaagttagtgtacga

SEQ ID NO: 409 - DNA, 23 bp, Artificial Sequence
  mitotic kinesin microtubule-associated protein Eg5 (Kif11) siRNA
acgaaaagaagttagtgtacgaa

SEQ ID NO: 410 - DNA, 23 bp, Artificial Sequence
  mitotic kinesin microtubule-associated protein Eg5 (Kif11) siRNA
cgaaaagaagttagtgtacgaac

SEQ ID NO: 411 - DNA, 23 bp, Artificial Sequence
  mitotic kinesin microtubule-associated protein Eg5 (Kif11) siRNA
gaaaagaagttagtgtacgaact

SEQ ID NO: 412 - DNA, 23 bp, Artificial Sequence
  mitotic kinesin microtubule-associated protein Eg5 (Kif11) siRNA
aaaagaagttagtgtacgaactg

SEQ ID NO: 413 - DNA, 23 bp, Artificial Sequence
  mitotic kinesin microtubule-associated protein Eg5 (Kif11) siRNA
aaagaagttagtgtacgaactgg

SEQ ID NO: 414 - DNA, 23 bp, Artificial Sequence
  mitotic kinesin microtubule-associated protein Eg5 (Kif11) siRNA
aagaagttagtgtacgaactgga

SEQ ID NO: 415 - DNA, 23 bp, Artificial Sequence
  mitotic kinesin microtubule-associated protein Eg5 (Kif11) siRNA
agaagttagtgtacgaactggag

SEQ ID NO: 416 - DNA, 23 bp, Artificial Sequence
  mitotic kinesin microtubule-associated protein Eg5 (Kif11) siRNA
gaagttagtgtacgaactggagg

SEQ ID NO: 417 - DNA, 23 bp, Artificial Sequence
  mitotic kinesin microtubule-associated protein Eg5 (Kif11) siRNA
aagttagtgtacgaactggagga

SEQ ID NO: 418 - DNA, 23 bp, Artificial Sequence
  mitotic kinesin microtubule-associated protein Eg5 (Kif11) siRNA
agttagtgtacgaactggaggat

SEQ ID NO: 419 - DNA, 23 bp, Artificial Sequence
  mitotic kinesin microtubule-associated protein Eg5 (Kif11) siRNA
gttagtgtacgaactggaggatt

SEQ ID NO: 420 - DNA, 23 bp, Artificial Sequence
  mitotic kinesin microtubule-associated protein Eg5 (Kif11) siRNA
ttagtgtacgaactggaggattg

SEQ ID NO: 421 - DNA, 23 bp, Artificial Sequence
  mitotic kinesin microtubule-associated protein Eg5 (Kif11) siRNA
tagtgtacgaactggaggattgg

SEQ ID NO: 422 - DNA, 23 bp, Artificial Sequence
  mitotic kinesin microtubule-associated protein Eg5 (Kif11) siRNA
agtgtacgaactggaggattggc

SEQ ID NO: 423 - DNA, 23 bp, Artificial Sequence
  mitotic kinesin microtubule-associated protein Eg5 (Kif11) siRNA
gtgtacgaactggaggattggct

SEQ ID NO: 424 - DNA, 23 bp, Artificial Sequence
  mitotic kinesin microtubule-associated protein Eg5 (Kif11) siRNA
tgtacgaactggaggattggctg

SEQ ID NO: 425 - DNA, 23 bp, Artificial Sequence
  mitotic kinesin microtubule-associated protein Eg5 (Kif11) siRNA
gtacgaactggaggattggctga

SEQ ID NO: 426 - DNA, 23 bp, Artificial Sequence
  mitotic kinesin microtubule-associated protein Eg5 (Kif11) siRNA
tacgaactggaggattggctgac

SEQ ID NO: 427 - DNA, 23 bp, Artificial Sequence
  mitotic kinesin microtubule-associated protein Eg5 (Kif11) siRNA
acgaactggaggattggctgaca

SEQ ID NO: 428 - DNA, 23 bp, Artificial Sequence
  mitotic kinesin microtubule-associated protein Eg5 (Kif11) siRNA
cgaactggaggattggctgacaa

SEQ ID NO: 429 - DNA, 23 bp, Artificial Sequence
  mitotic kinesin microtubule-associated protein Eg5 (Kif11) siRNA
gaactggaggattggctgacaag

SEQ ID NO: 430 - DNA, 23 bp, Artificial Sequence
  mitotic kinesin microtubule-associated protein Eg5 (Kif11) siRNA
aactggaggattggctgacaaga

SEQ ID NO: 431 - DNA, 23 bp, Artificial Sequence
  mitotic kinesin microtubule-associated protein Eg5 (Kif11) siRNA
actggaggattggctgacaagag

SEQ ID NO: 432 - DNA, 23 bp, Artificial Sequence
  mitotic kinesin microtubule-associated protein Eg5 (Kif11) siRNA
ctggaggattggctgacaagagc

SEQ ID NO: 433 - DNA, 23 bp, Artificial Sequence
  mitotic kinesin microtubule-associated protein Eg5 (Kif11) siRNA
tggaggattggctgacaagagct

SEQ ID NO: 434 - DNA, 23 bp, Artificial Sequence
  mitotic kinesin microtubule-associated protein Eg5 (Kif11) siRNA
ggaggattggctgacaagagctc

SEQ ID NO: 435 - DNA, 23 bp, Artificial Sequence
  mitotic kinesin microtubule-associated protein Eg5 (Kif11) siRNA
gaggattggctgacaagagctca

SEQ ID NO: 436 - DNA, 23 bp, Artificial Sequence
  mitotic kinesin microtubule-associated protein Eg5 (Kif11) siRNA
aggattggctgacaagagctcaa

SEQ ID NO: 437 - DNA, 23 bp, Artificial Sequence
  mitotic kinesin microtubule-associated protein Eg5 (Kif11) siRNA
ggattggctgacaagagctcaag

SEQ ID NO: 438 - DNA, 23 bp, Artificial Sequence
  mitotic kinesin microtubule-associated protein Eg5 (Kif11) siRNA
gattggctgacaagagctcaagg

SEQ ID NO: 439 - DNA, 23 bp, Artificial Sequence
  mitotic kinesin microtubule-associated protein Eg5 (Kif11) siRNA
attggctgacaagagctcaagga

SEQ ID NO: 440 - DNA, 23 bp, Artificial Sequence
  mitotic kinesin microtubule-associated protein Eg5 (Kif11) siRNA
ttggctgacaagagctcaaggaa

SEQ ID NO: 441 - DNA, 23 bp, Artificial Sequence
  mitotic kinesin microtubule-associated protein Eg5 (Kif11) siRNA
tggctgacaagagctcaaggaaa

SEQ ID NO: 442 - DNA, 23 bp, Artificial Sequence
  mitotic kinesin microtubule-associated protein Eg5 (Kif11) siRNA
ggctgacaagagctcaaggaaaa

SEQ ID NO: 443 - DNA, 23 bp, Artificial Sequence
  mitotic kinesin microtubule-associated protein Eg5 (Kif11) siRNA
gctgacaagagctcaaggaaaac

SEQ ID NO: 444 - DNA, 23 bp, Artificial Sequence
  mitotic kinesin microtubule-associated protein Eg5 (Kif11) siRNA
ctgacaagagctcaaggaaaaca

SEQ ID NO: 445 - DNA, 23 bp, Artificial Sequence
  mitotic kinesin microtubule-associated protein Eg5 (Kif11) siRNA
tgacaagagctcaaggaaaacat

SEQ ID NO: 446 - DNA, 23 bp, Artificial Sequence
  mitotic kinesin microtubule-associated protein Eg5 (Kif11) siRNA
gacaagagctcaaggaaaacata

SEQ ID NO: 447 - DNA, 23 bp, Artificial Sequence
  mitotic kinesin microtubule-associated protein Eg5 (Kif11) siRNA
acaagagctcaaggaaaacatac

SEQ ID NO: 448 - DNA, 23 bp, Artificial Sequence
  mitotic kinesin microtubule-associated protein Eg5 (Kif11) siRNA
caagagctcaaggaaaacataca

SEQ ID NO: 449 - DNA, 23 bp, Artificial Sequence
  mitotic kinesin microtubule-associated protein Eg5 (Kif11) siRNA
aagagctcaaggaaaacatacac

SEQ ID NO: 450 - DNA, 23 bp, Artificial Sequence
  mitotic kinesin microtubule-associated protein Eg5 (Kif11) siRNA
agagctcaaggaaaacatacact

SEQ ID NO: 451 - DNA, 23 bp, Artificial Sequence
  mitotic kinesin microtubule-associated protein Eg5 (Kif11) siRNA
gagctcaaggaaaacatacactt

SEQ ID NO: 452 - DNA, 23 bp, Artificial Sequence
  mitotic kinesin microtubule-associated protein Eg5 (Kif11) siRNA
agctcaaggaaaacatacacttt

SEQ ID NO: 453 - DNA, 23 bp, Artificial Sequence
  mitotic kinesin microtubule-associated protein Eg5 (Kif11) siRNA
gctcaaggaaaacatacactttt

SEQ ID NO: 454 - DNA, 23 bp, Artificial Sequence
  mitotic kinesin microtubule-associated protein Eg5 (Kif11) siRNA
ctcaaggaaaacatacacttttg

SEQ ID NO: 455 - DNA, 23 bp, Artificial Sequence
  mitotic kinesin microtubule-associated protein Eg5 (Kif11) siRNA
tcaaggaaaacatacacttttga

SEQ ID NO: 456 - DNA, 23 bp, Artificial Sequence
  mitotic kinesin microtubule-associated protein Eg5 (Kif11) siRNA
caaggaaaacatacacttttgat

SEQ ID NO: 457 - DNA, 23 bp, Artificial Sequence
  mitotic kinesin microtubule-associated protein Eg5 (Kif11) siRNA
aaggaaaacatacacttttgata

SEQ ID NO: 458 - DNA, 23 bp, Artificial Sequence
  mitotic kinesin microtubule-associated protein Eg5 (Kif11) siRNA
aggaaaacatacacttttgatat

SEQ ID NO: 459 - DNA, 23 bp, Artificial Sequence
  mitotic kinesin microtubule-associated protein Eg5 (Kif11) siRNA
ggaaaacatacacttttgatatg

SEQ ID NO: 460 - DNA, 23 bp, Artificial Sequence
  mitotic kinesin microtubule-associated protein Eg5 (Kif11) siRNA
gaaaacatacacttttgatatgg

SEQ ID NO: 461 - DNA, 23 bp, Artificial Sequence
  mitotic kinesin microtubule-associated protein Eg5 (Kif11) siRNA
aaaacatacacttttgatatggt

SEQ ID NO: 462 - DNA, 23 bp, Artificial Sequence
  mitotic kinesin microtubule-associated protein Eg5 (Kif11) siRNA
aaacatacacttttgatatggtg

SEQ ID NO: 463 - DNA, 23 bp, Artificial Sequence
  mitotic kinesin microtubule-associated protein Eg5 (Kif11) siRNA
aacatacacttttgatatggtgt

SEQ ID NO: 464 - DNA, 23 bp, Artificial Sequence
  mitotic kinesin microtubule-associated protein Eg5 (Kif11) siRNA
acatacacttttgatatggtgtt

SEQ ID NO: 465 - DNA, 23 bp, Artificial Sequence
  mitotic kinesin microtubule-associated protein Eg5 (Kif11) siRNA
catacacttttgatatggtgttt

SEQ ID NO: 466 - DNA, 23 bp, Artificial Sequence
  mitotic kinesin microtubule-associated protein Eg5 (Kif11) siRNA
atacacttttgatatggtgtttg

SEQ ID NO: 467 - DNA, 23 bp, Artificial Sequence
  mitotic kinesin microtubule-associated protein Eg5 (Kif11) siRNA
tacacttttgatatggtgtttgg

SEQ ID NO: 468 - DNA, 23 bp, Artificial Sequence
  mitotic kinesin microtubule-associated protein Eg5 (Kif11) siRNA
acacttttgatatggtgtttgga

SEQ ID NO: 469 - DNA, 23 bp, Artificial Sequence
  mitotic kinesin microtubule-associated protein Eg5 (Kif11) siRNA
cacttttgatatggtgtttggag

SEQ ID NO: 470 - DNA, 23 bp, Artificial Sequence
  mitotic kinesin microtubule-associated protein Eg5 (Kif11) siRNA
acttttgatatggtgtttggagc

SEQ ID NO: 471 - DNA, 23 bp, Artificial Sequence
  mitotic kinesin microtubule-associated protein Eg5 (Kif11) siRNA
cttttgatatggtgtttggagca

SEQ ID NO: 472 - DNA, 23 bp, Artificial Sequence
  mitotic kinesin microtubule-associated protein Eg5 (Kif11) siRNA
ttttgatatggtgtttggagcat

SEQ ID NO: 473 - DNA, 23 bp, Artificial Sequence
  mitotic kinesin microtubule-associated protein Eg5 (Kif11) siRNA
tttgatatggtgtttggagcatc

SEQ ID NO: 474 - DNA, 23 bp, Artificial Sequence
  mitotic kinesin microtubule-associated protein Eg5 (Kif11) siRNA
ttgatatggtgtttggagcatct

SEQ ID NO: 475 - DNA, 23 bp, Artificial Sequence
  mitotic kinesin microtubule-associated protein Eg5 (Kif11) siRNA
tgatatggtgtttggagcatcta

SEQ ID NO: 476 - DNA, 23 bp, Artificial Sequence
  mitotic kinesin microtubule-associated protein Eg5 (Kif11) siRNA
gatatggtgtttggagcatctac

SEQ ID NO: 477 - DNA, 23 bp, Artificial Sequence
  mitotic kinesin microtubule-associated protein Eg5 (Kif11) siRNA
atatggtgtttggagcatctact

SEQ ID NO: 478 - DNA, 23 bp, Artificial Sequence
  mitotic kinesin microtubule-associated protein Eg5 (Kif11) siRNA
tatggtgtttggagcatctacta

SEQ ID NO: 479 - DNA, 23 bp, Artificial Sequence
  mitotic kinesin microtubule-associated protein Eg5 (Kif11) siRNA
atggtgtttggagcatctactaa

SEQ ID NO: 480 - DNA, 23 bp, Artificial Sequence
  mitotic kinesin microtubule-associated protein Eg5 (Kif11) siRNA
tggtgtttggagcatctactaaa

SEQ ID NO: 481 - DNA, 23 bp, Artificial Sequence
  mitotic kinesin microtubule-associated protein Eg5 (Kif11) siRNA
ggtgtttggagcatctactaaac

SEQ ID NO: 482 - DNA, 23 bp, Artificial Sequence
  mitotic kinesin microtubule-associated protein Eg5 (Kif11) siRNA
gtgtttggagcatctactaaaca

SEQ ID NO: 483 - DNA, 23 bp, Artificial Sequence
  mitotic kinesin microtubule-associated protein Eg5 (Kif11) siRNA
tgtttggagcatctactaaacag

SEQ ID NO: 484 - DNA, 23 bp, Artificial Sequence
  mitotic kinesin microtubule-associated protein Eg5 (Kif11) siRNA
gtttggagcatctactaaacaga

SEQ ID NO: 485 - DNA, 23 bp, Artificial Sequence
  mitotic kinesin microtubule-associated protein Eg5 (Kif11) siRNA
tttggagcatctactaaacagat

SEQ ID NO: 486 - DNA, 23 bp, Artificial Sequence
  mitotic kinesin microtubule-associated protein Eg5 (Kif11) siRNA
ttggagcatctactaaacagatt

SEQ ID NO: 487 - DNA, 23 bp, Artificial Sequence
  mitotic kinesin microtubule-associated protein Eg5 (Kif11) siRNA
tggagcatctactaaacagattg

SEQ ID NO: 488 - DNA, 23 bp, Artificial Sequence
  mitotic kinesin microtubule-associated protein Eg5 (Kif11) siRNA
ggagcatctactaaacagattga

SEQ ID NO: 489 - DNA, 23 bp, Artificial Sequence
  mitotic kinesin microtubule-associated protein Eg5 (Kif11) siRNA
gagcatctactaaacagattgat

SEQ ID NO: 490 - DNA, 23 bp, Artificial Sequence
  mitotic kinesin microtubule-associated protein Eg5 (Kif11) siRNA
agcatctactaaacagattgatg

SEQ ID NO: 491 - DNA, 23 bp, Artificial Sequence
  mitotic kinesin microtubule-associated protein Eg5 (Kif11) siRNA
gcatctactaaacagattgatgt

SEQ ID NO: 492 - DNA, 23 bp, Artificial Sequence
  mitotic kinesin microtubule-associated protein Eg5 (Kif11) siRNA
catctactaaacagattgatgtt

SEQ ID NO: 493 - DNA, 23 bp, Artificial Sequence
  mitotic kinesin microtubule-associated protein Eg5 (Kif11) siRNA
atctactaaacagattgatgttt

SEQ ID NO: 494 - DNA, 23 bp, Artificial Sequence
  mitotic kinesin microtubule-associated protein Eg5 (Kif11) siRNA
tctactaaacagattgatgttta

SEQ ID NO: 495 - DNA, 23 bp, Artificial Sequence
  mitotic kinesin microtubule-associated protein Eg5 (Kif11) siRNA
ctactaaacagattgatgtttac

SEQ ID NO: 496 - DNA, 23 bp, Artificial Sequence
  mitotic kinesin microtubule-associated protein Eg5 (Kif11) siRNA
tactaaacagattgatgtttacc

SEQ ID NO: 497 - DNA, 23 bp, Artificial Sequence
  mitotic kinesin microtubule-associated protein Eg5 (Kif11) siRNA
actaaacagattgatgtttaccg

SEQ ID NO: 498 - DNA, 23 bp, Artificial Sequence
  mitotic kinesin microtubule-associated protein Eg5 (Kif11) siRNA
ctaaacagattgatgtttaccga

SEQ ID NO: 499 - DNA, 23 bp, Artificial Sequence
  mitotic kinesin microtubule-associated protein Eg5 (Kif11) siRNA
taaacagattgatgtttaccgaa

SEQ ID NO: 500 - DNA, 23 bp, Artificial Sequence
  mitotic kinesin microtubule-associated protein Eg5 (Kif11) siRNA
aaacagattgatgtttaccgaag

SEQ ID NO: 501 - DNA, 23 bp, Artificial Sequence
  mitotic kinesin microtubule-associated protein Eg5 (Kif11) siRNA
aacagattgatgtttaccgaagt

SEQ ID NO: 502 - DNA, 23 bp, Artificial Sequence
  mitotic kinesin microtubule-associated protein Eg5 (Kif11) siRNA
acagattgatgtttaccgaagtg

SEQ ID NO: 503 - DNA, 23 bp, Artificial Sequence
  mitotic kinesin microtubule-associated protein Eg5 (Kif11) siRNA
cagattgatgtttaccgaagtgt

SEQ ID NO: 504 - DNA, 23 bp, Artificial Sequence
  mitotic kinesin microtubule-associated protein Eg5 (Kif11) siRNA
agattgatgtttaccgaagtgtt

SEQ ID NO: 505 - DNA, 23 bp, Artificial Sequence
  mitotic kinesin microtubule-associated protein Eg5 (Kif11) siRNA
gattgatgtttaccgaagtgttg

SEQ ID NO: 506 - DNA, 23 bp, Artificial Sequence
  mitotic kinesin microtubule-associated protein Eg5 (Kif11) siRNA
attgatgtttaccgaagtgttgt

SEQ ID NO: 507 - DNA, 23 bp, Artificial Sequence
  mitotic kinesin microtubule-associated protein Eg5 (Kif11) siRNA
ttgatgtttaccgaagtgttgtt

SEQ ID NO: 508 - DNA, 23 bp, Artificial Sequence
  mitotic kinesin microtubule-associated protein Eg5 (Kif11) siRNA
tgatgtttaccgaagtgttgttt

SEQ ID NO: 509 - DNA, 23 bp, Artificial Sequence
  mitotic kinesin microtubule-associated protein Eg5 (Kif11) siRNA
gatgtttaccgaagtgttgtttg

SEQ ID NO: 510 - DNA, 23 bp, Artificial Sequence
  mitotic kinesin microtubule-associated protein Eg5 (Kif11) siRNA
atgtttaccgaagtgttgtttgt

SEQ ID NO: 511 - DNA, 23 bp, Artificial Sequence
  mitotic kinesin microtubule-associated protein Eg5 (Kif11) siRNA
tgtttaccgaagtgttgtttgtc

SEQ ID NO: 512 - DNA, 23 bp, Artificial Sequence
  mitotic kinesin microtubule-associated protein Eg5 (Kif11) siRNA
gtttaccgaagtgttgtttgtcc

SEQ ID NO: 513 - DNA, 23 bp, Artificial Sequence
  mitotic kinesin microtubule-associated protein Eg5 (Kif11) siRNA
tttaccgaagtgttgtttgtcca

SEQ ID NO: 514 - DNA, 23 bp, Artificial Sequence
  mitotic kinesin microtubule-associated protein Eg5 (Kif11) siRNA
ttaccgaagtgttgtttgtccaa

SEQ ID NO: 515 - DNA, 23 bp, Artificial Sequence
  mitotic kinesin microtubule-associated protein Eg5 (Kif11) siRNA
taccgaagtgttgtttgtccaat

SEQ ID NO: 516 - DNA, 23 bp, Artificial Sequence
  mitotic kinesin microtubule-associated protein Eg5 (Kif11) siRNA
accgaagtgttgtttgtccaatt

SEQ ID NO: 517 - DNA, 23 bp, Artificial Sequence
  mitotic kinesin microtubule-associated protein Eg5 (Kif11) siRNA
ccgaagtgttgtttgtccaattc

SEQ ID NO: 518 - DNA, 23 bp, Artificial Sequence
  mitotic kinesin microtubule-associated protein Eg5 (Kif11) siRNA
cgaagtgttgtttgtccaattct

SEQ ID NO: 519 - DNA, 23 bp, Artificial Sequence
  mitotic kinesin microtubule-associated protein Eg5 (Kif11) siRNA
gaagtgttgtttgtccaattctg

SEQ ID NO: 520 - DNA, 23 bp, Artificial Sequence
  mitotic kinesin microtubule-associated protein Eg5 (Kif11) siRNA
aagtgttgtttgtccaattctgg

SEQ ID NO: 521 - DNA, 23 bp, Artificial Sequence
  mitotic kinesin microtubule-associated protein Eg5 (Kif11) siRNA
agtgttgtttgtccaattctgga

SEQ ID NO: 522 - DNA, 23 bp, Artificial Sequence
  mitotic kinesin microtubule-associated protein Eg5 (Kif11) siRNA
gtgttgtttgtccaattctggat

SEQ ID NO: 523 - DNA, 23 bp, Artificial Sequence
  mitotic kinesin microtubule-associated protein Eg5 (Kif11) siRNA
tgttgtttgtccaattctggatg

SEQ ID NO: 524 - DNA, 23 bp, Artificial Sequence
  mitotic kinesin microtubule-associated protein Eg5 (Kif11) siRNA
gttgtttgtccaattctggatga

SEQ ID NO: 525 - DNA, 23 bp, Artificial Sequence
  mitotic kinesin microtubule-associated protein Eg5 (Kif11) siRNA
ttgtttgtccaattctggatgaa

SEQ ID NO: 526 - DNA, 23 bp, Artificial Sequence
  mitotic kinesin microtubule-associated protein Eg5 (Kif11) siRNA
tgtttgtccaattctggatgaag

SEQ ID NO: 527 - DNA, 23 bp, Artificial Sequence
  mitotic kinesin microtubule-associated protein Eg5 (Kif11) siRNA
gtttgtccaattctggatgaagt

SEQ ID NO: 528 - DNA, 23 bp, Artificial Sequence
  mitotic kinesin microtubule-associated protein Eg5 (Kif11) siRNA
tttgtccaattctggatgaagtt

SEQ ID NO: 529 - DNA, 23 bp, Artificial Sequence
  mitotic kinesin microtubule-associated protein Eg5 (Kif11) siRNA
ttgtccaattctggatgaagtta

SEQ ID NO: 530 - DNA, 23 bp, Artificial Sequence
  mitotic kinesin microtubule-associated protein Eg5 (Kif11) siRNA
tgtccaattctggatgaagttat

SEQ ID NO: 531 - DNA, 23 bp, Artificial Sequence
  mitotic kinesin microtubule-associated protein Eg5 (Kif11) siRNA
gtccaattctggatgaagttatt

SEQ ID NO: 532 - DNA, 23 bp, Artificial Sequence
  mitotic kinesin microtubule-associated protein Eg5 (Kif11) siRNA
tccaattctggatgaagttatta

SEQ ID NO: 533 - DNA, 23 bp, Artificial Sequence
  mitotic kinesin microtubule-associated protein Eg5 (Kif11) siRNA
ccaattctggatgaagttattat

SEQ ID NO: 534 - DNA, 23 bp, Artificial Sequence
  mitotic kinesin microtubule-associated protein Eg5 (Kif11) siRNA
caattctggatgaagttattatg

SEQ ID NO: 535 - DNA, 23 bp, Artificial Sequence
  mitotic kinesin microtubule-associated protein Eg5 (Kif11) siRNA
aattctggatgaagttattatgg

SEQ ID NO: 536 - DNA, 23 bp, Artificial Sequence
  mitotic kinesin microtubule-associated protein Eg5 (Kif11) siRNA
attctggatgaagttattatggg

SEQ ID NO: 537 - DNA, 23 bp, Artificial Sequence
  mitotic kinesin microtubule-associated protein Eg5 (Kif11) siRNA
ttctggatgaagttattatgggc

SEQ ID NO: 538 - DNA, 23 bp, Artificial Sequence
  mitotic kinesin microtubule-associated protein Eg5 (Kif11) siRNA
tctggatgaagttattatgggct

SEQ ID NO: 539 - DNA, 23 bp, Artificial Sequence
  mitotic kinesin microtubule-associated protein Eg5 (Kif11) siRNA
ctggatgaagttattatgggcta

SEQ ID NO: 540 - DNA, 23 bp, Artificial Sequence
  mitotic kinesin microtubule-associated protein Eg5 (Kif11) siRNA
tggatgaagttattatgggctat

SEQ ID NO: 541 - DNA, 23 bp, Artificial Sequence
  mitotic kinesin microtubule-associated protein Eg5 (Kif11) siRNA
ggatgaagttattatgggctata

SEQ ID NO: 542 - DNA, 23 bp, Artificial Sequence
  mitotic kinesin microtubule-associated protein Eg5 (Kif11) siRNA
gatgaagttattatgggctataa

SEQ ID NO: 543 - DNA, 23 bp, Artificial Sequence
  mitotic kinesin microtubule-associated protein Eg5 (Kif11) siRNA
atgaagttattatgggctataat

SEQ ID NO: 544 - DNA, 23 bp, Artificial Sequence
  mitotic kinesin microtubule-associated protein Eg5 (Kif11) siRNA
tgaagttattatgggctataatt

SEQ ID NO: 545 - DNA, 23 bp, Artificial Sequence
  mitotic kinesin microtubule-associated protein Eg5 (Kif11) siRNA
gaagttattatgggctataattg

SEQ ID NO: 546 - DNA, 23 bp, Artificial Sequence
  mitotic kinesin microtubule-associated protein Eg5 (Kif11) siRNA
aagttattatgggctataattgc

SEQ ID NO: 547 - DNA, 23 bp, Artificial Sequence
  mitotic kinesin microtubule-associated protein Eg5 (Kif11) siRNA
agttattatgggctataattgca

SEQ ID NO: 548 - DNA, 23 bp, Artificial Sequence
  mitotic kinesin microtubule-associated protein Eg5 (Kif11) siRNA
gttattatgggctataattgcac

SEQ ID NO: 549 - DNA, 23 bp, Artificial Sequence
  mitotic kinesin microtubule-associated protein Eg5 (Kif11) siRNA
ttattatgggctataattgcact

SEQ ID NO: 550 - DNA, 23 bp, Artificial Sequence
  mitotic kinesin microtubule-associated protein Eg5 (Kif11) siRNA
tattatgggctataattgcacta

SEQ ID NO: 551 - DNA, 23 bp, Artificial Sequence
  mitotic kinesin microtubule-associated protein Eg5 (Kif11) siRNA
attatgggctataattgcactat

SEQ ID NO: 552 - DNA, 23 bp, Artificial Sequence
  mitotic kinesin microtubule-associated protein Eg5 (Kif11) siRNA
ttatgggctataattgcactatc

SEQ ID NO: 553 - DNA, 23 bp, Artificial Sequence
  mitotic kinesin microtubule-associated protein Eg5 (Kif11) siRNA
tatgggctataattgcactatct

SEQ ID NO: 554 - DNA, 23 bp, Artificial Sequence
  mitotic kinesin microtubule-associated protein Eg5 (Kif11) siRNA
atgggctataattgcactatctt

SEQ ID NO: 555 - DNA, 23 bp, Artificial Sequence
  mitotic kinesin microtubule-associated protein Eg5 (Kif11) siRNA
tgggctataattgcactatcttt

SEQ ID NO: 556 - DNA, 23 bp, Artificial Sequence
  mitotic kinesin microtubule-associated protein Eg5 (Kif11) siRNA
gggctataattgcactatctttg

SEQ ID NO: 557 - DNA, 23 bp, Artificial Sequence
  mitotic kinesin microtubule-associated protein Eg5 (Kif11) siRNA
ggctataattgcactatctttgc

SEQ ID NO: 558 - DNA, 23 bp, Artificial Sequence
  mitotic kinesin microtubule-associated protein Eg5 (Kif11) siRNA
gctataattgcactatctttgcg

SEQ ID NO: 559 - DNA, 23 bp, Artificial Sequence
  mitotic kinesin microtubule-associated protein Eg5 (Kif11) siRNA
ctataattgcactatctttgcgt

SEQ ID NO: 560 - DNA, 23 bp, Artificial Sequence
  mitotic kinesin microtubule-associated protein Eg5 (Kif11) siRNA
tataattgcactatctttgcgta

SEQ ID NO: 561 - DNA, 23 bp, Artificial Sequence
  mitotic kinesin microtubule-associated protein Eg5 (Kif11) siRNA
ataattgcactatctttgcgtat

SEQ ID NO: 562 - DNA, 23 bp, Artificial Sequence
  mitotic kinesin microtubule-associated protein Eg5 (Kif11) siRNA
taattgcactatctttgcgtatg

SEQ ID NO: 563 - DNA, 23 bp, Artificial Sequence
  mitotic kinesin microtubule-associated protein Eg5 (Kif11) siRNA
aattgcactatctttgcgtatgg

SEQ ID NO: 564 - DNA, 23 bp, Artificial Sequence
  mitotic kinesin microtubule-associated protein Eg5 (Kif11) siRNA
attgcactatctttgcgtatggc

SEQ ID NO: 565 - DNA, 23 bp, Artificial Sequence
  mitotic kinesin microtubule-associated protein Eg5 (Kif11) siRNA
ttgcactatctttgcgtatggcc

SEQ ID NO: 566 - DNA, 23 bp, Artificial Sequence
  mitotic kinesin microtubule-associated protein Eg5 (Kif11) siRNA
tgcactatctttgcgtatggcca

SEQ ID NO: 567 - DNA, 23 bp, Artificial Sequence
  mitotic kinesin microtubule-associated protein Eg5 (Kif11) siRNA
gcactatctttgcgtatggccaa

SEQ ID NO: 568 - DNA, 23 bp, Artificial Sequence
  mitotic kinesin microtubule-associated protein Eg5 (Kif11) siRNA
cactatctttgcgtatggccaaa

SEQ ID NO: 569 - DNA, 23 bp, Artificial Sequence
  mitotic kinesin microtubule-associated protein Eg5 (Kif11) siRNA
actatctttgcgtatggccaaac

SEQ ID NO: 570 - DNA, 23 bp, Artificial Sequence
  mitotic kinesin microtubule-associated protein Eg5 (Kif11) siRNA
ctatctttgcgtatggccaaact

SEQ ID NO: 571 - DNA, 23 bp, Artificial Sequence
  mitotic kinesin microtubule-associated protein Eg5 (Kif11) siRNA
tatctttgcgtatggccaaactg

SEQ ID NO: 572 - DNA, 23 bp, Artificial Sequence
  mitotic kinesin microtubule-associated protein Eg5 (Kif11) siRNA
atctttgcgtatggccaaactgg

SEQ ID NO: 573 - DNA, 23 bp, Artificial Sequence
  mitotic kinesin microtubule-associated protein Eg5 (Kif11) siRNA
tctttgcgtatggccaaactggc

SEQ ID NO: 574 - DNA, 23 bp, Artificial Sequence
  mitotic kinesin microtubule-associated protein Eg5 (Kif11) siRNA
ctttgcgtatggccaaactggca

SEQ ID NO: 575 - DNA, 23 bp, Artificial Sequence
  mitotic kinesin microtubule-associated protein Eg5 (Kif11) siRNA
tttgcgtatggccaaactggcac

SEQ ID NO: 576 - DNA, 23 bp, Artificial Sequence
  mitotic kinesin microtubule-associated protein Eg5 (Kif11) siRNA
ttgcgtatggccaaactggcact

SEQ ID NO: 577 - DNA, 23 bp, Artificial Sequence
  mitotic kinesin microtubule-associated protein Eg5 (Kif11) siRNA
tgcgtatggccaaactggcactg

SEQ ID NO: 578 - DNA, 23 bp, Artificial Sequence
  mitotic kinesin microtubule-associated protein Eg5 (Kif11) siRNA
gcgtatggccaaactggcactgg

SEQ ID NO: 579 - DNA, 23 bp, Artificial Sequence
  mitotic kinesin microtubule-associated protein Eg5 (Kif11) siRNA
cgtatggccaaactggcactgga

SEQ ID NO: 580 - DNA, 23 bp, Artificial Sequence
  mitotic kinesin microtubule-associated protein Eg5 (Kif11) siRNA
gtatggccaaactggcactggaa

SEQ ID NO: 581 - DNA, 23 bp, Artificial Sequence
  mitotic kinesin microtubule-associated protein Eg5 (Kif11) siRNA
tatggccaaactggcactggaaa

SEQ ID NO: 582 - DNA, 23 bp, Artificial Sequence
  mitotic kinesin microtubule-associated protein Eg5 (Kif11) siRNA
atggccaaactggcactggaaaa

SEQ ID NO: 583 - DNA, 23 bp, Artificial Sequence
  mitotic kinesin microtubule-associated protein Eg5 (Kif11) siRNA
tggccaaactggcactggaaaaa

SEQ ID NO: 584 - DNA, 23 bp, Artificial Sequence
  mitotic kinesin microtubule-associated protein Eg5 (Kif11) siRNA
ggccaaactggcactggaaaaac

SEQ ID NO: 585 - DNA, 23 bp, Artificial Sequence
  mitotic kinesin microtubule-associated protein Eg5 (Kif11) siRNA
gccaaactggcactggaaaaact

SEQ ID NO: 586 - DNA, 23 bp, Artificial Sequence
  mitotic kinesin microtubule-associated protein Eg5 (Kif11) siRNA
ccaaactggcactggaaaaactt

SEQ ID NO: 587 - DNA, 23 bp, Artificial Sequence
  mitotic kinesin microtubule-associated protein Eg5 (Kif11) siRNA
caaactggcactggaaaaacttt

SEQ ID NO: 588 - DNA, 23 bp, Artificial Sequence
  mitotic kinesin microtubule-associated protein Eg5 (Kif11) siRNA
aaactggcactggaaaaactttt

SEQ ID NO: 589 - DNA, 23 bp, Artificial Sequence
  mitotic kinesin microtubule-associated protein Eg5 (Kif11) siRNA
aactggcactggaaaaactttta

SEQ ID NO: 590 - DNA, 23 bp, Artificial Sequence
  mitotic kinesin microtubule-associated protein Eg5 (Kif11) siRNA
actggcactggaaaaacttttac

SEQ ID NO: 591 - DNA, 23 bp, Artificial Sequence
  mitotic kinesin microtubule-associated protein Eg5 (Kif11) siRNA
ctggcactggaaaaacttttaca

SEQ ID NO: 592 - DNA, 23 bp, Artificial Sequence
  mitotic kinesin microtubule-associated protein Eg5 (Kif11) siRNA
tggcactggaaaaacttttacaa

SEQ ID NO: 593 - DNA, 23 bp, Artificial Sequence
  mitotic kinesin microtubule-associated protein Eg5 (Kif11) siRNA
ggcactggaaaaacttttacaat

SEQ ID NO: 594 - DNA, 23 bp, Artificial Sequence
  mitotic kinesin microtubule-associated protein Eg5 (Kif11) siRNA
gcactggaaaaacttttacaatg

SEQ ID NO: 595 - DNA, 23 bp, Artificial Sequence
  mitotic kinesin microtubule-associated protein Eg5 (Kif11) siRNA
cactggaaaaacttttacaatgg

SEQ ID NO: 596 - DNA, 23 bp, Artificial Sequence
  mitotic kinesin microtubule-associated protein Eg5 (Kif11) siRNA
actggaaaaacttttacaatgga

SEQ ID NO: 597 - DNA, 23 bp, Artificial Sequence
  mitotic kinesin microtubule-associated protein Eg5 (Kif11) siRNA
ctggaaaaacttttacaatggaa

SEQ ID NO: 598 - DNA, 23 bp, Artificial Sequence
  mitotic kinesin microtubule-associated protein Eg5 (Kif11) siRNA
tggaaaaacttttacaatggaag

SEQ ID NO: 599 - DNA, 23 bp, Artificial Sequence
  mitotic kinesin microtubule-associated protein Eg5 (Kif11) siRNA
ggaaaaacttttacaatggaagg

SEQ ID NO: 600 - DNA, 23 bp, Artificial Sequence
  mitotic kinesin microtubule-associated protein Eg5 (Kif11) siRNA
gaaaaacttttacaatggaaggt

SEQ ID NO: 601 - DNA, 23 bp, Artificial Sequence
  mitotic kinesin microtubule-associated protein Eg5 (Kif11) siRNA
aaaaacttttacaatggaaggtg

SEQ ID NO: 602 - DNA, 23 bp, Artificial Sequence
  mitotic kinesin microtubule-associated protein Eg5 (Kif11) siRNA
aaaacttttacaatggaaggtga

SEQ ID NO: 603 - DNA, 23 bp, Artificial Sequence
  mitotic kinesin microtubule-associated protein Eg5 (Kif11) siRNA
aaacttttacaatggaaggtgaa

SEQ ID NO: 604 - DNA, 23 bp, Artificial Sequence
  mitotic kinesin microtubule-associated protein Eg5 (Kif11) siRNA
aacttttacaatggaaggtgaaa

SEQ ID NO: 605 - DNA, 23 bp, Artificial Sequence
  mitotic kinesin microtubule-associated protein Eg5 (Kif11) siRNA
acttttacaatggaaggtgaaag

SEQ ID NO: 606 - DNA, 23 bp, Artificial Sequence
  mitotic kinesin microtubule-associated protein Eg5 (Kif11) siRNA
cttttacaatggaaggtgaaagg

SEQ ID NO: 607 - DNA, 23 bp, Artificial Sequence
  mitotic kinesin microtubule-associated protein Eg5 (Kif11) siRNA
ttttacaatggaaggtgaaaggt

SEQ ID NO: 608 - DNA, 23 bp, Artificial Sequence
  mitotic kinesin microtubule-associated protein Eg5 (Kif11) siRNA
tttacaatggaaggtgaaaggtc

SEQ ID NO: 609 - DNA, 23 bp, Artificial Sequence
  mitotic kinesin microtubule-associated protein Eg5 (Kif11) siRNA
ttacaatggaaggtgaaaggtca

SEQ ID NO: 610 - DNA, 23 bp, Artificial Sequence
  mitotic kinesin microtubule-associated protein Eg5 (Kif11) siRNA
tacaatggaaggtgaaaggtcac

SEQ ID NO: 611 - DNA, 23 bp, Artificial Sequence
  mitotic kinesin microtubule-associated protein Eg5 (Kif11) siRNA
acaatggaaggtgaaaggtcacc

SEQ ID NO: 612 - DNA, 23 bp, Artificial Sequence
  mitotic kinesin microtubule-associated protein Eg5 (Kif11) siRNA
caatggaaggtgaaaggtcacct

SEQ ID NO: 613 - DNA, 23 bp, Artificial Sequence
  mitotic kinesin microtubule-associated protein Eg5 (Kif11) siRNA
aatggaaggtgaaaggtcaccta

SEQ ID NO: 614 - DNA, 23 bp, Artificial Sequence
  mitotic kinesin microtubule-associated protein Eg5 (Kif11) siRNA
atggaaggtgaaaggtcacctaa

SEQ ID NO: 615 - DNA, 23 bp, Artificial Sequence
  mitotic kinesin microtubule-associated protein Eg5 (Kif11) siRNA
tggaaggtgaaaggtcacctaat

SEQ ID NO: 616 - DNA, 23 bp, Artificial Sequence
  mitotic kinesin microtubule-associated protein Eg5 (Kif11) siRNA
ggaaggtgaaaggtcacctaatg

SEQ ID NO: 617 - DNA, 23 bp, Artificial Sequence
  mitotic kinesin microtubule-associated protein Eg5 (Kif11) siRNA
gaaggtgaaaggtcacctaatga

SEQ ID NO: 618 - DNA, 23 bp, Artificial Sequence
  mitotic kinesin microtubule-associated protein Eg5 (Kif11) siRNA
aaggtgaaaggtcacctaatgaa

SEQ ID NO: 619 - DNA, 23 bp, Artificial Sequence
  mitotic kinesin microtubule-associated protein Eg5 (Kif11) siRNA
aggtgaaaggtcacctaatgaag

SEQ ID NO: 620 - DNA, 23 bp, Artificial Sequence
  mitotic kinesin microtubule-associated protein Eg5 (Kif11) siRNA
ggtgaaaggtcacctaatgaaga

SEQ ID NO: 621 - DNA, 23 bp, Artificial Sequence
  mitotic kinesin microtubule-associated protein Eg5 (Kif11) siRNA
gtgaaaggtcacctaatgaagag

SEQ ID NO: 622 - DNA, 23 bp, Artificial Sequence
  mitotic kinesin microtubule-associated protein Eg5 (Kif11) siRNA
tgaaaggtcacctaatgaagagt

SEQ ID NO: 623 - DNA, 23 bp, Artificial Sequence
  mitotic kinesin microtubule-associated protein Eg5 (Kif11) siRNA
gaaaggtcacctaatgaagagta

SEQ ID NO: 624 - DNA, 23 bp, Artificial Sequence
  mitotic kinesin microtubule-associated protein Eg5 (Kif11) siRNA
aaaggtcacctaatgaagagtat

SEQ ID NO: 625 - DNA, 23 bp, Artificial Sequence
  mitotic kinesin microtubule-associated protein Eg5 (Kif11) siRNA
aaggtcacctaatgaagagtata

SEQ ID NO: 626 - DNA, 23 bp, Artificial Sequence
  mitotic kinesin microtubule-associated protein Eg5 (Kif11) siRNA
aggtcacctaatgaagagtatac

SEQ ID NO: 627 - DNA, 23 bp, Artificial Sequence
  mitotic kinesin microtubule-associated protein Eg5 (Kif11) siRNA
ggtcacctaatgaagagtatacc

SEQ ID NO: 628 - DNA, 23 bp, Artificial Sequence
  mitotic kinesin microtubule-associated protein Eg5 (Kif11) siRNA
gtcacctaatgaagagtatacct

SEQ ID NO: 629 - DNA, 23 bp, Artificial Sequence
  mitotic kinesin microtubule-associated protein Eg5 (Kif11) siRNA
tcacctaatgaagagtatacctg

SEQ ID NO: 630 - DNA, 23 bp, Artificial Sequence
  mitotic kinesin microtubule-associated protein Eg5 (Kif11) siRNA
cacctaatgaagagtatacctgg

SEQ ID NO: 631 - DNA, 23 bp, Artificial Sequence
  mitotic kinesin microtubule-associated protein Eg5 (Kif11) siRNA
acctaatgaagagtatacctggg

SEQ ID NO: 632 - DNA, 23 bp, Artificial Sequence
  mitotic kinesin microtubule-associated protein Eg5 (Kif11) siRNA
cctaatgaagagtatacctggga

SEQ ID NO: 633 - DNA, 23 bp, Artificial Sequence
  mitotic kinesin microtubule-associated protein Eg5 (Kif11) siRNA
ctaatgaagagtatacctgggaa

SEQ ID NO: 634 - DNA, 23 bp, Artificial Sequence
  mitotic kinesin microtubule-associated protein Eg5 (Kif11) siRNA
taatgaagagtatacctgggaag

SEQ ID NO: 635 - DNA, 23 bp, Artificial Sequence
  mitotic kinesin microtubule-associated protein Eg5 (Kif11) siRNA
aatgaagagtatacctgggaaga

SEQ ID NO: 636 - DNA, 23 bp, Artificial Sequence
  mitotic kinesin microtubule-associated protein Eg5 (Kif11) siRNA
atgaagagtatacctgggaagag

SEQ ID NO: 637 - DNA, 23 bp, Artificial Sequence
  mitotic kinesin microtubule-associated protein Eg5 (Kif11) siRNA
tgaagagtatacctgggaagagg

SEQ ID NO: 638 - DNA, 23 bp, Artificial Sequence
  mitotic kinesin microtubule-associated protein Eg5 (Kif11) siRNA
ttcaaatcttaacccttaggact

SEQ ID NO: 639 - DNA, 23 bp, Artificial Sequence
  mitotic kinesin microtubule-associated protein Eg5 (Kif11) siRNA
tcaaatcttaacccttaggactc

SEQ ID NO: 640 - DNA, 23 bp, Artificial Sequence
  mitotic kinesin microtubule-associated protein Eg5 (Kif11) siRNA
agagtatacctgggaagaggatc

SEQ ID NO: 641 - DNA, 23 bp, Artificial Sequence
  mitotic kinesin microtubule-associated protein Eg5 (Kif11) siRNA
gagtatacctgggaagaggatcc

SEQ ID NO: 642 - DNA, 23 bp, Artificial Sequence
  mitotic kinesin microtubule-associated protein Eg5 (Kif11) siRNA
agtatacctgggaagaggatccc

SEQ ID NO: 643 - DNA, 23 bp, Artificial Sequence
  mitotic kinesin microtubule-associated protein Eg5 (Kif11) siRNA
gtatacctgggaagaggatccct

SEQ ID NO: 644 - DNA, 23 bp, Artificial Sequence
  mitotic kinesin microtubule-associated protein Eg5 (Kif11) siRNA
tatacctgggaagaggatccctt

SEQ ID NO: 645 - DNA, 23 bp, Artificial Sequence
  mitotic kinesin microtubule-associated protein Eg5 (Kif11) siRNA
atacctgggaagaggatcccttg

SEQ ID NO: 646 - DNA, 23 bp, Artificial Sequence
  mitotic kinesin microtubule-associated protein Eg5 (Kif11) siRNA
tacctgggaagaggatcccttgg

SEQ ID NO: 647 - DNA, 23 bp, Artificial Sequence
  mitotic kinesin microtubule-associated protein Eg5 (Kif11) siRNA
acctgggaagaggatcccttggc

SEQ ID NO: 648 - DNA, 23 bp, Artificial Sequence
  mitotic kinesin microtubule-associated protein Eg5 (Kif11) siRNA
cctgggaagaggatcccttggct

SEQ ID NO: 649 - DNA, 23 bp, Artificial Sequence
  mitotic kinesin microtubule-associated protein Eg5 (Kif11) siRNA
ctgggaagaggatcccttggctg

SEQ ID NO: 650 - DNA, 23 bp, Artificial Sequence
  mitotic kinesin microtubule-associated protein Eg5 (Kif11) siRNA
tgggaagaggatcccttggctgg

SEQ ID NO: 651 - DNA, 23 bp, Artificial Sequence
  mitotic kinesin microtubule-associated protein Eg5 (Kif11) siRNA
gggaagaggatcccttggctggt

SEQ ID NO: 652 - DNA, 23 bp, Artificial Sequence
  mitotic kinesin microtubule-associated protein Eg5 (Kif11) siRNA
ggaagaggatcccttggctggta

SEQ ID NO: 653 - DNA, 23 bp, Artificial Sequence
  mitotic kinesin microtubule-associated protein Eg5 (Kif11) siRNA
gaagaggatcccttggctggtat

SEQ ID NO: 654 - DNA, 23 bp, Artificial Sequence
  mitotic kinesin microtubule-associated protein Eg5 (Kif11) siRNA
aagaggatcccttggctggtata

SEQ ID NO: 655 - DNA, 23 bp, Artificial Sequence
  mitotic kinesin microtubule-associated protein Eg5 (Kif11) siRNA
agaggatcccttggctggtataa

SEQ ID NO: 656 - DNA, 23 bp, Artificial Sequence
  mitotic kinesin microtubule-associated protein Eg5 (Kif11) siRNA
gaggatcccttggctggtataat

SEQ ID NO: 657 - DNA, 23 bp, Artificial Sequence
  mitotic kinesin microtubule-associated protein Eg5 (Kif11) siRNA
aggatcccttggctggtataatt

SEQ ID NO: 658 - DNA, 23 bp, Artificial Sequence
  mitotic kinesin microtubule-associated protein Eg5 (Kif11) siRNA
ggatcccttggctggtataattc

SEQ ID NO: 659 - DNA, 23 bp, Artificial Sequence
  mitotic kinesin microtubule-associated protein Eg5 (Kif11) siRNA
gatcccttggctggtataattcc

SEQ ID NO: 660 - DNA, 23 bp, Artificial Sequence
  mitotic kinesin microtubule-associated protein Eg5 (Kif11) siRNA
atcccttggctggtataattcca

SEQ ID NO: 661 - DNA, 23 bp, Artificial Sequence
  mitotic kinesin microtubule-associated protein Eg5 (Kif11) siRNA
tcccttggctggtataattccac

SEQ ID NO: 662 - DNA, 23 bp, Artificial Sequence
  mitotic kinesin microtubule-associated protein Eg5 (Kif11) siRNA
cccttggctggtataattccacg

SEQ ID NO: 663 - DNA, 23 bp, Artificial Sequence
  mitotic kinesin microtubule-associated protein Eg5 (Kif11) siRNA
ccttggctggtataattccacgt

SEQ ID NO: 664 - DNA, 23 bp, Artificial Sequence
  mitotic kinesin microtubule-associated protein Eg5 (Kif11) siRNA
cttggctggtataattccacgta

SEQ ID NO: 665 - DNA, 23 bp, Artificial Sequence
  mitotic kinesin microtubule-associated protein Eg5 (Kif11) siRNA
ttggctggtataattccacgtac

SEQ ID NO: 666 - DNA, 23 bp, Artificial Sequence
  mitotic kinesin microtubule-associated protein Eg5 (Kif11) siRNA
tggctggtataattccacgtacc

SEQ ID NO: 667 - DNA, 23 bp, Artificial Sequence
  mitotic kinesin microtubule-associated protein Eg5 (Kif11) siRNA
ggctggtataattccacgtaccc

SEQ ID NO: 668 - DNA, 23 bp, Artificial Sequence
  mitotic kinesin microtubule-associated protein Eg5 (Kif11) siRNA
gctggtataattccacgtaccct

SEQ ID NO: 669 - DNA, 23 bp, Artificial Sequence
  mitotic kinesin microtubule-associated protein Eg5 (Kif11) siRNA
ctggtataattccacgtaccctt

SEQ ID NO: 670 - DNA, 23 bp, Artificial Sequence
  mitotic kinesin microtubule-associated protein Eg5 (Kif11) siRNA
tggtataattccacgtacccttc

SEQ ID NO: 671 - DNA, 23 bp, Artificial Sequence
  mitotic kinesin microtubule-associated protein Eg5 (Kif11) siRNA
ggtataattccacgtacccttca

SEQ ID NO: 672 - DNA, 23 bp, Artificial Sequence
  mitotic kinesin microtubule-associated protein Eg5 (Kif11) siRNA
gtataattccacgtacccttcat

SEQ ID NO: 673 - DNA, 23 bp, Artificial Sequence
  mitotic kinesin microtubule-associated protein Eg5 (Kif11) siRNA
tataattccacgtacccttcatc

SEQ ID NO: 674 - DNA, 23 bp, Artificial Sequence
  mitotic kinesin microtubule-associated protein Eg5 (Kif11) siRNA
ataattccacgtacccttcatca

SEQ ID NO: 675 - DNA, 23 bp, Artificial Sequence
  mitotic kinesin microtubule-associated protein Eg5 (Kif11) siRNA
taattccacgtacccttcatcaa

SEQ ID NO: 676 - DNA, 23 bp, Artificial Sequence
  mitotic kinesin microtubule-associated protein Eg5 (Kif11) siRNA
aattccacgtacccttcatcaaa

SEQ ID NO: 677 - DNA, 23 bp, Artificial Sequence
  mitotic kinesin microtubule-associated protein Eg5 (Kif11) siRNA
attccacgtacccttcatcaaat

SEQ ID NO: 678 - DNA, 23 bp, Artificial Sequence
  mitotic kinesin microtubule-associated protein Eg5 (Kif11) siRNA
ttccacgtacccttcatcaaatt

SEQ ID NO: 679 - DNA, 23 bp, Artificial Sequence
  mitotic kinesin microtubule-associated protein Eg5 (Kif11) siRNA
tccacgtacccttcatcaaattt

SEQ ID NO: 680 - DNA, 23 bp, Artificial Sequence
  mitotic kinesin microtubule-associated protein Eg5 (Kif11) siRNA
ccacgtacccttcatcaaatttt

SEQ ID NO: 681 - DNA, 23 bp, Artificial Sequence
  mitotic kinesin microtubule-associated protein Eg5 (Kif11) siRNA
cacgtacccttcatcaaattttt

SEQ ID NO: 682 - DNA, 23 bp, Artificial Sequence
  mitotic kinesin microtubule-associated protein Eg5 (Kif11) siRNA
acgtacccttcatcaaatttttg

SEQ ID NO: 683 - DNA, 23 bp, Artificial Sequence
  mitotic kinesin microtubule-associated protein Eg5 (Kif11) siRNA
cgtacccttcatcaaatttttga

SEQ ID NO: 684 - DNA, 23 bp, Artificial Sequence
  mitotic kinesin microtubule-associated protein Eg5 (Kif11) siRNA
gtacccttcatcaaatttttgag

SEQ ID NO: 685 - DNA, 23 bp, Artificial Sequence
  mitotic kinesin microtubule-associated protein Eg5 (Kif11) siRNA
tacccttcatcaaatttttgaga

SEQ ID NO: 686 - DNA, 23 bp, Artificial Sequence
  mitotic kinesin microtubule-associated protein Eg5 (Kif11) siRNA
acccttcatcaaatttttgagaa

SEQ ID NO: 687 - DNA, 23 bp, Artificial Sequence
  mitotic kinesin microtubule-associated protein Eg5 (Kif11) siRNA
cccttcatcaaatttttgagaaa

SEQ ID NO: 688 - DNA, 23 bp, Artificial Sequence
  mitotic kinesin microtubule-associated protein Eg5 (Kif11) siRNA
ccttcatcaaatttttgagaaac

SEQ ID NO: 689 - DNA, 23 bp, Artificial Sequence
  mitotic kinesin microtubule-associated protein Eg5 (Kif11) siRNA
cttcatcaaatttttgagaaact

SEQ ID NO: 690 - DNA, 23 bp, Artificial Sequence
  mitotic kinesin microtubule-associated protein Eg5 (Kif11) siRNA
ttcatcaaatttttgagaaactt

SEQ ID NO: 691 - DNA, 23 bp, Artificial Sequence
  mitotic kinesin microtubule-associated protein Eg5 (Kif11) siRNA
tcatcaaatttttgagaaactta

SEQ ID NO: 692 - DNA, 23 bp, Artificial Sequence
  mitotic kinesin microtubule-associated protein Eg5 (Kif11) siRNA
catcaaatttttgagaaacttac

SEQ ID NO: 693 - DNA, 23 bp, Artificial Sequence
  mitotic kinesin microtubule-associated protein Eg5 (Kif11) siRNA
atcaaatttttgagaaacttact

SEQ ID NO: 694 - DNA, 23 bp, Artificial Sequence
  mitotic kinesin microtubule-associated protein Eg5 (Kif11) siRNA
tcaaatttttgagaaacttactg

SEQ ID NO: 695 - DNA, 23 bp, Artificial Sequence
  mitotic kinesin microtubule-associated protein Eg5 (Kif11) siRNA
caaatttttgagaaacttactga

SEQ ID NO: 696 - DNA, 23 bp, Artificial Sequence
  mitotic kinesin microtubule-associated protein Eg5 (Kif11) siRNA
aaatttttgagaaacttactgat

SEQ ID NO: 697 - DNA, 23 bp, Artificial Sequence
  mitotic kinesin microtubule-associated protein Eg5 (Kif11) siRNA
aatttttgagaaacttactgata

SEQ ID NO: 698 - DNA, 23 bp, Artificial Sequence
  mitotic kinesin microtubule-associated protein Eg5 (Kif11) siRNA
atttttgagaaacttactgataa

SEQ ID NO: 699 - DNA, 23 bp, Artificial Sequence
  mitotic kinesin microtubule-associated protein Eg5 (Kif11) siRNA
tttttgagaaacttactgataat

SEQ ID NO: 700 - DNA, 23 bp, Artificial Sequence
  mitotic kinesin microtubule-associated protein Eg5 (Kif11) siRNA
ttttgagaaacttactgataatg

SEQ ID NO: 701 - DNA, 23 bp, Artificial Sequence
  mitotic kinesin microtubule-associated protein Eg5 (Kif11) siRNA
tttgagaaacttactgataatgg

SEQ ID NO: 702 - DNA, 23 bp, Artificial Sequence
  mitotic kinesin microtubule-associated protein Eg5 (Kif11) siRNA
ttgagaaacttactgataatggt

SEQ ID NO: 703 - DNA, 23 bp, Artificial Sequence
  mitotic kinesin microtubule-associated protein Eg5 (Kif11) siRNA
tgagaaacttactgataatggta

SEQ ID NO: 704 - DNA, 23 bp, Artificial Sequence
  mitotic kinesin microtubule-associated protein Eg5 (Kif11) siRNA
gagaaacttactgataatggtac

SEQ ID NO: 705 - DNA, 23 bp, Artificial Sequence
  mitotic kinesin microtubule-associated protein Eg5 (Kif11) siRNA
agaaacttactgataatggtact

SEQ ID NO: 706 - DNA, 23 bp, Artificial Sequence
  mitotic kinesin microtubule-associated protein Eg5 (Kif11) siRNA
gaaacttactgataatggtactg

SEQ ID NO: 707 - DNA, 23 bp, Artificial Sequence
  mitotic kinesin microtubule-associated protein Eg5 (Kif11) siRNA
aaacttactgataatggtactga

SEQ ID NO: 708 - DNA, 23 bp, Artificial Sequence
  mitotic kinesin microtubule-associated protein Eg5 (Kif11) siRNA
aacttactgataatggtactgaa

SEQ ID NO: 709 - DNA, 23 bp, Artificial Sequence
  mitotic kinesin microtubule-associated protein Eg5 (Kif11) siRNA
acttactgataatggtactgaat

SEQ ID NO: 710 - DNA, 23 bp, Artificial Sequence
  mitotic kinesin microtubule-associated protein Eg5 (Kif11) siRNA
cttactgataatggtactgaatt

SEQ ID NO: 711 - DNA, 23 bp, Artificial Sequence
  mitotic kinesin microtubule-associated protein Eg5 (Kif11) siRNA
ttactgataatggtactgaattt

SEQ ID NO: 712 - DNA, 23 bp, Artificial Sequence
  mitotic kinesin microtubule-associated protein Eg5 (Kif11) siRNA
tactgataatggtactgaatttt

SEQ ID NO: 713 - DNA, 23 bp, Artificial Sequence
  mitotic kinesin microtubule-associated protein Eg5 (Kif11) siRNA
actgataatggtactgaattttc

SEQ ID NO: 714 - DNA, 23 bp, Artificial Sequence
  mitotic kinesin microtubule-associated protein Eg5 (Kif11) siRNA
ctgataatggtactgaattttca

SEQ ID NO: 715 - DNA, 23 bp, Artificial Sequence
  mitotic kinesin microtubule-associated protein Eg5 (Kif11) siRNA
tgataatggtactgaattttcag

SEQ ID NO: 716 - DNA, 23 bp, Artificial Sequence
  mitotic kinesin microtubule-associated protein Eg5 (Kif11) siRNA
gataatggtactgaattttcagt

SEQ ID NO: 717 - DNA, 23 bp, Artificial Sequence
  mitotic kinesin microtubule-associated protein Eg5 (Kif11) siRNA
ataatggtactgaattttcagtc

SEQ ID NO: 718 - DNA, 23 bp, Artificial Sequence
  mitotic kinesin microtubule-associated protein Eg5 (Kif11) siRNA
taatggtactgaattttcagtca

SEQ ID NO: 719 - DNA, 23 bp, Artificial Sequence
  mitotic kinesin microtubule-associated protein Eg5 (Kif11) siRNA
aatggtactgaattttcagtcaa

SEQ ID NO: 720 - DNA, 23 bp, Artificial Sequence
  mitotic kinesin microtubule-associated protein Eg5 (Kif11) siRNA
atggtactgaattttcagtcaaa

SEQ ID NO: 721 - DNA, 23 bp, Artificial Sequence
  mitotic kinesin microtubule-associated protein Eg5 (Kif11) siRNA
tggtactgaattttcagtcaaag

SEQ ID NO: 722 - DNA, 23 bp, Artificial Sequence
  mitotic kinesin microtubule-associated protein Eg5 (Kif11) siRNA
ggtactgaattttcagtcaaagt

SEQ ID NO: 723 - DNA, 23 bp, Artificial Sequence
  mitotic kinesin microtubule-associated protein Eg5 (Kif11) siRNA
gtactgaattttcagtcaaagtg

SEQ ID NO: 724 - DNA, 23 bp, Artificial Sequence
  mitotic kinesin microtubule-associated protein Eg5 (Kif11) siRNA
tactgaattttcagtcaaagtgt

SEQ ID NO: 725 - DNA, 23 bp, Artificial Sequence
  mitotic kinesin microtubule-associated protein Eg5 (Kif11) siRNA
actgaattttcagtcaaagtgtc

SEQ ID NO: 726 - DNA, 23 bp, Artificial Sequence
  mitotic kinesin microtubule-associated protein Eg5 (Kif11) siRNA
ctgaattttcagtcaaagtgtct

SEQ ID NO: 727 - DNA, 23 bp, Artificial Sequence
  mitotic kinesin microtubule-associated protein Eg5 (Kif11) siRNA
tgaattttcagtcaaagtgtctc

SEQ ID NO: 728 - DNA, 23 bp, Artificial Sequence
  mitotic kinesin microtubule-associated protein Eg5 (Kif11) siRNA
gaattttcagtcaaagtgtctct

SEQ ID NO: 729 - DNA, 23 bp, Artificial Sequence
  mitotic kinesin microtubule-associated protein Eg5 (Kif11) siRNA
aattttcagtcaaagtgtctctg

SEQ ID NO: 730 - DNA, 23 bp, Artificial Sequence
  mitotic kinesin microtubule-associated protein Eg5 (Kif11) siRNA
attttcagtcaaagtgtctctgt

SEQ ID NO: 731 - DNA, 23 bp, Artificial Sequence
  mitotic kinesin microtubule-associated protein Eg5 (Kif11) siRNA
ttttcagtcaaagtgtctctgtt

SEQ ID NO: 732 - DNA, 23 bp, Artificial Sequence
  mitotic kinesin microtubule-associated protein Eg5 (Kif11) siRNA
tttcagtcaaagtgtctctgttg

SEQ ID NO: 733 - DNA, 23 bp, Artificial Sequence
  mitotic kinesin microtubule-associated protein Eg5 (Kif11) siRNA
ttcagtcaaagtgtctctgttgg

SEQ ID NO: 734 - DNA, 23 bp, Artificial Sequence
  mitotic kinesin microtubule-associated protein Eg5 (Kif11) siRNA
tcagtcaaagtgtctctgttgga

SEQ ID NO: 735 - DNA, 23 bp, Artificial Sequence
  mitotic kinesin microtubule-associated protein Eg5 (Kif11) siRNA
cagtcaaagtgtctctgttggag

SEQ ID NO: 736 - DNA, 23 bp, Artificial Sequence
  mitotic kinesin microtubule-associated protein Eg5 (Kif11) siRNA
agtcaaagtgtctctgttggaga

SEQ ID NO: 737 - DNA, 23 bp, Artificial Sequence
  mitotic kinesin microtubule-associated protein Eg5 (Kif11) siRNA
gtcaaagtgtctctgttggagat

SEQ ID NO: 738 - DNA, 23 bp, Artificial Sequence
  mitotic kinesin microtubule-associated protein Eg5 (Kif11) siRNA
tcaaagtgtctctgttggagatc

SEQ ID NO: 739 - DNA, 23 bp, Artificial Sequence
  mitotic kinesin microtubule-associated protein Eg5 (Kif11) siRNA
caaagtgtctctgttggagatct

SEQ ID NO: 740 - DNA, 23 bp, Artificial Sequence
  mitotic kinesin microtubule-associated protein Eg5 (Kif11) siRNA
aaagtgtctctgttggagatcta

SEQ ID NO: 741 - DNA, 23 bp, Artificial Sequence
  mitotic kinesin microtubule-associated protein Eg5 (Kif11) siRNA
aagtgtctctgttggagatctat

SEQ ID NO: 742 - DNA, 23 bp, Artificial Sequence
  mitotic kinesin microtubule-associated protein Eg5 (Kif11) siRNA
agtgtctctgttggagatctata

SEQ ID NO: 743 - DNA, 23 bp, Artificial Sequence
  mitotic kinesin microtubule-associated protein Eg5 (Kif11) siRNA
gtgtctctgttggagatctataa

SEQ ID NO: 744 - DNA, 23 bp, Artificial Sequence
  mitotic kinesin microtubule-associated protein Eg5 (Kif11) siRNA
tgtctctgttggagatctataat

SEQ ID NO: 745 - DNA, 23 bp, Artificial Sequence
  mitotic kinesin microtubule-associated protein Eg5 (Kif11) siRNA
gtctctgttggagatctataatg

SEQ ID NO: 746 - DNA, 23 bp, Artificial Sequence
  mitotic kinesin microtubule-associated protein Eg5 (Kif11) siRNA
tctctgttggagatctataatga

SEQ ID NO: 747 - DNA, 23 bp, Artificial Sequence
  mitotic kinesin microtubule-associated protein Eg5 (Kif11) siRNA
ctctgttggagatctataatgaa

SEQ ID NO: 748 - DNA, 23 bp, Artificial Sequence
  mitotic kinesin microtubule-associated protein Eg5 (Kif11) siRNA
tctgttggagatctataatgaag

SEQ ID NO: 749 - DNA, 23 bp, Artificial Sequence
  mitotic kinesin microtubule-associated protein Eg5 (Kif11) siRNA
ctgttggagatctataatgaaga

SEQ ID NO: 750 - DNA, 23 bp, Artificial Sequence
  mitotic kinesin microtubule-associated protein Eg5 (Kif11) siRNA
tgttggagatctataatgaagag

SEQ ID NO: 751 - DNA, 23 bp, Artificial Sequence
  mitotic kinesin microtubule-associated protein Eg5 (Kif11) siRNA
gttggagatctataatgaagagc

SEQ ID NO: 752 - DNA, 23 bp, Artificial Sequence
  mitotic kinesin microtubule-associated protein Eg5 (Kif11) siRNA
ttggagatctataatgaagagct

SEQ ID NO: 753 - DNA, 23 bp, Artificial Sequence
  mitotic kinesin microtubule-associated protein Eg5 (Kif11) siRNA
tggagatctataatgaagagctt

SEQ ID NO: 754 - DNA, 23 bp, Artificial Sequence
  mitotic kinesin microtubule-associated protein Eg5 (Kif11) siRNA
ggagatctataatgaagagcttt

SEQ ID NO: 755 - DNA, 23 bp, Artificial Sequence
  mitotic kinesin microtubule-associated protein Eg5 (Kif11) siRNA
gagatctataatgaagagctttt

SEQ ID NO: 756 - DNA, 23 bp, Artificial Sequence
  mitotic kinesin microtubule-associated protein Eg5 (Kif11) siRNA
agatctataatgaagagcttttt

SEQ ID NO: 757 - DNA, 23 bp, Artificial Sequence
  mitotic kinesin microtubule-associated protein Eg5 (Kif11) siRNA
gatctataatgaagagctttttg

SEQ ID NO: 758 - DNA, 23 bp, Artificial Sequence
  mitotic kinesin microtubule-associated protein Eg5 (Kif11) siRNA
atctataatgaagagctttttga

SEQ ID NO: 759 - DNA, 23 bp, Artificial Sequence
  mitotic kinesin microtubule-associated protein Eg5 (Kif11) siRNA
tctataatgaagagctttttgat

SEQ ID NO: 760 - DNA, 23 bp, Artificial Sequence
  mitotic kinesin microtubule-associated protein Eg5 (Kif11) siRNA
ctataatgaagagctttttgatc

SEQ ID NO: 761 - DNA, 23 bp, Artificial Sequence
  mitotic kinesin microtubule-associated protein Eg5 (Kif11) siRNA
tataatgaagagctttttgatct

SEQ ID NO: 762 - DNA, 23 bp, Artificial Sequence
  mitotic kinesin microtubule-associated protein Eg5 (Kif11) siRNA
ataatgaagagctttttgatctt

SEQ ID NO: 763 - DNA, 23 bp, Artificial Sequence
  mitotic kinesin microtubule-associated protein Eg5 (Kif11) siRNA
taatgaagagctttttgatcttc

SEQ ID NO: 764 - DNA, 23 bp, Artificial Sequence
  mitotic kinesin microtubule-associated protein Eg5 (Kif11) siRNA
aatgaagagctttttgatcttct

SEQ ID NO: 765 - DNA, 23 bp, Artificial Sequence
  mitotic kinesin microtubule-associated protein Eg5 (Kif11) siRNA
atgaagagctttttgatcttctt

SEQ ID NO: 766 - DNA, 23 bp, Artificial Sequence
  mitotic kinesin microtubule-associated protein Eg5 (Kif11) siRNA
tgaagagctttttgatcttctta

SEQ ID NO: 767 - DNA, 23 bp, Artificial Sequence
  mitotic kinesin microtubule-associated protein Eg5 (Kif11) siRNA
gaagagctttttgatcttcttaa

SEQ ID NO: 768 - DNA, 23 bp, Artificial Sequence
  mitotic kinesin microtubule-associated protein Eg5 (Kif11) siRNA
aagagctttttgatcttcttaat

SEQ ID NO: 769 - DNA, 23 bp, Artificial Sequence
  mitotic kinesin microtubule-associated protein Eg5 (Kif11) siRNA
agagctttttgatcttcttaatc

SEQ ID NO: 770 - DNA, 23 bp, Artificial Sequence
  mitotic kinesin microtubule-associated protein Eg5 (Kif11) siRNA
gagctttttgatcttcttaatcc

SEQ ID NO: 771 - DNA, 23 bp, Artificial Sequence
  mitotic kinesin microtubule-associated protein Eg5 (Kif11) siRNA
agctttttgatcttcttaatcca

SEQ ID NO: 772 - DNA, 23 bp, Artificial Sequence
  mitotic kinesin microtubule-associated protein Eg5 (Kif11) siRNA
gctttttgatcttcttaatccat

SEQ ID NO: 773 - DNA, 23 bp, Artificial Sequence
  mitotic kinesin microtubule-associated protein Eg5 (Kif11) siRNA
ctttttgatcttcttaatccatc

SEQ ID NO: 774 - DNA, 23 bp, Artificial Sequence
  mitotic kinesin microtubule-associated protein Eg5 (Kif11) siRNA
tttttgatcttcttaatccatca

SEQ ID NO: 775 - DNA, 23 bp, Artificial Sequence
  mitotic kinesin microtubule-associated protein Eg5 (Kif11) siRNA
ttttgatcttcttaatccatcat

SEQ ID NO: 776 - DNA, 23 bp, Artificial Sequence
  mitotic kinesin microtubule-associated protein Eg5 (Kif11) siRNA
tttgatcttcttaatccatcatc

SEQ ID NO: 777 - DNA, 23 bp, Artificial Sequence
  mitotic kinesin microtubule-associated protein Eg5 (Kif11) siRNA
ttgatcttcttaatccatcatct

SEQ ID NO: 778 - DNA, 23 bp, Artificial Sequence
  mitotic kinesin microtubule-associated protein Eg5 (Kif11) siRNA
tgatcttcttaatccatcatctg

SEQ ID NO: 779 - DNA, 23 bp, Artificial Sequence
  mitotic kinesin microtubule-associated protein Eg5 (Kif11) siRNA
gatcttcttaatccatcatctga

SEQ ID NO: 780 - DNA, 23 bp, Artificial Sequence
  mitotic kinesin microtubule-associated protein Eg5 (Kif11) siRNA
atcttcttaatccatcatctgat

SEQ ID NO: 781 - DNA, 23 bp, Artificial Sequence
  mitotic kinesin microtubule-associated protein Eg5 (Kif11) siRNA
tcttcttaatccatcatctgatg

SEQ ID NO: 782 - DNA, 23 bp, Artificial Sequence
  mitotic kinesin microtubule-associated protein Eg5 (Kif11) siRNA
cttcttaatccatcatctgatgt

SEQ ID NO: 783 - DNA, 23 bp, Artificial Sequence
  mitotic kinesin microtubule-associated protein Eg5 (Kif11) siRNA
ttcttaatccatcatctgatgtt

SEQ ID NO: 784 - DNA, 23 bp, Artificial Sequence
  mitotic kinesin microtubule-associated protein Eg5 (Kif11) siRNA
tcttaatccatcatctgatgttt

SEQ ID NO: 785 - DNA, 23 bp, Artificial Sequence
  mitotic kinesin microtubule-associated protein Eg5 (Kif11) siRNA
cttaatccatcatctgatgtttc

SEQ ID NO: 786 - DNA, 23 bp, Artificial Sequence
  mitotic kinesin microtubule-associated protein Eg5 (Kif11) siRNA
ttaatccatcatctgatgtttct

SEQ ID NO: 787 - DNA, 23 bp, Artificial Sequence
  mitotic kinesin microtubule-associated protein Eg5 (Kif11) siRNA
taatccatcatctgatgtttctg

SEQ ID NO: 788 - DNA, 23 bp, Artificial Sequence
  mitotic kinesin microtubule-associated protein Eg5 (Kif11) siRNA
aatccatcatctgatgtttctga

SEQ ID NO: 789 - DNA, 23 bp, Artificial Sequence
  mitotic kinesin microtubule-associated protein Eg5 (Kif11) siRNA
atccatcatctgatgtttctgag

SEQ ID NO: 790 - DNA, 23 bp, Artificial Sequence
  mitotic kinesin microtubule-associated protein Eg5 (Kif11) siRNA
tccatcatctgatgtttctgaga

SEQ ID NO: 791 - DNA, 23 bp, Artificial Sequence
  mitotic kinesin microtubule-associated protein Eg5 (Kif11) siRNA
ccatcatctgatgtttctgagag

SEQ ID NO: 792 - DNA, 23 bp, Artificial Sequence
  mitotic kinesin microtubule-associated protein Eg5 (Kif11) siRNA
catcatctgatgtttctgagaga

SEQ ID NO: 793 - DNA, 23 bp, Artificial Sequence
  mitotic kinesin microtubule-associated protein Eg5 (Kif11) siRNA
atcatctgatgtttctgagagac

SEQ ID NO: 794 - DNA, 23 bp, Artificial Sequence
  mitotic kinesin microtubule-associated protein Eg5 (Kif11) siRNA
tcatctgatgtttctgagagact

SEQ ID NO: 795 - DNA, 23 bp, Artificial Sequence
  mitotic kinesin microtubule-associated protein Eg5 (Kif11) siRNA
catctgatgtttctgagagacta

SEQ ID NO: 796 - DNA, 23 bp, Artificial Sequence
  mitotic kinesin microtubule-associated protein Eg5 (Kif11) siRNA
atctgatgtttctgagagactac

SEQ ID NO: 797 - DNA, 23 bp, Artificial Sequence
  mitotic kinesin microtubule-associated protein Eg5 (Kif11) siRNA
tctgatgtttctgagagactaca

SEQ ID NO: 798 - DNA, 23 bp, Artificial Sequence
  mitotic kinesin microtubule-associated protein Eg5 (Kif11) siRNA
ctgatgtttctgagagactacag

SEQ ID NO: 799 - DNA, 23 bp, Artificial Sequence
  mitotic kinesin microtubule-associated protein Eg5 (Kif11) siRNA
tgatgtttctgagagactacaga

SEQ ID NO: 800 - DNA, 23 bp, Artificial Sequence
  mitotic kinesin microtubule-associated protein Eg5 (Kif11) siRNA
gatgtttctgagagactacagat

SEQ ID NO: 801 - DNA, 23 bp, Artificial Sequence
  mitotic kinesin microtubule-associated protein Eg5 (Kif11) siRNA
atgtttctgagagactacagatg

SEQ ID NO: 802 - DNA, 23 bp, Artificial Sequence
  mitotic kinesin microtubule-associated protein Eg5 (Kif11) siRNA
tgtttctgagagactacagatgt

SEQ ID NO: 803 - DNA, 23 bp, Artificial Sequence
  mitotic kinesin microtubule-associated protein Eg5 (Kif11) siRNA
gtttctgagagactacagatgtt

SEQ ID NO: 804 - DNA, 23 bp, Artificial Sequence
  mitotic kinesin microtubule-associated protein Eg5 (Kif11) siRNA
tttctgagagactacagatgttt

SEQ ID NO: 805 - DNA, 23 bp, Artificial Sequence
  mitotic kinesin microtubule-associated protein Eg5 (Kif11) siRNA
ttctgagagactacagatgtttg

SEQ ID NO: 806 - DNA, 23 bp, Artificial Sequence
  mitotic kinesin microtubule-associated protein Eg5 (Kif11) siRNA
tctgagagactacagatgtttga

SEQ ID NO: 807 - DNA, 23 bp, Artificial Sequence
  mitotic kinesin microtubule-associated protein Eg5 (Kif11) siRNA
ctgagagactacagatgtttgat

SEQ ID NO: 808 - DNA, 23 bp, Artificial Sequence
  mitotic kinesin microtubule-associated protein Eg5 (Kif11) siRNA
tgagagactacagatgtttgatg

SEQ ID NO: 809 - DNA, 23 bp, Artificial Sequence
  mitotic kinesin microtubule-associated protein Eg5 (Kif11) siRNA
gagagactacagatgtttgatga

SEQ ID NO: 810 - DNA, 23 bp, Artificial Sequence
  mitotic kinesin microtubule-associated protein Eg5 (Kif11) siRNA
agagactacagatgtttgatgat

SEQ ID NO: 811 - DNA, 23 bp, Artificial Sequence
  mitotic kinesin microtubule-associated protein Eg5 (Kif11) siRNA
gagactacagatgtttgatgatc

SEQ ID NO: 812 - DNA, 23 bp, Artificial Sequence
  mitotic kinesin microtubule-associated protein Eg5 (Kif11) siRNA
agactacagatgtttgatgatcc

SEQ ID NO: 813 - DNA, 23 bp, Artificial Sequence
  mitotic kinesin microtubule-associated protein Eg5 (Kif11) siRNA
gactacagatgtttgatgatccc

SEQ ID NO: 814 - DNA, 23 bp, Artificial Sequence
  mitotic kinesin microtubule-associated protein Eg5 (Kif11) siRNA
actacagatgtttgatgatcccc

SEQ ID NO: 815 - DNA, 23 bp, Artificial Sequence
  mitotic kinesin microtubule-associated protein Eg5 (Kif11) siRNA
ctacagatgtttgatgatccccg

SEQ ID NO: 816 - DNA, 23 bp, Artificial Sequence
  mitotic kinesin microtubule-associated protein Eg5 (Kif11) siRNA
tacagatgtttgatgatccccgt

SEQ ID NO: 817 - DNA, 23 bp, Artificial Sequence
  mitotic kinesin microtubule-associated protein Eg5 (Kif11) siRNA
acagatgtttgatgatccccgta

SEQ ID NO: 818 - DNA, 23 bp, Artificial Sequence
  mitotic kinesin microtubule-associated protein Eg5 (Kif11) siRNA
cagatgtttgatgatccccgtaa

SEQ ID NO: 819 - DNA, 23 bp, Artificial Sequence
  mitotic kinesin microtubule-associated protein Eg5 (Kif11) siRNA
agatgtttgatgatccccgtaac

SEQ ID NO: 820 - DNA, 23 bp, Artificial Sequence
  mitotic kinesin microtubule-associated protein Eg5 (Kif11) siRNA
gatgtttgatgatccccgtaaca

SEQ ID NO: 821 - DNA, 23 bp, Artificial Sequence
  mitotic kinesin microtubule-associated protein Eg5 (Kif11) siRNA
atgtttgatgatccccgtaacaa

SEQ ID NO: 822 - DNA, 23 bp, Artificial Sequence
  mitotic kinesin microtubule-associated protein Eg5 (Kif11) siRNA
tgtttgatgatccccgtaacaag

SEQ ID NO: 823 - DNA, 23 bp, Artificial Sequence
  mitotic kinesin microtubule-associated protein Eg5 (Kif11) siRNA
gtttgatgatccccgtaacaaga

SEQ ID NO: 824 - DNA, 23 bp, Artificial Sequence
  mitotic kinesin microtubule-associated protein Eg5 (Kif11) siRNA
tttgatgatccccgtaacaagag

SEQ ID NO: 825 - DNA, 23 bp, Artificial Sequence
  mitotic kinesin microtubule-associated protein Eg5 (Kif11) siRNA
ttgatgatccccgtaacaagaga

SEQ ID NO: 826 - DNA, 23 bp, Artificial Sequence
  mitotic kinesin microtubule-associated protein Eg5 (Kif11) siRNA
tgatgatccccgtaacaagagag

SEQ ID NO: 827 - DNA, 23 bp, Artificial Sequence
  mitotic kinesin microtubule-associated protein Eg5 (Kif11) siRNA
gatgatccccgtaacaagagagg

SEQ ID NO: 828 - DNA, 23 bp, Artificial Sequence
  mitotic kinesin microtubule-associated protein Eg5 (Kif11) siRNA
atgatccccgtaacaagagagga

SEQ ID NO: 829 - DNA, 23 bp, Artificial Sequence
  mitotic kinesin microtubule-associated protein Eg5 (Kif11) siRNA
tgatccccgtaacaagagaggag

SEQ ID NO: 830 - DNA, 23 bp, Artificial Sequence
  mitotic kinesin microtubule-associated protein Eg5 (Kif11) siRNA
gatccccgtaacaagagaggagt

SEQ ID NO: 831 - DNA, 23 bp, Artificial Sequence
  mitotic kinesin microtubule-associated protein Eg5 (Kif11) siRNA
atccccgtaacaagagaggagtg

SEQ ID NO: 832 - DNA, 23 bp, Artificial Sequence
  mitotic kinesin microtubule-associated protein Eg5 (Kif11) siRNA
tccccgtaacaagagaggagtga

SEQ ID NO: 833 - DNA, 23 bp, Artificial Sequence
  mitotic kinesin microtubule-associated protein Eg5 (Kif11) siRNA
ccccgtaacaagagaggagtgat

SEQ ID NO: 834 - DNA, 23 bp, Artificial Sequence
  mitotic kinesin microtubule-associated protein Eg5 (Kif11) siRNA
cccgtaacaagagaggagtgata

SEQ ID NO: 835 - DNA, 23 bp, Artificial Sequence
  mitotic kinesin microtubule-associated protein Eg5 (Kif11) siRNA
ccgtaacaagagaggagtgataa

SEQ ID NO: 836 - DNA, 23 bp, Artificial Sequence
  mitotic kinesin microtubule-associated protein Eg5 (Kif11) siRNA
cgtaacaagagaggagtgataat

SEQ ID NO: 837 - DNA, 23 bp, Artificial Sequence
  mitotic kinesin microtubule-associated protein Eg5 (Kif11) siRNA
gtaacaagagaggagtgataatt

SEQ ID NO: 838 - DNA, 23 bp, Artificial Sequence
  mitotic kinesin microtubule-associated protein Eg5 (Kif11) siRNA
taacaagagaggagtgataatta

SEQ ID NO: 839 - DNA, 23 bp, Artificial Sequence
  mitotic kinesin microtubule-associated protein Eg5 (Kif11) siRNA
aacaagagaggagtgataattaa

SEQ ID NO: 840 - DNA, 23 bp, Artificial Sequence
  mitotic kinesin microtubule-associated protein Eg5 (Kif11) siRNA
acaagagaggagtgataattaaa

SEQ ID NO: 841 - DNA, 23 bp, Artificial Sequence
  mitotic kinesin microtubule-associated protein Eg5 (Kif11) siRNA
caagagaggagtgataattaaag

SEQ ID NO: 842 - DNA, 23 bp, Artificial Sequence
  mitotic kinesin microtubule-associated protein Eg5 (Kif11) siRNA
aagagaggagtgataattaaagg

SEQ ID NO: 843 - DNA, 23 bp, Artificial Sequence
  mitotic kinesin microtubule-associated protein Eg5 (Kif11) siRNA
agagaggagtgataattaaaggt

SEQ ID NO: 844 - DNA, 23 bp, Artificial Sequence
  mitotic kinesin microtubule-associated protein Eg5 (Kif11) siRNA
gagaggagtgataattaaaggtt

SEQ ID NO: 845 - DNA, 23 bp, Artificial Sequence
  mitotic kinesin microtubule-associated protein Eg5 (Kif11) siRNA
agaggagtgataattaaaggttt

SEQ ID NO: 846 - DNA, 23 bp, Artificial Sequence
  mitotic kinesin microtubule-associated protein Eg5 (Kif11) siRNA
gaggagtgataattaaaggttta

SEQ ID NO: 847 - DNA, 23 bp, Artificial Sequence
  mitotic kinesin microtubule-associated protein Eg5 (Kif11) siRNA
aggagtgataattaaaggtttag

SEQ ID NO: 848 - DNA, 23 bp, Artificial Sequence
  mitotic kinesin microtubule-associated protein Eg5 (Kif11) siRNA
ggagtgataattaaaggtttaga

SEQ ID NO: 849 - DNA, 23 bp, Artificial Sequence
  mitotic kinesin microtubule-associated protein Eg5 (Kif11) siRNA
gagtgataattaaaggtttagaa

SEQ ID NO: 850 - DNA, 23 bp, Artificial Sequence
  mitotic kinesin microtubule-associated protein Eg5 (Kif11) siRNA
agtgataattaaaggtttagaag

SEQ ID NO: 851 - DNA, 23 bp, Artificial Sequence
  mitotic kinesin microtubule-associated protein Eg5 (Kif11) siRNA
gtgataattaaaggtttagaaga

SEQ ID NO: 852 - DNA, 23 bp, Artificial Sequence
  mitotic kinesin microtubule-associated protein Eg5 (Kif11) siRNA
tgataattaaaggtttagaagaa

SEQ ID NO: 853 - DNA, 23 bp, Artificial Sequence
  mitotic kinesin microtubule-associated protein Eg5 (Kif11) siRNA
gataattaaaggtttagaagaaa

SEQ ID NO: 854 - DNA, 23 bp, Artificial Sequence
  mitotic kinesin microtubule-associated protein Eg5 (Kif11) siRNA
ataattaaaggtttagaagaaat

SEQ ID NO: 855 - DNA, 23 bp, Artificial Sequence
  mitotic kinesin microtubule-associated protein Eg5 (Kif11) siRNA
taattaaaggtttagaagaaatt

SEQ ID NO: 856 - DNA, 23 bp, Artificial Sequence
  mitotic kinesin microtubule-associated protein Eg5 (Kif11) siRNA
aattaaaggtttagaagaaatta

SEQ ID NO: 857 - DNA, 23 bp, Artificial Sequence
  mitotic kinesin microtubule-associated protein Eg5 (Kif11) siRNA
attaaaggtttagaagaaattac

SEQ ID NO: 858 - DNA, 23 bp, Artificial Sequence
  mitotic kinesin microtubule-associated protein Eg5 (Kif11) siRNA
ttaaaggtttagaagaaattaca

SEQ ID NO: 859 - DNA, 23 bp, Artificial Sequence
  mitotic kinesin microtubule-associated protein Eg5 (Kif11) siRNA
taaaggtttagaagaaattacag

SEQ ID NO: 860 - DNA, 23 bp, Artificial Sequence
  mitotic kinesin microtubule-associated protein Eg5 (Kif11) siRNA
aaaggtttagaagaaattacagt

SEQ ID NO: 861 - DNA, 23 bp, Artificial Sequence
  mitotic kinesin microtubule-associated protein Eg5 (Kif11) siRNA
aaggtttagaagaaattacagta

SEQ ID NO: 862 - DNA, 23 bp, Artificial Sequence
  mitotic kinesin microtubule-associated protein Eg5 (Kif11) siRNA
aggtttagaagaaattacagtac

SEQ ID NO: 863 - DNA, 23 bp, Artificial Sequence
  mitotic kinesin microtubule-associated protein Eg5 (Kif11) siRNA
ggtttagaagaaattacagtaca

SEQ ID NO: 864 - DNA, 23 bp, Artificial Sequence
  mitotic kinesin microtubule-associated protein Eg5 (Kif11) siRNA
gtttagaagaaattacagtacac

SEQ ID NO: 865 - DNA, 23 bp, Artificial Sequence
  mitotic kinesin microtubule-associated protein Eg5 (Kif11) siRNA
tttagaagaaattacagtacaca

SEQ ID NO: 866 - DNA, 23 bp, Artificial Sequence
  mitotic kinesin microtubule-associated protein Eg5 (Kif11) siRNA
ttagaagaaattacagtacacaa

SEQ ID NO: 867 - DNA, 23 bp, Artificial Sequence
  mitotic kinesin microtubule-associated protein Eg5 (Kif11) siRNA
tagaagaaattacagtacacaac

SEQ ID NO: 868 - DNA, 23 bp, Artificial Sequence
  mitotic kinesin microtubule-associated protein Eg5 (Kif11) siRNA
agaagaaattacagtacacaaca

SEQ ID NO: 869 - DNA, 23 bp, Artificial Sequence
  mitotic kinesin microtubule-associated protein Eg5 (Kif11) siRNA
gaagaaattacagtacacaacaa

SEQ ID NO: 870 - DNA, 23 bp, Artificial Sequence
  mitotic kinesin microtubule-associated protein Eg5 (Kif11) siRNA
aagaaattacagtacacaacaag

SEQ ID NO: 871 - DNA, 23 bp, Artificial Sequence
  mitotic kinesin microtubule-associated protein Eg5 (Kif11) siRNA
agaaattacagtacacaacaagg

SEQ ID NO: 872 - DNA, 23 bp, Artificial Sequence
  mitotic kinesin microtubule-associated protein Eg5 (Kif11) siRNA
gaaattacagtacacaacaagga

SEQ ID NO: 873 - DNA, 23 bp, Artificial Sequence
  mitotic kinesin microtubule-associated protein Eg5 (Kif11) siRNA
aaattacagtacacaacaaggat

SEQ ID NO: 874 - DNA, 23 bp, Artificial Sequence
  mitotic kinesin microtubule-associated protein Eg5 (Kif11) siRNA
aattacagtacacaacaaggatg

SEQ ID NO: 875 - DNA, 23 bp, Artificial Sequence
  mitotic kinesin microtubule-associated protein Eg5 (Kif11) siRNA
attacagtacacaacaaggatga

SEQ ID NO: 876 - DNA, 23 bp, Artificial Sequence
  mitotic kinesin microtubule-associated protein Eg5 (Kif11) siRNA
ttacagtacacaacaaggatgaa

SEQ ID NO: 877 - DNA, 23 bp, Artificial Sequence
  mitotic kinesin microtubule-associated protein Eg5 (Kif11) siRNA
tacagtacacaacaaggatgaag

SEQ ID NO: 878 - DNA, 23 bp, Artificial Sequence
  mitotic kinesin microtubule-associated protein Eg5 (Kif11) siRNA
acagtacacaacaaggatgaagt

SEQ ID NO: 879 - DNA, 23 bp, Artificial Sequence
  mitotic kinesin microtubule-associated protein Eg5 (Kif11) siRNA
cagtacacaacaaggatgaagtc

SEQ ID NO: 880 - DNA, 23 bp, Artificial Sequence
  mitotic kinesin microtubule-associated protein Eg5 (Kif11) siRNA
agtacacaacaaggatgaagtct

SEQ ID NO: 881 - DNA, 23 bp, Artificial Sequence
  mitotic kinesin microtubule-associated protein Eg5 (Kif11) siRNA
gtacacaacaaggatgaagtcta

SEQ ID NO: 882 - DNA, 23 bp, Artificial Sequence
  mitotic kinesin microtubule-associated protein Eg5 (Kif11) siRNA
tacacaacaaggatgaagtctat

SEQ ID NO: 883 - DNA, 23 bp, Artificial Sequence
  mitotic kinesin microtubule-associated protein Eg5 (Kif11) siRNA
acacaacaaggatgaagtctatc

SEQ ID NO: 884 - DNA, 23 bp, Artificial Sequence
  mitotic kinesin microtubule-associated protein Eg5 (Kif11) siRNA
cacaacaaggatgaagtctatca

SEQ ID NO: 885 - DNA, 23 bp, Artificial Sequence
  mitotic kinesin microtubule-associated protein Eg5 (Kif11) siRNA
acaacaaggatgaagtctatcaa

SEQ ID NO: 886 - DNA, 23 bp, Artificial Sequence
  mitotic kinesin microtubule-associated protein Eg5 (Kif11) siRNA
caacaaggatgaagtctatcaaa

SEQ ID NO: 887 - DNA, 23 bp, Artificial Sequence
  mitotic kinesin microtubule-associated protein Eg5 (Kif11) siRNA
aacaaggatgaagtctatcaaat

SEQ ID NO: 888 - DNA, 23 bp, Artificial Sequence
  mitotic kinesin microtubule-associated protein Eg5 (Kif11) siRNA
acaaggatgaagtctatcaaatt

SEQ ID NO: 889 - DNA, 23 bp, Artificial Sequence
  mitotic kinesin microtubule-associated protein Eg5 (Kif11) siRNA
caaggatgaagtctatcaaattt

SEQ ID NO: 890 - DNA, 23 bp, Artificial Sequence
  mitotic kinesin microtubule-associated protein Eg5 (Kif11) siRNA
aaggatgaagtctatcaaatttt

SEQ ID NO: 891 - DNA, 23 bp, Artificial Sequence
  mitotic kinesin microtubule-associated protein Eg5 (Kif11) siRNA
aggatgaagtctatcaaatttta

SEQ ID NO: 892 - DNA, 23 bp, Artificial Sequence
  mitotic kinesin microtubule-associated protein Eg5 (Kif11) siRNA
ggatgaagtctatcaaattttag

SEQ ID NO: 893 - DNA, 23 bp, Artificial Sequence
  mitotic kinesin microtubule-associated protein Eg5 (Kif11) siRNA
gatgaagtctatcaaattttaga

SEQ ID NO: 894 - DNA, 23 bp, Artificial Sequence
  mitotic kinesin microtubule-associated protein Eg5 (Kif11) siRNA
atgaagtctatcaaattttagaa

SEQ ID NO: 895 - DNA, 23 bp, Artificial Sequence
  mitotic kinesin microtubule-associated protein Eg5 (Kif11) siRNA
tgaagtctatcaaattttagaaa

SEQ ID NO: 896 - DNA, 23 bp, Artificial Sequence
  mitotic kinesin microtubule-associated protein Eg5 (Kif11) siRNA
gaagtctatcaaattttagaaaa

SEQ ID NO: 897 - DNA, 23 bp, Artificial Sequence
  mitotic kinesin microtubule-associated protein Eg5 (Kif11) siRNA
aagtctatcaaattttagaaaag

SEQ ID NO: 898 - DNA, 23 bp, Artificial Sequence
  mitotic kinesin microtubule-associated protein Eg5 (Kif11) siRNA
agtctatcaaattttagaaaagg

SEQ ID NO: 899 - DNA, 23 bp, Artificial Sequence
  mitotic kinesin microtubule-associated protein Eg5 (Kif11) siRNA
gtctatcaaattttagaaaaggg

SEQ ID NO: 900 - DNA, 23 bp, Artificial Sequence
  mitotic kinesin microtubule-associated protein Eg5 (Kif11) siRNA
tctatcaaattttagaaaagggg

SEQ ID NO: 901 - DNA, 23 bp, Artificial Sequence
  mitotic kinesin microtubule-associated protein Eg5 (Kif11) siRNA
ctatcaaattttagaaaaggggg

SEQ ID NO: 902 - DNA, 23 bp, Artificial Sequence
  mitotic kinesin microtubule-associated protein Eg5 (Kif11) siRNA
tatcaaattttagaaaagggggc

SEQ ID NO: 903 - DNA, 23 bp, Artificial Sequence
  mitotic kinesin microtubule-associated protein Eg5 (Kif11) siRNA
atcaaattttagaaaagggggca

SEQ ID NO: 904 - DNA, 23 bp, Artificial Sequence
  mitotic kinesin microtubule-associated protein Eg5 (Kif11) siRNA
tcaaattttagaaaagggggcag

SEQ ID NO: 905 - DNA, 23 bp, Artificial Sequence
  mitotic kinesin microtubule-associated protein Eg5 (Kif11) siRNA
caaattttagaaaagggggcagc

SEQ ID NO: 906 - DNA, 23 bp, Artificial Sequence
  mitotic kinesin microtubule-associated protein Eg5 (Kif11) siRNA
aaattttagaaaagggggcagca

SEQ ID NO: 907 - DNA, 23 bp, Artificial Sequence
  mitotic kinesin microtubule-associated protein Eg5 (Kif11) siRNA
aattttagaaaagggggcagcaa

SEQ ID NO: 908 - DNA, 23 bp, Artificial Sequence
  mitotic kinesin microtubule-associated protein Eg5 (Kif11) siRNA
attttagaaaagggggcagcaaa

SEQ ID NO: 909 - DNA, 23 bp, Artificial Sequence
  mitotic kinesin microtubule-associated protein Eg5 (Kif11) siRNA
ttttagaaaagggggcagcaaaa

SEQ ID NO: 910 - DNA, 23 bp, Artificial Sequence
  mitotic kinesin microtubule-associated protein Eg5 (Kif11) siRNA
tttagaaaagggggcagcaaaaa

SEQ ID NO: 911 - DNA, 23 bp, Artificial Sequence
  mitotic kinesin microtubule-associated protein Eg5 (Kif11) siRNA
ttagaaaagggggcagcaaaaag

SEQ ID NO: 912 - DNA, 23 bp, Artificial Sequence
  mitotic kinesin microtubule-associated protein Eg5 (Kif11) siRNA
tagaaaagggggcagcaaaaagg

SEQ ID NO: 913 - DNA, 23 bp, Artificial Sequence
  mitotic kinesin microtubule-associated protein Eg5 (Kif11) siRNA
agaaaagggggcagcaaaaagga

SEQ ID NO: 914 - DNA, 23 bp, Artificial Sequence
  mitotic kinesin microtubule-associated protein Eg5 (Kif11) siRNA
gaaaagggggcagcaaaaaggac

SEQ ID NO: 915 - DNA, 23 bp, Artificial Sequence
  mitotic kinesin microtubule-associated protein Eg5 (Kif11) siRNA
aaaagggggcagcaaaaaggaca

SEQ ID NO: 916 - DNA, 23 bp, Artificial Sequence
  mitotic kinesin microtubule-associated protein Eg5 (Kif11) siRNA
aaagggggcagcaaaaaggacaa

SEQ ID NO: 917 - DNA, 23 bp, Artificial Sequence
  mitotic kinesin microtubule-associated protein Eg5 (Kif11) siRNA
aagggggcagcaaaaaggacaac

SEQ ID NO: 918 - DNA, 23 bp, Artificial Sequence
  mitotic kinesin microtubule-associated protein Eg5 (Kif11) siRNA
agggggcagcaaaaaggacaact

SEQ ID NO: 919 - DNA, 23 bp, Artificial Sequence
  mitotic kinesin microtubule-associated protein Eg5 (Kif11) siRNA
gggggcagcaaaaaggacaactg

SEQ ID NO: 920 - DNA, 23 bp, Artificial Sequence
  mitotic kinesin microtubule-associated protein Eg5 (Kif11) siRNA
ggggcagcaaaaaggacaactgc

SEQ ID NO: 921 - DNA, 23 bp, Artificial Sequence
  mitotic kinesin microtubule-associated protein Eg5 (Kif11) siRNA
gggcagcaaaaaggacaactgca

SEQ ID NO: 922 - DNA, 23 bp, Artificial Sequence
  mitotic kinesin microtubule-associated protein Eg5 (Kif11) siRNA
ggcagcaaaaaggacaactgcag

SEQ ID NO: 923 - DNA, 23 bp, Artificial Sequence
  mitotic kinesin microtubule-associated protein Eg5 (Kif11) siRNA
gcagcaaaaaggacaactgcagc

SEQ ID NO: 924 - DNA, 23 bp, Artificial Sequence
  mitotic kinesin microtubule-associated protein Eg5 (Kif11) siRNA
cagcaaaaaggacaactgcagct

SEQ ID NO: 925 - DNA, 23 bp, Artificial Sequence
  mitotic kinesin microtubule-associated protein Eg5 (Kif11) siRNA
agcaaaaaggacaactgcagcta

SEQ ID NO: 926 - DNA, 23 bp, Artificial Sequence
  mitotic kinesin microtubule-associated protein Eg5 (Kif11) siRNA
gcaaaaaggacaactgcagctac

SEQ ID NO: 927 - DNA, 23 bp, Artificial Sequence
  mitotic kinesin microtubule-associated protein Eg5 (Kif11) siRNA
caaaaaggacaactgcagctact

SEQ ID NO: 928 - DNA, 23 bp, Artificial Sequence
  mitotic kinesin microtubule-associated protein Eg5 (Kif11) siRNA
aaaaaggacaactgcagctactc

SEQ ID NO: 929 - DNA, 23 bp, Artificial Sequence
  mitotic kinesin microtubule-associated protein Eg5 (Kif11) siRNA
aaaaggacaactgcagctactct

SEQ ID NO: 930 - DNA, 23 bp, Artificial Sequence
  mitotic kinesin microtubule-associated protein Eg5 (Kif11) siRNA
aaaggacaactgcagctactctg

SEQ ID NO: 931 - DNA, 23 bp, Artificial Sequence
  mitotic kinesin microtubule-associated protein Eg5 (Kif11) siRNA
aaggacaactgcagctactctga

SEQ ID NO: 932 - DNA, 23 bp, Artificial Sequence
  mitotic kinesin microtubule-associated protein Eg5 (Kif11) siRNA
aggacaactgcagctactctgat

SEQ ID NO: 933 - DNA, 23 bp, Artificial Sequence
  mitotic kinesin microtubule-associated protein Eg5 (Kif11) siRNA
ggacaactgcagctactctgatg

SEQ ID NO: 934 - DNA, 23 bp, Artificial Sequence
  mitotic kinesin microtubule-associated protein Eg5 (Kif11) siRNA
gacaactgcagctactctgatga

SEQ ID NO: 935 - DNA, 23 bp, Artificial Sequence
  mitotic kinesin microtubule-associated protein Eg5 (Kif11) siRNA
acaactgcagctactctgatgaa

SEQ ID NO: 936 - DNA, 23 bp, Artificial Sequence
  mitotic kinesin microtubule-associated protein Eg5 (Kif11) siRNA
caactgcagctactctgatgaat

SEQ ID NO: 937 - DNA, 23 bp, Artificial Sequence
  mitotic kinesin microtubule-associated protein Eg5 (Kif11) siRNA
aactgcagctactctgatgaatg

SEQ ID NO: 938 - DNA, 23 bp, Artificial Sequence
  mitotic kinesin microtubule-associated protein Eg5 (Kif11) siRNA
actgcagctactctgatgaatgc

SEQ ID NO: 939 - DNA, 23 bp, Artificial Sequence
  mitotic kinesin microtubule-associated protein Eg5 (Kif11) siRNA
ctgcagctactctgatgaatgca

SEQ ID NO: 940 - DNA, 23 bp, Artificial Sequence
  mitotic kinesin microtubule-associated protein Eg5 (Kif11) siRNA
tgcagctactctgatgaatgcat

SEQ ID NO: 941 - DNA, 23 bp, Artificial Sequence
  mitotic kinesin microtubule-associated protein Eg5 (Kif11) siRNA
gcagctactctgatgaatgcata

SEQ ID NO: 942 - DNA, 23 bp, Artificial Sequence
  mitotic kinesin microtubule-associated protein Eg5 (Kif11) siRNA
cagctactctgatgaatgcatac

SEQ ID NO: 943 - DNA, 23 bp, Artificial Sequence
  mitotic kinesin microtubule-associated protein Eg5 (Kif11) siRNA
agctactctgatgaatgcatact

SEQ ID NO: 944 - DNA, 23 bp, Artificial Sequence
  mitotic kinesin microtubule-associated protein Eg5 (Kif11) siRNA
gctactctgatgaatgcatactc

SEQ ID NO: 945 - DNA, 23 bp, Artificial Sequence
  mitotic kinesin microtubule-associated protein Eg5 (Kif11) siRNA
ctactctgatgaatgcatactct

SEQ ID NO: 946 - DNA, 23 bp, Artificial Sequence
  mitotic kinesin microtubule-associated protein Eg5 (Kif11) siRNA
tactctgatgaatgcatactcta

SEQ ID NO: 947 - DNA, 23 bp, Artificial Sequence
  mitotic kinesin microtubule-associated protein Eg5 (Kif11) siRNA
actctgatgaatgcatactctag

SEQ ID NO: 948 - DNA, 23 bp, Artificial Sequence
  mitotic kinesin microtubule-associated protein Eg5 (Kif11) siRNA
ctctgatgaatgcatactctagt

SEQ ID NO: 949 - DNA, 23 bp, Artificial Sequence
  mitotic kinesin microtubule-associated protein Eg5 (Kif11) siRNA
tctgatgaatgcatactctagtc

SEQ ID NO: 950 - DNA, 23 bp, Artificial Sequence
  mitotic kinesin microtubule-associated protein Eg5 (Kif11) siRNA
ctgatgaatgcatactctagtcg

SEQ ID NO: 951 - DNA, 23 bp, Artificial Sequence
  mitotic kinesin microtubule-associated protein Eg5 (Kif11) siRNA
tgatgaatgcatactctagtcgt

SEQ ID NO: 952 - DNA, 23 bp, Artificial Sequence
  mitotic kinesin microtubule-associated protein Eg5 (Kif11) siRNA
gatgaatgcatactctagtcgtt

SEQ ID NO: 953 - DNA, 23 bp, Artificial Sequence
  mitotic kinesin microtubule-associated protein Eg5 (Kif11) siRNA
atgaatgcatactctagtcgttc

SEQ ID NO: 954 - DNA, 23 bp, Artificial Sequence
  mitotic kinesin microtubule-associated protein Eg5 (Kif11) siRNA
tgaatgcatactctagtcgttcc

SEQ ID NO: 955 - DNA, 23 bp, Artificial Sequence
  mitotic kinesin microtubule-associated protein Eg5 (Kif11) siRNA
gaatgcatactctagtcgttccc

SEQ ID NO: 956 - DNA, 23 bp, Artificial Sequence
  mitotic kinesin microtubule-associated protein Eg5 (Kif11) siRNA
aatgcatactctagtcgttccca

SEQ ID NO: 957 - DNA, 23 bp, Artificial Sequence
  mitotic kinesin microtubule-associated protein Eg5 (Kif11) siRNA
atgcatactctagtcgttcccac

SEQ ID NO: 958 - DNA, 23 bp, Artificial Sequence
  mitotic kinesin microtubule-associated protein Eg5 (Kif11) siRNA
tgcatactctagtcgttcccact

SEQ ID NO: 959 - DNA, 23 bp, Artificial Sequence
  mitotic kinesin microtubule-associated protein Eg5 (Kif11) siRNA
gcatactctagtcgttcccactc

SEQ ID NO: 960 - DNA, 23 bp, Artificial Sequence
  mitotic kinesin microtubule-associated protein Eg5 (Kif11) siRNA
catactctagtcgttcccactca

SEQ ID NO: 961 - DNA, 23 bp, Artificial Sequence
  mitotic kinesin microtubule-associated protein Eg5 (Kif11) siRNA
atactctagtcgttcccactcag

SEQ ID NO: 962 - DNA, 23 bp, Artificial Sequence
  mitotic kinesin microtubule-associated protein Eg5 (Kif11) siRNA
tactctagtcgttcccactcagt

SEQ ID NO: 963 - DNA, 23 bp, Artificial Sequence
  mitotic kinesin microtubule-associated protein Eg5 (Kif11) siRNA
actctagtcgttcccactcagtt

SEQ ID NO: 964 - DNA, 23 bp, Artificial Sequence
  mitotic kinesin microtubule-associated protein Eg5 (Kif11) siRNA
ctctagtcgttcccactcagttt

SEQ ID NO: 965 - DNA, 23 bp, Artificial Sequence
  mitotic kinesin microtubule-associated protein Eg5 (Kif11) siRNA
tctagtcgttcccactcagtttt

SEQ ID NO: 966 - DNA, 23 bp, Artificial Sequence
  mitotic kinesin microtubule-associated protein Eg5 (Kif11) siRNA
ctagtcgttcccactcagttttc

SEQ ID NO: 967 - DNA, 23 bp, Artificial Sequence
  mitotic kinesin microtubule-associated protein Eg5 (Kif11) siRNA
tagtcgttcccactcagttttct

SEQ ID NO: 968 - DNA, 23 bp, Artificial Sequence
  mitotic kinesin microtubule-associated protein Eg5 (Kif11) siRNA
agtcgttcccactcagttttctc

SEQ ID NO: 969 - DNA, 23 bp, Artificial Sequence
  mitotic kinesin microtubule-associated protein Eg5 (Kif11) siRNA
gtcgttcccactcagttttctct

SEQ ID NO: 970 - DNA, 23 bp, Artificial Sequence
  mitotic kinesin microtubule-associated protein Eg5 (Kif11) siRNA
tcgttcccactcagttttctctg

SEQ ID NO: 971 - DNA, 23 bp, Artificial Sequence
  mitotic kinesin microtubule-associated protein Eg5 (Kif11) siRNA
cgttcccactcagttttctctgt

SEQ ID NO: 972 - DNA, 23 bp, Artificial Sequence
  mitotic kinesin microtubule-associated protein Eg5 (Kif11) siRNA
gttcccactcagttttctctgtt

SEQ ID NO: 973 - DNA, 23 bp, Artificial Sequence
  mitotic kinesin microtubule-associated protein Eg5 (Kif11) siRNA
ttcccactcagttttctctgtta

SEQ ID NO: 974 - DNA, 23 bp, Artificial Sequence
  mitotic kinesin microtubule-associated protein Eg5 (Kif11) siRNA
tcccactcagttttctctgttac

SEQ ID NO: 975 - DNA, 23 bp, Artificial Sequence
  mitotic kinesin microtubule-associated protein Eg5 (Kif11) siRNA
cccactcagttttctctgttaca

SEQ ID NO: 976 - DNA, 23 bp, Artificial Sequence
  mitotic kinesin microtubule-associated protein Eg5 (Kif11) siRNA
ccactcagttttctctgttacaa

SEQ ID NO: 977 - DNA, 23 bp, Artificial Sequence
  mitotic kinesin microtubule-associated protein Eg5 (Kif11) siRNA
cactcagttttctctgttacaat

SEQ ID NO: 978 - DNA, 23 bp, Artificial Sequence
  mitotic kinesin microtubule-associated protein Eg5 (Kif11) siRNA
actcagttttctctgttacaata

SEQ ID NO: 979 - DNA, 23 bp, Artificial Sequence
  mitotic kinesin microtubule-associated protein Eg5 (Kif11) siRNA
ctcagttttctctgttacaatac

SEQ ID NO: 980 - DNA, 23 bp, Artificial Sequence
  mitotic kinesin microtubule-associated protein Eg5 (Kif11) siRNA
tcagttttctctgttacaataca

SEQ ID NO: 981 - DNA, 23 bp, Artificial Sequence
  mitotic kinesin microtubule-associated protein Eg5 (Kif11) siRNA
cagttttctctgttacaatacat

SEQ ID NO: 982 - DNA, 23 bp, Artificial Sequence
  mitotic kinesin microtubule-associated protein Eg5 (Kif11) siRNA
agttttctctgttacaatacata

SEQ ID NO: 983 - DNA, 23 bp, Artificial Sequence
  mitotic kinesin microtubule-associated protein Eg5 (Kif11) siRNA
gttttctctgttacaatacatat

SEQ ID NO: 984 - DNA, 23 bp, Artificial Sequence
  mitotic kinesin microtubule-associated protein Eg5 (Kif11) siRNA
ttttctctgttacaatacatatg

SEQ ID NO: 985 - DNA, 23 bp, Artificial Sequence
  mitotic kinesin microtubule-associated protein Eg5 (Kif11) siRNA
tttctctgttacaatacatatga

SEQ ID NO: 986 - DNA, 23 bp, Artificial Sequence
  mitotic kinesin microtubule-associated protein Eg5 (Kif11) siRNA
ttctctgttacaatacatatgaa

SEQ ID NO: 987 - DNA, 23 bp, Artificial Sequence
  mitotic kinesin microtubule-associated protein Eg5 (Kif11) siRNA
tctctgttacaatacatatgaaa

SEQ ID NO: 988 - DNA, 23 bp, Artificial Sequence
  mitotic kinesin microtubule-associated protein Eg5 (Kif11) siRNA
ctctgttacaatacatatgaaag

SEQ ID NO: 989 - DNA, 23 bp, Artificial Sequence
  mitotic kinesin microtubule-associated protein Eg5 (Kif11) siRNA
tctgttacaatacatatgaaaga

SEQ ID NO: 990 - DNA, 23 bp, Artificial Sequence
  mitotic kinesin microtubule-associated protein Eg5 (Kif11) siRNA
ctgttacaatacatatgaaagaa

SEQ ID NO: 991 - DNA, 23 bp, Artificial Sequence
  mitotic kinesin microtubule-associated protein Eg5 (Kif11) siRNA
tgttacaatacatatgaaagaaa

SEQ ID NO: 992 - DNA, 23 bp, Artificial Sequence
  mitotic kinesin microtubule-associated protein Eg5 (Kif11) siRNA
gttacaatacatatgaaagaaac

SEQ ID NO: 993 - DNA, 23 bp, Artificial Sequence
  mitotic kinesin microtubule-associated protein Eg5 (Kif11) siRNA
ttacaatacatatgaaagaaact

SEQ ID NO: 994 - DNA, 23 bp, Artificial Sequence
  mitotic kinesin microtubule-associated protein Eg5 (Kif11) siRNA
tacaatacatatgaaagaaacta

SEQ ID NO: 995 - DNA, 23 bp, Artificial Sequence
  mitotic kinesin microtubule-associated protein Eg5 (Kif11) siRNA
acaatacatatgaaagaaactac

SEQ ID NO: 996 - DNA, 23 bp, Artificial Sequence
  mitotic kinesin microtubule-associated protein Eg5 (Kif11) siRNA
caatacatatgaaagaaactacg

SEQ ID NO: 997 - DNA, 23 bp, Artificial Sequence
  mitotic kinesin microtubule-associated protein Eg5 (Kif11) siRNA
aatacatatgaaagaaactacga

SEQ ID NO: 998 - DNA, 23 bp, Artificial Sequence
  mitotic kinesin microtubule-associated protein Eg5 (Kif11) siRNA
atacatatgaaagaaactacgat

SEQ ID NO: 999 - DNA, 23 bp, Artificial Sequence
  mitotic kinesin microtubule-associated protein Eg5 (Kif11) siRNA
tacatatgaaagaaactacgatt

SEQ ID NO: 1000 - DNA, 23 bp, Artificial Sequence
  mitotic kinesin microtubule-associated protein Eg5 (Kif11) siRNA
acatatgaaagaaactacgattg

SEQ ID NO: 1001 - DNA, 23 bp, Artificial Sequence
  mitotic kinesin microtubule-associated protein Eg5 (Kif11) siRNA
catatgaaagaaactacgattga

SEQ ID NO: 1002 - DNA, 23 bp, Artificial Sequence
  mitotic kinesin microtubule-associated protein Eg5 (Kif11) siRNA
atatgaaagaaactacgattgat

SEQ ID NO: 1003 - DNA, 23 bp, Artificial Sequence
  mitotic kinesin microtubule-associated protein Eg5 (Kif11) siRNA
tatgaaagaaactacgattgatg

SEQ ID NO: 1004 - DNA, 23 bp, Artificial Sequence
  mitotic kinesin microtubule-associated protein Eg5 (Kif11) siRNA
atgaaagaaactacgattgatgg

SEQ ID NO: 1005 - DNA, 23 bp, Artificial Sequence
  mitotic kinesin microtubule-associated protein Eg5 (Kif11) siRNA
tgaaagaaactacgattgatgga

SEQ ID NO: 1006 - DNA, 23 bp, Artificial Sequence
  mitotic kinesin microtubule-associated protein Eg5 (Kif11) siRNA
gaaagaaactacgattgatggag

SEQ ID NO: 1007 - DNA, 23 bp, Artificial Sequence
  mitotic kinesin microtubule-associated protein Eg5 (Kif11) siRNA
aaagaaactacgattgatggaga

SEQ ID NO: 1008 - DNA, 23 bp, Artificial Sequence
  mitotic kinesin microtubule-associated protein Eg5 (Kif11) siRNA
aagaaactacgattgatggagaa

SEQ ID NO: 1009 - DNA, 23 bp, Artificial Sequence
  mitotic kinesin microtubule-associated protein Eg5 (Kif11) siRNA
agaaactacgattgatggagaag

SEQ ID NO: 1010 - DNA, 23 bp, Artificial Sequence
  mitotic kinesin microtubule-associated protein Eg5 (Kif11) siRNA
gaaactacgattgatggagaaga

SEQ ID NO: 1011 - DNA, 23 bp, Artificial Sequence
  mitotic kinesin microtubule-associated protein Eg5 (Kif11) siRNA
aaactacgattgatggagaagag

SEQ ID NO: 1012 - DNA, 23 bp, Artificial Sequence
  mitotic kinesin microtubule-associated protein Eg5 (Kif11) siRNA
aactacgattgatggagaagagc

SEQ ID NO: 1013 - DNA, 23 bp, Artificial Sequence
  mitotic kinesin microtubule-associated protein Eg5 (Kif11) siRNA
actacgattgatggagaagagct

SEQ ID NO: 1014 - DNA, 23 bp, Artificial Sequence
  mitotic kinesin microtubule-associated protein Eg5 (Kif11) siRNA
ctacgattgatggagaagagctt

SEQ ID NO: 1015 - DNA, 23 bp, Artificial Sequence
  mitotic kinesin microtubule-associated protein Eg5 (Kif11) siRNA
tacgattgatggagaagagcttg

SEQ ID NO: 1016 - DNA, 23 bp, Artificial Sequence
  mitotic kinesin microtubule-associated protein Eg5 (Kif11) siRNA
acgattgatggagaagagcttgt

SEQ ID NO: 1017 - DNA, 23 bp, Artificial Sequence
  mitotic kinesin microtubule-associated protein Eg5 (Kif11) siRNA
cgattgatggagaagagcttgtt

SEQ ID NO: 1018 - DNA, 23 bp, Artificial Sequence
  mitotic kinesin microtubule-associated protein Eg5 (Kif11) siRNA
gattgatggagaagagcttgtta

SEQ ID NO: 1019 - DNA, 23 bp, Artificial Sequence
  mitotic kinesin microtubule-associated protein Eg5 (Kif11) siRNA
attgatggagaagagcttgttaa

SEQ ID NO: 1020 - DNA, 23 bp, Artificial Sequence
  mitotic kinesin microtubule-associated protein Eg5 (Kif11) siRNA
ttgatggagaagagcttgttaaa

SEQ ID NO: 1021 - DNA, 23 bp, Artificial Sequence
  mitotic kinesin microtubule-associated protein Eg5 (Kif11) siRNA
tgatggagaagagcttgttaaaa

SEQ ID NO: 1022 - DNA, 23 bp, Artificial Sequence
  mitotic kinesin microtubule-associated protein Eg5 (Kif11) siRNA
gatggagaagagcttgttaaaat

SEQ ID NO: 1023 - DNA, 23 bp, Artificial Sequence
  mitotic kinesin microtubule-associated protein Eg5 (Kif11) siRNA
atggagaagagcttgttaaaatc

SEQ ID NO: 1024 - DNA, 23 bp, Artificial Sequence
  mitotic kinesin microtubule-associated protein Eg5 (Kif11) siRNA
tggagaagagcttgttaaaatcg

SEQ ID NO: 1025 - DNA, 23 bp, Artificial Sequence
  mitotic kinesin microtubule-associated protein Eg5 (Kif11) siRNA
ggagaagagcttgttaaaatcgg

SEQ ID NO: 1026 - DNA, 23 bp, Artificial Sequence
  mitotic kinesin microtubule-associated protein Eg5 (Kif11) siRNA
gagaagagcttgttaaaatcgga

SEQ ID NO: 1027 - DNA, 23 bp, Artificial Sequence
  mitotic kinesin microtubule-associated protein Eg5 (Kif11) siRNA
agaagagcttgttaaaatcggaa

SEQ ID NO: 1028 - DNA, 23 bp, Artificial Sequence
  mitotic kinesin microtubule-associated protein Eg5 (Kif11) siRNA
gaagagcttgttaaaatcggaaa

SEQ ID NO: 1029 - DNA, 23 bp, Artificial Sequence
  mitotic kinesin microtubule-associated protein Eg5 (Kif11) siRNA
aagagcttgttaaaatcggaaag

SEQ ID NO: 1030 - DNA, 23 bp, Artificial Sequence
  mitotic kinesin microtubule-associated protein Eg5 (Kif11) siRNA
agagcttgttaaaatcggaaagt

SEQ ID NO: 1031 - DNA, 23 bp, Artificial Sequence
  mitotic kinesin microtubule-associated protein Eg5 (Kif11) siRNA
gagcttgttaaaatcggaaagtt

SEQ ID NO: 1032 - DNA, 23 bp, Artificial Sequence
  mitotic kinesin microtubule-associated protein Eg5 (Kif11) siRNA
agcttgttaaaatcggaaagttg

SEQ ID NO: 1033 - DNA, 23 bp, Artificial Sequence
  mitotic kinesin microtubule-associated protein Eg5 (Kif11) siRNA
gcttgttaaaatcggaaagttga

SEQ ID NO: 1034 - DNA, 23 bp, Artificial Sequence
  mitotic kinesin microtubule-associated protein Eg5 (Kif11) siRNA
cttgttaaaatcggaaagttgaa

SEQ ID NO: 1035 - DNA, 23 bp, Artificial Sequence
  mitotic kinesin microtubule-associated protein Eg5 (Kif11) siRNA
ttgttaaaatcggaaagttgaac

SEQ ID NO: 1036 - DNA, 23 bp, Artificial Sequence
  mitotic kinesin microtubule-associated protein Eg5 (Kif11) siRNA
tgttaaaatcggaaagttgaact

SEQ ID NO: 1037 - DNA, 23 bp, Artificial Sequence
  mitotic kinesin microtubule-associated protein Eg5 (Kif11) siRNA
gttaaaatcggaaagttgaactt

SEQ ID NO: 1038 - DNA, 23 bp, Artificial Sequence
  mitotic kinesin microtubule-associated protein Eg5 (Kif11) siRNA
ttaaaatcggaaagttgaacttg

SEQ ID NO: 1039 - DNA, 23 bp, Artificial Sequence
  mitotic kinesin microtubule-associated protein Eg5 (Kif11) siRNA
taaaatcggaaagttgaacttgg

SEQ ID NO: 1040 - DNA, 23 bp, Artificial Sequence
  mitotic kinesin microtubule-associated protein Eg5 (Kif11) siRNA
aaaatcggaaagttgaacttggt

SEQ ID NO: 1041 - DNA, 23 bp, Artificial Sequence
  mitotic kinesin microtubule-associated protein Eg5 (Kif11) siRNA
aaatcggaaagttgaacttggtt

SEQ ID NO: 1042 - DNA, 23 bp, Artificial Sequence
  mitotic kinesin microtubule-associated protein Eg5 (Kif11) siRNA
aatcggaaagttgaacttggttg

SEQ ID NO: 1043 - DNA, 23 bp, Artificial Sequence
  mitotic kinesin microtubule-associated protein Eg5 (Kif11) siRNA
atcggaaagttgaacttggttga

SEQ ID NO: 1044 - DNA, 23 bp, Artificial Sequence
  mitotic kinesin microtubule-associated protein Eg5 (Kif11) siRNA
tcggaaagttgaacttggttgat

SEQ ID NO: 1045 - DNA, 23 bp, Artificial Sequence
  mitotic kinesin microtubule-associated protein Eg5 (Kif11) siRNA
cggaaagttgaacttggttgatc

SEQ ID NO: 1046 - DNA, 23 bp, Artificial Sequence
  mitotic kinesin microtubule-associated protein Eg5 (Kif11) siRNA
ggaaagttgaacttggttgatct

SEQ ID NO: 1047 - DNA, 23 bp, Artificial Sequence
  mitotic kinesin microtubule-associated protein Eg5 (Kif11) siRNA
gaaagttgaacttggttgatctt

SEQ ID NO: 1048 - DNA, 23 bp, Artificial Sequence
  mitotic kinesin microtubule-associated protein Eg5 (Kif11) siRNA
aaagttgaacttggttgatcttg

SEQ ID NO: 1049 - DNA, 23 bp, Artificial Sequence
  mitotic kinesin microtubule-associated protein Eg5 (Kif11) siRNA
aagttgaacttggttgatcttgc

SEQ ID NO: 1050 - DNA, 23 bp, Artificial Sequence
  mitotic kinesin microtubule-associated protein Eg5 (Kif11) siRNA
agttgaacttggttgatcttgca

SEQ ID NO: 1051 - DNA, 23 bp, Artificial Sequence
  mitotic kinesin microtubule-associated protein Eg5 (Kif11) siRNA
gttgaacttggttgatcttgcag

SEQ ID NO: 1052 - DNA, 23 bp, Artificial Sequence
  mitotic kinesin microtubule-associated protein Eg5 (Kif11) siRNA
ttgaacttggttgatcttgcagg

SEQ ID NO: 1053 - DNA, 23 bp, Artificial Sequence
  mitotic kinesin microtubule-associated protein Eg5 (Kif11) siRNA
tgaacttggttgatcttgcagga

SEQ ID NO: 1054 - DNA, 23 bp, Artificial Sequence
  mitotic kinesin microtubule-associated protein Eg5 (Kif11) siRNA
gaacttggttgatcttgcaggaa

SEQ ID NO: 1055 - DNA, 23 bp, Artificial Sequence
  mitotic kinesin microtubule-associated protein Eg5 (Kif11) siRNA
aacttggttgatcttgcaggaag

SEQ ID NO: 1056 - DNA, 23 bp, Artificial Sequence
  mitotic kinesin microtubule-associated protein Eg5 (Kif11) siRNA
acttggttgatcttgcaggaagt

SEQ ID NO: 1057 - DNA, 23 bp, Artificial Sequence
  mitotic kinesin microtubule-associated protein Eg5 (Kif11) siRNA
cttggttgatcttgcaggaagtg

SEQ ID NO: 1058 - DNA, 23 bp, Artificial Sequence
  mitotic kinesin microtubule-associated protein Eg5 (Kif11) siRNA
ttggttgatcttgcaggaagtga

SEQ ID NO: 1059 - DNA, 23 bp, Artificial Sequence
  mitotic kinesin microtubule-associated protein Eg5 (Kif11) siRNA
tggttgatcttgcaggaagtgaa

SEQ ID NO: 1060 - DNA, 23 bp, Artificial Sequence
  mitotic kinesin microtubule-associated protein Eg5 (Kif11) siRNA
ggttgatcttgcaggaagtgaaa

SEQ ID NO: 1061 - DNA, 23 bp, Artificial Sequence
  mitotic kinesin microtubule-associated protein Eg5 (Kif11) siRNA
gttgatcttgcaggaagtgaaaa

SEQ ID NO: 1062 - DNA, 23 bp, Artificial Sequence
  mitotic kinesin microtubule-associated protein Eg5 (Kif11) siRNA
ttgatcttgcaggaagtgaaaac

SEQ ID NO: 1063 - DNA, 23 bp, Artificial Sequence
  mitotic kinesin microtubule-associated protein Eg5 (Kif11) siRNA
tgatcttgcaggaagtgaaaaca

SEQ ID NO: 1064 - DNA, 23 bp, Artificial Sequence
  mitotic kinesin microtubule-associated protein Eg5 (Kif11) siRNA
gatcttgcaggaagtgaaaacat

SEQ ID NO: 1065 - DNA, 23 bp, Artificial Sequence
  mitotic kinesin microtubule-associated protein Eg5 (Kif11) siRNA
atcttgcaggaagtgaaaacatt

SEQ ID NO: 1066 - DNA, 23 bp, Artificial Sequence
  mitotic kinesin microtubule-associated protein Eg5 (Kif11) siRNA
tcttgcaggaagtgaaaacattg

SEQ ID NO: 1067 - DNA, 23 bp, Artificial Sequence
  mitotic kinesin microtubule-associated protein Eg5 (Kif11) siRNA
cttgcaggaagtgaaaacattgg

SEQ ID NO: 1068 - DNA, 23 bp, Artificial Sequence
  mitotic kinesin microtubule-associated protein Eg5 (Kif11) siRNA
ttgcaggaagtgaaaacattggc

SEQ ID NO: 1069 - DNA, 23 bp, Artificial Sequence
  mitotic kinesin microtubule-associated protein Eg5 (Kif11) siRNA
tgcaggaagtgaaaacattggcc

SEQ ID NO: 1070 - DNA, 23 bp, Artificial Sequence
  mitotic kinesin microtubule-associated protein Eg5 (Kif11) siRNA
gcaggaagtgaaaacattggccg

SEQ ID NO: 1071 - DNA, 23 bp, Artificial Sequence
  mitotic kinesin microtubule-associated protein Eg5 (Kif11) siRNA
caggaagtgaaaacattggccgt

SEQ ID NO: 1072 - DNA, 23 bp, Artificial Sequence
  mitotic kinesin microtubule-associated protein Eg5 (Kif11) siRNA
aggaagtgaaaacattggccgtt

SEQ ID NO: 1073 - DNA, 23 bp, Artificial Sequence
  mitotic kinesin microtubule-associated protein Eg5 (Kif11) siRNA
ggaagtgaaaacattggccgttc

SEQ ID NO: 1074 - DNA, 23 bp, Artificial Sequence
  mitotic kinesin microtubule-associated protein Eg5 (Kif11) siRNA
gaagtgaaaacattggccgttct

SEQ ID NO: 1075 - DNA, 23 bp, Artificial Sequence
  mitotic kinesin microtubule-associated protein Eg5 (Kif11) siRNA
aagtgaaaacattggccgttctg

SEQ ID NO: 1076 - DNA, 23 bp, Artificial Sequence
  mitotic kinesin microtubule-associated protein Eg5 (Kif11) siRNA
agtgaaaacattggccgttctgg

SEQ ID NO: 1077 - DNA, 23 bp, Artificial Sequence
  mitotic kinesin microtubule-associated protein Eg5 (Kif11) siRNA
gtgaaaacattggccgttctgga

SEQ ID NO: 1078 - DNA, 23 bp, Artificial Sequence
  mitotic kinesin microtubule-associated protein Eg5 (Kif11) siRNA
tgaaaacattggccgttctggag

SEQ ID NO: 1079 - DNA, 23 bp, Artificial Sequence
  mitotic kinesin microtubule-associated protein Eg5 (Kif11) siRNA
gaaaacattggccgttctggagc

SEQ ID NO: 1080 - DNA, 23 bp, Artificial Sequence
  mitotic kinesin microtubule-associated protein Eg5 (Kif11) siRNA
aaaacattggccgttctggagct

SEQ ID NO: 1081 - DNA, 23 bp, Artificial Sequence
  mitotic kinesin microtubule-associated protein Eg5 (Kif11) siRNA
aaacattggccgttctggagctg

SEQ ID NO: 1082 - DNA, 23 bp, Artificial Sequence
  mitotic kinesin microtubule-associated protein Eg5 (Kif11) siRNA
aacattggccgttctggagctgt

SEQ ID NO: 1083 - DNA, 23 bp, Artificial Sequence
  mitotic kinesin microtubule-associated protein Eg5 (Kif11) siRNA
acattggccgttctggagctgtt

SEQ ID NO: 1084 - DNA, 23 bp, Artificial Sequence
  mitotic kinesin microtubule-associated protein Eg5 (Kif11) siRNA
cattggccgttctggagctgttg

SEQ ID NO: 1085 - DNA, 23 bp, Artificial Sequence
  mitotic kinesin microtubule-associated protein Eg5 (Kif11) siRNA
attggccgttctggagctgttga

SEQ ID NO: 1086 - DNA, 23 bp, Artificial Sequence
  mitotic kinesin microtubule-associated protein Eg5 (Kif11) siRNA
ttggccgttctggagctgttgat

SEQ ID NO: 1087 - DNA, 23 bp, Artificial Sequence
  mitotic kinesin microtubule-associated protein Eg5 (Kif11) siRNA
tggccgttctggagctgttgata

SEQ ID NO: 1088 - DNA, 23 bp, Artificial Sequence
  mitotic kinesin microtubule-associated protein Eg5 (Kif11) siRNA
ggccgttctggagctgttgataa

SEQ ID NO: 1089 - DNA, 23 bp, Artificial Sequence
  mitotic kinesin microtubule-associated protein Eg5 (Kif11) siRNA
gccgttctggagctgttgataag

SEQ ID NO: 1090 - DNA, 23 bp, Artificial Sequence
  mitotic kinesin microtubule-associated protein Eg5 (Kif11) siRNA
ccgttctggagctgttgataaga

SEQ ID NO: 1091 - DNA, 23 bp, Artificial Sequence
  mitotic kinesin microtubule-associated protein Eg5 (Kif11) siRNA
cgttctggagctgttgataagag

SEQ ID NO: 1092 - DNA, 23 bp, Artificial Sequence
  mitotic kinesin microtubule-associated protein Eg5 (Kif11) siRNA
gttctggagctgttgataagaga

SEQ ID NO: 1093 - DNA, 23 bp, Artificial Sequence
  mitotic kinesin microtubule-associated protein Eg5 (Kif11) siRNA
ttctggagctgttgataagagag

SEQ ID NO: 1094 - DNA, 23 bp, Artificial Sequence
  mitotic kinesin microtubule-associated protein Eg5 (Kif11) siRNA
tctggagctgttgataagagagc

SEQ ID NO: 1095 - DNA, 23 bp, Artificial Sequence
  mitotic kinesin microtubule-associated protein Eg5 (Kif11) siRNA
ctggagctgttgataagagagct

SEQ ID NO: 1096 - DNA, 23 bp, Artificial Sequence
  mitotic kinesin microtubule-associated protein Eg5 (Kif11) siRNA
tggagctgttgataagagagctc

SEQ ID NO: 1097 - DNA, 23 bp, Artificial Sequence
  mitotic kinesin microtubule-associated protein Eg5 (Kif11) siRNA
ggagctgttgataagagagctcg

SEQ ID NO: 1098 - DNA, 23 bp, Artificial Sequence
  mitotic kinesin microtubule-associated protein Eg5 (Kif11) siRNA
gagctgttgataagagagctcgg

SEQ ID NO: 1099 - DNA, 23 bp, Artificial Sequence
  mitotic kinesin microtubule-associated protein Eg5 (Kif11) siRNA
agctgttgataagagagctcggg

SEQ ID NO: 1100 - DNA, 23 bp, Artificial Sequence
  mitotic kinesin microtubule-associated protein Eg5 (Kif11) siRNA
gctgttgataagagagctcggga

SEQ ID NO: 1101 - DNA, 23 bp, Artificial Sequence
  mitotic kinesin microtubule-associated protein Eg5 (Kif11) siRNA
ctgttgataagagagctcgggaa

SEQ ID NO: 1102 - DNA, 23 bp, Artificial Sequence
  mitotic kinesin microtubule-associated protein Eg5 (Kif11) siRNA
tgttgataagagagctcgggaag

SEQ ID NO: 1103 - DNA, 23 bp, Artificial Sequence
  mitotic kinesin microtubule-associated protein Eg5 (Kif11) siRNA
gttgataagagagctcgggaagc

SEQ ID NO: 1104 - DNA, 23 bp, Artificial Sequence
  mitotic kinesin microtubule-associated protein Eg5 (Kif11) siRNA
ttgataagagagctcgggaagct

SEQ ID NO: 1105 - DNA, 23 bp, Artificial Sequence
  mitotic kinesin microtubule-associated protein Eg5 (Kif11) siRNA
tgataagagagctcgggaagctg

SEQ ID NO: 1106 - DNA, 23 bp, Artificial Sequence
  mitotic kinesin microtubule-associated protein Eg5 (Kif11) siRNA
gataagagagctcgggaagctgg

SEQ ID NO: 1107 - DNA, 23 bp, Artificial Sequence
  mitotic kinesin microtubule-associated protein Eg5 (Kif11) siRNA
ataagagagctcgggaagctgga

SEQ ID NO: 1108 - DNA, 23 bp, Artificial Sequence
  mitotic kinesin microtubule-associated protein Eg5 (Kif11) siRNA
taagagagctcgggaagctggaa

SEQ ID NO: 1109 - DNA, 23 bp, Artificial Sequence
  mitotic kinesin microtubule-associated protein Eg5 (Kif11) siRNA
aagagagctcgggaagctggaaa

SEQ ID NO: 1110 - DNA, 23 bp, Artificial Sequence
  mitotic kinesin microtubule-associated protein Eg5 (Kif11) siRNA
agagagctcgggaagctggaaat

SEQ ID NO: 1111 - DNA, 23 bp, Artificial Sequence
  mitotic kinesin microtubule-associated protein Eg5 (Kif11) siRNA
gagagctcgggaagctggaaata

SEQ ID NO: 1112 - DNA, 23 bp, Artificial Sequence
  mitotic kinesin microtubule-associated protein Eg5 (Kif11) siRNA
agagctcgggaagctggaaatat

SEQ ID NO: 1113 - DNA, 23 bp, Artificial Sequence
  mitotic kinesin microtubule-associated protein Eg5 (Kif11) siRNA
gagctcgggaagctggaaatata

SEQ ID NO: 1114 - DNA, 23 bp, Artificial Sequence
  mitotic kinesin microtubule-associated protein Eg5 (Kif11) siRNA
agctcgggaagctggaaatataa

SEQ ID NO: 1115 - DNA, 23 bp, Artificial Sequence
  mitotic kinesin microtubule-associated protein Eg5 (Kif11) siRNA
gctcgggaagctggaaatataaa

SEQ ID NO: 1116 - DNA, 23 bp, Artificial Sequence
  mitotic kinesin microtubule-associated protein Eg5 (Kif11) siRNA
ctcgggaagctggaaatataaat

SEQ ID NO: 1117 - DNA, 23 bp, Artificial Sequence
  mitotic kinesin microtubule-associated protein Eg5 (Kif11) siRNA
tcgggaagctggaaatataaatc

SEQ ID NO: 1118 - DNA, 23 bp, Artificial Sequence
  mitotic kinesin microtubule-associated protein Eg5 (Kif11) siRNA
cgggaagctggaaatataaatca

SEQ ID NO: 1119 - DNA, 23 bp, Artificial Sequence
  mitotic kinesin microtubule-associated protein Eg5 (Kif11) siRNA
gggaagctggaaatataaatcaa

SEQ ID NO: 1120 - DNA, 23 bp, Artificial Sequence
  mitotic kinesin microtubule-associated protein Eg5 (Kif11) siRNA
ggaagctggaaatataaatcaat

SEQ ID NO: 1121 - DNA, 23 bp, Artificial Sequence
  mitotic kinesin microtubule-associated protein Eg5 (Kif11) siRNA
gaagctggaaatataaatcaatc

SEQ ID NO: 1122 - DNA, 23 bp, Artificial Sequence
  mitotic kinesin microtubule-associated protein Eg5 (Kif11) siRNA
aagctggaaatataaatcaatcc

SEQ ID NO: 1123 - DNA, 23 bp, Artificial Sequence
  mitotic kinesin microtubule-associated protein Eg5 (Kif11) siRNA
agctggaaatataaatcaatccc

SEQ ID NO: 1124 - DNA, 23 bp, Artificial Sequence
  mitotic kinesin microtubule-associated protein Eg5 (Kif11) siRNA
gctggaaatataaatcaatccct

SEQ ID NO: 1125 - DNA, 23 bp, Artificial Sequence
  mitotic kinesin microtubule-associated protein Eg5 (Kif11) siRNA
ctggaaatataaatcaatccctg

SEQ ID NO: 1126 - DNA, 23 bp, Artificial Sequence
  mitotic kinesin microtubule-associated protein Eg5 (Kif11) siRNA
tggaaatataaatcaatccctgt

SEQ ID NO: 1127 - DNA, 23 bp, Artificial Sequence
  mitotic kinesin microtubule-associated protein Eg5 (Kif11) siRNA
ggaaatataaatcaatccctgtt

SEQ ID NO: 1128 - DNA, 23 bp, Artificial Sequence
  mitotic kinesin microtubule-associated protein Eg5 (Kif11) siRNA
gaaatataaatcaatccctgttg

SEQ ID NO: 1129 - DNA, 23 bp, Artificial Sequence
  mitotic kinesin microtubule-associated protein Eg5 (Kif11) siRNA
aaatataaatcaatccctgttga

SEQ ID NO: 1130 - DNA, 23 bp, Artificial Sequence
  mitotic kinesin microtubule-associated protein Eg5 (Kif11) siRNA
aatataaatcaatccctgttgac

SEQ ID NO: 1131 - DNA, 23 bp, Artificial Sequence
  mitotic kinesin microtubule-associated protein Eg5 (Kif11) siRNA
atataaatcaatccctgttgact

SEQ ID NO: 1132 - DNA, 23 bp, Artificial Sequence
  mitotic kinesin microtubule-associated protein Eg5 (Kif11) siRNA
tataaatcaatccctgttgactt

SEQ ID NO: 1133 - DNA, 23 bp, Artificial Sequence
  mitotic kinesin microtubule-associated protein Eg5 (Kif11) siRNA
ataaatcaatccctgttgacttt

SEQ ID NO: 1134 - DNA, 23 bp, Artificial Sequence
  mitotic kinesin microtubule-associated protein Eg5 (Kif11) siRNA
taaatcaatccctgttgactttg

SEQ ID NO: 1135 - DNA, 23 bp, Artificial Sequence
  mitotic kinesin microtubule-associated protein Eg5 (Kif11) siRNA
aaatcaatccctgttgactttgg

SEQ ID NO: 1136 - DNA, 23 bp, Artificial Sequence
  mitotic kinesin microtubule-associated protein Eg5 (Kif11) siRNA
aatcaatccctgttgactttggg

SEQ ID NO: 1137 - DNA, 23 bp, Artificial Sequence
  mitotic kinesin microtubule-associated protein Eg5 (Kif11) siRNA
atcaatccctgttgactttggga

SEQ ID NO: 1138 - DNA, 23 bp, Artificial Sequence
  mitotic kinesin microtubule-associated protein Eg5 (Kif11) siRNA
tcaatccctgttgactttgggaa

SEQ ID NO: 1139 - DNA, 23 bp, Artificial Sequence
  mitotic kinesin microtubule-associated protein Eg5 (Kif11) siRNA
caatccctgttgactttgggaag

SEQ ID NO: 1140 - DNA, 23 bp, Artificial Sequence
  mitotic kinesin microtubule-associated protein Eg5 (Kif11) siRNA
aatccctgttgactttgggaagg

SEQ ID NO: 1141 - DNA, 23 bp, Artificial Sequence
  mitotic kinesin microtubule-associated protein Eg5 (Kif11) siRNA
atccctgttgactttgggaaggg

SEQ ID NO: 1142 - DNA, 23 bp, Artificial Sequence
  mitotic kinesin microtubule-associated protein Eg5 (Kif11) siRNA
tccctgttgactttgggaagggt

SEQ ID NO: 1143 - DNA, 23 bp, Artificial Sequence
  mitotic kinesin microtubule-associated protein Eg5 (Kif11) siRNA
ccctgttgactttgggaagggtc

SEQ ID NO: 1144 - DNA, 23 bp, Artificial Sequence
  mitotic kinesin microtubule-associated protein Eg5 (Kif11) siRNA
cctgttgactttgggaagggtca

SEQ ID NO: 1145 - DNA, 23 bp, Artificial Sequence
  mitotic kinesin microtubule-associated protein Eg5 (Kif11) siRNA
ctgttgactttgggaagggtcat

SEQ ID NO: 1146 - DNA, 23 bp, Artificial Sequence
  mitotic kinesin microtubule-associated protein Eg5 (Kif11) siRNA
tgttgactttgggaagggtcatt

SEQ ID NO: 1147 - DNA, 23 bp, Artificial Sequence
  mitotic kinesin microtubule-associated protein Eg5 (Kif11) siRNA
gttgactttgggaagggtcatta

SEQ ID NO: 1148 - DNA, 23 bp, Artificial Sequence
  mitotic kinesin microtubule-associated protein Eg5 (Kif11) siRNA
ttgactttgggaagggtcattac

SEQ ID NO: 1149 - DNA, 23 bp, Artificial Sequence
  mitotic kinesin microtubule-associated protein Eg5 (Kif11) siRNA
tgactttgggaagggtcattact

SEQ ID NO: 1150 - DNA, 23 bp, Artificial Sequence
  mitotic kinesin microtubule-associated protein Eg5 (Kif11) siRNA
gactttgggaagggtcattactg

SEQ ID NO: 1151 - DNA, 23 bp, Artificial Sequence
  mitotic kinesin microtubule-associated protein Eg5 (Kif11) siRNA
actttgggaagggtcattactgc

SEQ ID NO: 1152 - DNA, 23 bp, Artificial Sequence
  mitotic kinesin microtubule-associated protein Eg5 (Kif11) siRNA
ctttgggaagggtcattactgcc

SEQ ID NO: 1153 - DNA, 23 bp, Artificial Sequence
  mitotic kinesin microtubule-associated protein Eg5 (Kif11) siRNA
tttgggaagggtcattactgccc

SEQ ID NO: 1154 - DNA, 23 bp, Artificial Sequence
  mitotic kinesin microtubule-associated protein Eg5 (Kif11) siRNA
ttgggaagggtcattactgccct

SEQ ID NO: 1155 - DNA, 23 bp, Artificial Sequence
  mitotic kinesin microtubule-associated protein Eg5 (Kif11) siRNA
tgggaagggtcattactgccctt

SEQ ID NO: 1156 - DNA, 23 bp, Artificial Sequence
  mitotic kinesin microtubule-associated protein Eg5 (Kif11) siRNA
gggaagggtcattactgcccttg

SEQ ID NO: 1157 - DNA, 23 bp, Artificial Sequence
  mitotic kinesin microtubule-associated protein Eg5 (Kif11) siRNA
ggaagggtcattactgcccttgt

SEQ ID NO: 1158 - DNA, 23 bp, Artificial Sequence
  mitotic kinesin microtubule-associated protein Eg5 (Kif11) siRNA
gaagggtcattactgcccttgta

SEQ ID NO: 1159 - DNA, 23 bp, Artificial Sequence
  mitotic kinesin microtubule-associated protein Eg5 (Kif11) siRNA
aagggtcattactgcccttgtag

SEQ ID NO: 1160 - DNA, 23 bp, Artificial Sequence
  mitotic kinesin microtubule-associated protein Eg5 (Kif11) siRNA
agggtcattactgcccttgtaga

SEQ ID NO: 1161 - DNA, 23 bp, Artificial Sequence
  mitotic kinesin microtubule-associated protein Eg5 (Kif11) siRNA
gggtcattactgcccttgtagaa

SEQ ID NO: 1162 - DNA, 23 bp, Artificial Sequence
  mitotic kinesin microtubule-associated protein Eg5 (Kif11) siRNA
ggtcattactgcccttgtagaaa

SEQ ID NO: 1163 - DNA, 23 bp, Artificial Sequence
  mitotic kinesin microtubule-associated protein Eg5 (Kif11) siRNA
gtcattactgcccttgtagaaag

SEQ ID NO: 1164 - DNA, 23 bp, Artificial Sequence
  mitotic kinesin microtubule-associated protein Eg5 (Kif11) siRNA
tcattactgcccttgtagaaaga

SEQ ID NO: 1165 - DNA, 23 bp, Artificial Sequence
  mitotic kinesin microtubule-associated protein Eg5 (Kif11) siRNA
cattactgcccttgtagaaagaa

SEQ ID NO: 1166 - DNA, 23 bp, Artificial Sequence
  mitotic kinesin microtubule-associated protein Eg5 (Kif11) siRNA
attactgcccttgtagaaagaac

SEQ ID NO: 1167 - DNA, 23 bp, Artificial Sequence
  mitotic kinesin microtubule-associated protein Eg5 (Kif11) siRNA
ttactgcccttgtagaaagaaca

SEQ ID NO: 1168 - DNA, 23 bp, Artificial Sequence
  mitotic kinesin microtubule-associated protein Eg5 (Kif11) siRNA
tactgcccttgtagaaagaacac

SEQ ID NO: 1169 - DNA, 23 bp, Artificial Sequence
  mitotic kinesin microtubule-associated protein Eg5 (Kif11) siRNA
actgcccttgtagaaagaacacc

SEQ ID NO: 1170 - DNA, 23 bp, Artificial Sequence
  mitotic kinesin microtubule-associated protein Eg5 (Kif11) siRNA
ctgcccttgtagaaagaacacct

SEQ ID NO: 1171 - DNA, 23 bp, Artificial Sequence
  mitotic kinesin microtubule-associated protein Eg5 (Kif11) siRNA
tgcccttgtagaaagaacacctc

SEQ ID NO: 1172 - DNA, 23 bp, Artificial Sequence
  mitotic kinesin microtubule-associated protein Eg5 (Kif11) siRNA
gcccttgtagaaagaacacctca

SEQ ID NO: 1173 - DNA, 23 bp, Artificial Sequence
  mitotic kinesin microtubule-associated protein Eg5 (Kif11) siRNA
cccttgtagaaagaacacctcat

SEQ ID NO: 1174 - DNA, 23 bp, Artificial Sequence
  mitotic kinesin microtubule-associated protein Eg5 (Kif11) siRNA
ccttgtagaaagaacacctcatg

SEQ ID NO: 1175 - DNA, 23 bp, Artificial Sequence
  mitotic kinesin microtubule-associated protein Eg5 (Kif11) siRNA
cttgtagaaagaacacctcatgt

SEQ ID NO: 1176 - DNA, 23 bp, Artificial Sequence
  mitotic kinesin microtubule-associated protein Eg5 (Kif11) siRNA
ttgtagaaagaacacctcatgtt

SEQ ID NO: 1177 - DNA, 23 bp, Artificial Sequence
  mitotic kinesin microtubule-associated protein Eg5 (Kif11) siRNA
tgtagaaagaacacctcatgttc

SEQ ID NO: 1178 - DNA, 23 bp, Artificial Sequence
  mitotic kinesin microtubule-associated protein Eg5 (Kif11) siRNA
gtagaaagaacacctcatgttcc

SEQ ID NO: 1179 - DNA, 23 bp, Artificial Sequence
  mitotic kinesin microtubule-associated protein Eg5 (Kif11) siRNA
tagaaagaacacctcatgttcct

SEQ ID NO: 1180 - DNA, 23 bp, Artificial Sequence
  mitotic kinesin microtubule-associated protein Eg5 (Kif11) siRNA
agaaagaacacctcatgttcctt

SEQ ID NO: 1181 - DNA, 23 bp, Artificial Sequence
  mitotic kinesin microtubule-associated protein Eg5 (Kif11) siRNA
gaaagaacacctcatgttcctta

SEQ ID NO: 1182 - DNA, 23 bp, Artificial Sequence
  mitotic kinesin microtubule-associated protein Eg5 (Kif11) siRNA
aaagaacacctcatgttccttat

SEQ ID NO: 1183 - DNA, 23 bp, Artificial Sequence
  mitotic kinesin microtubule-associated protein Eg5 (Kif11) siRNA
aagaacacctcatgttccttatc

SEQ ID NO: 1184 - DNA, 23 bp, Artificial Sequence
  mitotic kinesin microtubule-associated protein Eg5 (Kif11) siRNA
agaacacctcatgttccttatcg

SEQ ID NO: 1185 - DNA, 23 bp, Artificial Sequence
  mitotic kinesin microtubule-associated protein Eg5 (Kif11) siRNA
gaacacctcatgttccttatcga

SEQ ID NO: 1186 - DNA, 23 bp, Artificial Sequence
  mitotic kinesin microtubule-associated protein Eg5 (Kif11) siRNA
aacacctcatgttccttatcgag

SEQ ID NO: 1187 - DNA, 23 bp, Artificial Sequence
  mitotic kinesin microtubule-associated protein Eg5 (Kif11) siRNA
acacctcatgttccttatcgaga

SEQ ID NO: 1188 - DNA, 23 bp, Artificial Sequence
  mitotic kinesin microtubule-associated protein Eg5 (Kif11) siRNA
cacctcatgttccttatcgagaa

SEQ ID NO: 1189 - DNA, 23 bp, Artificial Sequence
  mitotic kinesin microtubule-associated protein Eg5 (Kif11) siRNA
acctcatgttccttatcgagaat

SEQ ID NO: 1190 - DNA, 23 bp, Artificial Sequence
  mitotic kinesin microtubule-associated protein Eg5 (Kif11) siRNA
cctcatgttccttatcgagaatc

SEQ ID NO: 1191 - DNA, 23 bp, Artificial Sequence
  mitotic kinesin microtubule-associated protein Eg5 (Kif11) siRNA
ctcatgttccttatcgagaatct

SEQ ID NO: 1192 - DNA, 23 bp, Artificial Sequence
  mitotic kinesin microtubule-associated protein Eg5 (Kif11) siRNA
tcatgttccttatcgagaatcta

SEQ ID NO: 1193 - DNA, 23 bp, Artificial Sequence
  mitotic kinesin microtubule-associated protein Eg5 (Kif11) siRNA
catgttccttatcgagaatctaa

SEQ ID NO: 1194 - DNA, 23 bp, Artificial Sequence
  mitotic kinesin microtubule-associated protein Eg5 (Kif11) siRNA
atgttccttatcgagaatctaaa

SEQ ID NO: 1195 - DNA, 23 bp, Artificial Sequence
  mitotic kinesin microtubule-associated protein Eg5 (Kif11) siRNA
tgttccttatcgagaatctaaac

SEQ ID NO: 1196 - DNA, 23 bp, Artificial Sequence
  mitotic kinesin microtubule-associated protein Eg5 (Kif11) siRNA
gttccttatcgagaatctaaact

SEQ ID NO: 1197 - DNA, 23 bp, Artificial Sequence
  mitotic kinesin microtubule-associated protein Eg5 (Kif11) siRNA
ttccttatcgagaatctaaacta

SEQ ID NO: 1198 - DNA, 23 bp, Artificial Sequence
  mitotic kinesin microtubule-associated protein Eg5 (Kif11) siRNA
tccttatcgagaatctaaactaa

SEQ ID NO: 1199 - DNA, 23 bp, Artificial Sequence
  mitotic kinesin microtubule-associated protein Eg5 (Kif11) siRNA
ccttatcgagaatctaaactaac

SEQ ID NO: 1200 - DNA, 23 bp, Artificial Sequence
  mitotic kinesin microtubule-associated protein Eg5 (Kif11) siRNA
cttatcgagaatctaaactaact

SEQ ID NO: 1201 - DNA, 23 bp, Artificial Sequence
  mitotic kinesin microtubule-associated protein Eg5 (Kif11) siRNA
ttatcgagaatctaaactaacta

SEQ ID NO: 1202 - DNA, 23 bp, Artificial Sequence
  mitotic kinesin microtubule-associated protein Eg5 (Kif11) siRNA
tatcgagaatctaaactaactag

SEQ ID NO: 1203 - DNA, 23 bp, Artificial Sequence
  mitotic kinesin microtubule-associated protein Eg5 (Kif11) siRNA
atcgagaatctaaactaactaga

SEQ ID NO: 1204 - DNA, 23 bp, Artificial Sequence
  mitotic kinesin microtubule-associated protein Eg5 (Kif11) siRNA
tcgagaatctaaactaactagaa

SEQ ID NO: 1205 - DNA, 23 bp, Artificial Sequence
  mitotic kinesin microtubule-associated protein Eg5 (Kif11) siRNA
cgagaatctaaactaactagaat

SEQ ID NO: 1206 - DNA, 23 bp, Artificial Sequence
  mitotic kinesin microtubule-associated protein Eg5 (Kif11) siRNA
gagaatctaaactaactagaatc

SEQ ID NO: 1207 - DNA, 23 bp, Artificial Sequence
  mitotic kinesin microtubule-associated protein Eg5 (Kif11) siRNA
agaatctaaactaactagaatcc

SEQ ID NO: 1208 - DNA, 23 bp, Artificial Sequence
  mitotic kinesin microtubule-associated protein Eg5 (Kif11) siRNA
gaatctaaactaactagaatcct

SEQ ID NO: 1209 - DNA, 23 bp, Artificial Sequence
  mitotic kinesin microtubule-associated protein Eg5 (Kif11) siRNA
aatctaaactaactagaatcctc

SEQ ID NO: 1210 - DNA, 23 bp, Artificial Sequence
  mitotic kinesin microtubule-associated protein Eg5 (Kif11) siRNA
atctaaactaactagaatcctcc

SEQ ID NO: 1211 - DNA, 23 bp, Artificial Sequence
  mitotic kinesin microtubule-associated protein Eg5 (Kif11) siRNA
tctaaactaactagaatcctcca

SEQ ID NO: 1212 - DNA, 23 bp, Artificial Sequence
  mitotic kinesin microtubule-associated protein Eg5 (Kif11) siRNA
ctaaactaactagaatcctccag

SEQ ID NO: 1213 - DNA, 23 bp, Artificial Sequence
  mitotic kinesin microtubule-associated protein Eg5 (Kif11) siRNA
taaactaactagaatcctccagg

SEQ ID NO: 1214 - DNA, 23 bp, Artificial Sequence
  mitotic kinesin microtubule-associated protein Eg5 (Kif11) siRNA
aaactaactagaatcctccagga

SEQ ID NO: 1215 - DNA, 23 bp, Artificial Sequence
  mitotic kinesin microtubule-associated protein Eg5 (Kif11) siRNA
aactaactagaatcctccaggat

SEQ ID NO: 1216 - DNA, 23 bp, Artificial Sequence
  mitotic kinesin microtubule-associated protein Eg5 (Kif11) siRNA
actaactagaatcctccaggatt

SEQ ID NO: 1217 - DNA, 23 bp, Artificial Sequence
  mitotic kinesin microtubule-associated protein Eg5 (Kif11) siRNA
ctaactagaatcctccaggattc

SEQ ID NO: 1218 - DNA, 23 bp, Artificial Sequence
  mitotic kinesin microtubule-associated protein Eg5 (Kif11) siRNA
taactagaatcctccaggattct

SEQ ID NO: 1219 - DNA, 23 bp, Artificial Sequence
  mitotic kinesin microtubule-associated protein Eg5 (Kif11) siRNA
aactagaatcctccaggattctc

SEQ ID NO: 1220 - DNA, 23 bp, Artificial Sequence
  mitotic kinesin microtubule-associated protein Eg5 (Kif11) siRNA
actagaatcctccaggattctct

SEQ ID NO: 1221 - DNA, 23 bp, Artificial Sequence
  mitotic kinesin microtubule-associated protein Eg5 (Kif11) siRNA
ctagaatcctccaggattctctt

SEQ ID NO: 1222 - DNA, 23 bp, Artificial Sequence
  mitotic kinesin microtubule-associated protein Eg5 (Kif11) siRNA
tagaatcctccaggattctcttg

SEQ ID NO: 1223 - DNA, 23 bp, Artificial Sequence
  mitotic kinesin microtubule-associated protein Eg5 (Kif11) siRNA
agaatcctccaggattctcttgg

SEQ ID NO: 1224 - DNA, 23 bp, Artificial Sequence
  mitotic kinesin microtubule-associated protein Eg5 (Kif11) siRNA
gaatcctccaggattctcttgga

SEQ ID NO: 1225 - DNA, 23 bp, Artificial Sequence
  mitotic kinesin microtubule-associated protein Eg5 (Kif11) siRNA
aatcctccaggattctcttggag

SEQ ID NO: 1226 - DNA, 23 bp, Artificial Sequence
  mitotic kinesin microtubule-associated protein Eg5 (Kif11) siRNA
atcctccaggattctcttggagg

SEQ ID NO: 1227 - DNA, 23 bp, Artificial Sequence
  mitotic kinesin microtubule-associated protein Eg5 (Kif11) siRNA
tcctccaggattctcttggaggg

SEQ ID NO: 1228 - DNA, 23 bp, Artificial Sequence
  mitotic kinesin microtubule-associated protein Eg5 (Kif11) siRNA
cctccaggattctcttggagggc

SEQ ID NO: 1229 - DNA, 23 bp, Artificial Sequence
  mitotic kinesin microtubule-associated protein Eg5 (Kif11) siRNA
ctccaggattctcttggagggcg

SEQ ID NO: 1230 - DNA, 23 bp, Artificial Sequence
  mitotic kinesin microtubule-associated protein Eg5 (Kif11) siRNA
tccaggattctcttggagggcgt

SEQ ID NO: 1231 - DNA, 23 bp, Artificial Sequence
  mitotic kinesin microtubule-associated protein Eg5 (Kif11) siRNA
ccaggattctcttggagggcgta

SEQ ID NO: 1232 - DNA, 23 bp, Artificial Sequence
  mitotic kinesin microtubule-associated protein Eg5 (Kif11) siRNA
caggattctcttggagggcgtac

SEQ ID NO: 1233 - DNA, 23 bp, Artificial Sequence
  mitotic kinesin microtubule-associated protein Eg5 (Kif11) siRNA
aggattctcttggagggcgtaca

SEQ ID NO: 1234 - DNA, 23 bp, Artificial Sequence
  mitotic kinesin microtubule-associated protein Eg5 (Kif11) siRNA
ggattctcttggagggcgtacaa

SEQ ID NO: 1235 - DNA, 23 bp, Artificial Sequence
  mitotic kinesin microtubule-associated protein Eg5 (Kif11) siRNA
gattctcttggagggcgtacaag

SEQ ID NO: 1236 - DNA, 23 bp, Artificial Sequence
  mitotic kinesin microtubule-associated protein Eg5 (Kif11) siRNA
attctcttggagggcgtacaaga

SEQ ID NO: 1237 - DNA, 23 bp, Artificial Sequence
  mitotic kinesin microtubule-associated protein Eg5 (Kif11) siRNA
ttctcttggagggcgtacaagaa

SEQ ID NO: 1238 - DNA, 23 bp, Artificial Sequence
  mitotic kinesin microtubule-associated protein Eg5 (Kif11) siRNA
tctcttggagggcgtacaagaac

SEQ ID NO: 1239 - DNA, 23 bp, Artificial Sequence
  mitotic kinesin microtubule-associated protein Eg5 (Kif11) siRNA
ctcttggagggcgtacaagaaca

SEQ ID NO: 1240 - DNA, 23 bp, Artificial Sequence
  mitotic kinesin microtubule-associated protein Eg5 (Kif11) siRNA
tcttggagggcgtacaagaacat

SEQ ID NO: 1241 - DNA, 23 bp, Artificial Sequence
  mitotic kinesin microtubule-associated protein Eg5 (Kif11) siRNA
cttggagggcgtacaagaacatc

SEQ ID NO: 1242 - DNA, 23 bp, Artificial Sequence
  mitotic kinesin microtubule-associated protein Eg5 (Kif11) siRNA
ttggagggcgtacaagaacatct

SEQ ID NO: 1243 - DNA, 23 bp, Artificial Sequence
  mitotic kinesin microtubule-associated protein Eg5 (Kif11) siRNA
tggagggcgtacaagaacatcta

SEQ ID NO: 1244 - DNA, 23 bp, Artificial Sequence
  mitotic kinesin microtubule-associated protein Eg5 (Kif11) siRNA
ggagggcgtacaagaacatctat

SEQ ID NO: 1245 - DNA, 23 bp, Artificial Sequence
  mitotic kinesin microtubule-associated protein Eg5 (Kif11) siRNA
gagggcgtacaagaacatctata

SEQ ID NO: 1246 - DNA, 23 bp, Artificial Sequence
  mitotic kinesin microtubule-associated protein Eg5 (Kif11) siRNA
agggcgtacaagaacatctataa

SEQ ID NO: 1247 - DNA, 23 bp, Artificial Sequence
  mitotic kinesin microtubule-associated protein Eg5 (Kif11) siRNA
gggcgtacaagaacatctataat

SEQ ID NO: 1248 - DNA, 23 bp, Artificial Sequence
  mitotic kinesin microtubule-associated protein Eg5 (Kif11) siRNA
ggcgtacaagaacatctataatt

SEQ ID NO: 1249 - DNA, 23 bp, Artificial Sequence
  mitotic kinesin microtubule-associated protein Eg5 (Kif11) siRNA
gcgtacaagaacatctataattg

SEQ ID NO: 1250 - DNA, 23 bp, Artificial Sequence
  mitotic kinesin microtubule-associated protein Eg5 (Kif11) siRNA
cgtacaagaacatctataattgc

SEQ ID NO: 1251 - DNA, 23 bp, Artificial Sequence
  mitotic kinesin microtubule-associated protein Eg5 (Kif11) siRNA
gtacaagaacatctataattgca

SEQ ID NO: 1252 - DNA, 23 bp, Artificial Sequence
  mitotic kinesin microtubule-associated protein Eg5 (Kif11) siRNA
tacaagaacatctataattgcaa

SEQ ID NO: 1253 - DNA, 23 bp, Artificial Sequence
  mitotic kinesin microtubule-associated protein Eg5 (Kif11) siRNA
acaagaacatctataattgcaac

SEQ ID NO: 1254 - DNA, 23 bp, Artificial Sequence
  mitotic kinesin microtubule-associated protein Eg5 (Kif11) siRNA
caagaacatctataattgcaaca

SEQ ID NO: 1255 - DNA, 23 bp, Artificial Sequence
  mitotic kinesin microtubule-associated protein Eg5 (Kif11) siRNA
aagaacatctataattgcaacaa

SEQ ID NO: 1256 - DNA, 23 bp, Artificial Sequence
  mitotic kinesin microtubule-associated protein Eg5 (Kif11) siRNA
agaacatctataattgcaacaat

SEQ ID NO: 1257 - DNA, 23 bp, Artificial Sequence
  mitotic kinesin microtubule-associated protein Eg5 (Kif11) siRNA
gaacatctataattgcaacaatt

SEQ ID NO: 1258 - DNA, 23 bp, Artificial Sequence
  mitotic kinesin microtubule-associated protein Eg5 (Kif11) siRNA
aacatctataattgcaacaattt

SEQ ID NO: 1259 - DNA, 23 bp, Artificial Sequence
  mitotic kinesin microtubule-associated protein Eg5 (Kif11) siRNA
acatctataattgcaacaatttc

SEQ ID NO: 1260 - DNA, 23 bp, Artificial Sequence
  mitotic kinesin microtubule-associated protein Eg5 (Kif11) siRNA
catctataattgcaacaatttct

SEQ ID NO: 1261 - DNA, 23 bp, Artificial Sequence
  mitotic kinesin microtubule-associated protein Eg5 (Kif11) siRNA
atctataattgcaacaatttctc

SEQ ID NO: 1262 - DNA, 23 bp, Artificial Sequence
  mitotic kinesin microtubule-associated protein Eg5 (Kif11) siRNA
tctataattgcaacaatttctcc

SEQ ID NO: 1263 - DNA, 23 bp, Artificial Sequence
  mitotic kinesin microtubule-associated protein Eg5 (Kif11) siRNA
ctataattgcaacaatttctcct

SEQ ID NO: 1264 - DNA, 23 bp, Artificial Sequence
  mitotic kinesin microtubule-associated protein Eg5 (Kif11) siRNA
tataattgcaacaatttctcctg

SEQ ID NO: 1265 - DNA, 23 bp, Artificial Sequence
  mitotic kinesin microtubule-associated protein Eg5 (Kif11) siRNA
ataattgcaacaatttctcctgc

SEQ ID NO: 1266 - DNA, 23 bp, Artificial Sequence
  mitotic kinesin microtubule-associated protein Eg5 (Kif11) siRNA
taattgcaacaatttctcctgca

SEQ ID NO: 1267 - DNA, 23 bp, Artificial Sequence
  mitotic kinesin microtubule-associated protein Eg5 (Kif11) siRNA
aattgcaacaatttctcctgcat

SEQ ID NO: 1268 - DNA, 23 bp, Artificial Sequence
  mitotic kinesin microtubule-associated protein Eg5 (Kif11) siRNA
attgcaacaatttctcctgcatc

SEQ ID NO: 1269 - DNA, 23 bp, Artificial Sequence
  mitotic kinesin microtubule-associated protein Eg5 (Kif11) siRNA
ttgcaacaatttctcctgcatct

SEQ ID NO: 1270 - DNA, 23 bp, Artificial Sequence
  mitotic kinesin microtubule-associated protein Eg5 (Kif11) siRNA
tgcaacaatttctcctgcatctc

SEQ ID NO: 1271 - DNA, 23 bp, Artificial Sequence
  mitotic kinesin microtubule-associated protein Eg5 (Kif11) siRNA
gcaacaatttctcctgcatctct

SEQ ID NO: 1272 - DNA, 23 bp, Artificial Sequence
  mitotic kinesin microtubule-associated protein Eg5 (Kif11) siRNA
caacaatttctcctgcatctctc

SEQ ID NO: 1273 - DNA, 23 bp, Artificial Sequence
  mitotic kinesin microtubule-associated protein Eg5 (Kif11) siRNA
aacaatttctcctgcatctctca

SEQ ID NO: 1274 - DNA, 23 bp, Artificial Sequence
  mitotic kinesin microtubule-associated protein Eg5 (Kif11) siRNA
acaatttctcctgcatctctcaa

SEQ ID NO: 1275 - DNA, 23 bp, Artificial Sequence
  mitotic kinesin microtubule-associated protein Eg5 (Kif11) siRNA
caatttctcctgcatctctcaat

SEQ ID NO: 1276 - DNA, 23 bp, Artificial Sequence
  mitotic kinesin microtubule-associated protein Eg5 (Kif11) siRNA
aatttctcctgcatctctcaatc

SEQ ID NO: 1277 - DNA, 23 bp, Artificial Sequence
  mitotic kinesin microtubule-associated protein Eg5 (Kif11) siRNA
atttctcctgcatctctcaatct

SEQ ID NO: 1278 - DNA, 23 bp, Artificial Sequence
  mitotic kinesin microtubule-associated protein Eg5 (Kif11) siRNA
tttctcctgcatctctcaatctt

SEQ ID NO: 1279 - DNA, 23 bp, Artificial Sequence
  mitotic kinesin microtubule-associated protein Eg5 (Kif11) siRNA
ttctcctgcatctctcaatcttg

SEQ ID NO: 1280 - DNA, 23 bp, Artificial Sequence
  mitotic kinesin microtubule-associated protein Eg5 (Kif11) siRNA
tctcctgcatctctcaatcttga

SEQ ID NO: 1281 - DNA, 23 bp, Artificial Sequence
  mitotic kinesin microtubule-associated protein Eg5 (Kif11) siRNA
ctcctgcatctctcaatcttgag

SEQ ID NO: 1282 - DNA, 23 bp, Artificial Sequence
  mitotic kinesin microtubule-associated protein Eg5 (Kif11) siRNA
tcctgcatctctcaatcttgagg

SEQ ID NO: 1283 - DNA, 23 bp, Artificial Sequence
  mitotic kinesin microtubule-associated protein Eg5 (Kif11) siRNA
cctgcatctctcaatcttgagga

SEQ ID NO: 1284 - DNA, 23 bp, Artificial Sequence
  mitotic kinesin microtubule-associated protein Eg5 (Kif11) siRNA
ctgcatctctcaatcttgaggaa

SEQ ID NO: 1285 - DNA, 23 bp, Artificial Sequence
  mitotic kinesin microtubule-associated protein Eg5 (Kif11) siRNA
tgcatctctcaatcttgaggaaa

SEQ ID NO: 1286 - DNA, 23 bp, Artificial Sequence
  mitotic kinesin microtubule-associated protein Eg5 (Kif11) siRNA
gcatctctcaatcttgaggaaac

SEQ ID NO: 1287 - DNA, 23 bp, Artificial Sequence
  mitotic kinesin microtubule-associated protein Eg5 (Kif11) siRNA
catctctcaatcttgaggaaact

SEQ ID NO: 1288 - DNA, 23 bp, Artificial Sequence
  mitotic kinesin microtubule-associated protein Eg5 (Kif11) siRNA
atctctcaatcttgaggaaactc

SEQ ID NO: 1289 - DNA, 23 bp, Artificial Sequence
  mitotic kinesin microtubule-associated protein Eg5 (Kif11) siRNA
tctctcaatcttgaggaaactct

SEQ ID NO: 1290 - DNA, 23 bp, Artificial Sequence
  mitotic kinesin microtubule-associated protein Eg5 (Kif11) siRNA
ctctcaatcttgaggaaactctg

SEQ ID NO: 1291 - DNA, 23 bp, Artificial Sequence
  mitotic kinesin microtubule-associated protein Eg5 (Kif11) siRNA
tctcaatcttgaggaaactctga

SEQ ID NO: 1292 - DNA, 23 bp, Artificial Sequence
  mitotic kinesin microtubule-associated protein Eg5 (Kif11) siRNA
ctcaatcttgaggaaactctgag

SEQ ID NO: 1293 - DNA, 23 bp, Artificial Sequence
  mitotic kinesin microtubule-associated protein Eg5 (Kif11) siRNA
tcaatcttgaggaaactctgagt

SEQ ID NO: 1294 - DNA, 23 bp, Artificial Sequence
  mitotic kinesin microtubule-associated protein Eg5 (Kif11) siRNA
caatcttgaggaaactctgagta

SEQ ID NO: 1295 - DNA, 23 bp, Artificial Sequence
  mitotic kinesin microtubule-associated protein Eg5 (Kif11) siRNA
aatcttgaggaaactctgagtac

SEQ ID NO: 1296 - DNA, 23 bp, Artificial Sequence
  mitotic kinesin microtubule-associated protein Eg5 (Kif11) siRNA
atcttgaggaaactctgagtaca

SEQ ID NO: 1297 - DNA, 23 bp, Artificial Sequence
  mitotic kinesin microtubule-associated protein Eg5 (Kif11) siRNA
tcttgaggaaactctgagtacat

SEQ ID NO: 1298 - DNA, 23 bp, Artificial Sequence
  mitotic kinesin microtubule-associated protein Eg5 (Kif11) siRNA
cttgaggaaactctgagtacatt

SEQ ID NO: 1299 - DNA, 23 bp, Artificial Sequence
  mitotic kinesin microtubule-associated protein Eg5 (Kif11) siRNA
ttgaggaaactctgagtacattg

SEQ ID NO: 1300 - DNA, 23 bp, Artificial Sequence
  mitotic kinesin microtubule-associated protein Eg5 (Kif11) siRNA
tgaggaaactctgagtacattgg

SEQ ID NO: 1301 - DNA, 23 bp, Artificial Sequence
  mitotic kinesin microtubule-associated protein Eg5 (Kif11) siRNA
gaggaaactctgagtacattgga

SEQ ID NO: 1302 - DNA, 23 bp, Artificial Sequence
  mitotic kinesin microtubule-associated protein Eg5 (Kif11) siRNA
aggaaactctgagtacattggaa

SEQ ID NO: 1303 - DNA, 23 bp, Artificial Sequence
  mitotic kinesin microtubule-associated protein Eg5 (Kif11) siRNA
ggaaactctgagtacattggaat

SEQ ID NO: 1304 - DNA, 23 bp, Artificial Sequence
  mitotic kinesin microtubule-associated protein Eg5 (Kif11) siRNA
gaaactctgagtacattggaata

SEQ ID NO: 1305 - DNA, 23 bp, Artificial Sequence
  mitotic kinesin microtubule-associated protein Eg5 (Kif11) siRNA
aaactctgagtacattggaatat

SEQ ID NO: 1306 - DNA, 23 bp, Artificial Sequence
  mitotic kinesin microtubule-associated protein Eg5 (Kif11) siRNA
aactctgagtacattggaatatg

SEQ ID NO: 1307 - DNA, 23 bp, Artificial Sequence
  mitotic kinesin microtubule-associated protein Eg5 (Kif11) siRNA
actctgagtacattggaatatgc

SEQ ID NO: 1308 - DNA, 23 bp, Artificial Sequence
  mitotic kinesin microtubule-associated protein Eg5 (Kif11) siRNA
ctctgagtacattggaatatgct

SEQ ID NO: 1309 - DNA, 23 bp, Artificial Sequence
  mitotic kinesin microtubule-associated protein Eg5 (Kif11) siRNA
tctgagtacattggaatatgctc

SEQ ID NO: 1310 - DNA, 23 bp, Artificial Sequence
  mitotic kinesin microtubule-associated protein Eg5 (Kif11) siRNA
ctgagtacattggaatatgctca

SEQ ID NO: 1311 - DNA, 23 bp, Artificial Sequence
  mitotic kinesin microtubule-associated protein Eg5 (Kif11) siRNA
tgagtacattggaatatgctcat

SEQ ID NO: 1312 - DNA, 23 bp, Artificial Sequence
  mitotic kinesin microtubule-associated protein Eg5 (Kif11) siRNA
gagtacattggaatatgctcata

SEQ ID NO: 1313 - DNA, 23 bp, Artificial Sequence
  mitotic kinesin microtubule-associated protein Eg5 (Kif11) siRNA
agtacattggaatatgctcatag

SEQ ID NO: 1314 - DNA, 23 bp, Artificial Sequence
  mitotic kinesin microtubule-associated protein Eg5 (Kif11) siRNA
gtacattggaatatgctcataga

SEQ ID NO: 1315 - DNA, 23 bp, Artificial Sequence
  mitotic kinesin microtubule-associated protein Eg5 (Kif11) siRNA
tacattggaatatgctcatagag

SEQ ID NO: 1316 - DNA, 23 bp, Artificial Sequence
  mitotic kinesin microtubule-associated protein Eg5 (Kif11) siRNA
acattggaatatgctcatagagc

SEQ ID NO: 1317 - DNA, 23 bp, Artificial Sequence
  mitotic kinesin microtubule-associated protein Eg5 (Kif11) siRNA
cattggaatatgctcatagagca

SEQ ID NO: 1318 - DNA, 23 bp, Artificial Sequence
  mitotic kinesin microtubule-associated protein Eg5 (Kif11) siRNA
attggaatatgctcatagagcaa

SEQ ID NO: 1319 - DNA, 23 bp, Artificial Sequence
  mitotic kinesin microtubule-associated protein Eg5 (Kif11) siRNA
ttggaatatgctcatagagcaaa

SEQ ID NO: 1320 - DNA, 23 bp, Artificial Sequence
  mitotic kinesin microtubule-associated protein Eg5 (Kif11) siRNA
tggaatatgctcatagagcaaag

SEQ ID NO: 1321 - DNA, 23 bp, Artificial Sequence
  mitotic kinesin microtubule-associated protein Eg5 (Kif11) siRNA
ggaatatgctcatagagcaaaga

SEQ ID NO: 1322 - DNA, 23 bp, Artificial Sequence
  mitotic kinesin microtubule-associated protein Eg5 (Kif11) siRNA
gaatatgctcatagagcaaagaa

SEQ ID NO: 1323 - DNA, 23 bp, Artificial Sequence
  mitotic kinesin microtubule-associated protein Eg5 (Kif11) siRNA
aatatgctcatagagcaaagaac

SEQ ID NO: 1324 - DNA, 23 bp, Artificial Sequence
  mitotic kinesin microtubule-associated protein Eg5 (Kif11) siRNA
atatgctcatagagcaaagaaca

SEQ ID NO: 1325 - DNA, 23 bp, Artificial Sequence
  mitotic kinesin microtubule-associated protein Eg5 (Kif11) siRNA
tatgctcatagagcaaagaacat

SEQ ID NO: 1326 - DNA, 23 bp, Artificial Sequence
  mitotic kinesin microtubule-associated protein Eg5 (Kif11) siRNA
atgctcatagagcaaagaacata

SEQ ID NO: 1327 - DNA, 23 bp, Artificial Sequence
  mitotic kinesin microtubule-associated protein Eg5 (Kif11) siRNA
tgctcatagagcaaagaacatat

SEQ ID NO: 1328 - DNA, 23 bp, Artificial Sequence
  mitotic kinesin microtubule-associated protein Eg5 (Kif11) siRNA
gctcatagagcaaagaacatatt

SEQ ID NO: 1329 - DNA, 23 bp, Artificial Sequence
  mitotic kinesin microtubule-associated protein Eg5 (Kif11) siRNA
ctcatagagcaaagaacatattg

SEQ ID NO: 1330 - DNA, 23 bp, Artificial Sequence
  mitotic kinesin microtubule-associated protein Eg5 (Kif11) siRNA
tcatagagcaaagaacatattga

SEQ ID NO: 1331 - DNA, 23 bp, Artificial Sequence
  mitotic kinesin microtubule-associated protein Eg5 (Kif11) siRNA
catagagcaaagaacatattgaa

SEQ ID NO: 1332 - DNA, 23 bp, Artificial Sequence
  mitotic kinesin microtubule-associated protein Eg5 (Kif11) siRNA
atagagcaaagaacatattgaat

SEQ ID NO: 1333 - DNA, 23 bp, Artificial Sequence
  mitotic kinesin microtubule-associated protein Eg5 (Kif11) siRNA
tagagcaaagaacatattgaata

SEQ ID NO: 1334 - DNA, 23 bp, Artificial Sequence
  mitotic kinesin microtubule-associated protein Eg5 (Kif11) siRNA
agagcaaagaacatattgaataa

SEQ ID NO: 1335 - DNA, 23 bp, Artificial Sequence
  mitotic kinesin microtubule-associated protein Eg5 (Kif11) siRNA
gagcaaagaacatattgaataag

SEQ ID NO: 1336 - DNA, 23 bp, Artificial Sequence
  mitotic kinesin microtubule-associated protein Eg5 (Kif11) siRNA
agcaaagaacatattgaataagc

SEQ ID NO: 1337 - DNA, 23 bp, Artificial Sequence
  mitotic kinesin microtubule-associated protein Eg5 (Kif11) siRNA
gcaaagaacatattgaataagcc

SEQ ID NO: 1338 - DNA, 23 bp, Artificial Sequence
  mitotic kinesin microtubule-associated protein Eg5 (Kif11) siRNA
caaagaacatattgaataagcct

SEQ ID NO: 1339 - DNA, 23 bp, Artificial Sequence
  mitotic kinesin microtubule-associated protein Eg5 (Kif11) siRNA
aaagaacatattgaataagcctg

SEQ ID NO: 1340 - DNA, 23 bp, Artificial Sequence
  mitotic kinesin microtubule-associated protein Eg5 (Kif11) siRNA
aagaacatattgaataagcctga

SEQ ID NO: 1341 - DNA, 23 bp, Artificial Sequence
  mitotic kinesin microtubule-associated protein Eg5 (Kif11) siRNA
agaacatattgaataagcctgaa

SEQ ID NO: 1342 - DNA, 23 bp, Artificial Sequence
  mitotic kinesin microtubule-associated protein Eg5 (Kif11) siRNA
gaacatattgaataagcctgaag

SEQ ID NO: 1343 - DNA, 23 bp, Artificial Sequence
  mitotic kinesin microtubule-associated protein Eg5 (Kif11) siRNA
aacatattgaataagcctgaagt

SEQ ID NO: 1344 - DNA, 23 bp, Artificial Sequence
  mitotic kinesin microtubule-associated protein Eg5 (Kif11) siRNA
acatattgaataagcctgaagtg

SEQ ID NO: 1345 - DNA, 23 bp, Artificial Sequence
  mitotic kinesin microtubule-associated protein Eg5 (Kif11) siRNA
catattgaataagcctgaagtga

SEQ ID NO: 1346 - DNA, 23 bp, Artificial Sequence
  mitotic kinesin microtubule-associated protein Eg5 (Kif11) siRNA
atattgaataagcctgaagtgaa

SEQ ID NO: 1347 - DNA, 23 bp, Artificial Sequence
  mitotic kinesin microtubule-associated protein Eg5 (Kif11) siRNA
tattgaataagcctgaagtgaat

SEQ ID NO: 1348 - DNA, 23 bp, Artificial Sequence
  mitotic kinesin microtubule-associated protein Eg5 (Kif11) siRNA
attgaataagcctgaagtgaatc

SEQ ID NO: 1349 - DNA, 23 bp, Artificial Sequence
  mitotic kinesin microtubule-associated protein Eg5 (Kif11) siRNA
ttgaataagcctgaagtgaatca

SEQ ID NO: 1350 - DNA, 23 bp, Artificial Sequence
  mitotic kinesin microtubule-associated protein Eg5 (Kif11) siRNA
tgaataagcctgaagtgaatcag

SEQ ID NO: 1351 - DNA, 23 bp, Artificial Sequence
  mitotic kinesin microtubule-associated protein Eg5 (Kif11) siRNA
gaataagcctgaagtgaatcaga

SEQ ID NO: 1352 - DNA, 23 bp, Artificial Sequence
  mitotic kinesin microtubule-associated protein Eg5 (Kif11) siRNA
aataagcctgaagtgaatcagaa

SEQ ID NO: 1353 - DNA, 23 bp, Artificial Sequence
  mitotic kinesin microtubule-associated protein Eg5 (Kif11) siRNA
ataagcctgaagtgaatcagaaa

SEQ ID NO: 1354 - DNA, 23 bp, Artificial Sequence
  mitotic kinesin microtubule-associated protein Eg5 (Kif11) siRNA
taagcctgaagtgaatcagaaac

SEQ ID NO: 1355 - DNA, 23 bp, Artificial Sequence
  mitotic kinesin microtubule-associated protein Eg5 (Kif11) siRNA
aagcctgaagtgaatcagaaact

SEQ ID NO: 1356 - DNA, 23 bp, Artificial Sequence
  mitotic kinesin microtubule-associated protein Eg5 (Kif11) siRNA
agcctgaagtgaatcagaaactc

SEQ ID NO: 1357 - DNA, 23 bp, Artificial Sequence
  mitotic kinesin microtubule-associated protein Eg5 (Kif11) siRNA
gcctgaagtgaatcagaaactca

SEQ ID NO: 1358 - DNA, 23 bp, Artificial Sequence
  mitotic kinesin microtubule-associated protein Eg5 (Kif11) siRNA
cctgaagtgaatcagaaactcac

SEQ ID NO: 1359 - DNA, 23 bp, Artificial Sequence
  mitotic kinesin microtubule-associated protein Eg5 (Kif11) siRNA
ctgaagtgaatcagaaactcacc

SEQ ID NO: 1360 - DNA, 23 bp, Artificial Sequence
  mitotic kinesin microtubule-associated protein Eg5 (Kif11) siRNA
tgaagtgaatcagaaactcacca

SEQ ID NO: 1361 - DNA, 23 bp, Artificial Sequence
  mitotic kinesin microtubule-associated protein Eg5 (Kif11) siRNA
gaagtgaatcagaaactcaccaa

SEQ ID NO: 1362 - DNA, 23 bp, Artificial Sequence
  mitotic kinesin microtubule-associated protein Eg5 (Kif11) siRNA
aagtgaatcagaaactcaccaaa

SEQ ID NO: 1363 - DNA, 23 bp, Artificial Sequence
  mitotic kinesin microtubule-associated protein Eg5 (Kif11) siRNA
agtgaatcagaaactcaccaaaa

SEQ ID NO: 1364 - DNA, 23 bp, Artificial Sequence
  mitotic kinesin microtubule-associated protein Eg5 (Kif11) siRNA
gtgaatcagaaactcaccaaaaa

SEQ ID NO: 1365 - DNA, 23 bp, Artificial Sequence
  mitotic kinesin microtubule-associated protein Eg5 (Kif11) siRNA
tgaatcagaaactcaccaaaaaa

SEQ ID NO: 1366 - DNA, 23 bp, Artificial Sequence
  mitotic kinesin microtubule-associated protein Eg5 (Kif11) siRNA
gaatcagaaactcaccaaaaaag

SEQ ID NO: 1367 - DNA, 23 bp, Artificial Sequence
  mitotic kinesin microtubule-associated protein Eg5 (Kif11) siRNA
aatcagaaactcaccaaaaaagc

SEQ ID NO: 1368 - DNA, 23 bp, Artificial Sequence
  mitotic kinesin microtubule-associated protein Eg5 (Kif11) siRNA
atcagaaactcaccaaaaaagct

SEQ ID NO: 1369 - DNA, 23 bp, Artificial Sequence
  mitotic kinesin microtubule-associated protein Eg5 (Kif11) siRNA
tcagaaactcaccaaaaaagctc

SEQ ID NO: 1370 - DNA, 23 bp, Artificial Sequence
  mitotic kinesin microtubule-associated protein Eg5 (Kif11) siRNA
cagaaactcaccaaaaaagctct

SEQ ID NO: 1371 - DNA, 23 bp, Artificial Sequence
  mitotic kinesin microtubule-associated protein Eg5 (Kif11) siRNA
agaaactcaccaaaaaagctctt

SEQ ID NO: 1372 - DNA, 23 bp, Artificial Sequence
  mitotic kinesin microtubule-associated protein Eg5 (Kif11) siRNA
gaaactcaccaaaaaagctctta

SEQ ID NO: 1373 - DNA, 23 bp, Artificial Sequence
  mitotic kinesin microtubule-associated protein Eg5 (Kif11) siRNA
aaactcaccaaaaaagctcttat

SEQ ID NO: 1374 - DNA, 23 bp, Artificial Sequence
  mitotic kinesin microtubule-associated protein Eg5 (Kif11) siRNA
aactcaccaaaaaagctcttatt

SEQ ID NO: 1375 - DNA, 23 bp, Artificial Sequence
  mitotic kinesin microtubule-associated protein Eg5 (Kif11) siRNA
actcaccaaaaaagctcttatta

SEQ ID NO: 1376 - DNA, 23 bp, Artificial Sequence
  mitotic kinesin microtubule-associated protein Eg5 (Kif11) siRNA
ctcaccaaaaaagctcttattaa

SEQ ID NO: 1377 - DNA, 23 bp, Artificial Sequence
  mitotic kinesin microtubule-associated protein Eg5 (Kif11) siRNA
tcaccaaaaaagctcttattaag

SEQ ID NO: 1378 - DNA, 23 bp, Artificial Sequence
  mitotic kinesin microtubule-associated protein Eg5 (Kif11) siRNA
caccaaaaaagctcttattaagg

SEQ ID NO: 1379 - DNA, 23 bp, Artificial Sequence
  mitotic kinesin microtubule-associated protein Eg5 (Kif11) siRNA
accaaaaaagctcttattaagga

SEQ ID NO: 1380 - DNA, 23 bp, Artificial Sequence
  mitotic kinesin microtubule-associated protein Eg5 (Kif11) siRNA
ccaaaaaagctcttattaaggag

SEQ ID NO: 1381 - DNA, 23 bp, Artificial Sequence
  mitotic kinesin microtubule-associated protein Eg5 (Kif11) siRNA
caaaaaagctcttattaaggagt

SEQ ID NO: 1382 - DNA, 23 bp, Artificial Sequence
  mitotic kinesin microtubule-associated protein Eg5 (Kif11) siRNA
aaaaaagctcttattaaggagta

SEQ ID NO: 1383 - DNA, 23 bp, Artificial Sequence
  mitotic kinesin microtubule-associated protein Eg5 (Kif11) siRNA
aaaaagctcttattaaggagtat

SEQ ID NO: 1384 - DNA, 23 bp, Artificial Sequence
  mitotic kinesin microtubule-associated protein Eg5 (Kif11) siRNA
aaaagctcttattaaggagtata

SEQ ID NO: 1385 - DNA, 23 bp, Artificial Sequence
  mitotic kinesin microtubule-associated protein Eg5 (Kif11) siRNA
aaagctcttattaaggagtatac

SEQ ID NO: 1386 - DNA, 23 bp, Artificial Sequence
  mitotic kinesin microtubule-associated protein Eg5 (Kif11) siRNA
aagctcttattaaggagtatacg

SEQ ID NO: 1387 - DNA, 23 bp, Artificial Sequence
  mitotic kinesin microtubule-associated protein Eg5 (Kif11) siRNA
agctcttattaaggagtatacgg

SEQ ID NO: 1388 - DNA, 23 bp, Artificial Sequence
  mitotic kinesin microtubule-associated protein Eg5 (Kif11) siRNA
gctcttattaaggagtatacgga

SEQ ID NO: 1389 - DNA, 23 bp, Artificial Sequence
  mitotic kinesin microtubule-associated protein Eg5 (Kif11) siRNA
ctcttattaaggagtatacggag

SEQ ID NO: 1390 - DNA, 23 bp, Artificial Sequence
  mitotic kinesin microtubule-associated protein Eg5 (Kif11) siRNA
tcttattaaggagtatacggagg

SEQ ID NO: 1391 - DNA, 23 bp, Artificial Sequence
  mitotic kinesin microtubule-associated protein Eg5 (Kif11) siRNA
cttattaaggagtatacggagga

SEQ ID NO: 1392 - DNA, 23 bp, Artificial Sequence
  mitotic kinesin microtubule-associated protein Eg5 (Kif11) siRNA
ttattaaggagtatacggaggag

SEQ ID NO: 1393 - DNA, 23 bp, Artificial Sequence
  mitotic kinesin microtubule-associated protein Eg5 (Kif11) siRNA
tattaaggagtatacggaggaga

SEQ ID NO: 1394 - DNA, 23 bp, Artificial Sequence
  mitotic kinesin microtubule-associated protein Eg5 (Kif11) siRNA
attaaggagtatacggaggagat

SEQ ID NO: 1395 - DNA, 23 bp, Artificial Sequence
  mitotic kinesin microtubule-associated protein Eg5 (Kif11) siRNA
ttaaggagtatacggaggagata

SEQ ID NO: 1396 - DNA, 23 bp, Artificial Sequence
  mitotic kinesin microtubule-associated protein Eg5 (Kif11) siRNA
taaggagtatacggaggagatag

SEQ ID NO: 1397 - DNA, 23 bp, Artificial Sequence
  mitotic kinesin microtubule-associated protein Eg5 (Kif11) siRNA
aaggagtatacggaggagataga

SEQ ID NO: 1398 - DNA, 23 bp, Artificial Sequence
  mitotic kinesin microtubule-associated protein Eg5 (Kif11) siRNA
aggagtatacggaggagatagaa

SEQ ID NO: 1399 - DNA, 23 bp, Artificial Sequence
  mitotic kinesin microtubule-associated protein Eg5 (Kif11) siRNA
ggagtatacggaggagatagaac

SEQ ID NO: 1400 - DNA, 23 bp, Artificial Sequence
  mitotic kinesin microtubule-associated protein Eg5 (Kif11) siRNA
gagtatacggaggagatagaacg

SEQ ID NO: 1401 - DNA, 23 bp, Artificial Sequence
  mitotic kinesin microtubule-associated protein Eg5 (Kif11) siRNA
agtatacggaggagatagaacgt

SEQ ID NO: 1402 - DNA, 23 bp, Artificial Sequence
  mitotic kinesin microtubule-associated protein Eg5 (Kif11) siRNA
gtatacggaggagatagaacgtt

SEQ ID NO: 1403 - DNA, 23 bp, Artificial Sequence
  mitotic kinesin microtubule-associated protein Eg5 (Kif11) siRNA
tatacggaggagatagaacgttt

SEQ ID NO: 1404 - DNA, 23 bp, Artificial Sequence
  mitotic kinesin microtubule-associated protein Eg5 (Kif11) siRNA
atacggaggagatagaacgttta

SEQ ID NO: 1405 - DNA, 23 bp, Artificial Sequence
  mitotic kinesin microtubule-associated protein Eg5 (Kif11) siRNA
tacggaggagatagaacgtttaa

SEQ ID NO: 1406 - DNA, 23 bp, Artificial Sequence
  mitotic kinesin microtubule-associated protein Eg5 (Kif11) siRNA
acggaggagatagaacgtttaaa

SEQ ID NO: 1407 - DNA, 23 bp, Artificial Sequence
  mitotic kinesin microtubule-associated protein Eg5 (Kif11) siRNA
cggaggagatagaacgtttaaaa

SEQ ID NO: 1408 - DNA, 23 bp, Artificial Sequence
  mitotic kinesin microtubule-associated protein Eg5 (Kif11) siRNA
ggaggagatagaacgtttaaaac

SEQ ID NO: 1409 - DNA, 23 bp, Artificial Sequence
  mitotic kinesin microtubule-associated protein Eg5 (Kif11) siRNA
gaggagatagaacgtttaaaacg

SEQ ID NO: 1410 - DNA, 23 bp, Artificial Sequence
  mitotic kinesin microtubule-associated protein Eg5 (Kif11) siRNA
aggagatagaacgtttaaaacga

SEQ ID NO: 1411 - DNA, 23 bp, Artificial Sequence
  mitotic kinesin microtubule-associated protein Eg5 (Kif11) siRNA
ggagatagaacgtttaaaacgag

SEQ ID NO: 1412 - DNA, 23 bp, Artificial Sequence
  mitotic kinesin microtubule-associated protein Eg5 (Kif11) siRNA
gagatagaacgtttaaaacgaga

SEQ ID NO: 1413 - DNA, 23 bp, Artificial Sequence
  mitotic kinesin microtubule-associated protein Eg5 (Kif11) siRNA
agatagaacgtttaaaacgagat

SEQ ID NO: 1414 - DNA, 23 bp, Artificial Sequence
  mitotic kinesin microtubule-associated protein Eg5 (Kif11) siRNA
gatagaacgtttaaaacgagatc

SEQ ID NO: 1415 - DNA, 23 bp, Artificial Sequence
  mitotic kinesin microtubule-associated protein Eg5 (Kif11) siRNA
atagaacgtttaaaacgagatct

SEQ ID NO: 1416 - DNA, 23 bp, Artificial Sequence
  mitotic kinesin microtubule-associated protein Eg5 (Kif11) siRNA
tagaacgtttaaaacgagatctt

SEQ ID NO: 1417 - DNA, 23 bp, Artificial Sequence
  mitotic kinesin microtubule-associated protein Eg5 (Kif11) siRNA
agaacgtttaaaacgagatcttg

SEQ ID NO: 1418 - DNA, 23 bp, Artificial Sequence
  mitotic kinesin microtubule-associated protein Eg5 (Kif11) siRNA
gaacgtttaaaacgagatcttgc

SEQ ID NO: 1419 - DNA, 23 bp, Artificial Sequence
  mitotic kinesin microtubule-associated protein Eg5 (Kif11) siRNA
aacgtttaaaacgagatcttgct

SEQ ID NO: 1420 - DNA, 23 bp, Artificial Sequence
  mitotic kinesin microtubule-associated protein Eg5 (Kif11) siRNA
acgtttaaaacgagatcttgctg

SEQ ID NO: 1421 - DNA, 23 bp, Artificial Sequence
  mitotic kinesin microtubule-associated protein Eg5 (Kif11) siRNA
cgtttaaaacgagatcttgctgc

SEQ ID NO: 1422 - DNA, 23 bp, Artificial Sequence
  mitotic kinesin microtubule-associated protein Eg5 (Kif11) siRNA
gtttaaaacgagatcttgctgca

SEQ ID NO: 1423 - DNA, 23 bp, Artificial Sequence
  mitotic kinesin microtubule-associated protein Eg5 (Kif11) siRNA
tttaaaacgagatcttgctgcag

SEQ ID NO: 1424 - DNA, 23 bp, Artificial Sequence
  mitotic kinesin microtubule-associated protein Eg5 (Kif11) siRNA
ttaaaacgagatcttgctgcagc

SEQ ID NO: 1425 - DNA, 23 bp, Artificial Sequence
  mitotic kinesin microtubule-associated protein Eg5 (Kif11) siRNA
taaaacgagatcttgctgcagcc

SEQ ID NO: 1426 - DNA, 23 bp, Artificial Sequence
  mitotic kinesin microtubule-associated protein Eg5 (Kif11) siRNA
aaaacgagatcttgctgcagccc

SEQ ID NO: 1427 - DNA, 23 bp, Artificial Sequence
  mitotic kinesin microtubule-associated protein Eg5 (Kif11) siRNA
aaacgagatcttgctgcagcccg

SEQ ID NO: 1428 - DNA, 23 bp, Artificial Sequence
  mitotic kinesin microtubule-associated protein Eg5 (Kif11) siRNA
aacgagatcttgctgcagcccgt

SEQ ID NO: 1429 - DNA, 23 bp, Artificial Sequence
  mitotic kinesin microtubule-associated protein Eg5 (Kif11) siRNA
acgagatcttgctgcagcccgtg

SEQ ID NO: 1430 - DNA, 23 bp, Artificial Sequence
  mitotic kinesin microtubule-associated protein Eg5 (Kif11) siRNA
cgagatcttgctgcagcccgtga

SEQ ID NO: 1431 - DNA, 23 bp, Artificial Sequence
  mitotic kinesin microtubule-associated protein Eg5 (Kif11) siRNA
gagatcttgctgcagcccgtgag

SEQ ID NO: 1432 - DNA, 23 bp, Artificial Sequence
  mitotic kinesin microtubule-associated protein Eg5 (Kif11) siRNA
agatcttgctgcagcccgtgaga

SEQ ID NO: 1433 - DNA, 23 bp, Artificial Sequence
  mitotic kinesin microtubule-associated protein Eg5 (Kif11) siRNA
gatcttgctgcagcccgtgagaa

SEQ ID NO: 1434 - DNA, 23 bp, Artificial Sequence
  mitotic kinesin microtubule-associated protein Eg5 (Kif11) siRNA
atcttgctgcagcccgtgagaaa

SEQ ID NO: 1435 - DNA, 23 bp, Artificial Sequence
  mitotic kinesin microtubule-associated protein Eg5 (Kif11) siRNA
tcttgctgcagcccgtgagaaaa

SEQ ID NO: 1436 - DNA, 23 bp, Artificial Sequence
  mitotic kinesin microtubule-associated protein Eg5 (Kif11) siRNA
cttgctgcagcccgtgagaaaaa

SEQ ID NO: 1437 - DNA, 23 bp, Artificial Sequence
  mitotic kinesin microtubule-associated protein Eg5 (Kif11) siRNA
ttgctgcagcccgtgagaaaaat

SEQ ID NO: 1438 - DNA, 23 bp, Artificial Sequence
  mitotic kinesin microtubule-associated protein Eg5 (Kif11) siRNA
tgctgcagcccgtgagaaaaatg

SEQ ID NO: 1439 - DNA, 23 bp, Artificial Sequence
  mitotic kinesin microtubule-associated protein Eg5 (Kif11) siRNA
gctgcagcccgtgagaaaaatgg

SEQ ID NO: 1440 - DNA, 23 bp, Artificial Sequence
  mitotic kinesin microtubule-associated protein Eg5 (Kif11) siRNA
ctgcagcccgtgagaaaaatgga

SEQ ID NO: 1441 - DNA, 23 bp, Artificial Sequence
  mitotic kinesin microtubule-associated protein Eg5 (Kif11) siRNA
tgcagcccgtgagaaaaatggag

SEQ ID NO: 1442 - DNA, 23 bp, Artificial Sequence
  mitotic kinesin microtubule-associated protein Eg5 (Kif11) siRNA
gcagcccgtgagaaaaatggagt

SEQ ID NO: 1443 - DNA, 23 bp, Artificial Sequence
  mitotic kinesin microtubule-associated protein Eg5 (Kif11) siRNA
cagcccgtgagaaaaatggagtg

SEQ ID NO: 1444 - DNA, 23 bp, Artificial Sequence
  mitotic kinesin microtubule-associated protein Eg5 (Kif11) siRNA
agcccgtgagaaaaatggagtgt

SEQ ID NO: 1445 - DNA, 23 bp, Artificial Sequence
  mitotic kinesin microtubule-associated protein Eg5 (Kif11) siRNA
gcccgtgagaaaaatggagtgta

SEQ ID NO: 1446 - DNA, 23 bp, Artificial Sequence
  mitotic kinesin microtubule-associated protein Eg5 (Kif11) siRNA
cccgtgagaaaaatggagtgtat

SEQ ID NO: 1447 - DNA, 23 bp, Artificial Sequence
  mitotic kinesin microtubule-associated protein Eg5 (Kif11) siRNA
ccgtgagaaaaatggagtgtata

SEQ ID NO: 1448 - DNA, 23 bp, Artificial Sequence
  mitotic kinesin microtubule-associated protein Eg5 (Kif11) siRNA
cgtgagaaaaatggagtgtatat

SEQ ID NO: 1449 - DNA, 23 bp, Artificial Sequence
  mitotic kinesin microtubule-associated protein Eg5 (Kif11) siRNA
gtgagaaaaatggagtgtatatt

SEQ ID NO: 1450 - DNA, 23 bp, Artificial Sequence
  mitotic kinesin microtubule-associated protein Eg5 (Kif11) siRNA
tgagaaaaatggagtgtatattt

SEQ ID NO: 1451 - DNA, 23 bp, Artificial Sequence
  mitotic kinesin microtubule-associated protein Eg5 (Kif11) siRNA
gagaaaaatggagtgtatatttc

SEQ ID NO: 1452 - DNA, 23 bp, Artificial Sequence
  mitotic kinesin microtubule-associated protein Eg5 (Kif11) siRNA
agaaaaatggagtgtatatttct

SEQ ID NO: 1453 - DNA, 23 bp, Artificial Sequence
  mitotic kinesin microtubule-associated protein Eg5 (Kif11) siRNA
gaaaaatggagtgtatatttctg

SEQ ID NO: 1454 - DNA, 23 bp, Artificial Sequence
  mitotic kinesin microtubule-associated protein Eg5 (Kif11) siRNA
aaaaatggagtgtatatttctga

SEQ ID NO: 1455 - DNA, 23 bp, Artificial Sequence
  mitotic kinesin microtubule-associated protein Eg5 (Kif11) siRNA
aaaatggagtgtatatttctgaa

SEQ ID NO: 1456 - DNA, 23 bp, Artificial Sequence
  mitotic kinesin microtubule-associated protein Eg5 (Kif11) siRNA
aaatggagtgtatatttctgaag

SEQ ID NO: 1457 - DNA, 23 bp, Artificial Sequence
  mitotic kinesin microtubule-associated protein Eg5 (Kif11) siRNA
aatggagtgtatatttctgaaga

SEQ ID NO: 1458 - DNA, 23 bp, Artificial Sequence
  mitotic kinesin microtubule-associated protein Eg5 (Kif11) siRNA
atggagtgtatatttctgaagaa

SEQ ID NO: 1459 - DNA, 23 bp, Artificial Sequence
  mitotic kinesin microtubule-associated protein Eg5 (Kif11) siRNA
tggagtgtatatttctgaagaaa

SEQ ID NO: 1460 - DNA, 23 bp, Artificial Sequence
  mitotic kinesin microtubule-associated protein Eg5 (Kif11) siRNA
ggagtgtatatttctgaagaaaa

SEQ ID NO: 1461 - DNA, 23 bp, Artificial Sequence
  mitotic kinesin microtubule-associated protein Eg5 (Kif11) siRNA
gagtgtatatttctgaagaaaat

SEQ ID NO: 1462 - DNA, 23 bp, Artificial Sequence
  mitotic kinesin microtubule-associated protein Eg5 (Kif11) siRNA
agtgtatatttctgaagaaaatt

SEQ ID NO: 1463 - DNA, 23 bp, Artificial Sequence
  mitotic kinesin microtubule-associated protein Eg5 (Kif11) siRNA
gtgtatatttctgaagaaaattt

SEQ ID NO: 1464 - DNA, 23 bp, Artificial Sequence
  mitotic kinesin microtubule-associated protein Eg5 (Kif11) siRNA
tgtatatttctgaagaaaatttt

SEQ ID NO: 1465 - DNA, 23 bp, Artificial Sequence
  mitotic kinesin microtubule-associated protein Eg5 (Kif11) siRNA
gtatatttctgaagaaaatttta

SEQ ID NO: 1466 - DNA, 23 bp, Artificial Sequence
  mitotic kinesin microtubule-associated protein Eg5 (Kif11) siRNA
tatatttctgaagaaaattttag

SEQ ID NO: 1467 - DNA, 23 bp, Artificial Sequence
  mitotic kinesin microtubule-associated protein Eg5 (Kif11) siRNA
atatttctgaagaaaattttaga

SEQ ID NO: 1468 - DNA, 23 bp, Artificial Sequence
  mitotic kinesin microtubule-associated protein Eg5 (Kif11) siRNA
tatttctgaagaaaattttagag

SEQ ID NO: 1469 - DNA, 23 bp, Artificial Sequence
  mitotic kinesin microtubule-associated protein Eg5 (Kif11) siRNA
atttctgaagaaaattttagagt

SEQ ID NO: 1470 - DNA, 23 bp, Artificial Sequence
  mitotic kinesin microtubule-associated protein Eg5 (Kif11) siRNA
tttctgaagaaaattttagagtc

SEQ ID NO: 1471 - DNA, 23 bp, Artificial Sequence
  mitotic kinesin microtubule-associated protein Eg5 (Kif11) siRNA
ttctgaagaaaattttagagtca

SEQ ID NO: 1472 - DNA, 23 bp, Artificial Sequence
  mitotic kinesin microtubule-associated protein Eg5 (Kif11) siRNA
tctgaagaaaattttagagtcat

SEQ ID NO: 1473 - DNA, 23 bp, Artificial Sequence
  mitotic kinesin microtubule-associated protein Eg5 (Kif11) siRNA
ctgaagaaaattttagagtcatg

SEQ ID NO: 1474 - DNA, 23 bp, Artificial Sequence
  mitotic kinesin microtubule-associated protein Eg5 (Kif11) siRNA
tgaagaaaattttagagtcatga

SEQ ID NO: 1475 - DNA, 23 bp, Artificial Sequence
  mitotic kinesin microtubule-associated protein Eg5 (Kif11) siRNA
gaagaaaattttagagtcatgag

SEQ ID NO: 1476 - DNA, 23 bp, Artificial Sequence
  mitotic kinesin microtubule-associated protein Eg5 (Kif11) siRNA
aagaaaattttagagtcatgagt

SEQ ID NO: 1477 - DNA, 23 bp, Artificial Sequence
  mitotic kinesin microtubule-associated protein Eg5 (Kif11) siRNA
agaaaattttagagtcatgagtg

SEQ ID NO: 1478 - DNA, 23 bp, Artificial Sequence
  mitotic kinesin microtubule-associated protein Eg5 (Kif11) siRNA
gaaaattttagagtcatgagtgg

SEQ ID NO: 1479 - DNA, 23 bp, Artificial Sequence
  mitotic kinesin microtubule-associated protein Eg5 (Kif11) siRNA
aaaattttagagtcatgagtgga

SEQ ID NO: 1480 - DNA, 23 bp, Artificial Sequence
  mitotic kinesin microtubule-associated protein Eg5 (Kif11) siRNA
aaattttagagtcatgagtggaa

SEQ ID NO: 1481 - DNA, 23 bp, Artificial Sequence
  mitotic kinesin microtubule-associated protein Eg5 (Kif11) siRNA
aattttagagtcatgagtggaaa

SEQ ID NO: 1482 - DNA, 23 bp, Artificial Sequence
  mitotic kinesin microtubule-associated protein Eg5 (Kif11) siRNA
attttagagtcatgagtggaaaa

SEQ ID NO: 1483 - DNA, 23 bp, Artificial Sequence
  mitotic kinesin microtubule-associated protein Eg5 (Kif11) siRNA
ttttagagtcatgagtggaaaat

SEQ ID NO: 1484 - DNA, 23 bp, Artificial Sequence
  mitotic kinesin microtubule-associated protein Eg5 (Kif11) siRNA
tttagagtcatgagtggaaaatt

SEQ ID NO: 1485 - DNA, 23 bp, Artificial Sequence
  mitotic kinesin microtubule-associated protein Eg5 (Kif11) siRNA
ttagagtcatgagtggaaaatta

SEQ ID NO: 1486 - DNA, 23 bp, Artificial Sequence
  mitotic kinesin microtubule-associated protein Eg5 (Kif11) siRNA
tagagtcatgagtggaaaattaa

SEQ ID NO: 1487 - DNA, 23 bp, Artificial Sequence
  mitotic kinesin microtubule-associated protein Eg5 (Kif11) siRNA
agagtcatgagtggaaaattaac

SEQ ID NO: 1488 - DNA, 23 bp, Artificial Sequence
  mitotic kinesin microtubule-associated protein Eg5 (Kif11) siRNA
gagtcatgagtggaaaattaact

SEQ ID NO: 1489 - DNA, 23 bp, Artificial Sequence
  mitotic kinesin microtubule-associated protein Eg5 (Kif11) siRNA
agtcatgagtggaaaattaactg

SEQ ID NO: 1490 - DNA, 23 bp, Artificial Sequence
  mitotic kinesin microtubule-associated protein Eg5 (Kif11) siRNA
gtcatgagtggaaaattaactgt

SEQ ID NO: 1491 - DNA, 23 bp, Artificial Sequence
  mitotic kinesin microtubule-associated protein Eg5 (Kif11) siRNA
tcatgagtggaaaattaactgtt

SEQ ID NO: 1492 - DNA, 23 bp, Artificial Sequence
  mitotic kinesin microtubule-associated protein Eg5 (Kif11) siRNA
catgagtggaaaattaactgttc

SEQ ID NO: 1493 - DNA, 23 bp, Artificial Sequence
  mitotic kinesin microtubule-associated protein Eg5 (Kif11) siRNA
atgagtggaaaattaactgttca

SEQ ID NO: 1494 - DNA, 23 bp, Artificial Sequence
  mitotic kinesin microtubule-associated protein Eg5 (Kif11) siRNA
tgagtggaaaattaactgttcaa

SEQ ID NO: 1495 - DNA, 23 bp, Artificial Sequence
  mitotic kinesin microtubule-associated protein Eg5 (Kif11) siRNA
gagtggaaaattaactgttcaag

SEQ ID NO: 1496 - DNA, 23 bp, Artificial Sequence
  mitotic kinesin microtubule-associated protein Eg5 (Kif11) siRNA
agtggaaaattaactgttcaaga

SEQ ID NO: 1497 - DNA, 23 bp, Artificial Sequence
  mitotic kinesin microtubule-associated protein Eg5 (Kif11) siRNA
gtggaaaattaactgttcaagaa

SEQ ID NO: 1498 - DNA, 23 bp, Artificial Sequence
  mitotic kinesin microtubule-associated protein Eg5 (Kif11) siRNA
tggaaaattaactgttcaagaag

SEQ ID NO: 1499 - DNA, 23 bp, Artificial Sequence
  mitotic kinesin microtubule-associated protein Eg5 (Kif11) siRNA
ggaaaattaactgttcaagaaga

SEQ ID NO: 1500 - DNA, 23 bp, Artificial Sequence
  mitotic kinesin microtubule-associated protein Eg5 (Kif11) siRNA
gaaaattaactgttcaagaagag

SEQ ID NO: 1501 - DNA, 23 bp, Artificial Sequence
  mitotic kinesin microtubule-associated protein Eg5 (Kif11) siRNA
aaaattaactgttcaagaagagc

SEQ ID NO: 1502 - DNA, 23 bp, Artificial Sequence
  mitotic kinesin microtubule-associated protein Eg5 (Kif11) siRNA
aaattaactgttcaagaagagca

SEQ ID NO: 1503 - DNA, 23 bp, Artificial Sequence
  mitotic kinesin microtubule-associated protein Eg5 (Kif11) siRNA
aattaactgttcaagaagagcag

SEQ ID NO: 1504 - DNA, 23 bp, Artificial Sequence
  mitotic kinesin microtubule-associated protein Eg5 (Kif11) siRNA
attaactgttcaagaagagcaga

SEQ ID NO: 1505 - DNA, 23 bp, Artificial Sequence
  mitotic kinesin microtubule-associated protein Eg5 (Kif11) siRNA
ttaactgttcaagaagagcagat

SEQ ID NO: 1506 - DNA, 23 bp, Artificial Sequence
  mitotic kinesin microtubule-associated protein Eg5 (Kif11) siRNA
taactgttcaagaagagcagatt

SEQ ID NO: 1507 - DNA, 23 bp, Artificial Sequence
  mitotic kinesin microtubule-associated protein Eg5 (Kif11) siRNA
aactgttcaagaagagcagattg

SEQ ID NO: 1508 - DNA, 23 bp, Artificial Sequence
  mitotic kinesin microtubule-associated protein Eg5 (Kif11) siRNA
actgttcaagaagagcagattgt

SEQ ID NO: 1509 - DNA, 23 bp, Artificial Sequence
  mitotic kinesin microtubule-associated protein Eg5 (Kif11) siRNA
ctgttcaagaagagcagattgta

SEQ ID NO: 1510 - DNA, 23 bp, Artificial Sequence
  mitotic kinesin microtubule-associated protein Eg5 (Kif11) siRNA
tgttcaagaagagcagattgtag

SEQ ID NO: 1511 - DNA, 23 bp, Artificial Sequence
  mitotic kinesin microtubule-associated protein Eg5 (Kif11) siRNA
gttcaagaagagcagattgtaga

SEQ ID NO: 1512 - DNA, 23 bp, Artificial Sequence
  mitotic kinesin microtubule-associated protein Eg5 (Kif11) siRNA
ttcaagaagagcagattgtagaa

SEQ ID NO: 1513 - DNA, 23 bp, Artificial Sequence
  mitotic kinesin microtubule-associated protein Eg5 (Kif11) siRNA
tcaagaagagcagattgtagaat

SEQ ID NO: 1514 - DNA, 23 bp, Artificial Sequence
  mitotic kinesin microtubule-associated protein Eg5 (Kif11) siRNA
caagaagagcagattgtagaatt

SEQ ID NO: 1515 - DNA, 23 bp, Artificial Sequence
  mitotic kinesin microtubule-associated protein Eg5 (Kif11) siRNA
aagaagagcagattgtagaattg

SEQ ID NO: 1516 - DNA, 23 bp, Artificial Sequence
  mitotic kinesin microtubule-associated protein Eg5 (Kif11) siRNA
agaagagcagattgtagaattga

SEQ ID NO: 1517 - DNA, 23 bp, Artificial Sequence
  mitotic kinesin microtubule-associated protein Eg5 (Kif11) siRNA
gaagagcagattgtagaattgat

SEQ ID NO: 1518 - DNA, 23 bp, Artificial Sequence
  mitotic kinesin microtubule-associated protein Eg5 (Kif11) siRNA
aagagcagattgtagaattgatt

SEQ ID NO: 1519 - DNA, 23 bp, Artificial Sequence
  mitotic kinesin microtubule-associated protein Eg5 (Kif11) siRNA
agagcagattgtagaattgattg

SEQ ID NO: 1520 - DNA, 23 bp, Artificial Sequence
  mitotic kinesin microtubule-associated protein Eg5 (Kif11) siRNA
gagcagattgtagaattgattga

SEQ ID NO: 1521 - DNA, 23 bp, Artificial Sequence
  mitotic kinesin microtubule-associated protein Eg5 (Kif11) siRNA
agcagattgtagaattgattgaa

SEQ ID NO: 1522 - DNA, 23 bp, Artificial Sequence
  mitotic kinesin microtubule-associated protein Eg5 (Kif11) siRNA
gcagattgtagaattgattgaaa

SEQ ID NO: 1523 - DNA, 23 bp, Artificial Sequence
  mitotic kinesin microtubule-associated protein Eg5 (Kif11) siRNA
cagattgtagaattgattgaaaa

SEQ ID NO: 1524 - DNA, 23 bp, Artificial Sequence
  mitotic kinesin microtubule-associated protein Eg5 (Kif11) siRNA
agattgtagaattgattgaaaaa

SEQ ID NO: 1525 - DNA, 23 bp, Artificial Sequence
  mitotic kinesin microtubule-associated protein Eg5 (Kif11) siRNA
gattgtagaattgattgaaaaaa

SEQ ID NO: 1526 - DNA, 23 bp, Artificial Sequence
  mitotic kinesin microtubule-associated protein Eg5 (Kif11) siRNA
attgtagaattgattgaaaaaat

SEQ ID NO: 1527 - DNA, 23 bp, Artificial Sequence
  mitotic kinesin microtubule-associated protein Eg5 (Kif11) siRNA
ttgtagaattgattgaaaaaatt

SEQ ID NO: 1528 - DNA, 23 bp, Artificial Sequence
  mitotic kinesin microtubule-associated protein Eg5 (Kif11) siRNA
tgtagaattgattgaaaaaattg

SEQ ID NO: 1529 - DNA, 23 bp, Artificial Sequence
  mitotic kinesin microtubule-associated protein Eg5 (Kif11) siRNA
gtagaattgattgaaaaaattgg

SEQ ID NO: 1530 - DNA, 23 bp, Artificial Sequence
  mitotic kinesin microtubule-associated protein Eg5 (Kif11) siRNA
tagaattgattgaaaaaattggt

SEQ ID NO: 1531 - DNA, 23 bp, Artificial Sequence
  mitotic kinesin microtubule-associated protein Eg5 (Kif11) siRNA
agaattgattgaaaaaattggtg

SEQ ID NO: 1532 - DNA, 23 bp, Artificial Sequence
  mitotic kinesin microtubule-associated protein Eg5 (Kif11) siRNA
gaattgattgaaaaaattggtgc

SEQ ID NO: 1533 - DNA, 23 bp, Artificial Sequence
  mitotic kinesin microtubule-associated protein Eg5 (Kif11) siRNA
aattgattgaaaaaattggtgct

SEQ ID NO: 1534 - DNA, 23 bp, Artificial Sequence
  mitotic kinesin microtubule-associated protein Eg5 (Kif11) siRNA
attgattgaaaaaattggtgctg

SEQ ID NO: 1535 - DNA, 23 bp, Artificial Sequence
  mitotic kinesin microtubule-associated protein Eg5 (Kif11) siRNA
ttgattgaaaaaattggtgctgt

SEQ ID NO: 1536 - DNA, 23 bp, Artificial Sequence
  mitotic kinesin microtubule-associated protein Eg5 (Kif11) siRNA
tgattgaaaaaattggtgctgtt

SEQ ID NO: 1537 - DNA, 23 bp, Artificial Sequence
  mitotic kinesin microtubule-associated protein Eg5 (Kif11) siRNA
gattgaaaaaattggtgctgttg

SEQ ID NO: 1538 - DNA, 23 bp, Artificial Sequence
  mitotic kinesin microtubule-associated protein Eg5 (Kif11) siRNA
attgaaaaaattggtgctgttga

SEQ ID NO: 1539 - DNA, 23 bp, Artificial Sequence
  mitotic kinesin microtubule-associated protein Eg5 (Kif11) siRNA
ttgaaaaaattggtgctgttgag

SEQ ID NO: 1540 - DNA, 23 bp, Artificial Sequence
  mitotic kinesin microtubule-associated protein Eg5 (Kif11) siRNA
tgaaaaaattggtgctgttgagg

SEQ ID NO: 1541 - DNA, 23 bp, Artificial Sequence
  mitotic kinesin microtubule-associated protein Eg5 (Kif11) siRNA
gaaaaaattggtgctgttgagga

SEQ ID NO: 1542 - DNA, 23 bp, Artificial Sequence
  mitotic kinesin microtubule-associated protein Eg5 (Kif11) siRNA
aaaaaattggtgctgttgaggag

SEQ ID NO: 1543 - DNA, 23 bp, Artificial Sequence
  mitotic kinesin microtubule-associated protein Eg5 (Kif11) siRNA
aaaaattggtgctgttgaggagg

SEQ ID NO: 1544 - DNA, 23 bp, Artificial Sequence
  mitotic kinesin microtubule-associated protein Eg5 (Kif11) siRNA
aaaattggtgctgttgaggagga

SEQ ID NO: 1545 - DNA, 23 bp, Artificial Sequence
  mitotic kinesin microtubule-associated protein Eg5 (Kif11) siRNA
aaattggtgctgttgaggaggag

SEQ ID NO: 1546 - DNA, 23 bp, Artificial Sequence
  mitotic kinesin microtubule-associated protein Eg5 (Kif11) siRNA
aattggtgctgttgaggaggagc

SEQ ID NO: 1547 - DNA, 23 bp, Artificial Sequence
  mitotic kinesin microtubule-associated protein Eg5 (Kif11) siRNA
attggtgctgttgaggaggagct

SEQ ID NO: 1548 - DNA, 23 bp, Artificial Sequence
  mitotic kinesin microtubule-associated protein Eg5 (Kif11) siRNA
ttggtgctgttgaggaggagctg

SEQ ID NO: 1549 - DNA, 23 bp, Artificial Sequence
  mitotic kinesin microtubule-associated protein Eg5 (Kif11) siRNA
tggtgctgttgaggaggagctga

SEQ ID NO: 1550 - DNA, 23 bp, Artificial Sequence
  mitotic kinesin microtubule-associated protein Eg5 (Kif11) siRNA
ggtgctgttgaggaggagctgaa

SEQ ID NO: 1551 - DNA, 23 bp, Artificial Sequence
  mitotic kinesin microtubule-associated protein Eg5 (Kif11) siRNA
gtgctgttgaggaggagctgaat

SEQ ID NO: 1552 - DNA, 23 bp, Artificial Sequence
  mitotic kinesin microtubule-associated protein Eg5 (Kif11) siRNA
tgctgttgaggaggagctgaata

SEQ ID NO: 1553 - DNA, 23 bp, Artificial Sequence
  mitotic kinesin microtubule-associated protein Eg5 (Kif11) siRNA
gctgttgaggaggagctgaatag

SEQ ID NO: 1554 - DNA, 23 bp, Artificial Sequence
  mitotic kinesin microtubule-associated protein Eg5 (Kif11) siRNA
ctgttgaggaggagctgaatagg

SEQ ID NO: 1555 - DNA, 23 bp, Artificial Sequence
  mitotic kinesin microtubule-associated protein Eg5 (Kif11) siRNA
tgttgaggaggagctgaataggg

SEQ ID NO: 1556 - DNA, 23 bp, Artificial Sequence
  mitotic kinesin microtubule-associated protein Eg5 (Kif11) siRNA
gttgaggaggagctgaatagggt

SEQ ID NO: 1557 - DNA, 23 bp, Artificial Sequence
  mitotic kinesin microtubule-associated protein Eg5 (Kif11) siRNA
ttgaggaggagctgaatagggtt

SEQ ID NO: 1558 - DNA, 23 bp, Artificial Sequence
  mitotic kinesin microtubule-associated protein Eg5 (Kif11) siRNA
tgaggaggagctgaatagggtta

SEQ ID NO: 1559 - DNA, 23 bp, Artificial Sequence
  mitotic kinesin microtubule-associated protein Eg5 (Kif11) siRNA
gaggaggagctgaatagggttac

SEQ ID NO: 1560 - DNA, 23 bp, Artificial Sequence
  mitotic kinesin microtubule-associated protein Eg5 (Kif11) siRNA
aggaggagctgaatagggttaca

SEQ ID NO: 1561 - DNA, 23 bp, Artificial Sequence
  mitotic kinesin microtubule-associated protein Eg5 (Kif11) siRNA
ggaggagctgaatagggttacag

SEQ ID NO: 1562 - DNA, 23 bp, Artificial Sequence
  mitotic kinesin microtubule-associated protein Eg5 (Kif11) siRNA
gaggagctgaatagggttacaga

SEQ ID NO: 1563 - DNA, 23 bp, Artificial Sequence
  mitotic kinesin microtubule-associated protein Eg5 (Kif11) siRNA
aggagctgaatagggttacagag

SEQ ID NO: 1564 - DNA, 23 bp, Artificial Sequence
  mitotic kinesin microtubule-associated protein Eg5 (Kif11) siRNA
ggagctgaatagggttacagagt

SEQ ID NO: 1565 - DNA, 23 bp, Artificial Sequence
  mitotic kinesin microtubule-associated protein Eg5 (Kif11) siRNA
gagctgaatagggttacagagtt

SEQ ID NO: 1566 - DNA, 23 bp, Artificial Sequence
  mitotic kinesin microtubule-associated protein Eg5 (Kif11) siRNA
agctgaatagggttacagagttg

SEQ ID NO: 1567 - DNA, 23 bp, Artificial Sequence
  mitotic kinesin microtubule-associated protein Eg5 (Kif11) siRNA
gctgaatagggttacagagttgt

SEQ ID NO: 1568 - DNA, 23 bp, Artificial Sequence
  mitotic kinesin microtubule-associated protein Eg5 (Kif11) siRNA
ctgaatagggttacagagttgtt

SEQ ID NO: 1569 - DNA, 23 bp, Artificial Sequence
  mitotic kinesin microtubule-associated protein Eg5 (Kif11) siRNA
tgaatagggttacagagttgttt

SEQ ID NO: 1570 - DNA, 23 bp, Artificial Sequence
  mitotic kinesin microtubule-associated protein Eg5 (Kif11) siRNA
gaatagggttacagagttgttta

SEQ ID NO: 1571 - DNA, 23 bp, Artificial Sequence
  mitotic kinesin microtubule-associated protein Eg5 (Kif11) siRNA
aatagggttacagagttgtttat

SEQ ID NO: 1572 - DNA, 23 bp, Artificial Sequence
  mitotic kinesin microtubule-associated protein Eg5 (Kif11) siRNA
atagggttacagagttgtttatg

SEQ ID NO: 1573 - DNA, 23 bp, Artificial Sequence
  mitotic kinesin microtubule-associated protein Eg5 (Kif11) siRNA
tagggttacagagttgtttatgg

SEQ ID NO: 1574 - DNA, 23 bp, Artificial Sequence
  mitotic kinesin microtubule-associated protein Eg5 (Kif11) siRNA
agggttacagagttgtttatgga

SEQ ID NO: 1575 - DNA, 23 bp, Artificial Sequence
  mitotic kinesin microtubule-associated protein Eg5 (Kif11) siRNA
gggttacagagttgtttatggat

SEQ ID NO: 1576 - DNA, 23 bp, Artificial Sequence
  mitotic kinesin microtubule-associated protein Eg5 (Kif11) siRNA
ggttacagagttgtttatggata

SEQ ID NO: 1577 - DNA, 23 bp, Artificial Sequence
  mitotic kinesin microtubule-associated protein Eg5 (Kif11) siRNA
gttacagagttgtttatggataa

SEQ ID NO: 1578 - DNA, 23 bp, Artificial Sequence
  mitotic kinesin microtubule-associated protein Eg5 (Kif11) siRNA
ttacagagttgtttatggataat

SEQ ID NO: 1579 - DNA, 23 bp, Artificial Sequence
  mitotic kinesin microtubule-associated protein Eg5 (Kif11) siRNA
tacagagttgtttatggataata

SEQ ID NO: 1580 - DNA, 23 bp, Artificial Sequence
  mitotic kinesin microtubule-associated protein Eg5 (Kif11) siRNA
acagagttgtttatggataataa

SEQ ID NO: 1581 - DNA, 23 bp, Artificial Sequence
  mitotic kinesin microtubule-associated protein Eg5 (Kif11) siRNA
cagagttgtttatggataataaa

SEQ ID NO: 1582 - DNA, 23 bp, Artificial Sequence
  mitotic kinesin microtubule-associated protein Eg5 (Kif11) siRNA
agagttgtttatggataataaaa

SEQ ID NO: 1583 - DNA, 23 bp, Artificial Sequence
  mitotic kinesin microtubule-associated protein Eg5 (Kif11) siRNA
gagttgtttatggataataaaaa

SEQ ID NO: 1584 - DNA, 23 bp, Artificial Sequence
  mitotic kinesin microtubule-associated protein Eg5 (Kif11) siRNA
agttgtttatggataataaaaat

SEQ ID NO: 1585 - DNA, 23 bp, Artificial Sequence
  mitotic kinesin microtubule-associated protein Eg5 (Kif11) siRNA
gttgtttatggataataaaaatg

SEQ ID NO: 1586 - DNA, 23 bp, Artificial Sequence
  mitotic kinesin microtubule-associated protein Eg5 (Kif11) siRNA
ttgtttatggataataaaaatga

SEQ ID NO: 1587 - DNA, 23 bp, Artificial Sequence
  mitotic kinesin microtubule-associated protein Eg5 (Kif11) siRNA
tgtttatggataataaaaatgaa

SEQ ID NO: 1588 - DNA, 23 bp, Artificial Sequence
  mitotic kinesin microtubule-associated protein Eg5 (Kif11) siRNA
gtttatggataataaaaatgaac

SEQ ID NO: 1589 - DNA, 23 bp, Artificial Sequence
  mitotic kinesin microtubule-associated protein Eg5 (Kif11) siRNA
tttatggataataaaaatgaact

SEQ ID NO: 1590 - DNA, 23 bp, Artificial Sequence
  mitotic kinesin microtubule-associated protein Eg5 (Kif11) siRNA
ttatggataataaaaatgaactt

SEQ ID NO: 1591 - DNA, 23 bp, Artificial Sequence
  mitotic kinesin microtubule-associated protein Eg5 (Kif11) siRNA
tatggataataaaaatgaacttg

SEQ ID NO: 1592 - DNA, 23 bp, Artificial Sequence
  mitotic kinesin microtubule-associated protein Eg5 (Kif11) siRNA
atggataataaaaatgaacttga

SEQ ID NO: 1593 - DNA, 23 bp, Artificial Sequence
  mitotic kinesin microtubule-associated protein Eg5 (Kif11) siRNA
tggataataaaaatgaacttgac

SEQ ID NO: 1594 - DNA, 23 bp, Artificial Sequence
  mitotic kinesin microtubule-associated protein Eg5 (Kif11) siRNA
ggataataaaaatgaacttgacc

SEQ ID NO: 1595 - DNA, 23 bp, Artificial Sequence
  mitotic kinesin microtubule-associated protein Eg5 (Kif11) siRNA
gataataaaaatgaacttgacca

SEQ ID NO: 1596 - DNA, 23 bp, Artificial Sequence
  mitotic kinesin microtubule-associated protein Eg5 (Kif11) siRNA
ataataaaaatgaacttgaccag

SEQ ID NO: 1597 - DNA, 23 bp, Artificial Sequence
  mitotic kinesin microtubule-associated protein Eg5 (Kif11) siRNA
taataaaaatgaacttgaccagt

SEQ ID NO: 1598 - DNA, 23 bp, Artificial Sequence
  mitotic kinesin microtubule-associated protein Eg5 (Kif11) siRNA
aataaaaatgaacttgaccagtg

SEQ ID NO: 1599 - DNA, 23 bp, Artificial Sequence
  mitotic kinesin microtubule-associated protein Eg5 (Kif11) siRNA
ataaaaatgaacttgaccagtgt

SEQ ID NO: 1600 - DNA, 23 bp, Artificial Sequence
  mitotic kinesin microtubule-associated protein Eg5 (Kif11) siRNA
taaaaatgaacttgaccagtgta

SEQ ID NO: 1601 - DNA, 23 bp, Artificial Sequence
  mitotic kinesin microtubule-associated protein Eg5 (Kif11) siRNA
aaaaatgaacttgaccagtgtaa

SEQ ID NO: 1602 - DNA, 23 bp, Artificial Sequence
  mitotic kinesin microtubule-associated protein Eg5 (Kif11) siRNA
aaaatgaacttgaccagtgtaaa

SEQ ID NO: 1603 - DNA, 23 bp, Artificial Sequence
  mitotic kinesin microtubule-associated protein Eg5 (Kif11) siRNA
aaatgaacttgaccagtgtaaat

SEQ ID NO: 1604 - DNA, 23 bp, Artificial Sequence
  mitotic kinesin microtubule-associated protein Eg5 (Kif11) siRNA
aatgaacttgaccagtgtaaatc

SEQ ID NO: 1605 - DNA, 23 bp, Artificial Sequence
  mitotic kinesin microtubule-associated protein Eg5 (Kif11) siRNA
atgaacttgaccagtgtaaatct

SEQ ID NO: 1606 - DNA, 23 bp, Artificial Sequence
  mitotic kinesin microtubule-associated protein Eg5 (Kif11) siRNA
tgaacttgaccagtgtaaatctg

SEQ ID NO: 1607 - DNA, 23 bp, Artificial Sequence
  mitotic kinesin microtubule-associated protein Eg5 (Kif11) siRNA
gaacttgaccagtgtaaatctga

SEQ ID NO: 1608 - DNA, 23 bp, Artificial Sequence
  mitotic kinesin microtubule-associated protein Eg5 (Kif11) siRNA
aacttgaccagtgtaaatctgac

SEQ ID NO: 1609 - DNA, 23 bp, Artificial Sequence
  mitotic kinesin microtubule-associated protein Eg5 (Kif11) siRNA
acttgaccagtgtaaatctgacc

SEQ ID NO: 1610 - DNA, 23 bp, Artificial Sequence
  mitotic kinesin microtubule-associated protein Eg5 (Kif11) siRNA
cttgaccagtgtaaatctgacct

SEQ ID NO: 1611 - DNA, 23 bp, Artificial Sequence
  mitotic kinesin microtubule-associated protein Eg5 (Kif11) siRNA
ttgaccagtgtaaatctgacctg

SEQ ID NO: 1612 - DNA, 23 bp, Artificial Sequence
  mitotic kinesin microtubule-associated protein Eg5 (Kif11) siRNA
tgaccagtgtaaatctgacctgc

SEQ ID NO: 1613 - DNA, 23 bp, Artificial Sequence
  mitotic kinesin microtubule-associated protein Eg5 (Kif11) siRNA
gaccagtgtaaatctgacctgca

SEQ ID NO: 1614 - DNA, 23 bp, Artificial Sequence
  mitotic kinesin microtubule-associated protein Eg5 (Kif11) siRNA
accagtgtaaatctgacctgcaa

SEQ ID NO: 1615 - DNA, 23 bp, Artificial Sequence
  mitotic kinesin microtubule-associated protein Eg5 (Kif11) siRNA
ccagtgtaaatctgacctgcaaa

SEQ ID NO: 1616 - DNA, 23 bp, Artificial Sequence
  mitotic kinesin microtubule-associated protein Eg5 (Kif11) siRNA
cagtgtaaatctgacctgcaaaa

SEQ ID NO: 1617 - DNA, 23 bp, Artificial Sequence
  mitotic kinesin microtubule-associated protein Eg5 (Kif11) siRNA
agtgtaaatctgacctgcaaaat

SEQ ID NO: 1618 - DNA, 23 bp, Artificial Sequence
  mitotic kinesin microtubule-associated protein Eg5 (Kif11) siRNA
gtgtaaatctgacctgcaaaata

SEQ ID NO: 1619 - DNA, 23 bp, Artificial Sequence
  mitotic kinesin microtubule-associated protein Eg5 (Kif11) siRNA
tgtaaatctgacctgcaaaataa

SEQ ID NO: 1620 - DNA, 23 bp, Artificial Sequence
  mitotic kinesin microtubule-associated protein Eg5 (Kif11) siRNA
gtaaatctgacctgcaaaataaa

SEQ ID NO: 1621 - DNA, 23 bp, Artificial Sequence
  mitotic kinesin microtubule-associated protein Eg5 (Kif11) siRNA
taaatctgacctgcaaaataaaa

SEQ ID NO: 1622 - DNA, 23 bp, Artificial Sequence
  mitotic kinesin microtubule-associated protein Eg5 (Kif11) siRNA
aaatctgacctgcaaaataaaac

SEQ ID NO: 1623 - DNA, 23 bp, Artificial Sequence
  mitotic kinesin microtubule-associated protein Eg5 (Kif11) siRNA
aatctgacctgcaaaataaaaca

SEQ ID NO: 1624 - DNA, 23 bp, Artificial Sequence
  mitotic kinesin microtubule-associated protein Eg5 (Kif11) siRNA
atctgacctgcaaaataaaacac

SEQ ID NO: 1625 - DNA, 23 bp, Artificial Sequence
  mitotic kinesin microtubule-associated protein Eg5 (Kif11) siRNA
tctgacctgcaaaataaaacaca

SEQ ID NO: 1626 - DNA, 23 bp, Artificial Sequence
  mitotic kinesin microtubule-associated protein Eg5 (Kif11) siRNA
ctgacctgcaaaataaaacacaa

SEQ ID NO: 1627 - DNA, 23 bp, Artificial Sequence
  mitotic kinesin microtubule-associated protein Eg5 (Kif11) siRNA
tgacctgcaaaataaaacacaag

SEQ ID NO: 1628 - DNA, 23 bp, Artificial Sequence
  mitotic kinesin microtubule-associated protein Eg5 (Kif11) siRNA
gacctgcaaaataaaacacaaga

SEQ ID NO: 1629 - DNA, 23 bp, Artificial Sequence
  mitotic kinesin microtubule-associated protein Eg5 (Kif11) siRNA
acctgcaaaataaaacacaagaa

SEQ ID NO: 1630 - DNA, 23 bp, Artificial Sequence
  mitotic kinesin microtubule-associated protein Eg5 (Kif11) siRNA
cctgcaaaataaaacacaagaac

SEQ ID NO: 1631 - DNA, 23 bp, Artificial Sequence
  mitotic kinesin microtubule-associated protein Eg5 (Kif11) siRNA
ctgcaaaataaaacacaagaact

SEQ ID NO: 1632 - DNA, 23 bp, Artificial Sequence
  mitotic kinesin microtubule-associated protein Eg5 (Kif11) siRNA
tgcaaaataaaacacaagaactt

SEQ ID NO: 1633 - DNA, 23 bp, Artificial Sequence
  mitotic kinesin microtubule-associated protein Eg5 (Kif11) siRNA
gcaaaataaaacacaagaacttg

SEQ ID NO: 1634 - DNA, 23 bp, Artificial Sequence
  mitotic kinesin microtubule-associated protein Eg5 (Kif11) siRNA
caaaataaaacacaagaacttga

SEQ ID NO: 1635 - DNA, 23 bp, Artificial Sequence
  mitotic kinesin microtubule-associated protein Eg5 (Kif11) siRNA
aaaataaaacacaagaacttgaa

SEQ ID NO: 1636 - DNA, 23 bp, Artificial Sequence
  mitotic kinesin microtubule-associated protein Eg5 (Kif11) siRNA
aaataaaacacaagaacttgaaa

SEQ ID NO: 1637 - DNA, 23 bp, Artificial Sequence
  mitotic kinesin microtubule-associated protein Eg5 (Kif11) siRNA
aataaaacacaagaacttgaaac

SEQ ID NO: 1638 - DNA, 23 bp, Artificial Sequence
  mitotic kinesin microtubule-associated protein Eg5 (Kif11) siRNA
ataaaacacaagaacttgaaacc

SEQ ID NO: 1639 - DNA, 23 bp, Artificial Sequence
  mitotic kinesin microtubule-associated protein Eg5 (Kif11) siRNA
taaaacacaagaacttgaaacca

SEQ ID NO: 1640 - DNA, 23 bp, Artificial Sequence
  mitotic kinesin microtubule-associated protein Eg5 (Kif11) siRNA
aaaacacaagaacttgaaaccac

SEQ ID NO: 1641 - DNA, 23 bp, Artificial Sequence
  mitotic kinesin microtubule-associated protein Eg5 (Kif11) siRNA
aaacacaagaacttgaaaccact

SEQ ID NO: 1642 - DNA, 23 bp, Artificial Sequence
  mitotic kinesin microtubule-associated protein Eg5 (Kif11) siRNA
aacacaagaacttgaaaccactc

SEQ ID NO: 1643 - DNA, 23 bp, Artificial Sequence
  mitotic kinesin microtubule-associated protein Eg5 (Kif11) siRNA
acacaagaacttgaaaccactca

SEQ ID NO: 1644 - DNA, 23 bp, Artificial Sequence
  mitotic kinesin microtubule-associated protein Eg5 (Kif11) siRNA
cacaagaacttgaaaccactcaa

SEQ ID NO: 1645 - DNA, 23 bp, Artificial Sequence
  mitotic kinesin microtubule-associated protein Eg5 (Kif11) siRNA
acaagaacttgaaaccactcaaa

SEQ ID NO: 1646 - DNA, 23 bp, Artificial Sequence
  mitotic kinesin microtubule-associated protein Eg5 (Kif11) siRNA
caagaacttgaaaccactcaaaa

SEQ ID NO: 1647 - DNA, 23 bp, Artificial Sequence
  mitotic kinesin microtubule-associated protein Eg5 (Kif11) siRNA
aagaacttgaaaccactcaaaaa

SEQ ID NO: 1648 - DNA, 23 bp, Artificial Sequence
  mitotic kinesin microtubule-associated protein Eg5 (Kif11) siRNA
agaacttgaaaccactcaaaaac

SEQ ID NO: 1649 - DNA, 23 bp, Artificial Sequence
  mitotic kinesin microtubule-associated protein Eg5 (Kif11) siRNA
gaacttgaaaccactcaaaaaca

SEQ ID NO: 1650 - DNA, 23 bp, Artificial Sequence
  mitotic kinesin microtubule-associated protein Eg5 (Kif11) siRNA
aacttgaaaccactcaaaaacat

SEQ ID NO: 1651 - DNA, 23 bp, Artificial Sequence
  mitotic kinesin microtubule-associated protein Eg5 (Kif11) siRNA
acttgaaaccactcaaaaacatt

SEQ ID NO: 1652 - DNA, 23 bp, Artificial Sequence
  mitotic kinesin microtubule-associated protein Eg5 (Kif11) siRNA
cttgaaaccactcaaaaacattt

SEQ ID NO: 1653 - DNA, 23 bp, Artificial Sequence
  mitotic kinesin microtubule-associated protein Eg5 (Kif11) siRNA
ttgaaaccactcaaaaacatttg

SEQ ID NO: 1654 - DNA, 23 bp, Artificial Sequence
  mitotic kinesin microtubule-associated protein Eg5 (Kif11) siRNA
tgaaaccactcaaaaacatttgc

SEQ ID NO: 1655 - DNA, 23 bp, Artificial Sequence
  mitotic kinesin microtubule-associated protein Eg5 (Kif11) siRNA
gaaaccactcaaaaacatttgca

SEQ ID NO: 1656 - DNA, 23 bp, Artificial Sequence
  mitotic kinesin microtubule-associated protein Eg5 (Kif11) siRNA
aaaccactcaaaaacatttgcaa

SEQ ID NO: 1657 - DNA, 23 bp, Artificial Sequence
  mitotic kinesin microtubule-associated protein Eg5 (Kif11) siRNA
aaccactcaaaaacatttgcaag

SEQ ID NO: 1658 - DNA, 23 bp, Artificial Sequence
  mitotic kinesin microtubule-associated protein Eg5 (Kif11) siRNA
accactcaaaaacatttgcaaga

SEQ ID NO: 1659 - DNA, 23 bp, Artificial Sequence
  mitotic kinesin microtubule-associated protein Eg5 (Kif11) siRNA
ccactcaaaaacatttgcaagaa

SEQ ID NO: 1660 - DNA, 23 bp, Artificial Sequence
  mitotic kinesin microtubule-associated protein Eg5 (Kif11) siRNA
cactcaaaaacatttgcaagaaa

SEQ ID NO: 1661 - DNA, 23 bp, Artificial Sequence
  mitotic kinesin microtubule-associated protein Eg5 (Kif11) siRNA
actcaaaaacatttgcaagaaac

SEQ ID NO: 1662 - DNA, 23 bp, Artificial Sequence
  mitotic kinesin microtubule-associated protein Eg5 (Kif11) siRNA
ctcaaaaacatttgcaagaaact

SEQ ID NO: 1663 - DNA, 23 bp, Artificial Sequence
  mitotic kinesin microtubule-associated protein Eg5 (Kif11) siRNA
tcaaaaacatttgcaagaaacta

SEQ ID NO: 1664 - DNA, 23 bp, Artificial Sequence
  mitotic kinesin microtubule-associated protein Eg5 (Kif11) siRNA
caaaaacatttgcaagaaactaa

SEQ ID NO: 1665 - DNA, 23 bp, Artificial Sequence
  mitotic kinesin microtubule-associated protein Eg5 (Kif11) siRNA
aaaaacatttgcaagaaactaaa

SEQ ID NO: 1666 - DNA, 23 bp, Artificial Sequence
  mitotic kinesin microtubule-associated protein Eg5 (Kif11) siRNA
aaaacatttgcaagaaactaaat

SEQ ID NO: 1667 - DNA, 23 bp, Artificial Sequence
  mitotic kinesin microtubule-associated protein Eg5 (Kif11) siRNA
aaacatttgcaagaaactaaatt

SEQ ID NO: 1668 - DNA, 23 bp, Artificial Sequence
  mitotic kinesin microtubule-associated protein Eg5 (Kif11) siRNA
aacatttgcaagaaactaaatta

SEQ ID NO: 1669 - DNA, 23 bp, Artificial Sequence
  mitotic kinesin microtubule-associated protein Eg5 (Kif11) siRNA
acatttgcaagaaactaaattac

SEQ ID NO: 1670 - DNA, 23 bp, Artificial Sequence
  mitotic kinesin microtubule-associated protein Eg5 (Kif11) siRNA
catttgcaagaaactaaattaca

SEQ ID NO: 1671 - DNA, 23 bp, Artificial Sequence
  mitotic kinesin microtubule-associated protein Eg5 (Kif11) siRNA
atttgcaagaaactaaattacaa

SEQ ID NO: 1672 - DNA, 23 bp, Artificial Sequence
  mitotic kinesin microtubule-associated protein Eg5 (Kif11) siRNA
tttgcaagaaactaaattacaac

SEQ ID NO: 1673 - DNA, 23 bp, Artificial Sequence
  mitotic kinesin microtubule-associated protein Eg5 (Kif11) siRNA
ttgcaagaaactaaattacaact

SEQ ID NO: 1674 - DNA, 23 bp, Artificial Sequence
  mitotic kinesin microtubule-associated protein Eg5 (Kif11) siRNA
tgcaagaaactaaattacaactt

SEQ ID NO: 1675 - DNA, 23 bp, Artificial Sequence
  mitotic kinesin microtubule-associated protein Eg5 (Kif11) siRNA
gcaagaaactaaattacaacttg

SEQ ID NO: 1676 - DNA, 23 bp, Artificial Sequence
  mitotic kinesin microtubule-associated protein Eg5 (Kif11) siRNA
caagaaactaaattacaacttgt

SEQ ID NO: 1677 - DNA, 23 bp, Artificial Sequence
  mitotic kinesin microtubule-associated protein Eg5 (Kif11) siRNA
aagaaactaaattacaacttgtt

SEQ ID NO: 1678 - DNA, 23 bp, Artificial Sequence
  mitotic kinesin microtubule-associated protein Eg5 (Kif11) siRNA
agaaactaaattacaacttgtta

SEQ ID NO: 1679 - DNA, 23 bp, Artificial Sequence
  mitotic kinesin microtubule-associated protein Eg5 (Kif11) siRNA
gaaactaaattacaacttgttaa

SEQ ID NO: 1680 - DNA, 23 bp, Artificial Sequence
  mitotic kinesin microtubule-associated protein Eg5 (Kif11) siRNA
aaactaaattacaacttgttaaa

SEQ ID NO: 1681 - DNA, 23 bp, Artificial Sequence
  mitotic kinesin microtubule-associated protein Eg5 (Kif11) siRNA
aactaaattacaacttgttaaag

SEQ ID NO: 1682 - DNA, 23 bp, Artificial Sequence
  mitotic kinesin microtubule-associated protein Eg5 (Kif11) siRNA
actaaattacaacttgttaaaga

SEQ ID NO: 1683 - DNA, 23 bp, Artificial Sequence
  mitotic kinesin microtubule-associated protein Eg5 (Kif11) siRNA
ctaaattacaacttgttaaagaa

SEQ ID NO: 1684 - DNA, 23 bp, Artificial Sequence
  mitotic kinesin microtubule-associated protein Eg5 (Kif11) siRNA
taaattacaacttgttaaagaag

SEQ ID NO: 1685 - DNA, 23 bp, Artificial Sequence
  mitotic kinesin microtubule-associated protein Eg5 (Kif11) siRNA
aaattacaacttgttaaagaaga

SEQ ID NO: 1686 - DNA, 23 bp, Artificial Sequence
  mitotic kinesin microtubule-associated protein Eg5 (Kif11) siRNA
aattacaacttgttaaagaagaa

SEQ ID NO: 1687 - DNA, 23 bp, Artificial Sequence
  mitotic kinesin microtubule-associated protein Eg5 (Kif11) siRNA
attacaacttgttaaagaagaat

SEQ ID NO: 1688 - DNA, 23 bp, Artificial Sequence
  mitotic kinesin microtubule-associated protein Eg5 (Kif11) siRNA
ttacaacttgttaaagaagaata

SEQ ID NO: 1689 - DNA, 23 bp, Artificial Sequence
  mitotic kinesin microtubule-associated protein Eg5 (Kif11) siRNA
tacaacttgttaaagaagaatat

SEQ ID NO: 1690 - DNA, 23 bp, Artificial Sequence
  mitotic kinesin microtubule-associated protein Eg5 (Kif11) siRNA
acaacttgttaaagaagaatata

SEQ ID NO: 1691 - DNA, 23 bp, Artificial Sequence
  mitotic kinesin microtubule-associated protein Eg5 (Kif11) siRNA
caacttgttaaagaagaatatat

SEQ ID NO: 1692 - DNA, 23 bp, Artificial Sequence
  mitotic kinesin microtubule-associated protein Eg5 (Kif11) siRNA
aacttgttaaagaagaatatatc

SEQ ID NO: 1693 - DNA, 23 bp, Artificial Sequence
  mitotic kinesin microtubule-associated protein Eg5 (Kif11) siRNA
acttgttaaagaagaatatatca

SEQ ID NO: 1694 - DNA, 23 bp, Artificial Sequence
  mitotic kinesin microtubule-associated protein Eg5 (Kif11) siRNA
cttgttaaagaagaatatatcac

SEQ ID NO: 1695 - DNA, 23 bp, Artificial Sequence
  mitotic kinesin microtubule-associated protein Eg5 (Kif11) siRNA
ttgttaaagaagaatatatcaca

SEQ ID NO: 1696 - DNA, 23 bp, Artificial Sequence
  mitotic kinesin microtubule-associated protein Eg5 (Kif11) siRNA
tgttaaagaagaatatatcacat

SEQ ID NO: 1697 - DNA, 23 bp, Artificial Sequence
  mitotic kinesin microtubule-associated protein Eg5 (Kif11) siRNA
gttaaagaagaatatatcacatc

SEQ ID NO: 1698 - DNA, 23 bp, Artificial Sequence
  mitotic kinesin microtubule-associated protein Eg5 (Kif11) siRNA
ttaaagaagaatatatcacatca

SEQ ID NO: 1699 - DNA, 23 bp, Artificial Sequence
  mitotic kinesin microtubule-associated protein Eg5 (Kif11) siRNA
taaagaagaatatatcacatcag

SEQ ID NO: 1700 - DNA, 23 bp, Artificial Sequence
  mitotic kinesin microtubule-associated protein Eg5 (Kif11) siRNA
aaagaagaatatatcacatcagc

SEQ ID NO: 1701 - DNA, 23 bp, Artificial Sequence
  mitotic kinesin microtubule-associated protein Eg5 (Kif11) siRNA
aagaagaatatatcacatcagct

SEQ ID NO: 1702 - DNA, 23 bp, Artificial Sequence
  mitotic kinesin microtubule-associated protein Eg5 (Kif11) siRNA
agaagaatatatcacatcagctt

SEQ ID NO: 1703 - DNA, 23 bp, Artificial Sequence
  mitotic kinesin microtubule-associated protein Eg5 (Kif11) siRNA
gaagaatatatcacatcagcttt

SEQ ID NO: 1704 - DNA, 23 bp, Artificial Sequence
  mitotic kinesin microtubule-associated protein Eg5 (Kif11) siRNA
aagaatatatcacatcagctttg

SEQ ID NO: 1705 - DNA, 23 bp, Artificial Sequence
  mitotic kinesin microtubule-associated protein Eg5 (Kif11) siRNA
agaatatatcacatcagctttgg

SEQ ID NO: 1706 - DNA, 23 bp, Artificial Sequence
  mitotic kinesin microtubule-associated protein Eg5 (Kif11) siRNA
gaatatatcacatcagctttgga

SEQ ID NO: 1707 - DNA, 23 bp, Artificial Sequence
  mitotic kinesin microtubule-associated protein Eg5 (Kif11) siRNA
aatatatcacatcagctttggaa

SEQ ID NO: 1708 - DNA, 23 bp, Artificial Sequence
  mitotic kinesin microtubule-associated protein Eg5 (Kif11) siRNA
atatatcacatcagctttggaaa

SEQ ID NO: 1709 - DNA, 23 bp, Artificial Sequence
  mitotic kinesin microtubule-associated protein Eg5 (Kif11) siRNA
tatatcacatcagctttggaaag

SEQ ID NO: 1710 - DNA, 23 bp, Artificial Sequence
  mitotic kinesin microtubule-associated protein Eg5 (Kif11) siRNA
atatcacatcagctttggaaagt

SEQ ID NO: 1711 - DNA, 23 bp, Artificial Sequence
  mitotic kinesin microtubule-associated protein Eg5 (Kif11) siRNA
tatcacatcagctttggaaagta

SEQ ID NO: 1712 - DNA, 23 bp, Artificial Sequence
  mitotic kinesin microtubule-associated protein Eg5 (Kif11) siRNA
atcacatcagctttggaaagtac

SEQ ID NO: 1713 - DNA, 23 bp, Artificial Sequence
  mitotic kinesin microtubule-associated protein Eg5 (Kif11) siRNA
tcacatcagctttggaaagtact

SEQ ID NO: 1714 - DNA, 23 bp, Artificial Sequence
  mitotic kinesin microtubule-associated protein Eg5 (Kif11) siRNA
cacatcagctttggaaagtactg

SEQ ID NO: 1715 - DNA, 23 bp, Artificial Sequence
  mitotic kinesin microtubule-associated protein Eg5 (Kif11) siRNA
acatcagctttggaaagtactga

SEQ ID NO: 1716 - DNA, 23 bp, Artificial Sequence
  mitotic kinesin microtubule-associated protein Eg5 (Kif11) siRNA
catcagctttggaaagtactgag

SEQ ID NO: 1717 - DNA, 23 bp, Artificial Sequence
  mitotic kinesin microtubule-associated protein Eg5 (Kif11) siRNA
atcagctttggaaagtactgagg

SEQ ID NO: 1718 - DNA, 23 bp, Artificial Sequence
  mitotic kinesin microtubule-associated protein Eg5 (Kif11) siRNA
tcagctttggaaagtactgagga

SEQ ID NO: 1719 - DNA, 23 bp, Artificial Sequence
  mitotic kinesin microtubule-associated protein Eg5 (Kif11) siRNA
cagctttggaaagtactgaggag

SEQ ID NO: 1720 - DNA, 23 bp, Artificial Sequence
  mitotic kinesin microtubule-associated protein Eg5 (Kif11) siRNA
agctttggaaagtactgaggaga

SEQ ID NO: 1721 - DNA, 23 bp, Artificial Sequence
  mitotic kinesin microtubule-associated protein Eg5 (Kif11) siRNA
gctttggaaagtactgaggagaa

SEQ ID NO: 1722 - DNA, 23 bp, Artificial Sequence
  mitotic kinesin microtubule-associated protein Eg5 (Kif11) siRNA
ctttggaaagtactgaggagaaa

SEQ ID NO: 1723 - DNA, 23 bp, Artificial Sequence
  mitotic kinesin microtubule-associated protein Eg5 (Kif11) siRNA
tttggaaagtactgaggagaaac

SEQ ID NO: 1724 - DNA, 23 bp, Artificial Sequence
  mitotic kinesin microtubule-associated protein Eg5 (Kif11) siRNA
ttggaaagtactgaggagaaact

SEQ ID NO: 1725 - DNA, 23 bp, Artificial Sequence
  mitotic kinesin microtubule-associated protein Eg5 (Kif11) siRNA
tggaaagtactgaggagaaactt

SEQ ID NO: 1726 - DNA, 23 bp, Artificial Sequence
  mitotic kinesin microtubule-associated protein Eg5 (Kif11) siRNA
ggaaagtactgaggagaaacttc

SEQ ID NO: 1727 - DNA, 23 bp, Artificial Sequence
  mitotic kinesin microtubule-associated protein Eg5 (Kif11) siRNA
gaaagtactgaggagaaacttca

SEQ ID NO: 1728 - DNA, 23 bp, Artificial Sequence
  mitotic kinesin microtubule-associated protein Eg5 (Kif11) siRNA
aaagtactgaggagaaacttcat

SEQ ID NO: 1729 - DNA, 23 bp, Artificial Sequence
  mitotic kinesin microtubule-associated protein Eg5 (Kif11) siRNA
aagtactgaggagaaacttcatg

SEQ ID NO: 1730 - DNA, 23 bp, Artificial Sequence
  mitotic kinesin microtubule-associated protein Eg5 (Kif11) siRNA
agtactgaggagaaacttcatga

SEQ ID NO: 1731 - DNA, 23 bp, Artificial Sequence
  mitotic kinesin microtubule-associated protein Eg5 (Kif11) siRNA
gtactgaggagaaacttcatgat

SEQ ID NO: 1732 - DNA, 23 bp, Artificial Sequence
  mitotic kinesin microtubule-associated protein Eg5 (Kif11) siRNA
tactgaggagaaacttcatgatg

SEQ ID NO: 1733 - DNA, 23 bp, Artificial Sequence
  mitotic kinesin microtubule-associated protein Eg5 (Kif11) siRNA
actgaggagaaacttcatgatgc

SEQ ID NO: 1734 - DNA, 23 bp, Artificial Sequence
  mitotic kinesin microtubule-associated protein Eg5 (Kif11) siRNA
ctgaggagaaacttcatgatgct

SEQ ID NO: 1735 - DNA, 23 bp, Artificial Sequence
  mitotic kinesin microtubule-associated protein Eg5 (Kif11) siRNA
tgaggagaaacttcatgatgctg

SEQ ID NO: 1736 - DNA, 23 bp, Artificial Sequence
  mitotic kinesin microtubule-associated protein Eg5 (Kif11) siRNA
gaggagaaacttcatgatgctgc

SEQ ID NO: 1737 - DNA, 23 bp, Artificial Sequence
  mitotic kinesin microtubule-associated protein Eg5 (Kif11) siRNA
aggagaaacttcatgatgctgcc

SEQ ID NO: 1738 - DNA, 23 bp, Artificial Sequence
  mitotic kinesin microtubule-associated protein Eg5 (Kif11) siRNA
ggagaaacttcatgatgctgcca

SEQ ID NO: 1739 - DNA, 23 bp, Artificial Sequence
  mitotic kinesin microtubule-associated protein Eg5 (Kif11) siRNA
gagaaacttcatgatgctgccag

SEQ ID NO: 1740 - DNA, 23 bp, Artificial Sequence
  mitotic kinesin microtubule-associated protein Eg5 (Kif11) siRNA
agaaacttcatgatgctgccagc

SEQ ID NO: 1741 - DNA, 23 bp, Artificial Sequence
  mitotic kinesin microtubule-associated protein Eg5 (Kif11) siRNA
gaaacttcatgatgctgccagca

SEQ ID NO: 1742 - DNA, 23 bp, Artificial Sequence
  mitotic kinesin microtubule-associated protein Eg5 (Kif11) siRNA
aaacttcatgatgctgccagcaa

SEQ ID NO: 1743 - DNA, 23 bp, Artificial Sequence
  mitotic kinesin microtubule-associated protein Eg5 (Kif11) siRNA
aacttcatgatgctgccagcaag

SEQ ID NO: 1744 - DNA, 23 bp, Artificial Sequence
  mitotic kinesin microtubule-associated protein Eg5 (Kif11) siRNA
acttcatgatgctgccagcaagc

SEQ ID NO: 1745 - DNA, 23 bp, Artificial Sequence
  mitotic kinesin microtubule-associated protein Eg5 (Kif11) siRNA
cttcatgatgctgccagcaagct

SEQ ID NO: 1746 - DNA, 23 bp, Artificial Sequence
  mitotic kinesin microtubule-associated protein Eg5 (Kif11) siRNA
ttcatgatgctgccagcaagctg

SEQ ID NO: 1747 - DNA, 23 bp, Artificial Sequence
  mitotic kinesin microtubule-associated protein Eg5 (Kif11) siRNA
tcatgatgctgccagcaagctgc

SEQ ID NO: 1748 - DNA, 23 bp, Artificial Sequence
  mitotic kinesin microtubule-associated protein Eg5 (Kif11) siRNA
catgatgctgccagcaagctgct

SEQ ID NO: 1749 - DNA, 23 bp, Artificial Sequence
  mitotic kinesin microtubule-associated protein Eg5 (Kif11) siRNA
atgatgctgccagcaagctgctt

SEQ ID NO: 1750 - DNA, 23 bp, Artificial Sequence
  mitotic kinesin microtubule-associated protein Eg5 (Kif11) siRNA
tgatgctgccagcaagctgctta

SEQ ID NO: 1751 - DNA, 23 bp, Artificial Sequence
  mitotic kinesin microtubule-associated protein Eg5 (Kif11) siRNA
gatgctgccagcaagctgcttaa

SEQ ID NO: 1752 - DNA, 23 bp, Artificial Sequence
  mitotic kinesin microtubule-associated protein Eg5 (Kif11) siRNA
atgctgccagcaagctgcttaac

SEQ ID NO: 1753 - DNA, 23 bp, Artificial Sequence
  mitotic kinesin microtubule-associated protein Eg5 (Kif11) siRNA
tgctgccagcaagctgcttaaca

SEQ ID NO: 1754 - DNA, 23 bp, Artificial Sequence
  mitotic kinesin microtubule-associated protein Eg5 (Kif11) siRNA
gctgccagcaagctgcttaacac

SEQ ID NO: 1755 - DNA, 23 bp, Artificial Sequence
  mitotic kinesin microtubule-associated protein Eg5 (Kif11) siRNA
ctgccagcaagctgcttaacaca

SEQ ID NO: 1756 - DNA, 23 bp, Artificial Sequence
  mitotic kinesin microtubule-associated protein Eg5 (Kif11) siRNA
tgccagcaagctgcttaacacag

SEQ ID NO: 1757 - DNA, 23 bp, Artificial Sequence
  mitotic kinesin microtubule-associated protein Eg5 (Kif11) siRNA
gccagcaagctgcttaacacagt

SEQ ID NO: 1758 - DNA, 23 bp, Artificial Sequence
  mitotic kinesin microtubule-associated protein Eg5 (Kif11) siRNA
ccagcaagctgcttaacacagtt

SEQ ID NO: 1759 - DNA, 23 bp, Artificial Sequence
  mitotic kinesin microtubule-associated protein Eg5 (Kif11) siRNA
cagcaagctgcttaacacagttg

SEQ ID NO: 1760 - DNA, 23 bp, Artificial Sequence
  mitotic kinesin microtubule-associated protein Eg5 (Kif11) siRNA
agcaagctgcttaacacagttga

SEQ ID NO: 1761 - DNA, 23 bp, Artificial Sequence
  mitotic kinesin microtubule-associated protein Eg5 (Kif11) siRNA
gcaagctgcttaacacagttgaa

SEQ ID NO: 1762 - DNA, 23 bp, Artificial Sequence
  mitotic kinesin microtubule-associated protein Eg5 (Kif11) siRNA
caagctgcttaacacagttgaag

SEQ ID NO: 1763 - DNA, 23 bp, Artificial Sequence
  mitotic kinesin microtubule-associated protein Eg5 (Kif11) siRNA
aagctgcttaacacagttgaaga

SEQ ID NO: 1764 - DNA, 23 bp, Artificial Sequence
  mitotic kinesin microtubule-associated protein Eg5 (Kif11) siRNA
agctgcttaacacagttgaagaa

SEQ ID NO: 1765 - DNA, 23 bp, Artificial Sequence
  mitotic kinesin microtubule-associated protein Eg5 (Kif11) siRNA
gctgcttaacacagttgaagaaa

SEQ ID NO: 1766 - DNA, 23 bp, Artificial Sequence
  mitotic kinesin microtubule-associated protein Eg5 (Kif11) siRNA
ctgcttaacacagttgaagaaac

SEQ ID NO: 1767 - DNA, 23 bp, Artificial Sequence
  mitotic kinesin microtubule-associated protein Eg5 (Kif11) siRNA
tgcttaacacagttgaagaaact

SEQ ID NO: 1768 - DNA, 23 bp, Artificial Sequence
  mitotic kinesin microtubule-associated protein Eg5 (Kif11) siRNA
gcttaacacagttgaagaaacta

SEQ ID NO: 1769 - DNA, 23 bp, Artificial Sequence
  mitotic kinesin microtubule-associated protein Eg5 (Kif11) siRNA
cttaacacagttgaagaaactac

SEQ ID NO: 1770 - DNA, 23 bp, Artificial Sequence
  mitotic kinesin microtubule-associated protein Eg5 (Kif11) siRNA
ttaacacagttgaagaaactaca

SEQ ID NO: 1771 - DNA, 23 bp, Artificial Sequence
  mitotic kinesin microtubule-associated protein Eg5 (Kif11) siRNA
taacacagttgaagaaactacaa

SEQ ID NO: 1772 - DNA, 23 bp, Artificial Sequence
  mitotic kinesin microtubule-associated protein Eg5 (Kif11) siRNA
aacacagttgaagaaactacaaa

SEQ ID NO: 1773 - DNA, 23 bp, Artificial Sequence
  mitotic kinesin microtubule-associated protein Eg5 (Kif11) siRNA
acacagttgaagaaactacaaaa

SEQ ID NO: 1774 - DNA, 23 bp, Artificial Sequence
  mitotic kinesin microtubule-associated protein Eg5 (Kif11) siRNA
cacagttgaagaaactacaaaag

SEQ ID NO: 1775 - DNA, 23 bp, Artificial Sequence
  mitotic kinesin microtubule-associated protein Eg5 (Kif11) siRNA
acagttgaagaaactacaaaaga

SEQ ID NO: 1776 - DNA, 23 bp, Artificial Sequence
  mitotic kinesin microtubule-associated protein Eg5 (Kif11) siRNA
cagttgaagaaactacaaaagat

SEQ ID NO: 1777 - DNA, 23 bp, Artificial Sequence
  mitotic kinesin microtubule-associated protein Eg5 (Kif11) siRNA
agttgaagaaactacaaaagatg

SEQ ID NO: 1778 - DNA, 23 bp, Artificial Sequence
  mitotic kinesin microtubule-associated protein Eg5 (Kif11) siRNA
gttgaagaaactacaaaagatgt

SEQ ID NO: 1779 - DNA, 23 bp, Artificial Sequence
  mitotic kinesin microtubule-associated protein Eg5 (Kif11) siRNA
ttgaagaaactacaaaagatgta

SEQ ID NO: 1780 - DNA, 23 bp, Artificial Sequence
  mitotic kinesin microtubule-associated protein Eg5 (Kif11) siRNA
tgaagaaactacaaaagatgtat

SEQ ID NO: 1781 - DNA, 23 bp, Artificial Sequence
  mitotic kinesin microtubule-associated protein Eg5 (Kif11) siRNA
gaagaaactacaaaagatgtatc

SEQ ID NO: 1782 - DNA, 23 bp, Artificial Sequence
  mitotic kinesin microtubule-associated protein Eg5 (Kif11) siRNA
aagaaactacaaaagatgtatct

SEQ ID NO: 1783 - DNA, 23 bp, Artificial Sequence
  mitotic kinesin microtubule-associated protein Eg5 (Kif11) siRNA
agaaactacaaaagatgtatctg

SEQ ID NO: 1784 - DNA, 23 bp, Artificial Sequence
  mitotic kinesin microtubule-associated protein Eg5 (Kif11) siRNA
gaaactacaaaagatgtatctgg

SEQ ID NO: 1785 - DNA, 23 bp, Artificial Sequence
  mitotic kinesin microtubule-associated protein Eg5 (Kif11) siRNA
aaactacaaaagatgtatctggt

SEQ ID NO: 1786 - DNA, 23 bp, Artificial Sequence
  mitotic kinesin microtubule-associated protein Eg5 (Kif11) siRNA
aactacaaaagatgtatctggtc

SEQ ID NO: 1787 - DNA, 23 bp, Artificial Sequence
  mitotic kinesin microtubule-associated protein Eg5 (Kif11) siRNA
actacaaaagatgtatctggtct

SEQ ID NO: 1788 - DNA, 23 bp, Artificial Sequence
  mitotic kinesin microtubule-associated protein Eg5 (Kif11) siRNA
ctacaaaagatgtatctggtctc

SEQ ID NO: 1789 - DNA, 23 bp, Artificial Sequence
  mitotic kinesin microtubule-associated protein Eg5 (Kif11) siRNA
tacaaaagatgtatctggtctcc

SEQ ID NO: 1790 - DNA, 23 bp, Artificial Sequence
  mitotic kinesin microtubule-associated protein Eg5 (Kif11) siRNA
acaaaagatgtatctggtctcca

SEQ ID NO: 1791 - DNA, 23 bp, Artificial Sequence
  mitotic kinesin microtubule-associated protein Eg5 (Kif11) siRNA
caaaagatgtatctggtctccat

SEQ ID NO: 1792 - DNA, 23 bp, Artificial Sequence
  mitotic kinesin microtubule-associated protein Eg5 (Kif11) siRNA
aaaagatgtatctggtctccatt

SEQ ID NO: 1793 - DNA, 23 bp, Artificial Sequence
  mitotic kinesin microtubule-associated protein Eg5 (Kif11) siRNA
aaagatgtatctggtctccattc

SEQ ID NO: 1794 - DNA, 23 bp, Artificial Sequence
  mitotic kinesin microtubule-associated protein Eg5 (Kif11) siRNA
aagatgtatctggtctccattcc

SEQ ID NO: 1795 - DNA, 23 bp, Artificial Sequence
  mitotic kinesin microtubule-associated protein Eg5 (Kif11) siRNA
agatgtatctggtctccattcca

SEQ ID NO: 1796 - DNA, 23 bp, Artificial Sequence
  mitotic kinesin microtubule-associated protein Eg5 (Kif11) siRNA
gatgtatctggtctccattccaa

SEQ ID NO: 1797 - DNA, 23 bp, Artificial Sequence
  mitotic kinesin microtubule-associated protein Eg5 (Kif11) siRNA
atgtatctggtctccattccaaa

SEQ ID NO: 1798 - DNA, 23 bp, Artificial Sequence
  mitotic kinesin microtubule-associated protein Eg5 (Kif11) siRNA
tgtatctggtctccattccaaac

SEQ ID NO: 1799 - DNA, 23 bp, Artificial Sequence
  mitotic kinesin microtubule-associated protein Eg5 (Kif11) siRNA
gtatctggtctccattccaaact

SEQ ID NO: 1800 - DNA, 23 bp, Artificial Sequence
  mitotic kinesin microtubule-associated protein Eg5 (Kif11) siRNA
tatctggtctccattccaaactg

SEQ ID NO: 1801 - DNA, 23 bp, Artificial Sequence
  mitotic kinesin microtubule-associated protein Eg5 (Kif11) siRNA
atctggtctccattccaaactgg

SEQ ID NO: 1802 - DNA, 23 bp, Artificial Sequence
  mitotic kinesin microtubule-associated protein Eg5 (Kif11) siRNA
tctggtctccattccaaactgga

SEQ ID NO: 1803 - DNA, 23 bp, Artificial Sequence
  mitotic kinesin microtubule-associated protein Eg5 (Kif11) siRNA
ctggtctccattccaaactggat

SEQ ID NO: 1804 - DNA, 23 bp, Artificial Sequence
  mitotic kinesin microtubule-associated protein Eg5 (Kif11) siRNA
tggtctccattccaaactggatc

SEQ ID NO: 1805 - DNA, 23 bp, Artificial Sequence
  mitotic kinesin microtubule-associated protein Eg5 (Kif11) siRNA
ggtctccattccaaactggatcg

SEQ ID NO: 1806 - DNA, 23 bp, Artificial Sequence
  mitotic kinesin microtubule-associated protein Eg5 (Kif11) siRNA
gtctccattccaaactggatcgt

SEQ ID NO: 1807 - DNA, 23 bp, Artificial Sequence
  mitotic kinesin microtubule-associated protein Eg5 (Kif11) siRNA
tctccattccaaactggatcgta

SEQ ID NO: 1808 - DNA, 23 bp, Artificial Sequence
  mitotic kinesin microtubule-associated protein Eg5 (Kif11) siRNA
ctccattccaaactggatcgtaa

SEQ ID NO: 1809 - DNA, 23 bp, Artificial Sequence
  mitotic kinesin microtubule-associated protein Eg5 (Kif11) siRNA
tccattccaaactggatcgtaag

SEQ ID NO: 1810 - DNA, 23 bp, Artificial Sequence
  mitotic kinesin microtubule-associated protein Eg5 (Kif11) siRNA
ccattccaaactggatcgtaaga

SEQ ID NO: 1811 - DNA, 23 bp, Artificial Sequence
  mitotic kinesin microtubule-associated protein Eg5 (Kif11) siRNA
cattccaaactggatcgtaagaa

SEQ ID NO: 1812 - DNA, 23 bp, Artificial Sequence
  mitotic kinesin microtubule-associated protein Eg5 (Kif11) siRNA
attccaaactggatcgtaagaag

SEQ ID NO: 1813 - DNA, 23 bp, Artificial Sequence
  mitotic kinesin microtubule-associated protein Eg5 (Kif11) siRNA
ttccaaactggatcgtaagaagg

SEQ ID NO: 1814 - DNA, 23 bp, Artificial Sequence
  mitotic kinesin microtubule-associated protein Eg5 (Kif11) siRNA
tccaaactggatcgtaagaaggc

SEQ ID NO: 1815 - DNA, 23 bp, Artificial Sequence
  mitotic kinesin microtubule-associated protein Eg5 (Kif11) siRNA
ccaaactggatcgtaagaaggca

SEQ ID NO: 1816 - DNA, 23 bp, Artificial Sequence
  mitotic kinesin microtubule-associated protein Eg5 (Kif11) siRNA
caaactggatcgtaagaaggcag

SEQ ID NO: 1817 - DNA, 23 bp, Artificial Sequence
  mitotic kinesin microtubule-associated protein Eg5 (Kif11) siRNA
aaactggatcgtaagaaggcagt

SEQ ID NO: 1818 - DNA, 23 bp, Artificial Sequence
  mitotic kinesin microtubule-associated protein Eg5 (Kif11) siRNA
aactggatcgtaagaaggcagtt

SEQ ID NO: 1819 - DNA, 23 bp, Artificial Sequence
  mitotic kinesin microtubule-associated protein Eg5 (Kif11) siRNA
actggatcgtaagaaggcagttg

SEQ ID NO: 1820 - DNA, 23 bp, Artificial Sequence
  mitotic kinesin microtubule-associated protein Eg5 (Kif11) siRNA
ctggatcgtaagaaggcagttga

SEQ ID NO: 1821 - DNA, 23 bp, Artificial Sequence
  mitotic kinesin microtubule-associated protein Eg5 (Kif11) siRNA
tggatcgtaagaaggcagttgac

SEQ ID NO: 1822 - DNA, 23 bp, Artificial Sequence
  mitotic kinesin microtubule-associated protein Eg5 (Kif11) siRNA
ggatcgtaagaaggcagttgacc

SEQ ID NO: 1823 - DNA, 23 bp, Artificial Sequence
  mitotic kinesin microtubule-associated protein Eg5 (Kif11) siRNA
gatcgtaagaaggcagttgacca

SEQ ID NO: 1824 - DNA, 23 bp, Artificial Sequence
  mitotic kinesin microtubule-associated protein Eg5 (Kif11) siRNA
atcgtaagaaggcagttgaccaa

SEQ ID NO: 1825 - DNA, 23 bp, Artificial Sequence
  mitotic kinesin microtubule-associated protein Eg5 (Kif11) siRNA
tcgtaagaaggcagttgaccaac

SEQ ID NO: 1826 - DNA, 23 bp, Artificial Sequence
  mitotic kinesin microtubule-associated protein Eg5 (Kif11) siRNA
cgtaagaaggcagttgaccaaca

SEQ ID NO: 1827 - DNA, 23 bp, Artificial Sequence
  mitotic kinesin microtubule-associated protein Eg5 (Kif11) siRNA
gtaagaaggcagttgaccaacac

SEQ ID NO: 1828 - DNA, 23 bp, Artificial Sequence
  mitotic kinesin microtubule-associated protein Eg5 (Kif11) siRNA
taagaaggcagttgaccaacaca

SEQ ID NO: 1829 - DNA, 23 bp, Artificial Sequence
  mitotic kinesin microtubule-associated protein Eg5 (Kif11) siRNA
aagaaggcagttgaccaacacaa

SEQ ID NO: 1830 - DNA, 23 bp, Artificial Sequence
  mitotic kinesin microtubule-associated protein Eg5 (Kif11) siRNA
agaaggcagttgaccaacacaat

SEQ ID NO: 1831 - DNA, 23 bp, Artificial Sequence
  mitotic kinesin microtubule-associated protein Eg5 (Kif11) siRNA
gaaggcagttgaccaacacaatg

SEQ ID NO: 1832 - DNA, 23 bp, Artificial Sequence
  mitotic kinesin microtubule-associated protein Eg5 (Kif11) siRNA
aaggcagttgaccaacacaatgc

SEQ ID NO: 1833 - DNA, 23 bp, Artificial Sequence
  mitotic kinesin microtubule-associated protein Eg5 (Kif11) siRNA
aggcagttgaccaacacaatgca

SEQ ID NO: 1834 - DNA, 23 bp, Artificial Sequence
  mitotic kinesin microtubule-associated protein Eg5 (Kif11) siRNA
ggcagttgaccaacacaatgcag

SEQ ID NO: 1835 - DNA, 23 bp, Artificial Sequence
  mitotic kinesin microtubule-associated protein Eg5 (Kif11) siRNA
gcagttgaccaacacaatgcaga

SEQ ID NO: 1836 - DNA, 23 bp, Artificial Sequence
  mitotic kinesin microtubule-associated protein Eg5 (Kif11) siRNA
cagttgaccaacacaatgcagaa

SEQ ID NO: 1837 - DNA, 23 bp, Artificial Sequence
  mitotic kinesin microtubule-associated protein Eg5 (Kif11) siRNA
agttgaccaacacaatgcagaag

SEQ ID NO: 1838 - DNA, 23 bp, Artificial Sequence
  mitotic kinesin microtubule-associated protein Eg5 (Kif11) siRNA
gttgaccaacacaatgcagaagc

SEQ ID NO: 1839 - DNA, 23 bp, Artificial Sequence
  mitotic kinesin microtubule-associated protein Eg5 (Kif11) siRNA
ttgaccaacacaatgcagaagct

SEQ ID NO: 1840 - DNA, 23 bp, Artificial Sequence
  mitotic kinesin microtubule-associated protein Eg5 (Kif11) siRNA
tgaccaacacaatgcagaagctc

SEQ ID NO: 1841 - DNA, 23 bp, Artificial Sequence
  mitotic kinesin microtubule-associated protein Eg5 (Kif11) siRNA
gaccaacacaatgcagaagctca

SEQ ID NO: 1842 - DNA, 23 bp, Artificial Sequence
  mitotic kinesin microtubule-associated protein Eg5 (Kif11) siRNA
accaacacaatgcagaagctcag

SEQ ID NO: 1843 - DNA, 23 bp, Artificial Sequence
  mitotic kinesin microtubule-associated protein Eg5 (Kif11) siRNA
ccaacacaatgcagaagctcagg

SEQ ID NO: 1844 - DNA, 23 bp, Artificial Sequence
  mitotic kinesin microtubule-associated protein Eg5 (Kif11) siRNA
caacacaatgcagaagctcagga

SEQ ID NO: 1845 - DNA, 23 bp, Artificial Sequence
  mitotic kinesin microtubule-associated protein Eg5 (Kif11) siRNA
aacacaatgcagaagctcaggat

SEQ ID NO: 1846 - DNA, 23 bp, Artificial Sequence
  mitotic kinesin microtubule-associated protein Eg5 (Kif11) siRNA
acacaatgcagaagctcaggata

SEQ ID NO: 1847 - DNA, 23 bp, Artificial Sequence
  mitotic kinesin microtubule-associated protein Eg5 (Kif11) siRNA
cacaatgcagaagctcaggatat

SEQ ID NO: 1848 - DNA, 23 bp, Artificial Sequence
  mitotic kinesin microtubule-associated protein Eg5 (Kif11) siRNA
acaatgcagaagctcaggatatt

SEQ ID NO: 1849 - DNA, 23 bp, Artificial Sequence
  mitotic kinesin microtubule-associated protein Eg5 (Kif11) siRNA
caatgcagaagctcaggatattt

SEQ ID NO: 1850 - DNA, 23 bp, Artificial Sequence
  mitotic kinesin microtubule-associated protein Eg5 (Kif11) siRNA
aatgcagaagctcaggatatttt

SEQ ID NO: 1851 - DNA, 23 bp, Artificial Sequence
  mitotic kinesin microtubule-associated protein Eg5 (Kif11) siRNA
atgcagaagctcaggatattttt

SEQ ID NO: 1852 - DNA, 23 bp, Artificial Sequence
  mitotic kinesin microtubule-associated protein Eg5 (Kif11) siRNA
tgcagaagctcaggatatttttg

SEQ ID NO: 1853 - DNA, 23 bp, Artificial Sequence
  mitotic kinesin microtubule-associated protein Eg5 (Kif11) siRNA
gcagaagctcaggatatttttgg

SEQ ID NO: 1854 - DNA, 23 bp, Artificial Sequence
  mitotic kinesin microtubule-associated protein Eg5 (Kif11) siRNA
cagaagctcaggatatttttggc

SEQ ID NO: 1855 - DNA, 23 bp, Artificial Sequence
  mitotic kinesin microtubule-associated protein Eg5 (Kif11) siRNA
agaagctcaggatatttttggca

SEQ ID NO: 1856 - DNA, 23 bp, Artificial Sequence
  mitotic kinesin microtubule-associated protein Eg5 (Kif11) siRNA
gaagctcaggatatttttggcaa

SEQ ID NO: 1857 - DNA, 23 bp, Artificial Sequence
  mitotic kinesin microtubule-associated protein Eg5 (Kif11) siRNA
aagctcaggatatttttggcaaa

SEQ ID NO: 1858 - DNA, 23 bp, Artificial Sequence
  mitotic kinesin microtubule-associated protein Eg5 (Kif11) siRNA
agctcaggatatttttggcaaaa

SEQ ID NO: 1859 - DNA, 23 bp, Artificial Sequence
  mitotic kinesin microtubule-associated protein Eg5 (Kif11) siRNA
gctcaggatatttttggcaaaaa

SEQ ID NO: 1860 - DNA, 23 bp, Artificial Sequence
  mitotic kinesin microtubule-associated protein Eg5 (Kif11) siRNA
ctcaggatatttttggcaaaaac

SEQ ID NO: 1861 - DNA, 23 bp, Artificial Sequence
  mitotic kinesin microtubule-associated protein Eg5 (Kif11) siRNA
tcaggatatttttggcaaaaacc

SEQ ID NO: 1862 - DNA, 23 bp, Artificial Sequence
  mitotic kinesin microtubule-associated protein Eg5 (Kif11) siRNA
caggatatttttggcaaaaacct

SEQ ID NO: 1863 - DNA, 23 bp, Artificial Sequence
  mitotic kinesin microtubule-associated protein Eg5 (Kif11) siRNA
aggatatttttggcaaaaacctg

SEQ ID NO: 1864 - DNA, 23 bp, Artificial Sequence
  mitotic kinesin microtubule-associated protein Eg5 (Kif11) siRNA
ggatatttttggcaaaaacctga

SEQ ID NO: 1865 - DNA, 23 bp, Artificial Sequence
  mitotic kinesin microtubule-associated protein Eg5 (Kif11) siRNA
gatatttttggcaaaaacctgaa

SEQ ID NO: 1866 - DNA, 23 bp, Artificial Sequence
  mitotic kinesin microtubule-associated protein Eg5 (Kif11) siRNA
atatttttggcaaaaacctgaat

SEQ ID NO: 1867 - DNA, 23 bp, Artificial Sequence
  mitotic kinesin microtubule-associated protein Eg5 (Kif11) siRNA
tatttttggcaaaaacctgaata

SEQ ID NO: 1868 - DNA, 23 bp, Artificial Sequence
  mitotic kinesin microtubule-associated protein Eg5 (Kif11) siRNA
atttttggcaaaaacctgaatag

SEQ ID NO: 1869 - DNA, 23 bp, Artificial Sequence
  mitotic kinesin microtubule-associated protein Eg5 (Kif11) siRNA
tttttggcaaaaacctgaatagt

SEQ ID NO: 1870 - DNA, 23 bp, Artificial Sequence
  mitotic kinesin microtubule-associated protein Eg5 (Kif11) siRNA
ttttggcaaaaacctgaatagtc

SEQ ID NO: 1871 - DNA, 23 bp, Artificial Sequence
  mitotic kinesin microtubule-associated protein Eg5 (Kif11) siRNA
tttggcaaaaacctgaatagtct

SEQ ID NO: 1872 - DNA, 23 bp, Artificial Sequence
  mitotic kinesin microtubule-associated protein Eg5 (Kif11) siRNA
ttggcaaaaacctgaatagtctg

SEQ ID NO: 1873 - DNA, 23 bp, Artificial Sequence
  mitotic kinesin microtubule-associated protein Eg5 (Kif11) siRNA
tggcaaaaacctgaatagtctgt

SEQ ID NO: 1874 - DNA, 23 bp, Artificial Sequence
  mitotic kinesin microtubule-associated protein Eg5 (Kif11) siRNA
ggcaaaaacctgaatagtctgtt

SEQ ID NO: 1875 - DNA, 23 bp, Artificial Sequence
  mitotic kinesin microtubule-associated protein Eg5 (Kif11) siRNA
gcaaaaacctgaatagtctgttt

SEQ ID NO: 1876 - DNA, 23 bp, Artificial Sequence
  mitotic kinesin microtubule-associated protein Eg5 (Kif11) siRNA
caaaaacctgaatagtctgttta

SEQ ID NO: 1877 - DNA, 23 bp, Artificial Sequence
  mitotic kinesin microtubule-associated protein Eg5 (Kif11) siRNA
aaaaacctgaatagtctgtttaa

SEQ ID NO: 1878 - DNA, 23 bp, Artificial Sequence
  mitotic kinesin microtubule-associated protein Eg5 (Kif11) siRNA
aaaacctgaatagtctgtttaat

SEQ ID NO: 1879 - DNA, 23 bp, Artificial Sequence
  mitotic kinesin microtubule-associated protein Eg5 (Kif11) siRNA
aaacctgaatagtctgtttaata

SEQ ID NO: 1880 - DNA, 23 bp, Artificial Sequence
  mitotic kinesin microtubule-associated protein Eg5 (Kif11) siRNA
aacctgaatagtctgtttaataa

SEQ ID NO: 1881 - DNA, 23 bp, Artificial Sequence
  mitotic kinesin microtubule-associated protein Eg5 (Kif11) siRNA
acctgaatagtctgtttaataat

SEQ ID NO: 1882 - DNA, 23 bp, Artificial Sequence
  mitotic kinesin microtubule-associated protein Eg5 (Kif11) siRNA
cctgaatagtctgtttaataata

SEQ ID NO: 1883 - DNA, 23 bp, Artificial Sequence
  mitotic kinesin microtubule-associated protein Eg5 (Kif11) siRNA
ctgaatagtctgtttaataatat

SEQ ID NO: 1884 - DNA, 23 bp, Artificial Sequence
  mitotic kinesin microtubule-associated protein Eg5 (Kif11) siRNA
tgaatagtctgtttaataatatg

SEQ ID NO: 1885 - DNA, 23 bp, Artificial Sequence
  mitotic kinesin microtubule-associated protein Eg5 (Kif11) siRNA
gaatagtctgtttaataatatgg

SEQ ID NO: 1886 - DNA, 23 bp, Artificial Sequence
  mitotic kinesin microtubule-associated protein Eg5 (Kif11) siRNA
aatagtctgtttaataatatgga

SEQ ID NO: 1887 - DNA, 23 bp, Artificial Sequence
  mitotic kinesin microtubule-associated protein Eg5 (Kif11) siRNA
atagtctgtttaataatatggaa

SEQ ID NO: 1888 - DNA, 23 bp, Artificial Sequence
  mitotic kinesin microtubule-associated protein Eg5 (Kif11) siRNA
tagtctgtttaataatatggaag

SEQ ID NO: 1889 - DNA, 23 bp, Artificial Sequence
  mitotic kinesin microtubule-associated protein Eg5 (Kif11) siRNA
agtctgtttaataatatggaaga

SEQ ID NO: 1890 - DNA, 23 bp, Artificial Sequence
  mitotic kinesin microtubule-associated protein Eg5 (Kif11) siRNA
gtctgtttaataatatggaagaa

SEQ ID NO: 1891 - DNA, 23 bp, Artificial Sequence
  mitotic kinesin microtubule-associated protein Eg5 (Kif11) siRNA
tctgtttaataatatggaagaat

SEQ ID NO: 1892 - DNA, 23 bp, Artificial Sequence
  mitotic kinesin microtubule-associated protein Eg5 (Kif11) siRNA
ctgtttaataatatggaagaatt

SEQ ID NO: 1893 - DNA, 23 bp, Artificial Sequence
  mitotic kinesin microtubule-associated protein Eg5 (Kif11) siRNA
tgtttaataatatggaagaatta

SEQ ID NO: 1894 - DNA, 23 bp, Artificial Sequence
  mitotic kinesin microtubule-associated protein Eg5 (Kif11) siRNA
gtttaataatatggaagaattaa

SEQ ID NO: 1895 - DNA, 23 bp, Artificial Sequence
  mitotic kinesin microtubule-associated protein Eg5 (Kif11) siRNA
tttaataatatggaagaattaat

SEQ ID NO: 1896 - DNA, 23 bp, Artificial Sequence
  mitotic kinesin microtubule-associated protein Eg5 (Kif11) siRNA
ttaataatatggaagaattaatt

SEQ ID NO: 1897 - DNA, 23 bp, Artificial Sequence
  mitotic kinesin microtubule-associated protein Eg5 (Kif11) siRNA
taataatatggaagaattaatta

SEQ ID NO: 1898 - DNA, 23 bp, Artificial Sequence
  mitotic kinesin microtubule-associated protein Eg5 (Kif11) siRNA
aataatatggaagaattaattaa

SEQ ID NO: 1899 - DNA, 23 bp, Artificial Sequence
  mitotic kinesin microtubule-associated protein Eg5 (Kif11) siRNA
ataatatggaagaattaattaag

SEQ ID NO: 1900 - DNA, 23 bp, Artificial Sequence
  mitotic kinesin microtubule-associated protein Eg5 (Kif11) siRNA
taatatggaagaattaattaagg

SEQ ID NO: 1901 - DNA, 23 bp, Artificial Sequence
  mitotic kinesin microtubule-associated protein Eg5 (Kif11) siRNA
aatatggaagaattaattaagga

SEQ ID NO: 1902 - DNA, 23 bp, Artificial Sequence
  mitotic kinesin microtubule-associated protein Eg5 (Kif11) siRNA
atatggaagaattaattaaggat

SEQ ID NO: 1903 - DNA, 23 bp, Artificial Sequence
  mitotic kinesin microtubule-associated protein Eg5 (Kif11) siRNA
tatggaagaattaattaaggatg

SEQ ID NO: 1904 - DNA, 23 bp, Artificial Sequence
  mitotic kinesin microtubule-associated protein Eg5 (Kif11) siRNA
atggaagaattaattaaggatgg

SEQ ID NO: 1905 - DNA, 23 bp, Artificial Sequence
  mitotic kinesin microtubule-associated protein Eg5 (Kif11) siRNA
tggaagaattaattaaggatggc

SEQ ID NO: 1906 - DNA, 23 bp, Artificial Sequence
  mitotic kinesin microtubule-associated protein Eg5 (Kif11) siRNA
ggaagaattaattaaggatggca

SEQ ID NO: 1907 - DNA, 23 bp, Artificial Sequence
  mitotic kinesin microtubule-associated protein Eg5 (Kif11) siRNA
gaagaattaattaaggatggcag

SEQ ID NO: 1908 - DNA, 23 bp, Artificial Sequence
  mitotic kinesin microtubule-associated protein Eg5 (Kif11) siRNA
aagaattaattaaggatggcagc

SEQ ID NO: 1909 - DNA, 23 bp, Artificial Sequence
  mitotic kinesin microtubule-associated protein Eg5 (Kif11) siRNA
agaattaattaaggatggcagct

SEQ ID NO: 1910 - DNA, 23 bp, Artificial Sequence
  mitotic kinesin microtubule-associated protein Eg5 (Kif11) siRNA
gaattaattaaggatggcagctc

SEQ ID NO: 1911 - DNA, 23 bp, Artificial Sequence
  mitotic kinesin microtubule-associated protein Eg5 (Kif11) siRNA
aattaattaaggatggcagctca

SEQ ID NO: 1912 - DNA, 23 bp, Artificial Sequence
  mitotic kinesin microtubule-associated protein Eg5 (Kif11) siRNA
attaattaaggatggcagctcaa

SEQ ID NO: 1913 - DNA, 23 bp, Artificial Sequence
  mitotic kinesin microtubule-associated protein Eg5 (Kif11) siRNA
ttaattaaggatggcagctcaaa

SEQ ID NO: 1914 - DNA, 23 bp, Artificial Sequence
  mitotic kinesin microtubule-associated protein Eg5 (Kif11) siRNA
taattaaggatggcagctcaaag

SEQ ID NO: 1915 - DNA, 23 bp, Artificial Sequence
  mitotic kinesin microtubule-associated protein Eg5 (Kif11) siRNA
aattaaggatggcagctcaaagc

SEQ ID NO: 1916 - DNA, 23 bp, Artificial Sequence
  mitotic kinesin microtubule-associated protein Eg5 (Kif11) siRNA
attaaggatggcagctcaaagca

SEQ ID NO: 1917 - DNA, 23 bp, Artificial Sequence
  mitotic kinesin microtubule-associated protein Eg5 (Kif11) siRNA
ttaaggatggcagctcaaagcaa

SEQ ID NO: 1918 - DNA, 23 bp, Artificial Sequence
  mitotic kinesin microtubule-associated protein Eg5 (Kif11) siRNA
taaggatggcagctcaaagcaaa

SEQ ID NO: 1919 - DNA, 23 bp, Artificial Sequence
  mitotic kinesin microtubule-associated protein Eg5 (Kif11) siRNA
aaggatggcagctcaaagcaaaa

SEQ ID NO: 1920 - DNA, 23 bp, Artificial Sequence
  mitotic kinesin microtubule-associated protein Eg5 (Kif11) siRNA
aggatggcagctcaaagcaaaag

SEQ ID NO: 1921 - DNA, 23 bp, Artificial Sequence
  mitotic kinesin microtubule-associated protein Eg5 (Kif11) siRNA
ggatggcagctcaaagcaaaagg

SEQ ID NO: 1922 - DNA, 23 bp, Artificial Sequence
  mitotic kinesin microtubule-associated protein Eg5 (Kif11) siRNA
gatggcagctcaaagcaaaaggc

SEQ ID NO: 1923 - DNA, 23 bp, Artificial Sequence
  mitotic kinesin microtubule-associated protein Eg5 (Kif11) siRNA
atggcagctcaaagcaaaaggcc

SEQ ID NO: 1924 - DNA, 23 bp, Artificial Sequence
  mitotic kinesin microtubule-associated protein Eg5 (Kif11) siRNA
tggcagctcaaagcaaaaggcca

SEQ ID NO: 1925 - DNA, 23 bp, Artificial Sequence
  mitotic kinesin microtubule-associated protein Eg5 (Kif11) siRNA
ggcagctcaaagcaaaaggccat

SEQ ID NO: 1926 - DNA, 23 bp, Artificial Sequence
  mitotic kinesin microtubule-associated protein Eg5 (Kif11) siRNA
gcagctcaaagcaaaaggccatg

SEQ ID NO: 1927 - DNA, 23 bp, Artificial Sequence
  mitotic kinesin microtubule-associated protein Eg5 (Kif11) siRNA
cagctcaaagcaaaaggccatgc

SEQ ID NO: 1928 - DNA, 23 bp, Artificial Sequence
  mitotic kinesin microtubule-associated protein Eg5 (Kif11) siRNA
agctcaaagcaaaaggccatgct

SEQ ID NO: 1929 - DNA, 23 bp, Artificial Sequence
  mitotic kinesin microtubule-associated protein Eg5 (Kif11) siRNA
gctcaaagcaaaaggccatgcta

SEQ ID NO: 1930 - DNA, 23 bp, Artificial Sequence
  mitotic kinesin microtubule-associated protein Eg5 (Kif11) siRNA
ctcaaagcaaaaggccatgctag

SEQ ID NO: 1931 - DNA, 23 bp, Artificial Sequence
  mitotic kinesin microtubule-associated protein Eg5 (Kif11) siRNA
tcaaagcaaaaggccatgctaga

SEQ ID NO: 1932 - DNA, 23 bp, Artificial Sequence
  mitotic kinesin microtubule-associated protein Eg5 (Kif11) siRNA
caaagcaaaaggccatgctagaa

SEQ ID NO: 1933 - DNA, 23 bp, Artificial Sequence
  mitotic kinesin microtubule-associated protein Eg5 (Kif11) siRNA
aaagcaaaaggccatgctagaag

SEQ ID NO: 1934 - DNA, 23 bp, Artificial Sequence
  mitotic kinesin microtubule-associated protein Eg5 (Kif11) siRNA
aagcaaaaggccatgctagaagt

SEQ ID NO: 1935 - DNA, 23 bp, Artificial Sequence
  mitotic kinesin microtubule-associated protein Eg5 (Kif11) siRNA
agcaaaaggccatgctagaagta

SEQ ID NO: 1936 - DNA, 23 bp, Artificial Sequence
  mitotic kinesin microtubule-associated protein Eg5 (Kif11) siRNA
gcaaaaggccatgctagaagtac

SEQ ID NO: 1937 - DNA, 23 bp, Artificial Sequence
  mitotic kinesin microtubule-associated protein Eg5 (Kif11) siRNA
caaaaggccatgctagaagtaca

SEQ ID NO: 1938 - DNA, 23 bp, Artificial Sequence
  mitotic kinesin microtubule-associated protein Eg5 (Kif11) siRNA
aaaaggccatgctagaagtacat

SEQ ID NO: 1939 - DNA, 23 bp, Artificial Sequence
  mitotic kinesin microtubule-associated protein Eg5 (Kif11) siRNA
aaaggccatgctagaagtacata

SEQ ID NO: 1940 - DNA, 23 bp, Artificial Sequence
  mitotic kinesin microtubule-associated protein Eg5 (Kif11) siRNA
aaggccatgctagaagtacataa

SEQ ID NO: 1941 - DNA, 23 bp, Artificial Sequence
  mitotic kinesin microtubule-associated protein Eg5 (Kif11) siRNA
aggccatgctagaagtacataag

SEQ ID NO: 1942 - DNA, 23 bp, Artificial Sequence
  mitotic kinesin microtubule-associated protein Eg5 (Kif11) siRNA
ggccatgctagaagtacataaga

SEQ ID NO: 1943 - DNA, 23 bp, Artificial Sequence
  mitotic kinesin microtubule-associated protein Eg5 (Kif11) siRNA
gccatgctagaagtacataagac

SEQ ID NO: 1944 - DNA, 23 bp, Artificial Sequence
  mitotic kinesin microtubule-associated protein Eg5 (Kif11) siRNA
ccatgctagaagtacataagacc

SEQ ID NO: 1945 - DNA, 23 bp, Artificial Sequence
  mitotic kinesin microtubule-associated protein Eg5 (Kif11) siRNA
catgctagaagtacataagacct

SEQ ID NO: 1946 - DNA, 23 bp, Artificial Sequence
  mitotic kinesin microtubule-associated protein Eg5 (Kif11) siRNA
atgctagaagtacataagacctt

SEQ ID NO: 1947 - DNA, 23 bp, Artificial Sequence
  mitotic kinesin microtubule-associated protein Eg5 (Kif11) siRNA
tgctagaagtacataagacctta

SEQ ID NO: 1948 - DNA, 23 bp, Artificial Sequence
  mitotic kinesin microtubule-associated protein Eg5 (Kif11) siRNA
gctagaagtacataagaccttat

SEQ ID NO: 1949 - DNA, 23 bp, Artificial Sequence
  mitotic kinesin microtubule-associated protein Eg5 (Kif11) siRNA
ctagaagtacataagaccttatt

SEQ ID NO: 1950 - DNA, 23 bp, Artificial Sequence
  mitotic kinesin microtubule-associated protein Eg5 (Kif11) siRNA
tagaagtacataagaccttattt

SEQ ID NO: 1951 - DNA, 23 bp, Artificial Sequence
  mitotic kinesin microtubule-associated protein Eg5 (Kif11) siRNA
agaagtacataagaccttatttg

SEQ ID NO: 1952 - DNA, 23 bp, Artificial Sequence
  mitotic kinesin microtubule-associated protein Eg5 (Kif11) siRNA
gaagtacataagaccttatttgg

SEQ ID NO: 1953 - DNA, 23 bp, Artificial Sequence
  mitotic kinesin microtubule-associated protein Eg5 (Kif11) siRNA
aagtacataagaccttatttggt

SEQ ID NO: 1954 - DNA, 23 bp, Artificial Sequence
  mitotic kinesin microtubule-associated protein Eg5 (Kif11) siRNA
agtacataagaccttatttggta

SEQ ID NO: 1955 - DNA, 23 bp, Artificial Sequence
  mitotic kinesin microtubule-associated protein Eg5 (Kif11) siRNA
gtacataagaccttatttggtaa

SEQ ID NO: 1956 - DNA, 23 bp, Artificial Sequence
  mitotic kinesin microtubule-associated protein Eg5 (Kif11) siRNA
tacataagaccttatttggtaat

SEQ ID NO: 1957 - DNA, 23 bp, Artificial Sequence
  mitotic kinesin microtubule-associated protein Eg5 (Kif11) siRNA
acataagaccttatttggtaatc

SEQ ID NO: 1958 - DNA, 23 bp, Artificial Sequence
  mitotic kinesin microtubule-associated protein Eg5 (Kif11) siRNA
cataagaccttatttggtaatct

SEQ ID NO: 1959 - DNA, 23 bp, Artificial Sequence
  mitotic kinesin microtubule-associated protein Eg5 (Kif11) siRNA
ataagaccttatttggtaatctg

SEQ ID NO: 1960 - DNA, 23 bp, Artificial Sequence
  mitotic kinesin microtubule-associated protein Eg5 (Kif11) siRNA
taagaccttatttggtaatctgc

SEQ ID NO: 1961 - DNA, 23 bp, Artificial Sequence
  mitotic kinesin microtubule-associated protein Eg5 (Kif11) siRNA
aagaccttatttggtaatctgct

SEQ ID NO: 1962 - DNA, 23 bp, Artificial Sequence
  mitotic kinesin microtubule-associated protein Eg5 (Kif11) siRNA
agaccttatttggtaatctgctg

SEQ ID NO: 1963 - DNA, 23 bp, Artificial Sequence
  mitotic kinesin microtubule-associated protein Eg5 (Kif11) siRNA
gaccttatttggtaatctgctgt

SEQ ID NO: 1964 - DNA, 23 bp, Artificial Sequence
  mitotic kinesin microtubule-associated protein Eg5 (Kif11) siRNA
accttatttggtaatctgctgtc

SEQ ID NO: 1965 - DNA, 23 bp, Artificial Sequence
  mitotic kinesin microtubule-associated protein Eg5 (Kif11) siRNA
ccttatttggtaatctgctgtct

SEQ ID NO: 1966 - DNA, 23 bp, Artificial Sequence
  mitotic kinesin microtubule-associated protein Eg5 (Kif11) siRNA
cttatttggtaatctgctgtctt

SEQ ID NO: 1967 - DNA, 23 bp, Artificial Sequence
  mitotic kinesin microtubule-associated protein Eg5 (Kif11) siRNA
ttatttggtaatctgctgtcttc

SEQ ID NO: 1968 - DNA, 23 bp, Artificial Sequence
  mitotic kinesin microtubule-associated protein Eg5 (Kif11) siRNA
tatttggtaatctgctgtcttcc

SEQ ID NO: 1969 - DNA, 23 bp, Artificial Sequence
  mitotic kinesin microtubule-associated protein Eg5 (Kif11) siRNA
atttggtaatctgctgtcttcca

SEQ ID NO: 1970 - DNA, 23 bp, Artificial Sequence
  mitotic kinesin microtubule-associated protein Eg5 (Kif11) siRNA
tttggtaatctgctgtcttccag

SEQ ID NO: 1971 - DNA, 23 bp, Artificial Sequence
  mitotic kinesin microtubule-associated protein Eg5 (Kif11) siRNA
ttggtaatctgctgtcttccagt

SEQ ID NO: 1972 - DNA, 23 bp, Artificial Sequence
  mitotic kinesin microtubule-associated protein Eg5 (Kif11) siRNA
tggtaatctgctgtcttccagtg

SEQ ID NO: 1973 - DNA, 23 bp, Artificial Sequence
  mitotic kinesin microtubule-associated protein Eg5 (Kif11) siRNA
ggtaatctgctgtcttccagtgt

SEQ ID NO: 1974 - DNA, 23 bp, Artificial Sequence
  mitotic kinesin microtubule-associated protein Eg5 (Kif11) siRNA
gtaatctgctgtcttccagtgtc

SEQ ID NO: 1975 - DNA, 23 bp, Artificial Sequence
  mitotic kinesin microtubule-associated protein Eg5 (Kif11) siRNA
taatctgctgtcttccagtgtct

SEQ ID NO: 1976 - DNA, 23 bp, Artificial Sequence
  mitotic kinesin microtubule-associated protein Eg5 (Kif11) siRNA
aatctgctgtcttccagtgtctc

SEQ ID NO: 1977 - DNA, 23 bp, Artificial Sequence
  mitotic kinesin microtubule-associated protein Eg5 (Kif11) siRNA
atctgctgtcttccagtgtctct

SEQ ID NO: 1978 - DNA, 23 bp, Artificial Sequence
  mitotic kinesin microtubule-associated protein Eg5 (Kif11) siRNA
tctgctgtcttccagtgtctctg

SEQ ID NO: 1979 - DNA, 23 bp, Artificial Sequence
  mitotic kinesin microtubule-associated protein Eg5 (Kif11) siRNA
ctgctgtcttccagtgtctctgc

SEQ ID NO: 1980 - DNA, 23 bp, Artificial Sequence
  mitotic kinesin microtubule-associated protein Eg5 (Kif11) siRNA
tgctgtcttccagtgtctctgca

SEQ ID NO: 1981 - DNA, 23 bp, Artificial Sequence
  mitotic kinesin microtubule-associated protein Eg5 (Kif11) siRNA
gctgtcttccagtgtctctgcat

SEQ ID NO: 1982 - DNA, 23 bp, Artificial Sequence
  mitotic kinesin microtubule-associated protein Eg5 (Kif11) siRNA
ctgtcttccagtgtctctgcatt

SEQ ID NO: 1983 - DNA, 23 bp, Artificial Sequence
  mitotic kinesin microtubule-associated protein Eg5 (Kif11) siRNA
tgtcttccagtgtctctgcatta

SEQ ID NO: 1984 - DNA, 23 bp, Artificial Sequence
  mitotic kinesin microtubule-associated protein Eg5 (Kif11) siRNA
gtcttccagtgtctctgcattag

SEQ ID NO: 1985 - DNA, 23 bp, Artificial Sequence
  mitotic kinesin microtubule-associated protein Eg5 (Kif11) siRNA
tcttccagtgtctctgcattaga

SEQ ID NO: 1986 - DNA, 23 bp, Artificial Sequence
  mitotic kinesin microtubule-associated protein Eg5 (Kif11) siRNA
cttccagtgtctctgcattagat

SEQ ID NO: 1987 - DNA, 23 bp, Artificial Sequence
  mitotic kinesin microtubule-associated protein Eg5 (Kif11) siRNA
ttccagtgtctctgcattagata

SEQ ID NO: 1988 - DNA, 23 bp, Artificial Sequence
  mitotic kinesin microtubule-associated protein Eg5 (Kif11) siRNA
tccagtgtctctgcattagatac

SEQ ID NO: 1989 - DNA, 23 bp, Artificial Sequence
  mitotic kinesin microtubule-associated protein Eg5 (Kif11) siRNA
ccagtgtctctgcattagatacc

SEQ ID NO: 1990 - DNA, 23 bp, Artificial Sequence
  mitotic kinesin microtubule-associated protein Eg5 (Kif11) siRNA
cagtgtctctgcattagatacca

SEQ ID NO: 1991 - DNA, 23 bp, Artificial Sequence
  mitotic kinesin microtubule-associated protein Eg5 (Kif11) siRNA
agtgtctctgcattagataccat

SEQ ID NO: 1992 - DNA, 23 bp, Artificial Sequence
  mitotic kinesin microtubule-associated protein Eg5 (Kif11) siRNA
gtgtctctgcattagataccatt

SEQ ID NO: 1993 - DNA, 23 bp, Artificial Sequence
  mitotic kinesin microtubule-associated protein Eg5 (Kif11) siRNA
tgtctctgcattagataccatta

SEQ ID NO: 1994 - DNA, 23 bp, Artificial Sequence
  mitotic kinesin microtubule-associated protein Eg5 (Kif11) siRNA
gtctctgcattagataccattac

SEQ ID NO: 1995 - DNA, 23 bp, Artificial Sequence
  mitotic kinesin microtubule-associated protein Eg5 (Kif11) siRNA
tctctgcattagataccattact

SEQ ID NO: 1996 - DNA, 23 bp, Artificial Sequence
  mitotic kinesin microtubule-associated protein Eg5 (Kif11) siRNA
ctctgcattagataccattacta

SEQ ID NO: 1997 - DNA, 23 bp, Artificial Sequence
  mitotic kinesin microtubule-associated protein Eg5 (Kif11) siRNA
tctgcattagataccattactac

SEQ ID NO: 1998 - DNA, 23 bp, Artificial Sequence
  mitotic kinesin microtubule-associated protein Eg5 (Kif11) siRNA
ctgcattagataccattactaca

SEQ ID NO: 1999 - DNA, 23 bp, Artificial Sequence
  mitotic kinesin microtubule-associated protein Eg5 (Kif11) siRNA
tgcattagataccattactacag

SEQ ID NO: 2000 - DNA, 23 bp, Artificial Sequence
  mitotic kinesin microtubule-associated protein Eg5 (Kif11) siRNA
gcattagataccattactacagt

SEQ ID NO: 2001 - DNA, 23 bp, Artificial Sequence
  mitotic kinesin microtubule-associated protein Eg5 (Kif11) siRNA
cattagataccattactacagta

SEQ ID NO: 2002 - DNA, 23 bp, Artificial Sequence
  mitotic kinesin microtubule-associated protein Eg5 (Kif11) siRNA
attagataccattactacagtag

SEQ ID NO: 2003 - DNA, 23 bp, Artificial Sequence
  mitotic kinesin microtubule-associated protein Eg5 (Kif11) siRNA
ttagataccattactacagtagc

SEQ ID NO: 2004 - DNA, 23 bp, Artificial Sequence
  mitotic kinesin microtubule-associated protein Eg5 (Kif11) siRNA
tagataccattactacagtagca

SEQ ID NO: 2005 - DNA, 23 bp, Artificial Sequence
  mitotic kinesin microtubule-associated protein Eg5 (Kif11) siRNA
agataccattactacagtagcac

SEQ ID NO: 2006 - DNA, 23 bp, Artificial Sequence
  mitotic kinesin microtubule-associated protein Eg5 (Kif11) siRNA
gataccattactacagtagcact

SEQ ID NO: 2007 - DNA, 23 bp, Artificial Sequence
  mitotic kinesin microtubule-associated protein Eg5 (Kif11) siRNA
ataccattactacagtagcactt

SEQ ID NO: 2008 - DNA, 23 bp, Artificial Sequence
  mitotic kinesin microtubule-associated protein Eg5 (Kif11) siRNA
taccattactacagtagcacttg

SEQ ID NO: 2009 - DNA, 23 bp, Artificial Sequence
  mitotic kinesin microtubule-associated protein Eg5 (Kif11) siRNA
accattactacagtagcacttgg

SEQ ID NO: 2010 - DNA, 23 bp, Artificial Sequence
  mitotic kinesin microtubule-associated protein Eg5 (Kif11) siRNA
ccattactacagtagcacttgga

SEQ ID NO: 2011 - DNA, 23 bp, Artificial Sequence
  mitotic kinesin microtubule-associated protein Eg5 (Kif11) siRNA
cattactacagtagcacttggat

SEQ ID NO: 2012 - DNA, 23 bp, Artificial Sequence
  mitotic kinesin microtubule-associated protein Eg5 (Kif11) siRNA
attactacagtagcacttggatc

SEQ ID NO: 2013 - DNA, 23 bp, Artificial Sequence
  mitotic kinesin microtubule-associated protein Eg5 (Kif11) siRNA
ttactacagtagcacttggatct

SEQ ID NO: 2014 - DNA, 23 bp, Artificial Sequence
  mitotic kinesin microtubule-associated protein Eg5 (Kif11) siRNA
tactacagtagcacttggatctc

SEQ ID NO: 2015 - DNA, 23 bp, Artificial Sequence
  mitotic kinesin microtubule-associated protein Eg5 (Kif11) siRNA
actacagtagcacttggatctct

SEQ ID NO: 2016 - DNA, 23 bp, Artificial Sequence
  mitotic kinesin microtubule-associated protein Eg5 (Kif11) siRNA
ctacagtagcacttggatctctc

SEQ ID NO: 2017 - DNA, 23 bp, Artificial Sequence
  mitotic kinesin microtubule-associated protein Eg5 (Kif11) siRNA
tacagtagcacttggatctctca

SEQ ID NO: 2018 - DNA, 23 bp, Artificial Sequence
  mitotic kinesin microtubule-associated protein Eg5 (Kif11) siRNA
acagtagcacttggatctctcac

SEQ ID NO: 2019 - DNA, 23 bp, Artificial Sequence
  mitotic kinesin microtubule-associated protein Eg5 (Kif11) siRNA
cagtagcacttggatctctcaca

SEQ ID NO: 2020 - DNA, 23 bp, Artificial Sequence
  mitotic kinesin microtubule-associated protein Eg5 (Kif11) siRNA
agtagcacttggatctctcacat

SEQ ID NO: 2021 - DNA, 23 bp, Artificial Sequence
  mitotic kinesin microtubule-associated protein Eg5 (Kif11) siRNA
gtagcacttggatctctcacatc

SEQ ID NO: 2022 - DNA, 23 bp, Artificial Sequence
  mitotic kinesin microtubule-associated protein Eg5 (Kif11) siRNA
tagcacttggatctctcacatct

SEQ ID NO: 2023 - DNA, 23 bp, Artificial Sequence
  mitotic kinesin microtubule-associated protein Eg5 (Kif11) siRNA
agcacttggatctctcacatcta

SEQ ID NO: 2024 - DNA, 23 bp, Artificial Sequence
  mitotic kinesin microtubule-associated protein Eg5 (Kif11) siRNA
gcacttggatctctcacatctat

SEQ ID NO: 2025 - DNA, 23 bp, Artificial Sequence
  mitotic kinesin microtubule-associated protein Eg5 (Kif11) siRNA
cacttggatctctcacatctatt

SEQ ID NO: 2026 - DNA, 23 bp, Artificial Sequence
  mitotic kinesin microtubule-associated protein Eg5 (Kif11) siRNA
acttggatctctcacatctattc

SEQ ID NO: 2027 - DNA, 23 bp, Artificial Sequence
  mitotic kinesin microtubule-associated protein Eg5 (Kif11) siRNA
cttggatctctcacatctattcc

SEQ ID NO: 2028 - DNA, 23 bp, Artificial Sequence
  mitotic kinesin microtubule-associated protein Eg5 (Kif11) siRNA
ttggatctctcacatctattcca

SEQ ID NO: 2029 - DNA, 23 bp, Artificial Sequence
  mitotic kinesin microtubule-associated protein Eg5 (Kif11) siRNA
tggatctctcacatctattccag

SEQ ID NO: 2030 - DNA, 23 bp, Artificial Sequence
  mitotic kinesin microtubule-associated protein Eg5 (Kif11) siRNA
ggatctctcacatctattccaga

SEQ ID NO: 2031 - DNA, 23 bp, Artificial Sequence
  mitotic kinesin microtubule-associated protein Eg5 (Kif11) siRNA
gatctctcacatctattccagaa

SEQ ID NO: 2032 - DNA, 23 bp, Artificial Sequence
  mitotic kinesin microtubule-associated protein Eg5 (Kif11) siRNA
atctctcacatctattccagaaa

SEQ ID NO: 2033 - DNA, 23 bp, Artificial Sequence
  mitotic kinesin microtubule-associated protein Eg5 (Kif11) siRNA
tctctcacatctattccagaaaa

SEQ ID NO: 2034 - DNA, 23 bp, Artificial Sequence
  mitotic kinesin microtubule-associated protein Eg5 (Kif11) siRNA
ctctcacatctattccagaaaat

SEQ ID NO: 2035 - DNA, 23 bp, Artificial Sequence
  mitotic kinesin microtubule-associated protein Eg5 (Kif11) siRNA
tctcacatctattccagaaaatg

SEQ ID NO: 2036 - DNA, 23 bp, Artificial Sequence
  mitotic kinesin microtubule-associated protein Eg5 (Kif11) siRNA
ctcacatctattccagaaaatgt

SEQ ID NO: 2037 - DNA, 23 bp, Artificial Sequence
  mitotic kinesin microtubule-associated protein Eg5 (Kif11) siRNA
tcacatctattccagaaaatgtg

SEQ ID NO: 2038 - DNA, 23 bp, Artificial Sequence
  mitotic kinesin microtubule-associated protein Eg5 (Kif11) siRNA
cacatctattccagaaaatgtgt

SEQ ID NO: 2039 - DNA, 23 bp, Artificial Sequence
  mitotic kinesin microtubule-associated protein Eg5 (Kif11) siRNA
acatctattccagaaaatgtgtc

SEQ ID NO: 2040 - DNA, 23 bp, Artificial Sequence
  mitotic kinesin microtubule-associated protein Eg5 (Kif11) siRNA
catctattccagaaaatgtgtct

SEQ ID NO: 2041 - DNA, 23 bp, Artificial Sequence
  mitotic kinesin microtubule-associated protein Eg5 (Kif11) siRNA
atctattccagaaaatgtgtcta

SEQ ID NO: 2042 - DNA, 23 bp, Artificial Sequence
  mitotic kinesin microtubule-associated protein Eg5 (Kif11) siRNA
tctattccagaaaatgtgtctac

SEQ ID NO: 2043 - DNA, 23 bp, Artificial Sequence
  mitotic kinesin microtubule-associated protein Eg5 (Kif11) siRNA
ctattccagaaaatgtgtctact

SEQ ID NO: 2044 - DNA, 23 bp, Artificial Sequence
  mitotic kinesin microtubule-associated protein Eg5 (Kif11) siRNA
tattccagaaaatgtgtctactc

SEQ ID NO: 2045 - DNA, 23 bp, Artificial Sequence
  mitotic kinesin microtubule-associated protein Eg5 (Kif11) siRNA
attccagaaaatgtgtctactca

SEQ ID NO: 2046 - DNA, 23 bp, Artificial Sequence
  mitotic kinesin microtubule-associated protein Eg5 (Kif11) siRNA
ttccagaaaatgtgtctactcat

SEQ ID NO: 2047 - DNA, 23 bp, Artificial Sequence
  mitotic kinesin microtubule-associated protein Eg5 (Kif11) siRNA
tccagaaaatgtgtctactcatg

SEQ ID NO: 2048 - DNA, 23 bp, Artificial Sequence
  mitotic kinesin microtubule-associated protein Eg5 (Kif11) siRNA
ccagaaaatgtgtctactcatgt

SEQ ID NO: 2049 - DNA, 23 bp, Artificial Sequence
  mitotic kinesin microtubule-associated protein Eg5 (Kif11) siRNA
cagaaaatgtgtctactcatgtt

SEQ ID NO: 2050 - DNA, 23 bp, Artificial Sequence
  mitotic kinesin microtubule-associated protein Eg5 (Kif11) siRNA
agaaaatgtgtctactcatgttt

SEQ ID NO: 2051 - DNA, 23 bp, Artificial Sequence
  mitotic kinesin microtubule-associated protein Eg5 (Kif11) siRNA
gaaaatgtgtctactcatgtttc

SEQ ID NO: 2052 - DNA, 23 bp, Artificial Sequence
  mitotic kinesin microtubule-associated protein Eg5 (Kif11) siRNA
aaaatgtgtctactcatgtttct

SEQ ID NO: 2053 - DNA, 23 bp, Artificial Sequence
  mitotic kinesin microtubule-associated protein Eg5 (Kif11) siRNA
aaatgtgtctactcatgtttctc

SEQ ID NO: 2054 - DNA, 23 bp, Artificial Sequence
  mitotic kinesin microtubule-associated protein Eg5 (Kif11) siRNA
aatgtgtctactcatgtttctca

SEQ ID NO: 2055 - DNA, 23 bp, Artificial Sequence
  mitotic kinesin microtubule-associated protein Eg5 (Kif11) siRNA
atgtgtctactcatgtttctcag

SEQ ID NO: 2056 - DNA, 23 bp, Artificial Sequence
  mitotic kinesin microtubule-associated protein Eg5 (Kif11) siRNA
tgtgtctactcatgtttctcaga

SEQ ID NO: 2057 - DNA, 23 bp, Artificial Sequence
  mitotic kinesin microtubule-associated protein Eg5 (Kif11) siRNA
gtgtctactcatgtttctcagat

SEQ ID NO: 2058 - DNA, 23 bp, Artificial Sequence
  mitotic kinesin microtubule-associated protein Eg5 (Kif11) siRNA
tgtctactcatgtttctcagatt

SEQ ID NO: 2059 - DNA, 23 bp, Artificial Sequence
  mitotic kinesin microtubule-associated protein Eg5 (Kif11) siRNA
gtctactcatgtttctcagattt

SEQ ID NO: 2060 - DNA, 23 bp, Artificial Sequence
  mitotic kinesin microtubule-associated protein Eg5 (Kif11) siRNA
tctactcatgtttctcagatttt

SEQ ID NO: 2061 - DNA, 23 bp, Artificial Sequence
  mitotic kinesin microtubule-associated protein Eg5 (Kif11) siRNA
ctactcatgtttctcagattttt

SEQ ID NO: 2062 - DNA, 23 bp, Artificial Sequence
  mitotic kinesin microtubule-associated protein Eg5 (Kif11) siRNA
tactcatgtttctcagattttta

SEQ ID NO: 2063 - DNA, 23 bp, Artificial Sequence
  mitotic kinesin microtubule-associated protein Eg5 (Kif11) siRNA
actcatgtttctcagatttttaa

SEQ ID NO: 2064 - DNA, 23 bp, Artificial Sequence
  mitotic kinesin microtubule-associated protein Eg5 (Kif11) siRNA
ctcatgtttctcagatttttaat

SEQ ID NO: 2065 - DNA, 23 bp, Artificial Sequence
  mitotic kinesin microtubule-associated protein Eg5 (Kif11) siRNA
tcatgtttctcagatttttaata

SEQ ID NO: 2066 - DNA, 23 bp, Artificial Sequence
  mitotic kinesin microtubule-associated protein Eg5 (Kif11) siRNA
catgtttctcagatttttaatat

SEQ ID NO: 2067 - DNA, 23 bp, Artificial Sequence
  mitotic kinesin microtubule-associated protein Eg5 (Kif11) siRNA
atgtttctcagatttttaatatg

SEQ ID NO: 2068 - DNA, 23 bp, Artificial Sequence
  mitotic kinesin microtubule-associated protein Eg5 (Kif11) siRNA
tgtttctcagatttttaatatga

SEQ ID NO: 2069 - DNA, 23 bp, Artificial Sequence
  mitotic kinesin microtubule-associated protein Eg5 (Kif11) siRNA
gtttctcagatttttaatatgat

SEQ ID NO: 2070 - DNA, 23 bp, Artificial Sequence
  mitotic kinesin microtubule-associated protein Eg5 (Kif11) siRNA
tttctcagatttttaatatgata

SEQ ID NO: 2071 - DNA, 23 bp, Artificial Sequence
  mitotic kinesin microtubule-associated protein Eg5 (Kif11) siRNA
ttctcagatttttaatatgatac

SEQ ID NO: 2072 - DNA, 23 bp, Artificial Sequence
  mitotic kinesin microtubule-associated protein Eg5 (Kif11) siRNA
tctcagatttttaatatgatact

SEQ ID NO: 2073 - DNA, 23 bp, Artificial Sequence
  mitotic kinesin microtubule-associated protein Eg5 (Kif11) siRNA
ctcagatttttaatatgatacta

SEQ ID NO: 2074 - DNA, 23 bp, Artificial Sequence
  mitotic kinesin microtubule-associated protein Eg5 (Kif11) siRNA
tcagatttttaatatgatactaa

SEQ ID NO: 2075 - DNA, 23 bp, Artificial Sequence
  mitotic kinesin microtubule-associated protein Eg5 (Kif11) siRNA
cagatttttaatatgatactaaa

SEQ ID NO: 2076 - DNA, 23 bp, Artificial Sequence
  mitotic kinesin microtubule-associated protein Eg5 (Kif11) siRNA
agatttttaatatgatactaaaa

SEQ ID NO: 2077 - DNA, 23 bp, Artificial Sequence
  mitotic kinesin microtubule-associated protein Eg5 (Kif11) siRNA
gatttttaatatgatactaaaag

SEQ ID NO: 2078 - DNA, 23 bp, Artificial Sequence
  mitotic kinesin microtubule-associated protein Eg5 (Kif11) siRNA
atttttaatatgatactaaaaga

SEQ ID NO: 2079 - DNA, 23 bp, Artificial Sequence
  mitotic kinesin microtubule-associated protein Eg5 (Kif11) siRNA
tttttaatatgatactaaaagaa

SEQ ID NO: 2080 - DNA, 23 bp, Artificial Sequence
  mitotic kinesin microtubule-associated protein Eg5 (Kif11) siRNA
ttttaatatgatactaaaagaac

SEQ ID NO: 2081 - DNA, 23 bp, Artificial Sequence
  mitotic kinesin microtubule-associated protein Eg5 (Kif11) siRNA
tttaatatgatactaaaagaaca

SEQ ID NO: 2082 - DNA, 23 bp, Artificial Sequence
  mitotic kinesin microtubule-associated protein Eg5 (Kif11) siRNA
ttaatatgatactaaaagaacaa

SEQ ID NO: 2083 - DNA, 23 bp, Artificial Sequence
  mitotic kinesin microtubule-associated protein Eg5 (Kif11) siRNA
taatatgatactaaaagaacaat

SEQ ID NO: 2084 - DNA, 23 bp, Artificial Sequence
  mitotic kinesin microtubule-associated protein Eg5 (Kif11) siRNA
aatatgatactaaaagaacaatc

SEQ ID NO: 2085 - DNA, 23 bp, Artificial Sequence
  mitotic kinesin microtubule-associated protein Eg5 (Kif11) siRNA
atatgatactaaaagaacaatca

SEQ ID NO: 2086 - DNA, 23 bp, Artificial Sequence
  mitotic kinesin microtubule-associated protein Eg5 (Kif11) siRNA
tatgatactaaaagaacaatcat

SEQ ID NO: 2087 - DNA, 23 bp, Artificial Sequence
  mitotic kinesin microtubule-associated protein Eg5 (Kif11) siRNA
atgatactaaaagaacaatcatt

SEQ ID NO: 2088 - DNA, 23 bp, Artificial Sequence
  mitotic kinesin microtubule-associated protein Eg5 (Kif11) siRNA
tgatactaaaagaacaatcatta

SEQ ID NO: 2089 - DNA, 23 bp, Artificial Sequence
  mitotic kinesin microtubule-associated protein Eg5 (Kif11) siRNA
gatactaaaagaacaatcattag

SEQ ID NO: 2090 - DNA, 23 bp, Artificial Sequence
  mitotic kinesin microtubule-associated protein Eg5 (Kif11) siRNA
atactaaaagaacaatcattagc

SEQ ID NO: 2091 - DNA, 23 bp, Artificial Sequence
  mitotic kinesin microtubule-associated protein Eg5 (Kif11) siRNA
tactaaaagaacaatcattagca

SEQ ID NO: 2092 - DNA, 23 bp, Artificial Sequence
  mitotic kinesin microtubule-associated protein Eg5 (Kif11) siRNA
actaaaagaacaatcattagcag

SEQ ID NO: 2093 - DNA, 23 bp, Artificial Sequence
  mitotic kinesin microtubule-associated protein Eg5 (Kif11) siRNA
ctaaaagaacaatcattagcagc

SEQ ID NO: 2094 - DNA, 23 bp, Artificial Sequence
  mitotic kinesin microtubule-associated protein Eg5 (Kif11) siRNA
taaaagaacaatcattagcagca

SEQ ID NO: 2095 - DNA, 23 bp, Artificial Sequence
  mitotic kinesin microtubule-associated protein Eg5 (Kif11) siRNA
aaaagaacaatcattagcagcag

SEQ ID NO: 2096 - DNA, 23 bp, Artificial Sequence
  mitotic kinesin microtubule-associated protein Eg5 (Kif11) siRNA
aaagaacaatcattagcagcaga

SEQ ID NO: 2097 - DNA, 23 bp, Artificial Sequence
  mitotic kinesin microtubule-associated protein Eg5 (Kif11) siRNA
aagaacaatcattagcagcagaa

SEQ ID NO: 2098 - DNA, 23 bp, Artificial Sequence
  mitotic kinesin microtubule-associated protein Eg5 (Kif11) siRNA
agaacaatcattagcagcagaaa

SEQ ID NO: 2099 - DNA, 23 bp, Artificial Sequence
  mitotic kinesin microtubule-associated protein Eg5 (Kif11) siRNA
gaacaatcattagcagcagaaag

SEQ ID NO: 2100 - DNA, 23 bp, Artificial Sequence
  mitotic kinesin microtubule-associated protein Eg5 (Kif11) siRNA
aacaatcattagcagcagaaagt

SEQ ID NO: 2101 - DNA, 23 bp, Artificial Sequence
  mitotic kinesin microtubule-associated protein Eg5 (Kif11) siRNA
acaatcattagcagcagaaagta

SEQ ID NO: 2102 - DNA, 23 bp, Artificial Sequence
  mitotic kinesin microtubule-associated protein Eg5 (Kif11) siRNA
caatcattagcagcagaaagtaa

SEQ ID NO: 2103 - DNA, 23 bp, Artificial Sequence
  mitotic kinesin microtubule-associated protein Eg5 (Kif11) siRNA
aatcattagcagcagaaagtaaa

SEQ ID NO: 2104 - DNA, 23 bp, Artificial Sequence
  mitotic kinesin microtubule-associated protein Eg5 (Kif11) siRNA
atcattagcagcagaaagtaaaa

SEQ ID NO: 2105 - DNA, 23 bp, Artificial Sequence
  mitotic kinesin microtubule-associated protein Eg5 (Kif11) siRNA
tcattagcagcagaaagtaaaac

SEQ ID NO: 2106 - DNA, 23 bp, Artificial Sequence
  mitotic kinesin microtubule-associated protein Eg5 (Kif11) siRNA
cattagcagcagaaagtaaaact

SEQ ID NO: 2107 - DNA, 23 bp, Artificial Sequence
  mitotic kinesin microtubule-associated protein Eg5 (Kif11) siRNA
attagcagcagaaagtaaaactg

SEQ ID NO: 2108 - DNA, 23 bp, Artificial Sequence
  mitotic kinesin microtubule-associated protein Eg5 (Kif11) siRNA
ttagcagcagaaagtaaaactgt

SEQ ID NO: 2109 - DNA, 23 bp, Artificial Sequence
  mitotic kinesin microtubule-associated protein Eg5 (Kif11) siRNA
tagcagcagaaagtaaaactgta

SEQ ID NO: 2110 - DNA, 23 bp, Artificial Sequence
  mitotic kinesin microtubule-associated protein Eg5 (Kif11) siRNA
agcagcagaaagtaaaactgtac

SEQ ID NO: 2111 - DNA, 23 bp, Artificial Sequence
  mitotic kinesin microtubule-associated protein Eg5 (Kif11) siRNA
gcagcagaaagtaaaactgtact

SEQ ID NO: 2112 - DNA, 23 bp, Artificial Sequence
  mitotic kinesin microtubule-associated protein Eg5 (Kif11) siRNA
cagcagaaagtaaaactgtacta

SEQ ID NO: 2113 - DNA, 23 bp, Artificial Sequence
  mitotic kinesin microtubule-associated protein Eg5 (Kif11) siRNA
agcagaaagtaaaactgtactac

SEQ ID NO: 2114 - DNA, 23 bp, Artificial Sequence
  mitotic kinesin microtubule-associated protein Eg5 (Kif11) siRNA
gcagaaagtaaaactgtactaca

SEQ ID NO: 2115 - DNA, 23 bp, Artificial Sequence
  mitotic kinesin microtubule-associated protein Eg5 (Kif11) siRNA
cagaaagtaaaactgtactacag

SEQ ID NO: 2116 - DNA, 23 bp, Artificial Sequence
  mitotic kinesin microtubule-associated protein Eg5 (Kif11) siRNA
agaaagtaaaactgtactacagg

SEQ ID NO: 2117 - DNA, 23 bp, Artificial Sequence
  mitotic kinesin microtubule-associated protein Eg5 (Kif11) siRNA
gaaagtaaaactgtactacagga

SEQ ID NO: 2118 - DNA, 23 bp, Artificial Sequence
  mitotic kinesin microtubule-associated protein Eg5 (Kif11) siRNA
aaagtaaaactgtactacaggaa

SEQ ID NO: 2119 - DNA, 23 bp, Artificial Sequence
  mitotic kinesin microtubule-associated protein Eg5 (Kif11) siRNA
aagtaaaactgtactacaggaat

SEQ ID NO: 2120 - DNA, 23 bp, Artificial Sequence
  mitotic kinesin microtubule-associated protein Eg5 (Kif11) siRNA
agtaaaactgtactacaggaatt

SEQ ID NO: 2121 - DNA, 23 bp, Artificial Sequence
  mitotic kinesin microtubule-associated protein Eg5 (Kif11) siRNA
gtaaaactgtactacaggaattg

SEQ ID NO: 2122 - DNA, 23 bp, Artificial Sequence
  mitotic kinesin microtubule-associated protein Eg5 (Kif11) siRNA
taaaactgtactacaggaattga

SEQ ID NO: 2123 - DNA, 23 bp, Artificial Sequence
  mitotic kinesin microtubule-associated protein Eg5 (Kif11) siRNA
aaaactgtactacaggaattgat

SEQ ID NO: 2124 - DNA, 23 bp, Artificial Sequence
  mitotic kinesin microtubule-associated protein Eg5 (Kif11) siRNA
aaactgtactacaggaattgatt

SEQ ID NO: 2125 - DNA, 23 bp, Artificial Sequence
  mitotic kinesin microtubule-associated protein Eg5 (Kif11) siRNA
aactgtactacaggaattgatta

SEQ ID NO: 2126 - DNA, 23 bp, Artificial Sequence
  mitotic kinesin microtubule-associated protein Eg5 (Kif11) siRNA
actgtactacaggaattgattaa

SEQ ID NO: 2127 - DNA, 23 bp, Artificial Sequence
  mitotic kinesin microtubule-associated protein Eg5 (Kif11) siRNA
ctgtactacaggaattgattaat

SEQ ID NO: 2128 - DNA, 23 bp, Artificial Sequence
  mitotic kinesin microtubule-associated protein Eg5 (Kif11) siRNA
tgtactacaggaattgattaatg

SEQ ID NO: 2129 - DNA, 23 bp, Artificial Sequence
  mitotic kinesin microtubule-associated protein Eg5 (Kif11) siRNA
gtactacaggaattgattaatgt

SEQ ID NO: 2130 - DNA, 23 bp, Artificial Sequence
  mitotic kinesin microtubule-associated protein Eg5 (Kif11) siRNA
tactacaggaattgattaatgta

SEQ ID NO: 2131 - DNA, 23 bp, Artificial Sequence
  mitotic kinesin microtubule-associated protein Eg5 (Kif11) siRNA
actacaggaattgattaatgtac

SEQ ID NO: 2132 - DNA, 23 bp, Artificial Sequence
  mitotic kinesin microtubule-associated protein Eg5 (Kif11) siRNA
ctacaggaattgattaatgtact

SEQ ID NO: 2133 - DNA, 23 bp, Artificial Sequence
  mitotic kinesin microtubule-associated protein Eg5 (Kif11) siRNA
tacaggaattgattaatgtactc

SEQ ID NO: 2134 - DNA, 23 bp, Artificial Sequence
  mitotic kinesin microtubule-associated protein Eg5 (Kif11) siRNA
acaggaattgattaatgtactca

SEQ ID NO: 2135 - DNA, 23 bp, Artificial Sequence
  mitotic kinesin microtubule-associated protein Eg5 (Kif11) siRNA
caggaattgattaatgtactcaa

SEQ ID NO: 2136 - DNA, 23 bp, Artificial Sequence
  mitotic kinesin microtubule-associated protein Eg5 (Kif11) siRNA
aggaattgattaatgtactcaag

SEQ ID NO: 2137 - DNA, 23 bp, Artificial Sequence
  mitotic kinesin microtubule-associated protein Eg5 (Kif11) siRNA
ggaattgattaatgtactcaaga

SEQ ID NO: 2138 - DNA, 23 bp, Artificial Sequence
  mitotic kinesin microtubule-associated protein Eg5 (Kif11) siRNA
gaattgattaatgtactcaagac

SEQ ID NO: 2139 - DNA, 23 bp, Artificial Sequence
  mitotic kinesin microtubule-associated protein Eg5 (Kif11) siRNA
aattgattaatgtactcaagact

SEQ ID NO: 2140 - DNA, 23 bp, Artificial Sequence
  mitotic kinesin microtubule-associated protein Eg5 (Kif11) siRNA
attgattaatgtactcaagactg

SEQ ID NO: 2141 - DNA, 23 bp, Artificial Sequence
  mitotic kinesin microtubule-associated protein Eg5 (Kif11) siRNA
ttgattaatgtactcaagactga

SEQ ID NO: 2142 - DNA, 23 bp, Artificial Sequence
  mitotic kinesin microtubule-associated protein Eg5 (Kif11) siRNA
tgattaatgtactcaagactgat

SEQ ID NO: 2143 - DNA, 23 bp, Artificial Sequence
  mitotic kinesin microtubule-associated protein Eg5 (Kif11) siRNA
gattaatgtactcaagactgatc

SEQ ID NO: 2144 - DNA, 23 bp, Artificial Sequence
  mitotic kinesin microtubule-associated protein Eg5 (Kif11) siRNA
attaatgtactcaagactgatct

SEQ ID NO: 2145 - DNA, 23 bp, Artificial Sequence
  mitotic kinesin microtubule-associated protein Eg5 (Kif11) siRNA
ttaatgtactcaagactgatctt

SEQ ID NO: 2146 - DNA, 23 bp, Artificial Sequence
  mitotic kinesin microtubule-associated protein Eg5 (Kif11) siRNA
taatgtactcaagactgatcttc

SEQ ID NO: 2147 - DNA, 23 bp, Artificial Sequence
  mitotic kinesin microtubule-associated protein Eg5 (Kif11) siRNA
aatgtactcaagactgatcttct

SEQ ID NO: 2148 - DNA, 23 bp, Artificial Sequence
  mitotic kinesin microtubule-associated protein Eg5 (Kif11) siRNA
atgtactcaagactgatcttcta

SEQ ID NO: 2149 - DNA, 23 bp, Artificial Sequence
  mitotic kinesin microtubule-associated protein Eg5 (Kif11) siRNA
tgtactcaagactgatcttctaa

SEQ ID NO: 2150 - DNA, 23 bp, Artificial Sequence
  mitotic kinesin microtubule-associated protein Eg5 (Kif11) siRNA
gtactcaagactgatcttctaag

SEQ ID NO: 2151 - DNA, 23 bp, Artificial Sequence
  mitotic kinesin microtubule-associated protein Eg5 (Kif11) siRNA
tactcaagactgatcttctaagt

SEQ ID NO: 2152 - DNA, 23 bp, Artificial Sequence
  mitotic kinesin microtubule-associated protein Eg5 (Kif11) siRNA
actcaagactgatcttctaagtt

SEQ ID NO: 2153 - DNA, 23 bp, Artificial Sequence
  mitotic kinesin microtubule-associated protein Eg5 (Kif11) siRNA
ctcaagactgatcttctaagttc

SEQ ID NO: 2154 - DNA, 23 bp, Artificial Sequence
  mitotic kinesin microtubule-associated protein Eg5 (Kif11) siRNA
tcaagactgatcttctaagttca

SEQ ID NO: 2155 - DNA, 23 bp, Artificial Sequence
  mitotic kinesin microtubule-associated protein Eg5 (Kif11) siRNA
caagactgatcttctaagttcac

SEQ ID NO: 2156 - DNA, 23 bp, Artificial Sequence
  mitotic kinesin microtubule-associated protein Eg5 (Kif11) siRNA
aagactgatcttctaagttcact

SEQ ID NO: 2157 - DNA, 23 bp, Artificial Sequence
  mitotic kinesin microtubule-associated protein Eg5 (Kif11) siRNA
agactgatcttctaagttcactg

SEQ ID NO: 2158 - DNA, 23 bp, Artificial Sequence
  mitotic kinesin microtubule-associated protein Eg5 (Kif11) siRNA
gactgatcttctaagttcactgg

SEQ ID NO: 2159 - DNA, 23 bp, Artificial Sequence
  mitotic kinesin microtubule-associated protein Eg5 (Kif11) siRNA
actgatcttctaagttcactgga

SEQ ID NO: 2160 - DNA, 23 bp, Artificial Sequence
  mitotic kinesin microtubule-associated protein Eg5 (Kif11) siRNA
ctgatcttctaagttcactggaa

SEQ ID NO: 2161 - DNA, 23 bp, Artificial Sequence
  mitotic kinesin microtubule-associated protein Eg5 (Kif11) siRNA
tgatcttctaagttcactggaaa

SEQ ID NO: 2162 - DNA, 23 bp, Artificial Sequence
  mitotic kinesin microtubule-associated protein Eg5 (Kif11) siRNA
gatcttctaagttcactggaaat

SEQ ID NO: 2163 - DNA, 23 bp, Artificial Sequence
  mitotic kinesin microtubule-associated protein Eg5 (Kif11) siRNA
atcttctaagttcactggaaatg

SEQ ID NO: 2164 - DNA, 23 bp, Artificial Sequence
  mitotic kinesin microtubule-associated protein Eg5 (Kif11) siRNA
tcttctaagttcactggaaatga

SEQ ID NO: 2165 - DNA, 23 bp, Artificial Sequence
  mitotic kinesin microtubule-associated protein Eg5 (Kif11) siRNA
cttctaagttcactggaaatgat

SEQ ID NO: 2166 - DNA, 23 bp, Artificial Sequence
  mitotic kinesin microtubule-associated protein Eg5 (Kif11) siRNA
ttctaagttcactggaaatgatt

SEQ ID NO: 2167 - DNA, 23 bp, Artificial Sequence
  mitotic kinesin microtubule-associated protein Eg5 (Kif11) siRNA
tctaagttcactggaaatgattt

SEQ ID NO: 2168 - DNA, 23 bp, Artificial Sequence
  mitotic kinesin microtubule-associated protein Eg5 (Kif11) siRNA
ctaagttcactggaaatgatttt

SEQ ID NO: 2169 - DNA, 23 bp, Artificial Sequence
  mitotic kinesin microtubule-associated protein Eg5 (Kif11) siRNA
taagttcactggaaatgatttta

SEQ ID NO: 2170 - DNA, 23 bp, Artificial Sequence
  mitotic kinesin microtubule-associated protein Eg5 (Kif11) siRNA
aagttcactggaaatgattttat

SEQ ID NO: 2171 - DNA, 23 bp, Artificial Sequence
  mitotic kinesin microtubule-associated protein Eg5 (Kif11) siRNA
agttcactggaaatgattttatc

SEQ ID NO: 2172 - DNA, 23 bp, Artificial Sequence
  mitotic kinesin microtubule-associated protein Eg5 (Kif11) siRNA
gttcactggaaatgattttatcc

SEQ ID NO: 2173 - DNA, 23 bp, Artificial Sequence
  mitotic kinesin microtubule-associated protein Eg5 (Kif11) siRNA
ttcactggaaatgattttatccc

SEQ ID NO: 2174 - DNA, 23 bp, Artificial Sequence
  mitotic kinesin microtubule-associated protein Eg5 (Kif11) siRNA
tcactggaaatgattttatcccc

SEQ ID NO: 2175 - DNA, 23 bp, Artificial Sequence
  mitotic kinesin microtubule-associated protein Eg5 (Kif11) siRNA
cactggaaatgattttatcccca

SEQ ID NO: 2176 - DNA, 23 bp, Artificial Sequence
  mitotic kinesin microtubule-associated protein Eg5 (Kif11) siRNA
actggaaatgattttatccccaa

SEQ ID NO: 2177 - DNA, 23 bp, Artificial Sequence
  mitotic kinesin microtubule-associated protein Eg5 (Kif11) siRNA
ctggaaatgattttatccccaac

SEQ ID NO: 2178 - DNA, 23 bp, Artificial Sequence
  mitotic kinesin microtubule-associated protein Eg5 (Kif11) siRNA
tggaaatgattttatccccaact

SEQ ID NO: 2179 - DNA, 23 bp, Artificial Sequence
  mitotic kinesin microtubule-associated protein Eg5 (Kif11) siRNA
ggaaatgattttatccccaactg

SEQ ID NO: 2180 - DNA, 23 bp, Artificial Sequence
  mitotic kinesin microtubule-associated protein Eg5 (Kif11) siRNA
gaaatgattttatccccaactgt

SEQ ID NO: 2181 - DNA, 23 bp, Artificial Sequence
  mitotic kinesin microtubule-associated protein Eg5 (Kif11) siRNA
aaatgattttatccccaactgtg

SEQ ID NO: 2182 - DNA, 23 bp, Artificial Sequence
  mitotic kinesin microtubule-associated protein Eg5 (Kif11) siRNA
aatgattttatccccaactgtgg

SEQ ID NO: 2183 - DNA, 23 bp, Artificial Sequence
  mitotic kinesin microtubule-associated protein Eg5 (Kif11) siRNA
atgattttatccccaactgtggt

SEQ ID NO: 2184 - DNA, 23 bp, Artificial Sequence
  mitotic kinesin microtubule-associated protein Eg5 (Kif11) siRNA
tgattttatccccaactgtggtg

SEQ ID NO: 2185 - DNA, 23 bp, Artificial Sequence
  mitotic kinesin microtubule-associated protein Eg5 (Kif11) siRNA
gattttatccccaactgtggtgt

SEQ ID NO: 2186 - DNA, 23 bp, Artificial Sequence
  mitotic kinesin microtubule-associated protein Eg5 (Kif11) siRNA
attttatccccaactgtggtgtc

SEQ ID NO: 2187 - DNA, 23 bp, Artificial Sequence
  mitotic kinesin microtubule-associated protein Eg5 (Kif11) siRNA
ttttatccccaactgtggtgtct

SEQ ID NO: 2188 - DNA, 23 bp, Artificial Sequence
  mitotic kinesin microtubule-associated protein Eg5 (Kif11) siRNA
tttatccccaactgtggtgtcta

SEQ ID NO: 2189 - DNA, 23 bp, Artificial Sequence
  mitotic kinesin microtubule-associated protein Eg5 (Kif11) siRNA
ttatccccaactgtggtgtctat

SEQ ID NO: 2190 - DNA, 23 bp, Artificial Sequence
  mitotic kinesin microtubule-associated protein Eg5 (Kif11) siRNA
tatccccaactgtggtgtctata

SEQ ID NO: 2191 - DNA, 23 bp, Artificial Sequence
  mitotic kinesin microtubule-associated protein Eg5 (Kif11) siRNA
atccccaactgtggtgtctatac

SEQ ID NO: 2192 - DNA, 23 bp, Artificial Sequence
  mitotic kinesin microtubule-associated protein Eg5 (Kif11) siRNA
tccccaactgtggtgtctatact

SEQ ID NO: 2193 - DNA, 23 bp, Artificial Sequence
  mitotic kinesin microtubule-associated protein Eg5 (Kif11) siRNA
ccccaactgtggtgtctatactg

SEQ ID NO: 2194 - DNA, 23 bp, Artificial Sequence
  mitotic kinesin microtubule-associated protein Eg5 (Kif11) siRNA
cccaactgtggtgtctatactga

SEQ ID NO: 2195 - DNA, 23 bp, Artificial Sequence
  mitotic kinesin microtubule-associated protein Eg5 (Kif11) siRNA
ccaactgtggtgtctatactgaa

SEQ ID NO: 2196 - DNA, 23 bp, Artificial Sequence
  mitotic kinesin microtubule-associated protein Eg5 (Kif11) siRNA
caactgtggtgtctatactgaaa

SEQ ID NO: 2197 - DNA, 23 bp, Artificial Sequence
  mitotic kinesin microtubule-associated protein Eg5 (Kif11) siRNA
aactgtggtgtctatactgaaaa

SEQ ID NO: 2198 - DNA, 23 bp, Artificial Sequence
  mitotic kinesin microtubule-associated protein Eg5 (Kif11) siRNA
actgtggtgtctatactgaaaat

SEQ ID NO: 2199 - DNA, 23 bp, Artificial Sequence
  mitotic kinesin microtubule-associated protein Eg5 (Kif11) siRNA
ctgtggtgtctatactgaaaatc

SEQ ID NO: 2200 - DNA, 23 bp, Artificial Sequence
  mitotic kinesin microtubule-associated protein Eg5 (Kif11) siRNA
tgtggtgtctatactgaaaatca

SEQ ID NO: 2201 - DNA, 23 bp, Artificial Sequence
  mitotic kinesin microtubule-associated protein Eg5 (Kif11) siRNA
gtggtgtctatactgaaaatcaa

SEQ ID NO: 2202 - DNA, 23 bp, Artificial Sequence
  mitotic kinesin microtubule-associated protein Eg5 (Kif11) siRNA
tggtgtctatactgaaaatcaat

SEQ ID NO: 2203 - DNA, 23 bp, Artificial Sequence
  mitotic kinesin microtubule-associated protein Eg5 (Kif11) siRNA
ggtgtctatactgaaaatcaata

SEQ ID NO: 2204 - DNA, 23 bp, Artificial Sequence
  mitotic kinesin microtubule-associated protein Eg5 (Kif11) siRNA
gtgtctatactgaaaatcaatag

SEQ ID NO: 2205 - DNA, 23 bp, Artificial Sequence
  mitotic kinesin microtubule-associated protein Eg5 (Kif11) siRNA
tgtctatactgaaaatcaatagt

SEQ ID NO: 2206 - DNA, 23 bp, Artificial Sequence
  mitotic kinesin microtubule-associated protein Eg5 (Kif11) siRNA
gtctatactgaaaatcaatagtc

SEQ ID NO: 2207 - DNA, 23 bp, Artificial Sequence
  mitotic kinesin microtubule-associated protein Eg5 (Kif11) siRNA
tctatactgaaaatcaatagtca

SEQ ID NO: 2208 - DNA, 23 bp, Artificial Sequence
  mitotic kinesin microtubule-associated protein Eg5 (Kif11) siRNA
ctatactgaaaatcaatagtcaa

SEQ ID NO: 2209 - DNA, 23 bp, Artificial Sequence
  mitotic kinesin microtubule-associated protein Eg5 (Kif11) siRNA
tatactgaaaatcaatagtcaac

SEQ ID NO: 2210 - DNA, 23 bp, Artificial Sequence
  mitotic kinesin microtubule-associated protein Eg5 (Kif11) siRNA
atactgaaaatcaatagtcaact

SEQ ID NO: 2211 - DNA, 23 bp, Artificial Sequence
  mitotic kinesin microtubule-associated protein Eg5 (Kif11) siRNA
tactgaaaatcaatagtcaacta

SEQ ID NO: 2212 - DNA, 23 bp, Artificial Sequence
  mitotic kinesin microtubule-associated protein Eg5 (Kif11) siRNA
actgaaaatcaatagtcaactaa

SEQ ID NO: 2213 - DNA, 23 bp, Artificial Sequence
  mitotic kinesin microtubule-associated protein Eg5 (Kif11) siRNA
ctgaaaatcaatagtcaactaaa

SEQ ID NO: 2214 - DNA, 23 bp, Artificial Sequence
  mitotic kinesin microtubule-associated protein Eg5 (Kif11) siRNA
tgaaaatcaatagtcaactaaag

SEQ ID NO: 2215 - DNA, 23 bp, Artificial Sequence
  mitotic kinesin microtubule-associated protein Eg5 (Kif11) siRNA
gaaaatcaatagtcaactaaagc

SEQ ID NO: 2216 - DNA, 23 bp, Artificial Sequence
  mitotic kinesin microtubule-associated protein Eg5 (Kif11) siRNA
aaaatcaatagtcaactaaagca

SEQ ID NO: 2217 - DNA, 23 bp, Artificial Sequence
  mitotic kinesin microtubule-associated protein Eg5 (Kif11) siRNA
aaatcaatagtcaactaaagcat

SEQ ID NO: 2218 - DNA, 23 bp, Artificial Sequence
  mitotic kinesin microtubule-associated protein Eg5 (Kif11) siRNA
aatcaatagtcaactaaagcata

SEQ ID NO: 2219 - DNA, 23 bp, Artificial Sequence
  mitotic kinesin microtubule-associated protein Eg5 (Kif11) siRNA
atcaatagtcaactaaagcatat

SEQ ID NO: 2220 - DNA, 23 bp, Artificial Sequence
  mitotic kinesin microtubule-associated protein Eg5 (Kif11) siRNA
tcaatagtcaactaaagcatatt

SEQ ID NO: 2221 - DNA, 23 bp, Artificial Sequence
  mitotic kinesin microtubule-associated protein Eg5 (Kif11) siRNA
caatagtcaactaaagcatattt

SEQ ID NO: 2222 - DNA, 23 bp, Artificial Sequence
  mitotic kinesin microtubule-associated protein Eg5 (Kif11) siRNA
aatagtcaactaaagcatatttt

SEQ ID NO: 2223 - DNA, 23 bp, Artificial Sequence
  mitotic kinesin microtubule-associated protein Eg5 (Kif11) siRNA
atagtcaactaaagcatattttc

SEQ ID NO: 2224 - DNA, 23 bp, Artificial Sequence
  mitotic kinesin microtubule-associated protein Eg5 (Kif11) siRNA
tagtcaactaaagcatattttca

SEQ ID NO: 2225 - DNA, 23 bp, Artificial Sequence
  mitotic kinesin microtubule-associated protein Eg5 (Kif11) siRNA
agtcaactaaagcatattttcaa

SEQ ID NO: 2226 - DNA, 23 bp, Artificial Sequence
  mitotic kinesin microtubule-associated protein Eg5 (Kif11) siRNA
gtcaactaaagcatattttcaag

SEQ ID NO: 2227 - DNA, 23 bp, Artificial Sequence
  mitotic kinesin microtubule-associated protein Eg5 (Kif11) siRNA
tcaactaaagcatattttcaaga

SEQ ID NO: 2228 - DNA, 23 bp, Artificial Sequence
  mitotic kinesin microtubule-associated protein Eg5 (Kif11) siRNA
caactaaagcatattttcaagac

SEQ ID NO: 2229 - DNA, 23 bp, Artificial Sequence
  mitotic kinesin microtubule-associated protein Eg5 (Kif11) siRNA
aactaaagcatattttcaagact

SEQ ID NO: 2230 - DNA, 23 bp, Artificial Sequence
  mitotic kinesin microtubule-associated protein Eg5 (Kif11) siRNA
actaaagcatattttcaagactt

SEQ ID NO: 2231 - DNA, 23 bp, Artificial Sequence
  mitotic kinesin microtubule-associated protein Eg5 (Kif11) siRNA
ctaaagcatattttcaagacttc

SEQ ID NO: 2232 - DNA, 23 bp, Artificial Sequence
  mitotic kinesin microtubule-associated protein Eg5 (Kif11) siRNA
taaagcatattttcaagacttca

SEQ ID NO: 2233 - DNA, 23 bp, Artificial Sequence
  mitotic kinesin microtubule-associated protein Eg5 (Kif11) siRNA
aaagcatattttcaagacttcat

SEQ ID NO: 2234 - DNA, 23 bp, Artificial Sequence
  mitotic kinesin microtubule-associated protein Eg5 (Kif11) siRNA
aagcatattttcaagacttcatt

SEQ ID NO: 2235 - DNA, 23 bp, Artificial Sequence
  mitotic kinesin microtubule-associated protein Eg5 (Kif11) siRNA
agcatattttcaagacttcattg

SEQ ID NO: 2236 - DNA, 23 bp, Artificial Sequence
  mitotic kinesin microtubule-associated protein Eg5 (Kif11) siRNA
gcatattttcaagacttcattga

SEQ ID NO: 2237 - DNA, 23 bp, Artificial Sequence
  mitotic kinesin microtubule-associated protein Eg5 (Kif11) siRNA
catattttcaagacttcattgac

SEQ ID NO: 2238 - DNA, 23 bp, Artificial Sequence
  mitotic kinesin microtubule-associated protein Eg5 (Kif11) siRNA
atattttcaagacttcattgaca

SEQ ID NO: 2239 - DNA, 23 bp, Artificial Sequence
  mitotic kinesin microtubule-associated protein Eg5 (Kif11) siRNA
tattttcaagacttcattgacag

SEQ ID NO: 2240 - DNA, 23 bp, Artificial Sequence
  mitotic kinesin microtubule-associated protein Eg5 (Kif11) siRNA
attttcaagacttcattgacagt

SEQ ID NO: 2241 - DNA, 23 bp, Artificial Sequence
  mitotic kinesin microtubule-associated protein Eg5 (Kif11) siRNA
ttttcaagacttcattgacagtg

SEQ ID NO: 2242 - DNA, 23 bp, Artificial Sequence
  mitotic kinesin microtubule-associated protein Eg5 (Kif11) siRNA
tttcaagacttcattgacagtgg

SEQ ID NO: 2243 - DNA, 23 bp, Artificial Sequence
  mitotic kinesin microtubule-associated protein Eg5 (Kif11) siRNA
ttcaagacttcattgacagtggc

SEQ ID NO: 2244 - DNA, 23 bp, Artificial Sequence
  mitotic kinesin microtubule-associated protein Eg5 (Kif11) siRNA
tcaagacttcattgacagtggcc

SEQ ID NO: 2245 - DNA, 23 bp, Artificial Sequence
  mitotic kinesin microtubule-associated protein Eg5 (Kif11) siRNA
caagacttcattgacagtggccg

SEQ ID NO: 2246 - DNA, 23 bp, Artificial Sequence
  mitotic kinesin microtubule-associated protein Eg5 (Kif11) siRNA
aagacttcattgacagtggccga

SEQ ID NO: 2247 - DNA, 23 bp, Artificial Sequence
  mitotic kinesin microtubule-associated protein Eg5 (Kif11) siRNA
agacttcattgacagtggccgat

SEQ ID NO: 2248 - DNA, 23 bp, Artificial Sequence
  mitotic kinesin microtubule-associated protein Eg5 (Kif11) siRNA
gacttcattgacagtggccgata

SEQ ID NO: 2249 - DNA, 23 bp, Artificial Sequence
  mitotic kinesin microtubule-associated protein Eg5 (Kif11) siRNA
acttcattgacagtggccgataa

SEQ ID NO: 2250 - DNA, 23 bp, Artificial Sequence
  mitotic kinesin microtubule-associated protein Eg5 (Kif11) siRNA
cttcattgacagtggccgataag

SEQ ID NO: 2251 - DNA, 23 bp, Artificial Sequence
  mitotic kinesin microtubule-associated protein Eg5 (Kif11) siRNA
ttcattgacagtggccgataaga

SEQ ID NO: 2252 - DNA, 23 bp, Artificial Sequence
  mitotic kinesin microtubule-associated protein Eg5 (Kif11) siRNA
tcattgacagtggccgataagat

SEQ ID NO: 2253 - DNA, 23 bp, Artificial Sequence
  mitotic kinesin microtubule-associated protein Eg5 (Kif11) siRNA
cattgacagtggccgataagata

SEQ ID NO: 2254 - DNA, 23 bp, Artificial Sequence
  mitotic kinesin microtubule-associated protein Eg5 (Kif11) siRNA
attgacagtggccgataagatag

SEQ ID NO: 2255 - DNA, 23 bp, Artificial Sequence
  mitotic kinesin microtubule-associated protein Eg5 (Kif11) siRNA
ttgacagtggccgataagataga

SEQ ID NO: 2256 - DNA, 23 bp, Artificial Sequence
  mitotic kinesin microtubule-associated protein Eg5 (Kif11) siRNA
tgacagtggccgataagatagaa

SEQ ID NO: 2257 - DNA, 23 bp, Artificial Sequence
  mitotic kinesin microtubule-associated protein Eg5 (Kif11) siRNA
gacagtggccgataagatagaag

SEQ ID NO: 2258 - DNA, 23 bp, Artificial Sequence
  mitotic kinesin microtubule-associated protein Eg5 (Kif11) siRNA
acagtggccgataagatagaaga

SEQ ID NO: 2259 - DNA, 23 bp, Artificial Sequence
  mitotic kinesin microtubule-associated protein Eg5 (Kif11) siRNA
cagtggccgataagatagaagat

SEQ ID NO: 2260 - DNA, 23 bp, Artificial Sequence
  mitotic kinesin microtubule-associated protein Eg5 (Kif11) siRNA
agtggccgataagatagaagatc

SEQ ID NO: 2261 - DNA, 23 bp, Artificial Sequence
  mitotic kinesin microtubule-associated protein Eg5 (Kif11) siRNA
gtggccgataagatagaagatca

SEQ ID NO: 2262 - DNA, 23 bp, Artificial Sequence
  mitotic kinesin microtubule-associated protein Eg5 (Kif11) siRNA
tggccgataagatagaagatcaa

SEQ ID NO: 2263 - DNA, 23 bp, Artificial Sequence
  mitotic kinesin microtubule-associated protein Eg5 (Kif11) siRNA
ggccgataagatagaagatcaaa

SEQ ID NO: 2264 - DNA, 23 bp, Artificial Sequence
  mitotic kinesin microtubule-associated protein Eg5 (Kif11) siRNA
gccgataagatagaagatcaaaa

SEQ ID NO: 2265 - DNA, 23 bp, Artificial Sequence
  mitotic kinesin microtubule-associated protein Eg5 (Kif11) siRNA
ccgataagatagaagatcaaaaa

SEQ ID NO: 2266 - DNA, 23 bp, Artificial Sequence
  mitotic kinesin microtubule-associated protein Eg5 (Kif11) siRNA
cgataagatagaagatcaaaaaa

SEQ ID NO: 2267 - DNA, 23 bp, Artificial Sequence
  mitotic kinesin microtubule-associated protein Eg5 (Kif11) siRNA
gataagatagaagatcaaaaaaa

SEQ ID NO: 2268 - DNA, 23 bp, Artificial Sequence
  mitotic kinesin microtubule-associated protein Eg5 (Kif11) siRNA
ataagatagaagatcaaaaaaag

SEQ ID NO: 2269 - DNA, 23 bp, Artificial Sequence
  mitotic kinesin microtubule-associated protein Eg5 (Kif11) siRNA
taagatagaagatcaaaaaaagg

SEQ ID NO: 2270 - DNA, 23 bp, Artificial Sequence
  mitotic kinesin microtubule-associated protein Eg5 (Kif11) siRNA
aagatagaagatcaaaaaaagga

SEQ ID NO: 2271 - DNA, 23 bp, Artificial Sequence
  mitotic kinesin microtubule-associated protein Eg5 (Kif11) siRNA
agatagaagatcaaaaaaaggaa

SEQ ID NO: 2272 - DNA, 23 bp, Artificial Sequence
  mitotic kinesin microtubule-associated protein Eg5 (Kif11) siRNA
gatagaagatcaaaaaaaggaac

SEQ ID NO: 2273 - DNA, 23 bp, Artificial Sequence
  mitotic kinesin microtubule-associated protein Eg5 (Kif11) siRNA
atagaagatcaaaaaaaggaact

SEQ ID NO: 2274 - DNA, 23 bp, Artificial Sequence
  mitotic kinesin microtubule-associated protein Eg5 (Kif11) siRNA
tagaagatcaaaaaaaggaacta

SEQ ID NO: 2275 - DNA, 23 bp, Artificial Sequence
  mitotic kinesin microtubule-associated protein Eg5 (Kif11) siRNA
agaagatcaaaaaaaggaactag

SEQ ID NO: 2276 - DNA, 23 bp, Artificial Sequence
  mitotic kinesin microtubule-associated protein Eg5 (Kif11) siRNA
gaagatcaaaaaaaggaactaga

SEQ ID NO: 2277 - DNA, 23 bp, Artificial Sequence
  mitotic kinesin microtubule-associated protein Eg5 (Kif11) siRNA
aagatcaaaaaaaggaactagat

SEQ ID NO: 2278 - DNA, 23 bp, Artificial Sequence
  mitotic kinesin microtubule-associated protein Eg5 (Kif11) siRNA
agatcaaaaaaaggaactagatg

SEQ ID NO: 2279 - DNA, 23 bp, Artificial Sequence
  mitotic kinesin microtubule-associated protein Eg5 (Kif11) siRNA
gatcaaaaaaaggaactagatgg

SEQ ID NO: 2280 - DNA, 23 bp, Artificial Sequence
  mitotic kinesin microtubule-associated protein Eg5 (Kif11) siRNA
atcaaaaaaaggaactagatggc

SEQ ID NO: 2281 - DNA, 23 bp, Artificial Sequence
  mitotic kinesin microtubule-associated protein Eg5 (Kif11) siRNA
tcaaaaaaaggaactagatggct

SEQ ID NO: 2282 - DNA, 23 bp, Artificial Sequence
  mitotic kinesin microtubule-associated protein Eg5 (Kif11) siRNA
caaaaaaaggaactagatggctt

SEQ ID NO: 2283 - DNA, 23 bp, Artificial Sequence
  mitotic kinesin microtubule-associated protein Eg5 (Kif11) siRNA
aaaaaaaggaactagatggcttt

SEQ ID NO: 2284 - DNA, 23 bp, Artificial Sequence
  mitotic kinesin microtubule-associated protein Eg5 (Kif11) siRNA
aaaaaaggaactagatggctttc

SEQ ID NO: 2285 - DNA, 23 bp, Artificial Sequence
  mitotic kinesin microtubule-associated protein Eg5 (Kif11) siRNA
aaaaaggaactagatggctttct

SEQ ID NO: 2286 - DNA, 23 bp, Artificial Sequence
  mitotic kinesin microtubule-associated protein Eg5 (Kif11) siRNA
aaaaggaactagatggctttctc

SEQ ID NO: 2287 - DNA, 23 bp, Artificial Sequence
  mitotic kinesin microtubule-associated protein Eg5 (Kif11) siRNA
aaaggaactagatggctttctca

SEQ ID NO: 2288 - DNA, 23 bp, Artificial Sequence
  mitotic kinesin microtubule-associated protein Eg5 (Kif11) siRNA
aaggaactagatggctttctcag

SEQ ID NO: 2289 - DNA, 23 bp, Artificial Sequence
  mitotic kinesin microtubule-associated protein Eg5 (Kif11) siRNA
aggaactagatggctttctcagt

SEQ ID NO: 2290 - DNA, 23 bp, Artificial Sequence
  mitotic kinesin microtubule-associated protein Eg5 (Kif11) siRNA
ggaactagatggctttctcagta

SEQ ID NO: 2291 - DNA, 23 bp, Artificial Sequence
  mitotic kinesin microtubule-associated protein Eg5 (Kif11) siRNA
gaactagatggctttctcagtat

SEQ ID NO: 2292 - DNA, 23 bp, Artificial Sequence
  mitotic kinesin microtubule-associated protein Eg5 (Kif11) siRNA
aactagatggctttctcagtata

SEQ ID NO: 2293 - DNA, 23 bp, Artificial Sequence
  mitotic kinesin microtubule-associated protein Eg5 (Kif11) siRNA
actagatggctttctcagtatac

SEQ ID NO: 2294 - DNA, 23 bp, Artificial Sequence
  mitotic kinesin microtubule-associated protein Eg5 (Kif11) siRNA
ctagatggctttctcagtatact

SEQ ID NO: 2295 - DNA, 23 bp, Artificial Sequence
  mitotic kinesin microtubule-associated protein Eg5 (Kif11) siRNA
tagatggctttctcagtatactg

SEQ ID NO: 2296 - DNA, 23 bp, Artificial Sequence
  mitotic kinesin microtubule-associated protein Eg5 (Kif11) siRNA
agatggctttctcagtatactgt

SEQ ID NO: 2297 - DNA, 23 bp, Artificial Sequence
  mitotic kinesin microtubule-associated protein Eg5 (Kif11) siRNA
gatggctttctcagtatactgtg

SEQ ID NO: 2298 - DNA, 23 bp, Artificial Sequence
  mitotic kinesin microtubule-associated protein Eg5 (Kif11) siRNA
atggctttctcagtatactgtgt

SEQ ID NO: 2299 - DNA, 23 bp, Artificial Sequence
  mitotic kinesin microtubule-associated protein Eg5 (Kif11) siRNA
tggctttctcagtatactgtgta

SEQ ID NO: 2300 - DNA, 23 bp, Artificial Sequence
  mitotic kinesin microtubule-associated protein Eg5 (Kif11) siRNA
ggctttctcagtatactgtgtaa

SEQ ID NO: 2301 - DNA, 23 bp, Artificial Sequence
  mitotic kinesin microtubule-associated protein Eg5 (Kif11) siRNA
gctttctcagtatactgtgtaac

SEQ ID NO: 2302 - DNA, 23 bp, Artificial Sequence
  mitotic kinesin microtubule-associated protein Eg5 (Kif11) siRNA
ctttctcagtatactgtgtaaca

SEQ ID NO: 2303 - DNA, 23 bp, Artificial Sequence
  mitotic kinesin microtubule-associated protein Eg5 (Kif11) siRNA
tttctcagtatactgtgtaacaa

SEQ ID NO: 2304 - DNA, 23 bp, Artificial Sequence
  mitotic kinesin microtubule-associated protein Eg5 (Kif11) siRNA
ttctcagtatactgtgtaacaat

SEQ ID NO: 2305 - DNA, 23 bp, Artificial Sequence
  mitotic kinesin microtubule-associated protein Eg5 (Kif11) siRNA
tctcagtatactgtgtaacaatc

SEQ ID NO: 2306 - DNA, 23 bp, Artificial Sequence
  mitotic kinesin microtubule-associated protein Eg5 (Kif11) siRNA
ctcagtatactgtgtaacaatct

SEQ ID NO: 2307 - DNA, 23 bp, Artificial Sequence
  mitotic kinesin microtubule-associated protein Eg5 (Kif11) siRNA
tcagtatactgtgtaacaatcta

SEQ ID NO: 2308 - DNA, 23 bp, Artificial Sequence
  mitotic kinesin microtubule-associated protein Eg5 (Kif11) siRNA
cagtatactgtgtaacaatctac

SEQ ID NO: 2309 - DNA, 23 bp, Artificial Sequence
  mitotic kinesin microtubule-associated protein Eg5 (Kif11) siRNA
agtatactgtgtaacaatctaca

SEQ ID NO: 2310 - DNA, 23 bp, Artificial Sequence
  mitotic kinesin microtubule-associated protein Eg5 (Kif11) siRNA
gtatactgtgtaacaatctacat

SEQ ID NO: 2311 - DNA, 23 bp, Artificial Sequence
  mitotic kinesin microtubule-associated protein Eg5 (Kif11) siRNA
tatactgtgtaacaatctacatg

SEQ ID NO: 2312 - DNA, 23 bp, Artificial Sequence
  mitotic kinesin microtubule-associated protein Eg5 (Kif11) siRNA
atactgtgtaacaatctacatga

SEQ ID NO: 2313 - DNA, 23 bp, Artificial Sequence
  mitotic kinesin microtubule-associated protein Eg5 (Kif11) siRNA
tactgtgtaacaatctacatgaa

SEQ ID NO: 2314 - DNA, 23 bp, Artificial Sequence
  mitotic kinesin microtubule-associated protein Eg5 (Kif11) siRNA
actgtgtaacaatctacatgaac

SEQ ID NO: 2315 - DNA, 23 bp, Artificial Sequence
  mitotic kinesin microtubule-associated protein Eg5 (Kif11) siRNA
ctgtgtaacaatctacatgaact

SEQ ID NO: 2316 - DNA, 23 bp, Artificial Sequence
  mitotic kinesin microtubule-associated protein Eg5 (Kif11) siRNA
tgtgtaacaatctacatgaacta

SEQ ID NO: 2317 - DNA, 23 bp, Artificial Sequence
  mitotic kinesin microtubule-associated protein Eg5 (Kif11) siRNA
gtgtaacaatctacatgaactac

SEQ ID NO: 2318 - DNA, 23 bp, Artificial Sequence
  mitotic kinesin microtubule-associated protein Eg5 (Kif11) siRNA
tgtaacaatctacatgaactaca

SEQ ID NO: 2319 - DNA, 23 bp, Artificial Sequence
  mitotic kinesin microtubule-associated protein Eg5 (Kif11) siRNA
gtaacaatctacatgaactacaa

SEQ ID NO: 2320 - DNA, 23 bp, Artificial Sequence
  mitotic kinesin microtubule-associated protein Eg5 (Kif11) siRNA
taacaatctacatgaactacaag

SEQ ID NO: 2321 - DNA, 23 bp, Artificial Sequence
  mitotic kinesin microtubule-associated protein Eg5 (Kif11) siRNA
aacaatctacatgaactacaaga

SEQ ID NO: 2322 - DNA, 23 bp, Artificial Sequence
  mitotic kinesin microtubule-associated protein Eg5 (Kif11) siRNA
acaatctacatgaactacaagaa

SEQ ID NO: 2323 - DNA, 23 bp, Artificial Sequence
  mitotic kinesin microtubule-associated protein Eg5 (Kif11) siRNA
caatctacatgaactacaagaaa

SEQ ID NO: 2324 - DNA, 23 bp, Artificial Sequence
  mitotic kinesin microtubule-associated protein Eg5 (Kif11) siRNA
aatctacatgaactacaagaaaa

SEQ ID NO: 2325 - DNA, 23 bp, Artificial Sequence
  mitotic kinesin microtubule-associated protein Eg5 (Kif11) siRNA
atctacatgaactacaagaaaat

SEQ ID NO: 2326 - DNA, 23 bp, Artificial Sequence
  mitotic kinesin microtubule-associated protein Eg5 (Kif11) siRNA
tctacatgaactacaagaaaata

SEQ ID NO: 2327 - DNA, 23 bp, Artificial Sequence
  mitotic kinesin microtubule-associated protein Eg5 (Kif11) siRNA
ctacatgaactacaagaaaatac

SEQ ID NO: 2328 - DNA, 23 bp, Artificial Sequence
  mitotic kinesin microtubule-associated protein Eg5 (Kif11) siRNA
tacatgaactacaagaaaatacc

SEQ ID NO: 2329 - DNA, 23 bp, Artificial Sequence
  mitotic kinesin microtubule-associated protein Eg5 (Kif11) siRNA
acatgaactacaagaaaatacca

SEQ ID NO: 2330 - DNA, 23 bp, Artificial Sequence
  mitotic kinesin microtubule-associated protein Eg5 (Kif11) siRNA
catgaactacaagaaaataccat

SEQ ID NO: 2331 - DNA, 23 bp, Artificial Sequence
  mitotic kinesin microtubule-associated protein Eg5 (Kif11) siRNA
atgaactacaagaaaataccatt

SEQ ID NO: 2332 - DNA, 23 bp, Artificial Sequence
  mitotic kinesin microtubule-associated protein Eg5 (Kif11) siRNA
tgaactacaagaaaataccattt

SEQ ID NO: 2333 - DNA, 23 bp, Artificial Sequence
  mitotic kinesin microtubule-associated protein Eg5 (Kif11) siRNA
gaactacaagaaaataccatttg

SEQ ID NO: 2334 - DNA, 23 bp, Artificial Sequence
  mitotic kinesin microtubule-associated protein Eg5 (Kif11) siRNA
aactacaagaaaataccatttgt

SEQ ID NO: 2335 - DNA, 23 bp, Artificial Sequence
  mitotic kinesin microtubule-associated protein Eg5 (Kif11) siRNA
actacaagaaaataccatttgtt

SEQ ID NO: 2336 - DNA, 23 bp, Artificial Sequence
  mitotic kinesin microtubule-associated protein Eg5 (Kif11) siRNA
ctacaagaaaataccatttgttc

SEQ ID NO: 2337 - DNA, 23 bp, Artificial Sequence
  mitotic kinesin microtubule-associated protein Eg5 (Kif11) siRNA
tacaagaaaataccatttgttcc

SEQ ID NO: 2338 - DNA, 23 bp, Artificial Sequence
  mitotic kinesin microtubule-associated protein Eg5 (Kif11) siRNA
acaagaaaataccatttgttcct

SEQ ID NO: 2339 - DNA, 23 bp, Artificial Sequence
  mitotic kinesin microtubule-associated protein Eg5 (Kif11) siRNA
caagaaaataccatttgttcctt

SEQ ID NO: 2340 - DNA, 23 bp, Artificial Sequence
  mitotic kinesin microtubule-associated protein Eg5 (Kif11) siRNA
aagaaaataccatttgttccttg

SEQ ID NO: 2341 - DNA, 23 bp, Artificial Sequence
  mitotic kinesin microtubule-associated protein Eg5 (Kif11) siRNA
agaaaataccatttgttccttgg

SEQ ID NO: 2342 - DNA, 23 bp, Artificial Sequence
  mitotic kinesin microtubule-associated protein Eg5 (Kif11) siRNA
gaaaataccatttgttccttggt

SEQ ID NO: 2343 - DNA, 23 bp, Artificial Sequence
  mitotic kinesin microtubule-associated protein Eg5 (Kif11) siRNA
aaaataccatttgttccttggtt

SEQ ID NO: 2344 - DNA, 23 bp, Artificial Sequence
  mitotic kinesin microtubule-associated protein Eg5 (Kif11) siRNA
aaataccatttgttccttggttg

SEQ ID NO: 2345 - DNA, 23 bp, Artificial Sequence
  mitotic kinesin microtubule-associated protein Eg5 (Kif11) siRNA
aataccatttgttccttggttga

SEQ ID NO: 2346 - DNA, 23 bp, Artificial Sequence
  mitotic kinesin microtubule-associated protein Eg5 (Kif11) siRNA
ataccatttgttccttggttgag

SEQ ID NO: 2347 - DNA, 23 bp, Artificial Sequence
  mitotic kinesin microtubule-associated protein Eg5 (Kif11) siRNA
taccatttgttccttggttgagt

SEQ ID NO: 2348 - DNA, 23 bp, Artificial Sequence
  mitotic kinesin microtubule-associated protein Eg5 (Kif11) siRNA
accatttgttccttggttgagtc

SEQ ID NO: 2349 - DNA, 23 bp, Artificial Sequence
  mitotic kinesin microtubule-associated protein Eg5 (Kif11) siRNA
ccatttgttccttggttgagtca

SEQ ID NO: 2350 - DNA, 23 bp, Artificial Sequence
  mitotic kinesin microtubule-associated protein Eg5 (Kif11) siRNA
catttgttccttggttgagtcac

SEQ ID NO: 2351 - DNA, 23 bp, Artificial Sequence
  mitotic kinesin microtubule-associated protein Eg5 (Kif11) siRNA
atttgttccttggttgagtcaca

SEQ ID NO: 2352 - DNA, 23 bp, Artificial Sequence
  mitotic kinesin microtubule-associated protein Eg5 (Kif11) siRNA
tttgttccttggttgagtcacaa

SEQ ID NO: 2353 - DNA, 23 bp, Artificial Sequence
  mitotic kinesin microtubule-associated protein Eg5 (Kif11) siRNA
ttgttccttggttgagtcacaaa

SEQ ID NO: 2354 - DNA, 23 bp, Artificial Sequence
  mitotic kinesin microtubule-associated protein Eg5 (Kif11) siRNA
tgttccttggttgagtcacaaaa

SEQ ID NO: 2355 - DNA, 23 bp, Artificial Sequence
  mitotic kinesin microtubule-associated protein Eg5 (Kif11) siRNA
gttccttggttgagtcacaaaag

SEQ ID NO: 2356 - DNA, 23 bp, Artificial Sequence
  mitotic kinesin microtubule-associated protein Eg5 (Kif11) siRNA
ttccttggttgagtcacaaaagc

SEQ ID NO: 2357 - DNA, 23 bp, Artificial Sequence
  mitotic kinesin microtubule-associated protein Eg5 (Kif11) siRNA
tccttggttgagtcacaaaagca

SEQ ID NO: 2358 - DNA, 23 bp, Artificial Sequence
  mitotic kinesin microtubule-associated protein Eg5 (Kif11) siRNA
ccttggttgagtcacaaaagcaa

SEQ ID NO: 2359 - DNA, 23 bp, Artificial Sequence
  mitotic kinesin microtubule-associated protein Eg5 (Kif11) siRNA
cttggttgagtcacaaaagcaat

SEQ ID NO: 2360 - DNA, 23 bp, Artificial Sequence
  mitotic kinesin microtubule-associated protein Eg5 (Kif11) siRNA
ttggttgagtcacaaaagcaatg

SEQ ID NO: 2361 - DNA, 23 bp, Artificial Sequence
  mitotic kinesin microtubule-associated protein Eg5 (Kif11) siRNA
tggttgagtcacaaaagcaatgt

SEQ ID NO: 2362 - DNA, 23 bp, Artificial Sequence
  mitotic kinesin microtubule-associated protein Eg5 (Kif11) siRNA
ggttgagtcacaaaagcaatgtg

SEQ ID NO: 2363 - DNA, 23 bp, Artificial Sequence
  mitotic kinesin microtubule-associated protein Eg5 (Kif11) siRNA
gttgagtcacaaaagcaatgtgg

SEQ ID NO: 2364 - DNA, 23 bp, Artificial Sequence
  mitotic kinesin microtubule-associated protein Eg5 (Kif11) siRNA
ttgagtcacaaaagcaatgtgga

SEQ ID NO: 2365 - DNA, 23 bp, Artificial Sequence
  mitotic kinesin microtubule-associated protein Eg5 (Kif11) siRNA
tgagtcacaaaagcaatgtggaa

SEQ ID NO: 2366 - DNA, 23 bp, Artificial Sequence
  mitotic kinesin microtubule-associated protein Eg5 (Kif11) siRNA
gagtcacaaaagcaatgtggaaa

SEQ ID NO: 2367 - DNA, 23 bp, Artificial Sequence
  mitotic kinesin microtubule-associated protein Eg5 (Kif11) siRNA
agtcacaaaagcaatgtggaaac

SEQ ID NO: 2368 - DNA, 23 bp, Artificial Sequence
  mitotic kinesin microtubule-associated protein Eg5 (Kif11) siRNA
gtcacaaaagcaatgtggaaacc

SEQ ID NO: 2369 - DNA, 23 bp, Artificial Sequence
  mitotic kinesin microtubule-associated protein Eg5 (Kif11) siRNA
tcacaaaagcaatgtggaaacct

SEQ ID NO: 2370 - DNA, 23 bp, Artificial Sequence
  mitotic kinesin microtubule-associated protein Eg5 (Kif11) siRNA
cacaaaagcaatgtggaaaccta

SEQ ID NO: 2371 - DNA, 23 bp, Artificial Sequence
  mitotic kinesin microtubule-associated protein Eg5 (Kif11) siRNA
acaaaagcaatgtggaaacctaa

SEQ ID NO: 2372 - DNA, 23 bp, Artificial Sequence
  mitotic kinesin microtubule-associated protein Eg5 (Kif11) siRNA
caaaagcaatgtggaaacctaac

SEQ ID NO: 2373 - DNA, 23 bp, Artificial Sequence
  mitotic kinesin microtubule-associated protein Eg5 (Kif11) siRNA
aaaagcaatgtggaaacctaact

SEQ ID NO: 2374 - DNA, 23 bp, Artificial Sequence
  mitotic kinesin microtubule-associated protein Eg5 (Kif11) siRNA
aaagcaatgtggaaacctaactg

SEQ ID NO: 2375 - DNA, 23 bp, Artificial Sequence
  mitotic kinesin microtubule-associated protein Eg5 (Kif11) siRNA
aagcaatgtggaaacctaactga

SEQ ID NO: 2376 - DNA, 23 bp, Artificial Sequence
  mitotic kinesin microtubule-associated protein Eg5 (Kif11) siRNA
agcaatgtggaaacctaactgaa

SEQ ID NO: 2377 - DNA, 23 bp, Artificial Sequence
  mitotic kinesin microtubule-associated protein Eg5 (Kif11) siRNA
gcaatgtggaaacctaactgaag

SEQ ID NO: 2378 - DNA, 23 bp, Artificial Sequence
  mitotic kinesin microtubule-associated protein Eg5 (Kif11) siRNA
caatgtggaaacctaactgaaga

SEQ ID NO: 2379 - DNA, 23 bp, Artificial Sequence
  mitotic kinesin microtubule-associated protein Eg5 (Kif11) siRNA
aatgtggaaacctaactgaagac

SEQ ID NO: 2380 - DNA, 23 bp, Artificial Sequence
  mitotic kinesin microtubule-associated protein Eg5 (Kif11) siRNA
atgtggaaacctaactgaagacc

SEQ ID NO: 2381 - DNA, 23 bp, Artificial Sequence
  mitotic kinesin microtubule-associated protein Eg5 (Kif11) siRNA
tgtggaaacctaactgaagacct

SEQ ID NO: 2382 - DNA, 23 bp, Artificial Sequence
  mitotic kinesin microtubule-associated protein Eg5 (Kif11) siRNA
gtggaaacctaactgaagacctg

SEQ ID NO: 2383 - DNA, 23 bp, Artificial Sequence
  mitotic kinesin microtubule-associated protein Eg5 (Kif11) siRNA
tggaaacctaactgaagacctga

SEQ ID NO: 2384 - DNA, 23 bp, Artificial Sequence
  mitotic kinesin microtubule-associated protein Eg5 (Kif11) siRNA
ggaaacctaactgaagacctgaa

SEQ ID NO: 2385 - DNA, 23 bp, Artificial Sequence
  mitotic kinesin microtubule-associated protein Eg5 (Kif11) siRNA
gaaacctaactgaagacctgaag

SEQ ID NO: 2386 - DNA, 23 bp, Artificial Sequence
  mitotic kinesin microtubule-associated protein Eg5 (Kif11) siRNA
aaacctaactgaagacctgaaga

SEQ ID NO: 2387 - DNA, 23 bp, Artificial Sequence
  mitotic kinesin microtubule-associated protein Eg5 (Kif11) siRNA
aacctaactgaagacctgaagac

SEQ ID NO: 2388 - DNA, 23 bp, Artificial Sequence
  mitotic kinesin microtubule-associated protein Eg5 (Kif11) siRNA
acctaactgaagacctgaagaca

SEQ ID NO: 2389 - DNA, 23 bp, Artificial Sequence
  mitotic kinesin microtubule-associated protein Eg5 (Kif11) siRNA
cctaactgaagacctgaagacaa

SEQ ID NO: 2390 - DNA, 23 bp, Artificial Sequence
  mitotic kinesin microtubule-associated protein Eg5 (Kif11) siRNA
ctaactgaagacctgaagacaat

SEQ ID NO: 2391 - DNA, 23 bp, Artificial Sequence
  mitotic kinesin microtubule-associated protein Eg5 (Kif11) siRNA
taactgaagacctgaagacaata

SEQ ID NO: 2392 - DNA, 23 bp, Artificial Sequence
  mitotic kinesin microtubule-associated protein Eg5 (Kif11) siRNA
aactgaagacctgaagacaataa

SEQ ID NO: 2393 - DNA, 23 bp, Artificial Sequence
  mitotic kinesin microtubule-associated protein Eg5 (Kif11) siRNA
actgaagacctgaagacaataaa

SEQ ID NO: 2394 - DNA, 23 bp, Artificial Sequence
  mitotic kinesin microtubule-associated protein Eg5 (Kif11) siRNA
ctgaagacctgaagacaataaag

SEQ ID NO: 2395 - DNA, 23 bp, Artificial Sequence
  mitotic kinesin microtubule-associated protein Eg5 (Kif11) siRNA
tgaagacctgaagacaataaagc

SEQ ID NO: 2396 - DNA, 23 bp, Artificial Sequence
  mitotic kinesin microtubule-associated protein Eg5 (Kif11) siRNA
gaagacctgaagacaataaagca

SEQ ID NO: 2397 - DNA, 23 bp, Artificial Sequence
  mitotic kinesin microtubule-associated protein Eg5 (Kif11) siRNA
aagacctgaagacaataaagcag

SEQ ID NO: 2398 - DNA, 23 bp, Artificial Sequence
  mitotic kinesin microtubule-associated protein Eg5 (Kif11) siRNA
agacctgaagacaataaagcaga

SEQ ID NO: 2399 - DNA, 23 bp, Artificial Sequence
  mitotic kinesin microtubule-associated protein Eg5 (Kif11) siRNA
gacctgaagacaataaagcagac

SEQ ID NO: 2400 - DNA, 23 bp, Artificial Sequence
  mitotic kinesin microtubule-associated protein Eg5 (Kif11) siRNA
acctgaagacaataaagcagacc

SEQ ID NO: 2401 - DNA, 23 bp, Artificial Sequence
  mitotic kinesin microtubule-associated protein Eg5 (Kif11) siRNA
cctgaagacaataaagcagaccc

SEQ ID NO: 2402 - DNA, 23 bp, Artificial Sequence
  mitotic kinesin microtubule-associated protein Eg5 (Kif11) siRNA
ctgaagacaataaagcagaccca

SEQ ID NO: 2403 - DNA, 23 bp, Artificial Sequence
  mitotic kinesin microtubule-associated protein Eg5 (Kif11) siRNA
tgaagacaataaagcagacccat

SEQ ID NO: 2404 - DNA, 23 bp, Artificial Sequence
  mitotic kinesin microtubule-associated protein Eg5 (Kif11) siRNA
gaagacaataaagcagacccatt

SEQ ID NO: 2405 - DNA, 23 bp, Artificial Sequence
  mitotic kinesin microtubule-associated protein Eg5 (Kif11) siRNA
aagacaataaagcagacccattc

SEQ ID NO: 2406 - DNA, 23 bp, Artificial Sequence
  mitotic kinesin microtubule-associated protein Eg5 (Kif11) siRNA
agacaataaagcagacccattcc

SEQ ID NO: 2407 - DNA, 23 bp, Artificial Sequence
  mitotic kinesin microtubule-associated protein Eg5 (Kif11) siRNA
gacaataaagcagacccattccc

SEQ ID NO: 2408 - DNA, 23 bp, Artificial Sequence
  mitotic kinesin microtubule-associated protein Eg5 (Kif11) siRNA
acaataaagcagacccattccca

SEQ ID NO: 2409 - DNA, 23 bp, Artificial Sequence
  mitotic kinesin microtubule-associated protein Eg5 (Kif11) siRNA
caataaagcagacccattcccag

SEQ ID NO: 2410 - DNA, 23 bp, Artificial Sequence
  mitotic kinesin microtubule-associated protein Eg5 (Kif11) siRNA
aataaagcagacccattcccagg

SEQ ID NO: 2411 - DNA, 23 bp, Artificial Sequence
  mitotic kinesin microtubule-associated protein Eg5 (Kif11) siRNA
ataaagcagacccattcccagga

SEQ ID NO: 2412 - DNA, 23 bp, Artificial Sequence
  mitotic kinesin microtubule-associated protein Eg5 (Kif11) siRNA
taaagcagacccattcccaggaa

SEQ ID NO: 2413 - DNA, 23 bp, Artificial Sequence
  mitotic kinesin microtubule-associated protein Eg5 (Kif11) siRNA
aaagcagacccattcccaggaac

SEQ ID NO: 2414 - DNA, 23 bp, Artificial Sequence
  mitotic kinesin microtubule-associated protein Eg5 (Kif11) siRNA
aagcagacccattcccaggaact

SEQ ID NO: 2415 - DNA, 23 bp, Artificial Sequence
  mitotic kinesin microtubule-associated protein Eg5 (Kif11) siRNA
agcagacccattcccaggaactt

SEQ ID NO: 2416 - DNA, 23 bp, Artificial Sequence
  mitotic kinesin microtubule-associated protein Eg5 (Kif11) siRNA
gcagacccattcccaggaacttt

SEQ ID NO: 2417 - DNA, 23 bp, Artificial Sequence
  mitotic kinesin microtubule-associated protein Eg5 (Kif11) siRNA
cagacccattcccaggaactttg

SEQ ID NO: 2418 - DNA, 23 bp, Artificial Sequence
  mitotic kinesin microtubule-associated protein Eg5 (Kif11) siRNA
agacccattcccaggaactttgc

SEQ ID NO: 2419 - DNA, 23 bp, Artificial Sequence
  mitotic kinesin microtubule-associated protein Eg5 (Kif11) siRNA
gacccattcccaggaactttgca

SEQ ID NO: 2420 - DNA, 23 bp, Artificial Sequence
  mitotic kinesin microtubule-associated protein Eg5 (Kif11) siRNA
acccattcccaggaactttgcaa

SEQ ID NO: 2421 - DNA, 23 bp, Artificial Sequence
  mitotic kinesin microtubule-associated protein Eg5 (Kif11) siRNA
cccattcccaggaactttgcaag

SEQ ID NO: 2422 - DNA, 23 bp, Artificial Sequence
  mitotic kinesin microtubule-associated protein Eg5 (Kif11) siRNA
ccattcccaggaactttgcaagt

SEQ ID NO: 2423 - DNA, 23 bp, Artificial Sequence
  mitotic kinesin microtubule-associated protein Eg5 (Kif11) siRNA
cattcccaggaactttgcaagtt

SEQ ID NO: 2424 - DNA, 23 bp, Artificial Sequence
  mitotic kinesin microtubule-associated protein Eg5 (Kif11) siRNA
attcccaggaactttgcaagtta

SEQ ID NO: 2425 - DNA, 23 bp, Artificial Sequence
  mitotic kinesin microtubule-associated protein Eg5 (Kif11) siRNA
ttcccaggaactttgcaagttaa

SEQ ID NO: 2426 - DNA, 23 bp, Artificial Sequence
  mitotic kinesin microtubule-associated protein Eg5 (Kif11) siRNA
tcccaggaactttgcaagttaat

SEQ ID NO: 2427 - DNA, 23 bp, Artificial Sequence
  mitotic kinesin microtubule-associated protein Eg5 (Kif11) siRNA
cccaggaactttgcaagttaatg

SEQ ID NO: 2428 - DNA, 23 bp, Artificial Sequence
  mitotic kinesin microtubule-associated protein Eg5 (Kif11) siRNA
ccaggaactttgcaagttaatga

SEQ ID NO: 2429 - DNA, 23 bp, Artificial Sequence
  mitotic kinesin microtubule-associated protein Eg5 (Kif11) siRNA
caggaactttgcaagttaatgaa

SEQ ID NO: 2430 - DNA, 23 bp, Artificial Sequence
  mitotic kinesin microtubule-associated protein Eg5 (Kif11) siRNA
aggaactttgcaagttaatgaat

SEQ ID NO: 2431 - DNA, 23 bp, Artificial Sequence
  mitotic kinesin microtubule-associated protein Eg5 (Kif11) siRNA
ggaactttgcaagttaatgaatc

SEQ ID NO: 2432 - DNA, 23 bp, Artificial Sequence
  mitotic kinesin microtubule-associated protein Eg5 (Kif11) siRNA
gaactttgcaagttaatgaatct

SEQ ID NO: 2433 - DNA, 23 bp, Artificial Sequence
  mitotic kinesin microtubule-associated protein Eg5 (Kif11) siRNA
aactttgcaagttaatgaatctt

SEQ ID NO: 2434 - DNA, 23 bp, Artificial Sequence
  mitotic kinesin microtubule-associated protein Eg5 (Kif11) siRNA
actttgcaagttaatgaatcttt

SEQ ID NO: 2435 - DNA, 23 bp, Artificial Sequence
  mitotic kinesin microtubule-associated protein Eg5 (Kif11) siRNA
ctttgcaagttaatgaatctttg

SEQ ID NO: 2436 - DNA, 23 bp, Artificial Sequence
  mitotic kinesin microtubule-associated protein Eg5 (Kif11) siRNA
tttgcaagttaatgaatctttgg

SEQ ID NO: 2437 - DNA, 23 bp, Artificial Sequence
  mitotic kinesin microtubule-associated protein Eg5 (Kif11) siRNA
ttgcaagttaatgaatctttgga

SEQ ID NO: 2438 - DNA, 23 bp, Artificial Sequence
  mitotic kinesin microtubule-associated protein Eg5 (Kif11) siRNA
tgcaagttaatgaatctttggac

SEQ ID NO: 2439 - DNA, 23 bp, Artificial Sequence
  mitotic kinesin microtubule-associated protein Eg5 (Kif11) siRNA
gcaagttaatgaatctttggaca

SEQ ID NO: 2440 - DNA, 23 bp, Artificial Sequence
  mitotic kinesin microtubule-associated protein Eg5 (Kif11) siRNA
caagttaatgaatctttggacag

SEQ ID NO: 2441 - DNA, 23 bp, Artificial Sequence
  mitotic kinesin microtubule-associated protein Eg5 (Kif11) siRNA
aagttaatgaatctttggacaga

SEQ ID NO: 2442 - DNA, 23 bp, Artificial Sequence
  mitotic kinesin microtubule-associated protein Eg5 (Kif11) siRNA
agttaatgaatctttggacagag

SEQ ID NO: 2443 - DNA, 23 bp, Artificial Sequence
  mitotic kinesin microtubule-associated protein Eg5 (Kif11) siRNA
gttaatgaatctttggacagaga

SEQ ID NO: 2444 - DNA, 23 bp, Artificial Sequence
  mitotic kinesin microtubule-associated protein Eg5 (Kif11) siRNA
ttaatgaatctttggacagagag

SEQ ID NO: 2445 - DNA, 23 bp, Artificial Sequence
  mitotic kinesin microtubule-associated protein Eg5 (Kif11) siRNA
taatgaatctttggacagagaga

SEQ ID NO: 2446 - DNA, 23 bp, Artificial Sequence
  mitotic kinesin microtubule-associated protein Eg5 (Kif11) siRNA
aatgaatctttggacagagagat

SEQ ID NO: 2447 - DNA, 23 bp, Artificial Sequence
  mitotic kinesin microtubule-associated protein Eg5 (Kif11) siRNA
atgaatctttggacagagagatt

SEQ ID NO: 2448 - DNA, 23 bp, Artificial Sequence
  mitotic kinesin microtubule-associated protein Eg5 (Kif11) siRNA
tgaatctttggacagagagattc

SEQ ID NO: 2449 - DNA, 23 bp, Artificial Sequence
  mitotic kinesin microtubule-associated protein Eg5 (Kif11) siRNA
gaatctttggacagagagattct

SEQ ID NO: 2450 - DNA, 23 bp, Artificial Sequence
  mitotic kinesin microtubule-associated protein Eg5 (Kif11) siRNA
aatctttggacagagagattctg

SEQ ID NO: 2451 - DNA, 23 bp, Artificial Sequence
  mitotic kinesin microtubule-associated protein Eg5 (Kif11) siRNA
atctttggacagagagattctgt

SEQ ID NO: 2452 - DNA, 23 bp, Artificial Sequence
  mitotic kinesin microtubule-associated protein Eg5 (Kif11) siRNA
tctttggacagagagattctgtg

SEQ ID NO: 2453 - DNA, 23 bp, Artificial Sequence
  mitotic kinesin microtubule-associated protein Eg5 (Kif11) siRNA
ctttggacagagagattctgtgc

SEQ ID NO: 2454 - DNA, 23 bp, Artificial Sequence
  mitotic kinesin microtubule-associated protein Eg5 (Kif11) siRNA
tttggacagagagattctgtgct

SEQ ID NO: 2455 - DNA, 23 bp, Artificial Sequence
  mitotic kinesin microtubule-associated protein Eg5 (Kif11) siRNA
ttggacagagagattctgtgctt

SEQ ID NO: 2456 - DNA, 23 bp, Artificial Sequence
  mitotic kinesin microtubule-associated protein Eg5 (Kif11) siRNA
tggacagagagattctgtgcttt

SEQ ID NO: 2457 - DNA, 23 bp, Artificial Sequence
  mitotic kinesin microtubule-associated protein Eg5 (Kif11) siRNA
ggacagagagattctgtgctttg

SEQ ID NO: 2458 - DNA, 23 bp, Artificial Sequence
  mitotic kinesin microtubule-associated protein Eg5 (Kif11) siRNA
gacagagagattctgtgctttgg

SEQ ID NO: 2459 - DNA, 23 bp, Artificial Sequence
  mitotic kinesin microtubule-associated protein Eg5 (Kif11) siRNA
acagagagattctgtgctttgga

SEQ ID NO: 2460 - DNA, 23 bp, Artificial Sequence
  mitotic kinesin microtubule-associated protein Eg5 (Kif11) siRNA
cagagagattctgtgctttggag

SEQ ID NO: 2461 - DNA, 23 bp, Artificial Sequence
  mitotic kinesin microtubule-associated protein Eg5 (Kif11) siRNA
agagagattctgtgctttggagg

SEQ ID NO: 2462 - DNA, 23 bp, Artificial Sequence
  mitotic kinesin microtubule-associated protein Eg5 (Kif11) siRNA
gagagattctgtgctttggagga

SEQ ID NO: 2463 - DNA, 23 bp, Artificial Sequence
  mitotic kinesin microtubule-associated protein Eg5 (Kif11) siRNA
agagattctgtgctttggaggaa

SEQ ID NO: 2464 - DNA, 23 bp, Artificial Sequence
  mitotic kinesin microtubule-associated protein Eg5 (Kif11) siRNA
gagattctgtgctttggaggaaa

SEQ ID NO: 2465 - DNA, 23 bp, Artificial Sequence
  mitotic kinesin microtubule-associated protein Eg5 (Kif11) siRNA
agattctgtgctttggaggaaaa

SEQ ID NO: 2466 - DNA, 23 bp, Artificial Sequence
  mitotic kinesin microtubule-associated protein Eg5 (Kif11) siRNA
gattctgtgctttggaggaaaag

SEQ ID NO: 2467 - DNA, 23 bp, Artificial Sequence
  mitotic kinesin microtubule-associated protein Eg5 (Kif11) siRNA
attctgtgctttggaggaaaagt

SEQ ID NO: 2468 - DNA, 23 bp, Artificial Sequence
  mitotic kinesin microtubule-associated protein Eg5 (Kif11) siRNA
ttctgtgctttggaggaaaagtg

SEQ ID NO: 2469 - DNA, 23 bp, Artificial Sequence
  mitotic kinesin microtubule-associated protein Eg5 (Kif11) siRNA
tctgtgctttggaggaaaagtgt

SEQ ID NO: 2470 - DNA, 23 bp, Artificial Sequence
  mitotic kinesin microtubule-associated protein Eg5 (Kif11) siRNA
ctgtgctttggaggaaaagtgtg

SEQ ID NO: 2471 - DNA, 23 bp, Artificial Sequence
  mitotic kinesin microtubule-associated protein Eg5 (Kif11) siRNA
tgtgctttggaggaaaagtgtga

SEQ ID NO: 2472 - DNA, 23 bp, Artificial Sequence
  mitotic kinesin microtubule-associated protein Eg5 (Kif11) siRNA
gtgctttggaggaaaagtgtgaa

SEQ ID NO: 2473 - DNA, 23 bp, Artificial Sequence
  mitotic kinesin microtubule-associated protein Eg5 (Kif11) siRNA
tgctttggaggaaaagtgtgaaa

SEQ ID NO: 2474 - DNA, 23 bp, Artificial Sequence
  mitotic kinesin microtubule-associated protein Eg5 (Kif11) siRNA
gctttggaggaaaagtgtgaaaa

SEQ ID NO: 2475 - DNA, 23 bp, Artificial Sequence
  mitotic kinesin microtubule-associated protein Eg5 (Kif11) siRNA
ctttggaggaaaagtgtgaaaat

SEQ ID NO: 2476 - DNA, 23 bp, Artificial Sequence
  mitotic kinesin microtubule-associated protein Eg5 (Kif11) siRNA
tttggaggaaaagtgtgaaaata

SEQ ID NO: 2477 - DNA, 23 bp, Artificial Sequence
  mitotic kinesin microtubule-associated protein Eg5 (Kif11) siRNA
ttggaggaaaagtgtgaaaatat

SEQ ID NO: 2478 - DNA, 23 bp, Artificial Sequence
  mitotic kinesin microtubule-associated protein Eg5 (Kif11) siRNA
tggaggaaaagtgtgaaaatata

SEQ ID NO: 2479 - DNA, 23 bp, Artificial Sequence
  mitotic kinesin microtubule-associated protein Eg5 (Kif11) siRNA
ggaggaaaagtgtgaaaatatac

SEQ ID NO: 2480 - DNA, 23 bp, Artificial Sequence
  mitotic kinesin microtubule-associated protein Eg5 (Kif11) siRNA
gaggaaaagtgtgaaaatataca

SEQ ID NO: 2481 - DNA, 23 bp, Artificial Sequence
  mitotic kinesin microtubule-associated protein Eg5 (Kif11) siRNA
aggaaaagtgtgaaaatatacag

SEQ ID NO: 2482 - DNA, 23 bp, Artificial Sequence
  mitotic kinesin microtubule-associated protein Eg5 (Kif11) siRNA
ggaaaagtgtgaaaatatacaga

SEQ ID NO: 2483 - DNA, 23 bp, Artificial Sequence
  mitotic kinesin microtubule-associated protein Eg5 (Kif11) siRNA
gaaaagtgtgaaaatatacagaa

SEQ ID NO: 2484 - DNA, 23 bp, Artificial Sequence
  mitotic kinesin microtubule-associated protein Eg5 (Kif11) siRNA
aaaagtgtgaaaatatacagaaa

SEQ ID NO: 2485 - DNA, 23 bp, Artificial Sequence
  mitotic kinesin microtubule-associated protein Eg5 (Kif11) siRNA
aaagtgtgaaaatatacagaaac

SEQ ID NO: 2486 - DNA, 23 bp, Artificial Sequence
  mitotic kinesin microtubule-associated protein Eg5 (Kif11) siRNA
aagtgtgaaaatatacagaaacc

SEQ ID NO: 2487 - DNA, 23 bp, Artificial Sequence
  mitotic kinesin microtubule-associated protein Eg5 (Kif11) siRNA
agtgtgaaaatatacagaaacca

SEQ ID NO: 2488 - DNA, 23 bp, Artificial Sequence
  mitotic kinesin microtubule-associated protein Eg5 (Kif11) siRNA
gtgtgaaaatatacagaaaccac

SEQ ID NO: 2489 - DNA, 23 bp, Artificial Sequence
  mitotic kinesin microtubule-associated protein Eg5 (Kif11) siRNA
tgtgaaaatatacagaaaccact

SEQ ID NO: 2490 - DNA, 23 bp, Artificial Sequence
  mitotic kinesin microtubule-associated protein Eg5 (Kif11) siRNA
gtgaaaatatacagaaaccactt

SEQ ID NO: 2491 - DNA, 23 bp, Artificial Sequence
  mitotic kinesin microtubule-associated protein Eg5 (Kif11) siRNA
tgaaaatatacagaaaccactta

SEQ ID NO: 2492 - DNA, 23 bp, Artificial Sequence
  mitotic kinesin microtubule-associated protein Eg5 (Kif11) siRNA
gaaaatatacagaaaccacttag

SEQ ID NO: 2493 - DNA, 23 bp, Artificial Sequence
  mitotic kinesin microtubule-associated protein Eg5 (Kif11) siRNA
aaaatatacagaaaccacttagt

SEQ ID NO: 2494 - DNA, 23 bp, Artificial Sequence
  mitotic kinesin microtubule-associated protein Eg5 (Kif11) siRNA
aaatatacagaaaccacttagta

SEQ ID NO: 2495 - DNA, 23 bp, Artificial Sequence
  mitotic kinesin microtubule-associated protein Eg5 (Kif11) siRNA
aatatacagaaaccacttagtag

SEQ ID NO: 2496 - DNA, 23 bp, Artificial Sequence
  mitotic kinesin microtubule-associated protein Eg5 (Kif11) siRNA
atatacagaaaccacttagtagt

SEQ ID NO: 2497 - DNA, 23 bp, Artificial Sequence
  mitotic kinesin microtubule-associated protein Eg5 (Kif11) siRNA
tatacagaaaccacttagtagtg

SEQ ID NO: 2498 - DNA, 23 bp, Artificial Sequence
  mitotic kinesin microtubule-associated protein Eg5 (Kif11) siRNA
atacagaaaccacttagtagtgt

SEQ ID NO: 2499 - DNA, 23 bp, Artificial Sequence
  mitotic kinesin microtubule-associated protein Eg5 (Kif11) siRNA
tacagaaaccacttagtagtgtc

SEQ ID NO: 2500 - DNA, 23 bp, Artificial Sequence
  mitotic kinesin microtubule-associated protein Eg5 (Kif11) siRNA
acagaaaccacttagtagtgtcc

SEQ ID NO: 2501 - DNA, 23 bp, Artificial Sequence
  mitotic kinesin microtubule-associated protein Eg5 (Kif11) siRNA
cagaaaccacttagtagtgtcca

SEQ ID NO: 2502 - DNA, 23 bp, Artificial Sequence
  mitotic kinesin microtubule-associated protein Eg5 (Kif11) siRNA
agaaaccacttagtagtgtccag

SEQ ID NO: 2503 - DNA, 23 bp, Artificial Sequence
  mitotic kinesin microtubule-associated protein Eg5 (Kif11) siRNA
gaaaccacttagtagtgtccagg

SEQ ID NO: 2504 - DNA, 23 bp, Artificial Sequence
  mitotic kinesin microtubule-associated protein Eg5 (Kif11) siRNA
aaaccacttagtagtgtccagga

SEQ ID NO: 2505 - DNA, 23 bp, Artificial Sequence
  mitotic kinesin microtubule-associated protein Eg5 (Kif11) siRNA
aaccacttagtagtgtccaggaa

SEQ ID NO: 2506 - DNA, 23 bp, Artificial Sequence
  mitotic kinesin microtubule-associated protein Eg5 (Kif11) siRNA
accacttagtagtgtccaggaaa

SEQ ID NO: 2507 - DNA, 23 bp, Artificial Sequence
  mitotic kinesin microtubule-associated protein Eg5 (Kif11) siRNA
ccacttagtagtgtccaggaaaa

SEQ ID NO: 2508 - DNA, 23 bp, Artificial Sequence
  mitotic kinesin microtubule-associated protein Eg5 (Kif11) siRNA
cacttagtagtgtccaggaaaat

SEQ ID NO: 2509 - DNA, 23 bp, Artificial Sequence
  mitotic kinesin microtubule-associated protein Eg5 (Kif11) siRNA
acttagtagtgtccaggaaaata

SEQ ID NO: 2510 - DNA, 23 bp, Artificial Sequence
  mitotic kinesin microtubule-associated protein Eg5 (Kif11) siRNA
cttagtagtgtccaggaaaatat

SEQ ID NO: 2511 - DNA, 23 bp, Artificial Sequence
  mitotic kinesin microtubule-associated protein Eg5 (Kif11) siRNA
ttagtagtgtccaggaaaatata

SEQ ID NO: 2512 - DNA, 23 bp, Artificial Sequence
  mitotic kinesin microtubule-associated protein Eg5 (Kif11) siRNA
tagtagtgtccaggaaaatatac

SEQ ID NO: 2513 - DNA, 23 bp, Artificial Sequence
  mitotic kinesin microtubule-associated protein Eg5 (Kif11) siRNA
agtagtgtccaggaaaatataca

SEQ ID NO: 2514 - DNA, 23 bp, Artificial Sequence
  mitotic kinesin microtubule-associated protein Eg5 (Kif11) siRNA
gtagtgtccaggaaaatatacag

SEQ ID NO: 2515 - DNA, 23 bp, Artificial Sequence
  mitotic kinesin microtubule-associated protein Eg5 (Kif11) siRNA
tagtgtccaggaaaatatacagc

SEQ ID NO: 2516 - DNA, 23 bp, Artificial Sequence
  mitotic kinesin microtubule-associated protein Eg5 (Kif11) siRNA
agtgtccaggaaaatatacagca

SEQ ID NO: 2517 - DNA, 23 bp, Artificial Sequence
  mitotic kinesin microtubule-associated protein Eg5 (Kif11) siRNA
gtgtccaggaaaatatacagcag

SEQ ID NO: 2518 - DNA, 23 bp, Artificial Sequence
  mitotic kinesin microtubule-associated protein Eg5 (Kif11) siRNA
tgtccaggaaaatatacagcaga

SEQ ID NO: 2519 - DNA, 23 bp, Artificial Sequence
  mitotic kinesin microtubule-associated protein Eg5 (Kif11) siRNA
gtccaggaaaatatacagcagaa

SEQ ID NO: 2520 - DNA, 23 bp, Artificial Sequence
  mitotic kinesin microtubule-associated protein Eg5 (Kif11) siRNA
tccaggaaaatatacagcagaaa

SEQ ID NO: 2521 - DNA, 23 bp, Artificial Sequence
  mitotic kinesin microtubule-associated protein Eg5 (Kif11) siRNA
ccaggaaaatatacagcagaaat

SEQ ID NO: 2522 - DNA, 23 bp, Artificial Sequence
  mitotic kinesin microtubule-associated protein Eg5 (Kif11) siRNA
caggaaaatatacagcagaaatc

SEQ ID NO: 2523 - DNA, 23 bp, Artificial Sequence
  mitotic kinesin microtubule-associated protein Eg5 (Kif11) siRNA
aggaaaatatacagcagaaatct

SEQ ID NO: 2524 - DNA, 23 bp, Artificial Sequence
  mitotic kinesin microtubule-associated protein Eg5 (Kif11) siRNA
ggaaaatatacagcagaaatcta

SEQ ID NO: 2525 - DNA, 23 bp, Artificial Sequence
  mitotic kinesin microtubule-associated protein Eg5 (Kif11) siRNA
gaaaatatacagcagaaatctaa

SEQ ID NO: 2526 - DNA, 23 bp, Artificial Sequence
  mitotic kinesin microtubule-associated protein Eg5 (Kif11) siRNA
aaaatatacagcagaaatctaag

SEQ ID NO: 2527 - DNA, 23 bp, Artificial Sequence
  mitotic kinesin microtubule-associated protein Eg5 (Kif11) siRNA
aaatatacagcagaaatctaagg

SEQ ID NO: 2528 - DNA, 23 bp, Artificial Sequence
  mitotic kinesin microtubule-associated protein Eg5 (Kif11) siRNA
aatatacagcagaaatctaagga

SEQ ID NO: 2529 - DNA, 23 bp, Artificial Sequence
  mitotic kinesin microtubule-associated protein Eg5 (Kif11) siRNA
atatacagcagaaatctaaggat

SEQ ID NO: 2530 - DNA, 23 bp, Artificial Sequence
  mitotic kinesin microtubule-associated protein Eg5 (Kif11) siRNA
tatacagcagaaatctaaggata

SEQ ID NO: 2531 - DNA, 23 bp, Artificial Sequence
  mitotic kinesin microtubule-associated protein Eg5 (Kif11) siRNA
atacagcagaaatctaaggatat

SEQ ID NO: 2532 - DNA, 23 bp, Artificial Sequence
  mitotic kinesin microtubule-associated protein Eg5 (Kif11) siRNA
tacagcagaaatctaaggatata

SEQ ID NO: 2533 - DNA, 23 bp, Artificial Sequence
  mitotic kinesin microtubule-associated protein Eg5 (Kif11) siRNA
acagcagaaatctaaggatatag

SEQ ID NO: 2534 - DNA, 23 bp, Artificial Sequence
  mitotic kinesin microtubule-associated protein Eg5 (Kif11) siRNA
cagcagaaatctaaggatatagt

SEQ ID NO: 2535 - DNA, 23 bp, Artificial Sequence
  mitotic kinesin microtubule-associated protein Eg5 (Kif11) siRNA
agcagaaatctaaggatatagtc

SEQ ID NO: 2536 - DNA, 23 bp, Artificial Sequence
  mitotic kinesin microtubule-associated protein Eg5 (Kif11) siRNA
gcagaaatctaaggatatagtca

SEQ ID NO: 2537 - DNA, 23 bp, Artificial Sequence
  mitotic kinesin microtubule-associated protein Eg5 (Kif11) siRNA
cagaaatctaaggatatagtcaa

SEQ ID NO: 2538 - DNA, 23 bp, Artificial Sequence
  mitotic kinesin microtubule-associated protein Eg5 (Kif11) siRNA
agaaatctaaggatatagtcaac

SEQ ID NO: 2539 - DNA, 23 bp, Artificial Sequence
  mitotic kinesin microtubule-associated protein Eg5 (Kif11) siRNA
gaaatctaaggatatagtcaaca

SEQ ID NO: 2540 - DNA, 23 bp, Artificial Sequence
  mitotic kinesin microtubule-associated protein Eg5 (Kif11) siRNA
aaatctaaggatatagtcaacaa

SEQ ID NO: 2541 - DNA, 23 bp, Artificial Sequence
  mitotic kinesin microtubule-associated protein Eg5 (Kif11) siRNA
aatctaaggatatagtcaacaaa

SEQ ID NO: 2542 - DNA, 23 bp, Artificial Sequence
  mitotic kinesin microtubule-associated protein Eg5 (Kif11) siRNA
atctaaggatatagtcaacaaaa

SEQ ID NO: 2543 - DNA, 23 bp, Artificial Sequence
  mitotic kinesin microtubule-associated protein Eg5 (Kif11) siRNA
tctaaggatatagtcaacaaaat

SEQ ID NO: 2544 - DNA, 23 bp, Artificial Sequence
  mitotic kinesin microtubule-associated protein Eg5 (Kif11) siRNA
ctaaggatatagtcaacaaaatg

SEQ ID NO: 2545 - DNA, 23 bp, Artificial Sequence
  mitotic kinesin microtubule-associated protein Eg5 (Kif11) siRNA
taaggatatagtcaacaaaatga

SEQ ID NO: 2546 - DNA, 23 bp, Artificial Sequence
  mitotic kinesin microtubule-associated protein Eg5 (Kif11) siRNA
aaggatatagtcaacaaaatgac

SEQ ID NO: 2547 - DNA, 23 bp, Artificial Sequence
  mitotic kinesin microtubule-associated protein Eg5 (Kif11) siRNA
aggatatagtcaacaaaatgact

SEQ ID NO: 2548 - DNA, 23 bp, Artificial Sequence
  mitotic kinesin microtubule-associated protein Eg5 (Kif11) siRNA
ggatatagtcaacaaaatgactt

SEQ ID NO: 2549 - DNA, 23 bp, Artificial Sequence
  mitotic kinesin microtubule-associated protein Eg5 (Kif11) siRNA
gatatagtcaacaaaatgacttt

SEQ ID NO: 2550 - DNA, 23 bp, Artificial Sequence
  mitotic kinesin microtubule-associated protein Eg5 (Kif11) siRNA
atatagtcaacaaaatgactttt

SEQ ID NO: 2551 - DNA, 23 bp, Artificial Sequence
  mitotic kinesin microtubule-associated protein Eg5 (Kif11) siRNA
tatagtcaacaaaatgacttttc

SEQ ID NO: 2552 - DNA, 23 bp, Artificial Sequence
  mitotic kinesin microtubule-associated protein Eg5 (Kif11) siRNA
atagtcaacaaaatgacttttca

SEQ ID NO: 2553 - DNA, 23 bp, Artificial Sequence
  mitotic kinesin microtubule-associated protein Eg5 (Kif11) siRNA
tagtcaacaaaatgacttttcac

SEQ ID NO: 2554 - DNA, 23 bp, Artificial Sequence
  mitotic kinesin microtubule-associated protein Eg5 (Kif11) siRNA
agtcaacaaaatgacttttcaca

SEQ ID NO: 2555 - DNA, 23 bp, Artificial Sequence
  mitotic kinesin microtubule-associated protein Eg5 (Kif11) siRNA
gtcaacaaaatgacttttcacag

SEQ ID NO: 2556 - DNA, 23 bp, Artificial Sequence
  mitotic kinesin microtubule-associated protein Eg5 (Kif11) siRNA
tcaacaaaatgacttttcacagt

SEQ ID NO: 2557 - DNA, 23 bp, Artificial Sequence
  mitotic kinesin microtubule-associated protein Eg5 (Kif11) siRNA
caacaaaatgacttttcacagtc

SEQ ID NO: 2558 - DNA, 23 bp, Artificial Sequence
  mitotic kinesin microtubule-associated protein Eg5 (Kif11) siRNA
aacaaaatgacttttcacagtca

SEQ ID NO: 2559 - DNA, 23 bp, Artificial Sequence
  mitotic kinesin microtubule-associated protein Eg5 (Kif11) siRNA
acaaaatgacttttcacagtcaa

SEQ ID NO: 2560 - DNA, 23 bp, Artificial Sequence
  mitotic kinesin microtubule-associated protein Eg5 (Kif11) siRNA
caaaatgacttttcacagtcaaa

SEQ ID NO: 2561 - DNA, 23 bp, Artificial Sequence
  mitotic kinesin microtubule-associated protein Eg5 (Kif11) siRNA
aaaatgacttttcacagtcaaaa

SEQ ID NO: 2562 - DNA, 23 bp, Artificial Sequence
  mitotic kinesin microtubule-associated protein Eg5 (Kif11) siRNA
aaatgacttttcacagtcaaaaa

SEQ ID NO: 2563 - DNA, 23 bp, Artificial Sequence
  mitotic kinesin microtubule-associated protein Eg5 (Kif11) siRNA
aatgacttttcacagtcaaaaat

SEQ ID NO: 2564 - DNA, 23 bp, Artificial Sequence
  mitotic kinesin microtubule-associated protein Eg5 (Kif11) siRNA
atgacttttcacagtcaaaaatt

SEQ ID NO: 2565 - DNA, 23 bp, Artificial Sequence
  mitotic kinesin microtubule-associated protein Eg5 (Kif11) siRNA
tgacttttcacagtcaaaaattt

SEQ ID NO: 2566 - DNA, 23 bp, Artificial Sequence
  mitotic kinesin microtubule-associated protein Eg5 (Kif11) siRNA
gacttttcacagtcaaaaatttt

SEQ ID NO: 2567 - DNA, 23 bp, Artificial Sequence
  mitotic kinesin microtubule-associated protein Eg5 (Kif11) siRNA
acttttcacagtcaaaaattttg

SEQ ID NO: 2568 - DNA, 23 bp, Artificial Sequence
  mitotic kinesin microtubule-associated protein Eg5 (Kif11) siRNA
cttttcacagtcaaaaattttgt

SEQ ID NO: 2569 - DNA, 23 bp, Artificial Sequence
  mitotic kinesin microtubule-associated protein Eg5 (Kif11) siRNA
ttttcacagtcaaaaattttgtg

SEQ ID NO: 2570 - DNA, 23 bp, Artificial Sequence
  mitotic kinesin microtubule-associated protein Eg5 (Kif11) siRNA
tttcacagtcaaaaattttgtgc

SEQ ID NO: 2571 - DNA, 23 bp, Artificial Sequence
  mitotic kinesin microtubule-associated protein Eg5 (Kif11) siRNA
ttcacagtcaaaaattttgtgct

SEQ ID NO: 2572 - DNA, 23 bp, Artificial Sequence
  mitotic kinesin microtubule-associated protein Eg5 (Kif11) siRNA
tcacagtcaaaaattttgtgctg

SEQ ID NO: 2573 - DNA, 23 bp, Artificial Sequence
  mitotic kinesin microtubule-associated protein Eg5 (Kif11) siRNA
cacagtcaaaaattttgtgctga

SEQ ID NO: 2574 - DNA, 23 bp, Artificial Sequence
  mitotic kinesin microtubule-associated protein Eg5 (Kif11) siRNA
acagtcaaaaattttgtgctgat

SEQ ID NO: 2575 - DNA, 23 bp, Artificial Sequence
  mitotic kinesin microtubule-associated protein Eg5 (Kif11) siRNA
cagtcaaaaattttgtgctgatt

SEQ ID NO: 2576 - DNA, 23 bp, Artificial Sequence
  mitotic kinesin microtubule-associated protein Eg5 (Kif11) siRNA
agtcaaaaattttgtgctgattc

SEQ ID NO: 2577 - DNA, 23 bp, Artificial Sequence
  mitotic kinesin microtubule-associated protein Eg5 (Kif11) siRNA
gtcaaaaattttgtgctgattct

SEQ ID NO: 2578 - DNA, 23 bp, Artificial Sequence
  mitotic kinesin microtubule-associated protein Eg5 (Kif11) siRNA
tcaaaaattttgtgctgattctg

SEQ ID NO: 2579 - DNA, 23 bp, Artificial Sequence
  mitotic kinesin microtubule-associated protein Eg5 (Kif11) siRNA
caaaaattttgtgctgattctga

SEQ ID NO: 2580 - DNA, 23 bp, Artificial Sequence
  mitotic kinesin microtubule-associated protein Eg5 (Kif11) siRNA
aaaaattttgtgctgattctgat

SEQ ID NO: 2581 - DNA, 23 bp, Artificial Sequence
  mitotic kinesin microtubule-associated protein Eg5 (Kif11) siRNA
aaaattttgtgctgattctgatg

SEQ ID NO: 2582 - DNA, 23 bp, Artificial Sequence
  mitotic kinesin microtubule-associated protein Eg5 (Kif11) siRNA
aaattttgtgctgattctgatgg

SEQ ID NO: 2583 - DNA, 23 bp, Artificial Sequence
  mitotic kinesin microtubule-associated protein Eg5 (Kif11) siRNA
aattttgtgctgattctgatggc

SEQ ID NO: 2584 - DNA, 23 bp, Artificial Sequence
  mitotic kinesin microtubule-associated protein Eg5 (Kif11) siRNA
attttgtgctgattctgatggct

SEQ ID NO: 2585 - DNA, 23 bp, Artificial Sequence
  mitotic kinesin microtubule-associated protein Eg5 (Kif11) siRNA
ttttgtgctgattctgatggctt

SEQ ID NO: 2586 - DNA, 23 bp, Artificial Sequence
  mitotic kinesin microtubule-associated protein Eg5 (Kif11) siRNA
tttgtgctgattctgatggcttc

SEQ ID NO: 2587 - DNA, 23 bp, Artificial Sequence
  mitotic kinesin microtubule-associated protein Eg5 (Kif11) siRNA
ttgtgctgattctgatggcttct

SEQ ID NO: 2588 - DNA, 23 bp, Artificial Sequence
  mitotic kinesin microtubule-associated protein Eg5 (Kif11) siRNA
tgtgctgattctgatggcttctc

SEQ ID NO: 2589 - DNA, 23 bp, Artificial Sequence
  mitotic kinesin microtubule-associated protein Eg5 (Kif11) siRNA
gtgctgattctgatggcttctca

SEQ ID NO: 2590 - DNA, 23 bp, Artificial Sequence
  mitotic kinesin microtubule-associated protein Eg5 (Kif11) siRNA
tgctgattctgatggcttctcac

SEQ ID NO: 2591 - DNA, 23 bp, Artificial Sequence
  mitotic kinesin microtubule-associated protein Eg5 (Kif11) siRNA
gctgattctgatggcttctcaca

SEQ ID NO: 2592 - DNA, 23 bp, Artificial Sequence
  mitotic kinesin microtubule-associated protein Eg5 (Kif11) siRNA
ctgattctgatggcttctcacag

SEQ ID NO: 2593 - DNA, 23 bp, Artificial Sequence
  mitotic kinesin microtubule-associated protein Eg5 (Kif11) siRNA
tgattctgatggcttctcacagg

SEQ ID NO: 2594 - DNA, 23 bp, Artificial Sequence
  mitotic kinesin microtubule-associated protein Eg5 (Kif11) siRNA
gattctgatggcttctcacagga

SEQ ID NO: 2595 - DNA, 23 bp, Artificial Sequence
  mitotic kinesin microtubule-associated protein Eg5 (Kif11) siRNA
attctgatggcttctcacaggaa

SEQ ID NO: 2596 - DNA, 23 bp, Artificial Sequence
  mitotic kinesin microtubule-associated protein Eg5 (Kif11) siRNA
ttctgatggcttctcacaggaac

SEQ ID NO: 2597 - DNA, 23 bp, Artificial Sequence
  mitotic kinesin microtubule-associated protein Eg5 (Kif11) siRNA
tctgatggcttctcacaggaact

SEQ ID NO: 2598 - DNA, 23 bp, Artificial Sequence
  mitotic kinesin microtubule-associated protein Eg5 (Kif11) siRNA
ctgatggcttctcacaggaactc

SEQ ID NO: 2599 - DNA, 23 bp, Artificial Sequence
  mitotic kinesin microtubule-associated protein Eg5 (Kif11) siRNA
tgatggcttctcacaggaactca

SEQ ID NO: 2600 - DNA, 23 bp, Artificial Sequence
  mitotic kinesin microtubule-associated protein Eg5 (Kif11) siRNA
gatggcttctcacaggaactcag

SEQ ID NO: 2601 - DNA, 23 bp, Artificial Sequence
  mitotic kinesin microtubule-associated protein Eg5 (Kif11) siRNA
atggcttctcacaggaactcaga

SEQ ID NO: 2602 - DNA, 23 bp, Artificial Sequence
  mitotic kinesin microtubule-associated protein Eg5 (Kif11) siRNA
tggcttctcacaggaactcagaa

SEQ ID NO: 2603 - DNA, 23 bp, Artificial Sequence
  mitotic kinesin microtubule-associated protein Eg5 (Kif11) siRNA
ggcttctcacaggaactcagaaa

SEQ ID NO: 2604 - DNA, 23 bp, Artificial Sequence
  mitotic kinesin microtubule-associated protein Eg5 (Kif11) siRNA
gcttctcacaggaactcagaaat

SEQ ID NO: 2605 - DNA, 23 bp, Artificial Sequence
  mitotic kinesin microtubule-associated protein Eg5 (Kif11) siRNA
cttctcacaggaactcagaaatt

SEQ ID NO: 2606 - DNA, 23 bp, Artificial Sequence
  mitotic kinesin microtubule-associated protein Eg5 (Kif11) siRNA
ttctcacaggaactcagaaattt

SEQ ID NO: 2607 - DNA, 23 bp, Artificial Sequence
  mitotic kinesin microtubule-associated protein Eg5 (Kif11) siRNA
tctcacaggaactcagaaatttt

SEQ ID NO: 2608 - DNA, 23 bp, Artificial Sequence
  mitotic kinesin microtubule-associated protein Eg5 (Kif11) siRNA
ctcacaggaactcagaaatttta

SEQ ID NO: 2609 - DNA, 23 bp, Artificial Sequence
  mitotic kinesin microtubule-associated protein Eg5 (Kif11) siRNA
tcacaggaactcagaaattttaa

SEQ ID NO: 2610 - DNA, 23 bp, Artificial Sequence
  mitotic kinesin microtubule-associated protein Eg5 (Kif11) siRNA
cacaggaactcagaaattttaac

SEQ ID NO: 2611 - DNA, 23 bp, Artificial Sequence
  mitotic kinesin microtubule-associated protein Eg5 (Kif11) siRNA
acaggaactcagaaattttaacc

SEQ ID NO: 2612 - DNA, 23 bp, Artificial Sequence
  mitotic kinesin microtubule-associated protein Eg5 (Kif11) siRNA
caggaactcagaaattttaacca

SEQ ID NO: 2613 - DNA, 23 bp, Artificial Sequence
  mitotic kinesin microtubule-associated protein Eg5 (Kif11) siRNA
aggaactcagaaattttaaccaa

SEQ ID NO: 2614 - DNA, 23 bp, Artificial Sequence
  mitotic kinesin microtubule-associated protein Eg5 (Kif11) siRNA
ggaactcagaaattttaaccaag

SEQ ID NO: 2615 - DNA, 23 bp, Artificial Sequence
  mitotic kinesin microtubule-associated protein Eg5 (Kif11) siRNA
gaactcagaaattttaaccaaga

SEQ ID NO: 2616 - DNA, 23 bp, Artificial Sequence
  mitotic kinesin microtubule-associated protein Eg5 (Kif11) siRNA
aactcagaaattttaaccaagaa

SEQ ID NO: 2617 - DNA, 23 bp, Artificial Sequence
  mitotic kinesin microtubule-associated protein Eg5 (Kif11) siRNA
actcagaaattttaaccaagaag

SEQ ID NO: 2618 - DNA, 23 bp, Artificial Sequence
  mitotic kinesin microtubule-associated protein Eg5 (Kif11) siRNA
ctcagaaattttaaccaagaagg

SEQ ID NO: 2619 - DNA, 23 bp, Artificial Sequence
  mitotic kinesin microtubule-associated protein Eg5 (Kif11) siRNA
tcagaaattttaaccaagaaggt

SEQ ID NO: 2620 - DNA, 23 bp, Artificial Sequence
  mitotic kinesin microtubule-associated protein Eg5 (Kif11) siRNA
cagaaattttaaccaagaaggta

SEQ ID NO: 2621 - DNA, 23 bp, Artificial Sequence
  mitotic kinesin microtubule-associated protein Eg5 (Kif11) siRNA
agaaattttaaccaagaaggtac

SEQ ID NO: 2622 - DNA, 23 bp, Artificial Sequence
  mitotic kinesin microtubule-associated protein Eg5 (Kif11) siRNA
gaaattttaaccaagaaggtaca

SEQ ID NO: 2623 - DNA, 23 bp, Artificial Sequence
  mitotic kinesin microtubule-associated protein Eg5 (Kif11) siRNA
aaattttaaccaagaaggtacaa

SEQ ID NO: 2624 - DNA, 23 bp, Artificial Sequence
  mitotic kinesin microtubule-associated protein Eg5 (Kif11) siRNA
aattttaaccaagaaggtacaaa

SEQ ID NO: 2625 - DNA, 23 bp, Artificial Sequence
  mitotic kinesin microtubule-associated protein Eg5 (Kif11) siRNA
attttaaccaagaaggtacaaaa

SEQ ID NO: 2626 - DNA, 23 bp, Artificial Sequence
  mitotic kinesin microtubule-associated protein Eg5 (Kif11) siRNA
ttttaaccaagaaggtacaaaat

SEQ ID NO: 2627 - DNA, 23 bp, Artificial Sequence
  mitotic kinesin microtubule-associated protein Eg5 (Kif11) siRNA
tttaaccaagaaggtacaaaatt

SEQ ID NO: 2628 - DNA, 23 bp, Artificial Sequence
  mitotic kinesin microtubule-associated protein Eg5 (Kif11) siRNA
ttaaccaagaaggtacaaaattg

SEQ ID NO: 2629 - DNA, 23 bp, Artificial Sequence
  mitotic kinesin microtubule-associated protein Eg5 (Kif11) siRNA
taaccaagaaggtacaaaattgg

SEQ ID NO: 2630 - DNA, 23 bp, Artificial Sequence
  mitotic kinesin microtubule-associated protein Eg5 (Kif11) siRNA
aaccaagaaggtacaaaattggt

SEQ ID NO: 2631 - DNA, 23 bp, Artificial Sequence
  mitotic kinesin microtubule-associated protein Eg5 (Kif11) siRNA
accaagaaggtacaaaattggtt

SEQ ID NO: 2632 - DNA, 23 bp, Artificial Sequence
  mitotic kinesin microtubule-associated protein Eg5 (Kif11) siRNA
ccaagaaggtacaaaattggttg

SEQ ID NO: 2633 - DNA, 23 bp, Artificial Sequence
  mitotic kinesin microtubule-associated protein Eg5 (Kif11) siRNA
caagaaggtacaaaattggttga

SEQ ID NO: 2634 - DNA, 23 bp, Artificial Sequence
  mitotic kinesin microtubule-associated protein Eg5 (Kif11) siRNA
aagaaggtacaaaattggttgaa

SEQ ID NO: 2635 - DNA, 23 bp, Artificial Sequence
  mitotic kinesin microtubule-associated protein Eg5 (Kif11) siRNA
agaaggtacaaaattggttgaag

SEQ ID NO: 2636 - DNA, 23 bp, Artificial Sequence
  mitotic kinesin microtubule-associated protein Eg5 (Kif11) siRNA
gaaggtacaaaattggttgaaga

SEQ ID NO: 2637 - DNA, 23 bp, Artificial Sequence
  mitotic kinesin microtubule-associated protein Eg5 (Kif11) siRNA
aaggtacaaaattggttgaagaa

SEQ ID NO: 2638 - DNA, 23 bp, Artificial Sequence
  mitotic kinesin microtubule-associated protein Eg5 (Kif11) siRNA
aggtacaaaattggttgaagaat

SEQ ID NO: 2639 - DNA, 23 bp, Artificial Sequence
  mitotic kinesin microtubule-associated protein Eg5 (Kif11) siRNA
ggtacaaaattggttgaagaatc

SEQ ID NO: 2640 - DNA, 23 bp, Artificial Sequence
  mitotic kinesin microtubule-associated protein Eg5 (Kif11) siRNA
gtacaaaattggttgaagaatct

SEQ ID NO: 2641 - DNA, 23 bp, Artificial Sequence
  mitotic kinesin microtubule-associated protein Eg5 (Kif11) siRNA
tacaaaattggttgaagaatctg

SEQ ID NO: 2642 - DNA, 23 bp, Artificial Sequence
  mitotic kinesin microtubule-associated protein Eg5 (Kif11) siRNA
acaaaattggttgaagaatctgt

SEQ ID NO: 2643 - DNA, 23 bp, Artificial Sequence
  mitotic kinesin microtubule-associated protein Eg5 (Kif11) siRNA
caaaattggttgaagaatctgtg

SEQ ID NO: 2644 - DNA, 23 bp, Artificial Sequence
  mitotic kinesin microtubule-associated protein Eg5 (Kif11) siRNA
aaaattggttgaagaatctgtga

SEQ ID NO: 2645 - DNA, 23 bp, Artificial Sequence
  mitotic kinesin microtubule-associated protein Eg5 (Kif11) siRNA
aaattggttgaagaatctgtgaa

SEQ ID NO: 2646 - DNA, 23 bp, Artificial Sequence
  mitotic kinesin microtubule-associated protein Eg5 (Kif11) siRNA
aattggttgaagaatctgtgaaa

SEQ ID NO: 2647 - DNA, 23 bp, Artificial Sequence
  mitotic kinesin microtubule-associated protein Eg5 (Kif11) siRNA
attggttgaagaatctgtgaaac

SEQ ID NO: 2648 - DNA, 23 bp, Artificial Sequence
  mitotic kinesin microtubule-associated protein Eg5 (Kif11) siRNA
ttggttgaagaatctgtgaaaca

SEQ ID NO: 2649 - DNA, 23 bp, Artificial Sequence
  mitotic kinesin microtubule-associated protein Eg5 (Kif11) siRNA
tggttgaagaatctgtgaaacac

SEQ ID NO: 2650 - DNA, 23 bp, Artificial Sequence
  mitotic kinesin microtubule-associated protein Eg5 (Kif11) siRNA
ggttgaagaatctgtgaaacact

SEQ ID NO: 2651 - DNA, 23 bp, Artificial Sequence
  mitotic kinesin microtubule-associated protein Eg5 (Kif11) siRNA
gttgaagaatctgtgaaacactc

SEQ ID NO: 2652 - DNA, 23 bp, Artificial Sequence
  mitotic kinesin microtubule-associated protein Eg5 (Kif11) siRNA
ttgaagaatctgtgaaacactct

SEQ ID NO: 2653 - DNA, 23 bp, Artificial Sequence
  mitotic kinesin microtubule-associated protein Eg5 (Kif11) siRNA
tgaagaatctgtgaaacactctg

SEQ ID NO: 2654 - DNA, 23 bp, Artificial Sequence
  mitotic kinesin microtubule-associated protein Eg5 (Kif11) siRNA
gaagaatctgtgaaacactctga

SEQ ID NO: 2655 - DNA, 23 bp, Artificial Sequence
  mitotic kinesin microtubule-associated protein Eg5 (Kif11) siRNA
aagaatctgtgaaacactctgat

SEQ ID NO: 2656 - DNA, 23 bp, Artificial Sequence
  mitotic kinesin microtubule-associated protein Eg5 (Kif11) siRNA
agaatctgtgaaacactctgata

SEQ ID NO: 2657 - DNA, 23 bp, Artificial Sequence
  mitotic kinesin microtubule-associated protein Eg5 (Kif11) siRNA
gaatctgtgaaacactctgataa

SEQ ID NO: 2658 - DNA, 23 bp, Artificial Sequence
  mitotic kinesin microtubule-associated protein Eg5 (Kif11) siRNA
aatctgtgaaacactctgataaa

SEQ ID NO: 2659 - DNA, 23 bp, Artificial Sequence
  mitotic kinesin microtubule-associated protein Eg5 (Kif11) siRNA
atctgtgaaacactctgataaac

SEQ ID NO: 2660 - DNA, 23 bp, Artificial Sequence
  mitotic kinesin microtubule-associated protein Eg5 (Kif11) siRNA
tctgtgaaacactctgataaact

SEQ ID NO: 2661 - DNA, 23 bp, Artificial Sequence
  mitotic kinesin microtubule-associated protein Eg5 (Kif11) siRNA
ctgtgaaacactctgataaactc

SEQ ID NO: 2662 - DNA, 23 bp, Artificial Sequence
  mitotic kinesin microtubule-associated protein Eg5 (Kif11) siRNA
tgtgaaacactctgataaactca

SEQ ID NO: 2663 - DNA, 23 bp, Artificial Sequence
  mitotic kinesin microtubule-associated protein Eg5 (Kif11) siRNA
gtgaaacactctgataaactcaa

SEQ ID NO: 2664 - DNA, 23 bp, Artificial Sequence
  mitotic kinesin microtubule-associated protein Eg5 (Kif11) siRNA
tgaaacactctgataaactcaat

SEQ ID NO: 2665 - DNA, 23 bp, Artificial Sequence
  mitotic kinesin microtubule-associated protein Eg5 (Kif11) siRNA
gaaacactctgataaactcaatg

SEQ ID NO: 2666 - DNA, 23 bp, Artificial Sequence
  mitotic kinesin microtubule-associated protein Eg5 (Kif11) siRNA
aaacactctgataaactcaatgg

SEQ ID NO: 2667 - DNA, 23 bp, Artificial Sequence
  mitotic kinesin microtubule-associated protein Eg5 (Kif11) siRNA
aacactctgataaactcaatggc

SEQ ID NO: 2668 - DNA, 23 bp, Artificial Sequence
  mitotic kinesin microtubule-associated protein Eg5 (Kif11) siRNA
acactctgataaactcaatggca

SEQ ID NO: 2669 - DNA, 23 bp, Artificial Sequence
  mitotic kinesin microtubule-associated protein Eg5 (Kif11) siRNA
cactctgataaactcaatggcaa

SEQ ID NO: 2670 - DNA, 23 bp, Artificial Sequence
  mitotic kinesin microtubule-associated protein Eg5 (Kif11) siRNA
actctgataaactcaatggcaac

SEQ ID NO: 2671 - DNA, 23 bp, Artificial Sequence
  mitotic kinesin microtubule-associated protein Eg5 (Kif11) siRNA
ctctgataaactcaatggcaacc

SEQ ID NO: 2672 - DNA, 23 bp, Artificial Sequence
  mitotic kinesin microtubule-associated protein Eg5 (Kif11) siRNA
tctgataaactcaatggcaacct

SEQ ID NO: 2673 - DNA, 23 bp, Artificial Sequence
  mitotic kinesin microtubule-associated protein Eg5 (Kif11) siRNA
ctgataaactcaatggcaacctg

SEQ ID NO: 2674 - DNA, 23 bp, Artificial Sequence
  mitotic kinesin microtubule-associated protein Eg5 (Kif11) siRNA
tgataaactcaatggcaacctgg

SEQ ID NO: 2675 - DNA, 23 bp, Artificial Sequence
  mitotic kinesin microtubule-associated protein Eg5 (Kif11) siRNA
gataaactcaatggcaacctgga

SEQ ID NO: 2676 - DNA, 23 bp, Artificial Sequence
  mitotic kinesin microtubule-associated protein Eg5 (Kif11) siRNA
ataaactcaatggcaacctggaa

SEQ ID NO: 2677 - DNA, 23 bp, Artificial Sequence
  mitotic kinesin microtubule-associated protein Eg5 (Kif11) siRNA
taaactcaatggcaacctggaaa

SEQ ID NO: 2678 - DNA, 23 bp, Artificial Sequence
  mitotic kinesin microtubule-associated protein Eg5 (Kif11) siRNA
aaactcaatggcaacctggaaaa

SEQ ID NO: 2679 - DNA, 23 bp, Artificial Sequence
  mitotic kinesin microtubule-associated protein Eg5 (Kif11) siRNA
aactcaatggcaacctggaaaaa

SEQ ID NO: 2680 - DNA, 23 bp, Artificial Sequence
  mitotic kinesin microtubule-associated protein Eg5 (Kif11) siRNA
actcaatggcaacctggaaaaaa

SEQ ID NO: 2681 - DNA, 23 bp, Artificial Sequence
  mitotic kinesin microtubule-associated protein Eg5 (Kif11) siRNA
ctcaatggcaacctggaaaaaat

SEQ ID NO: 2682 - DNA, 23 bp, Artificial Sequence
  mitotic kinesin microtubule-associated protein Eg5 (Kif11) siRNA
tcaatggcaacctggaaaaaata

SEQ ID NO: 2683 - DNA, 23 bp, Artificial Sequence
  mitotic kinesin microtubule-associated protein Eg5 (Kif11) siRNA
caatggcaacctggaaaaaatat

SEQ ID NO: 2684 - DNA, 23 bp, Artificial Sequence
  mitotic kinesin microtubule-associated protein Eg5 (Kif11) siRNA
aatggcaacctggaaaaaatatc

SEQ ID NO: 2685 - DNA, 23 bp, Artificial Sequence
  mitotic kinesin microtubule-associated protein Eg5 (Kif11) siRNA
atggcaacctggaaaaaatatct

SEQ ID NO: 2686 - DNA, 23 bp, Artificial Sequence
  mitotic kinesin microtubule-associated protein Eg5 (Kif11) siRNA
tggcaacctggaaaaaatatctc

SEQ ID NO: 2687 - DNA, 23 bp, Artificial Sequence
  mitotic kinesin microtubule-associated protein Eg5 (Kif11) siRNA
ggcaacctggaaaaaatatctca

SEQ ID NO: 2688 - DNA, 23 bp, Artificial Sequence
  mitotic kinesin microtubule-associated protein Eg5 (Kif11) siRNA
gcaacctggaaaaaatatctcaa

SEQ ID NO: 2689 - DNA, 23 bp, Artificial Sequence
  mitotic kinesin microtubule-associated protein Eg5 (Kif11) siRNA
caacctggaaaaaatatctcaag

SEQ ID NO: 2690 - DNA, 23 bp, Artificial Sequence
  mitotic kinesin microtubule-associated protein Eg5 (Kif11) siRNA
aacctggaaaaaatatctcaaga

SEQ ID NO: 2691 - DNA, 23 bp, Artificial Sequence
  mitotic kinesin microtubule-associated protein Eg5 (Kif11) siRNA
acctggaaaaaatatctcaagag

SEQ ID NO: 2692 - DNA, 23 bp, Artificial Sequence
  mitotic kinesin microtubule-associated protein Eg5 (Kif11) siRNA
cctggaaaaaatatctcaagaga

SEQ ID NO: 2693 - DNA, 23 bp, Artificial Sequence
  mitotic kinesin microtubule-associated protein Eg5 (Kif11) siRNA
ctggaaaaaatatctcaagagac

SEQ ID NO: 2694 - DNA, 23 bp, Artificial Sequence
  mitotic kinesin microtubule-associated protein Eg5 (Kif11) siRNA
tggaaaaaatatctcaagagact

SEQ ID NO: 2695 - DNA, 23 bp, Artificial Sequence
  mitotic kinesin microtubule-associated protein Eg5 (Kif11) siRNA
ggaaaaaatatctcaagagactg

SEQ ID NO: 2696 - DNA, 23 bp, Artificial Sequence
  mitotic kinesin microtubule-associated protein Eg5 (Kif11) siRNA
gaaaaaatatctcaagagactga

SEQ ID NO: 2697 - DNA, 23 bp, Artificial Sequence
  mitotic kinesin microtubule-associated protein Eg5 (Kif11) siRNA
aaaaaatatctcaagagactgaa

SEQ ID NO: 2698 - DNA, 23 bp, Artificial Sequence
  mitotic kinesin microtubule-associated protein Eg5 (Kif11) siRNA
aaaaatatctcaagagactgaac

SEQ ID NO: 2699 - DNA, 23 bp, Artificial Sequence
  mitotic kinesin microtubule-associated protein Eg5 (Kif11) siRNA
aaaatatctcaagagactgaaca

SEQ ID NO: 2700 - DNA, 23 bp, Artificial Sequence
  mitotic kinesin microtubule-associated protein Eg5 (Kif11) siRNA
aaatatctcaagagactgaacag

SEQ ID NO: 2701 - DNA, 23 bp, Artificial Sequence
  mitotic kinesin microtubule-associated protein Eg5 (Kif11) siRNA
aatatctcaagagactgaacaga

SEQ ID NO: 2702 - DNA, 23 bp, Artificial Sequence
  mitotic kinesin microtubule-associated protein Eg5 (Kif11) siRNA
atatctcaagagactgaacagag

SEQ ID NO: 2703 - DNA, 23 bp, Artificial Sequence
  mitotic kinesin microtubule-associated protein Eg5 (Kif11) siRNA
tatctcaagagactgaacagaga

SEQ ID NO: 2704 - DNA, 23 bp, Artificial Sequence
  mitotic kinesin microtubule-associated protein Eg5 (Kif11) siRNA
atctcaagagactgaacagagat

SEQ ID NO: 2705 - DNA, 23 bp, Artificial Sequence
  mitotic kinesin microtubule-associated protein Eg5 (Kif11) siRNA
tctcaagagactgaacagagatg

SEQ ID NO: 2706 - DNA, 23 bp, Artificial Sequence
  mitotic kinesin microtubule-associated protein Eg5 (Kif11) siRNA
ctcaagagactgaacagagatgt

SEQ ID NO: 2707 - DNA, 23 bp, Artificial Sequence
  mitotic kinesin microtubule-associated protein Eg5 (Kif11) siRNA
tcaagagactgaacagagatgtg

SEQ ID NO: 2708 - DNA, 23 bp, Artificial Sequence
  mitotic kinesin microtubule-associated protein Eg5 (Kif11) siRNA
caagagactgaacagagatgtga

SEQ ID NO: 2709 - DNA, 23 bp, Artificial Sequence
  mitotic kinesin microtubule-associated protein Eg5 (Kif11) siRNA
aagagactgaacagagatgtgaa

SEQ ID NO: 2710 - DNA, 23 bp, Artificial Sequence
  mitotic kinesin microtubule-associated protein Eg5 (Kif11) siRNA
agagactgaacagagatgtgaat

SEQ ID NO: 2711 - DNA, 23 bp, Artificial Sequence
  mitotic kinesin microtubule-associated protein Eg5 (Kif11) siRNA
gagactgaacagagatgtgaatc

SEQ ID NO: 2712 - DNA, 23 bp, Artificial Sequence
  mitotic kinesin microtubule-associated protein Eg5 (Kif11) siRNA
agactgaacagagatgtgaatct

SEQ ID NO: 2713 - DNA, 23 bp, Artificial Sequence
  mitotic kinesin microtubule-associated protein Eg5 (Kif11) siRNA
gactgaacagagatgtgaatctc

SEQ ID NO: 2714 - DNA, 23 bp, Artificial Sequence
  mitotic kinesin microtubule-associated protein Eg5 (Kif11) siRNA
actgaacagagatgtgaatctct

SEQ ID NO: 2715 - DNA, 23 bp, Artificial Sequence
  mitotic kinesin microtubule-associated protein Eg5 (Kif11) siRNA
ctgaacagagatgtgaatctctg

SEQ ID NO: 2716 - DNA, 23 bp, Artificial Sequence
  mitotic kinesin microtubule-associated protein Eg5 (Kif11) siRNA
tgaacagagatgtgaatctctga

SEQ ID NO: 2717 - DNA, 23 bp, Artificial Sequence
  mitotic kinesin microtubule-associated protein Eg5 (Kif11) siRNA
gaacagagatgtgaatctctgaa

SEQ ID NO: 2718 - DNA, 23 bp, Artificial Sequence
  mitotic kinesin microtubule-associated protein Eg5 (Kif11) siRNA
aacagagatgtgaatctctgaac

SEQ ID NO: 2719 - DNA, 23 bp, Artificial Sequence
  mitotic kinesin microtubule-associated protein Eg5 (Kif11) siRNA
acagagatgtgaatctctgaaca

SEQ ID NO: 2720 - DNA, 23 bp, Artificial Sequence
  mitotic kinesin microtubule-associated protein Eg5 (Kif11) siRNA
cagagatgtgaatctctgaacac

SEQ ID NO: 2721 - DNA, 23 bp, Artificial Sequence
  mitotic kinesin microtubule-associated protein Eg5 (Kif11) siRNA
agagatgtgaatctctgaacaca

SEQ ID NO: 2722 - DNA, 23 bp, Artificial Sequence
  mitotic kinesin microtubule-associated protein Eg5 (Kif11) siRNA
gagatgtgaatctctgaacacaa

SEQ ID NO: 2723 - DNA, 23 bp, Artificial Sequence
  mitotic kinesin microtubule-associated protein Eg5 (Kif11) siRNA
agatgtgaatctctgaacacaag

SEQ ID NO: 2724 - DNA, 23 bp, Artificial Sequence
  mitotic kinesin microtubule-associated protein Eg5 (Kif11) siRNA
gatgtgaatctctgaacacaaga

SEQ ID NO: 2725 - DNA, 23 bp, Artificial Sequence
  mitotic kinesin microtubule-associated protein Eg5 (Kif11) siRNA
atgtgaatctctgaacacaagaa

SEQ ID NO: 2726 - DNA, 23 bp, Artificial Sequence
  mitotic kinesin microtubule-associated protein Eg5 (Kif11) siRNA
tgtgaatctctgaacacaagaac

SEQ ID NO: 2727 - DNA, 23 bp, Artificial Sequence
  mitotic kinesin microtubule-associated protein Eg5 (Kif11) siRNA
gtgaatctctgaacacaagaaca

SEQ ID NO: 2728 - DNA, 23 bp, Artificial Sequence
  mitotic kinesin microtubule-associated protein Eg5 (Kif11) siRNA
tgaatctctgaacacaagaacag

SEQ ID NO: 2729 - DNA, 23 bp, Artificial Sequence
  mitotic kinesin microtubule-associated protein Eg5 (Kif11) siRNA
gaatctctgaacacaagaacagt

SEQ ID NO: 2730 - DNA, 23 bp, Artificial Sequence
  mitotic kinesin microtubule-associated protein Eg5 (Kif11) siRNA
aatctctgaacacaagaacagtt

SEQ ID NO: 2731 - DNA, 23 bp, Artificial Sequence
  mitotic kinesin microtubule-associated protein Eg5 (Kif11) siRNA
atctctgaacacaagaacagttt

SEQ ID NO: 2732 - DNA, 23 bp, Artificial Sequence
  mitotic kinesin microtubule-associated protein Eg5 (Kif11) siRNA
tctctgaacacaagaacagttta

SEQ ID NO: 2733 - DNA, 23 bp, Artificial Sequence
  mitotic kinesin microtubule-associated protein Eg5 (Kif11) siRNA
ctctgaacacaagaacagtttat

SEQ ID NO: 2734 - DNA, 23 bp, Artificial Sequence
  mitotic kinesin microtubule-associated protein Eg5 (Kif11) siRNA
tctgaacacaagaacagtttatt

SEQ ID NO: 2735 - DNA, 23 bp, Artificial Sequence
  mitotic kinesin microtubule-associated protein Eg5 (Kif11) siRNA
ctgaacacaagaacagtttattt

SEQ ID NO: 2736 - DNA, 23 bp, Artificial Sequence
  mitotic kinesin microtubule-associated protein Eg5 (Kif11) siRNA
tgaacacaagaacagtttatttt

SEQ ID NO: 2737 - DNA, 23 bp, Artificial Sequence
  mitotic kinesin microtubule-associated protein Eg5 (Kif11) siRNA
gaacacaagaacagtttattttt

SEQ ID NO: 2738 - DNA, 23 bp, Artificial Sequence
  mitotic kinesin microtubule-associated protein Eg5 (Kif11) siRNA
aacacaagaacagtttatttttc

SEQ ID NO: 2739 - DNA, 23 bp, Artificial Sequence
  mitotic kinesin microtubule-associated protein Eg5 (Kif11) siRNA
acacaagaacagtttatttttct

SEQ ID NO: 2740 - DNA, 23 bp, Artificial Sequence
  mitotic kinesin microtubule-associated protein Eg5 (Kif11) siRNA
cacaagaacagtttatttttctg

SEQ ID NO: 2741 - DNA, 23 bp, Artificial Sequence
  mitotic kinesin microtubule-associated protein Eg5 (Kif11) siRNA
acaagaacagtttatttttctga

SEQ ID NO: 2742 - DNA, 23 bp, Artificial Sequence
  mitotic kinesin microtubule-associated protein Eg5 (Kif11) siRNA
caagaacagtttatttttctgaa

SEQ ID NO: 2743 - DNA, 23 bp, Artificial Sequence
  mitotic kinesin microtubule-associated protein Eg5 (Kif11) siRNA
aagaacagtttatttttctgaac

SEQ ID NO: 2744 - DNA, 23 bp, Artificial Sequence
  mitotic kinesin microtubule-associated protein Eg5 (Kif11) siRNA
agaacagtttatttttctgaaca

SEQ ID NO: 2745 - DNA, 23 bp, Artificial Sequence
  mitotic kinesin microtubule-associated protein Eg5 (Kif11) siRNA
gaacagtttatttttctgaacag

SEQ ID NO: 2746 - DNA, 23 bp, Artificial Sequence
  mitotic kinesin microtubule-associated protein Eg5 (Kif11) siRNA
aacagtttatttttctgaacagt

SEQ ID NO: 2747 - DNA, 23 bp, Artificial Sequence
  mitotic kinesin microtubule-associated protein Eg5 (Kif11) siRNA
acagtttatttttctgaacagtg

SEQ ID NO: 2748 - DNA, 23 bp, Artificial Sequence
  mitotic kinesin microtubule-associated protein Eg5 (Kif11) siRNA
cagtttatttttctgaacagtgg

SEQ ID NO: 2749 - DNA, 23 bp, Artificial Sequence
  mitotic kinesin microtubule-associated protein Eg5 (Kif11) siRNA
agtttatttttctgaacagtggg

SEQ ID NO: 2750 - DNA, 23 bp, Artificial Sequence
  mitotic kinesin microtubule-associated protein Eg5 (Kif11) siRNA
gtttatttttctgaacagtgggt

SEQ ID NO: 2751 - DNA, 23 bp, Artificial Sequence
  mitotic kinesin microtubule-associated protein Eg5 (Kif11) siRNA
tttatttttctgaacagtgggta

SEQ ID NO: 2752 - DNA, 23 bp, Artificial Sequence
  mitotic kinesin microtubule-associated protein Eg5 (Kif11) siRNA
ttatttttctgaacagtgggtat

SEQ ID NO: 2753 - DNA, 23 bp, Artificial Sequence
  mitotic kinesin microtubule-associated protein Eg5 (Kif11) siRNA
tatttttctgaacagtgggtatc

SEQ ID NO: 2754 - DNA, 23 bp, Artificial Sequence
  mitotic kinesin microtubule-associated protein Eg5 (Kif11) siRNA
atttttctgaacagtgggtatct

SEQ ID NO: 2755 - DNA, 23 bp, Artificial Sequence
  mitotic kinesin microtubule-associated protein Eg5 (Kif11) siRNA
tttttctgaacagtgggtatctt

SEQ ID NO: 2756 - DNA, 23 bp, Artificial Sequence
  mitotic kinesin microtubule-associated protein Eg5 (Kif11) siRNA
ttttctgaacagtgggtatcttc

SEQ ID NO: 2757 - DNA, 23 bp, Artificial Sequence
  mitotic kinesin microtubule-associated protein Eg5 (Kif11) siRNA
tttctgaacagtgggtatcttcc

SEQ ID NO: 2758 - DNA, 23 bp, Artificial Sequence
  mitotic kinesin microtubule-associated protein Eg5 (Kif11) siRNA
ttctgaacagtgggtatcttcct

SEQ ID NO: 2759 - DNA, 23 bp, Artificial Sequence
  mitotic kinesin microtubule-associated protein Eg5 (Kif11) siRNA
tctgaacagtgggtatcttcctt

SEQ ID NO: 2760 - DNA, 23 bp, Artificial Sequence
  mitotic kinesin microtubule-associated protein Eg5 (Kif11) siRNA
ctgaacagtgggtatcttcctta

SEQ ID NO: 2761 - DNA, 23 bp, Artificial Sequence
  mitotic kinesin microtubule-associated protein Eg5 (Kif11) siRNA
tgaacagtgggtatcttccttaa

SEQ ID NO: 2762 - DNA, 23 bp, Artificial Sequence
  mitotic kinesin microtubule-associated protein Eg5 (Kif11) siRNA
gaacagtgggtatcttccttaaa

SEQ ID NO: 2763 - DNA, 23 bp, Artificial Sequence
  mitotic kinesin microtubule-associated protein Eg5 (Kif11) siRNA
aacagtgggtatcttccttaaat

SEQ ID NO: 2764 - DNA, 23 bp, Artificial Sequence
  mitotic kinesin microtubule-associated protein Eg5 (Kif11) siRNA
acagtgggtatcttccttaaatg

SEQ ID NO: 2765 - DNA, 23 bp, Artificial Sequence
  mitotic kinesin microtubule-associated protein Eg5 (Kif11) siRNA
cagtgggtatcttccttaaatga

SEQ ID NO: 2766 - DNA, 23 bp, Artificial Sequence
  mitotic kinesin microtubule-associated protein Eg5 (Kif11) siRNA
agtgggtatcttccttaaatgaa

SEQ ID NO: 2767 - DNA, 23 bp, Artificial Sequence
  mitotic kinesin microtubule-associated protein Eg5 (Kif11) siRNA
gtgggtatcttccttaaatgaaa

SEQ ID NO: 2768 - DNA, 23 bp, Artificial Sequence
  mitotic kinesin microtubule-associated protein Eg5 (Kif11) siRNA
tgggtatcttccttaaatgaaag

SEQ ID NO: 2769 - DNA, 23 bp, Artificial Sequence
  mitotic kinesin microtubule-associated protein Eg5 (Kif11) siRNA
gggtatcttccttaaatgaaagg

SEQ ID NO: 2770 - DNA, 23 bp, Artificial Sequence
  mitotic kinesin microtubule-associated protein Eg5 (Kif11) siRNA
ggtatcttccttaaatgaaaggg

SEQ ID NO: 2771 - DNA, 23 bp, Artificial Sequence
  mitotic kinesin microtubule-associated protein Eg5 (Kif11) siRNA
gtatcttccttaaatgaaaggga

SEQ ID NO: 2772 - DNA, 23 bp, Artificial Sequence
  mitotic kinesin microtubule-associated protein Eg5 (Kif11) siRNA
tatcttccttaaatgaaagggaa

SEQ ID NO: 2773 - DNA, 23 bp, Artificial Sequence
  mitotic kinesin microtubule-associated protein Eg5 (Kif11) siRNA
atcttccttaaatgaaagggaac

SEQ ID NO: 2774 - DNA, 23 bp, Artificial Sequence
  mitotic kinesin microtubule-associated protein Eg5 (Kif11) siRNA
tcttccttaaatgaaagggaaca

SEQ ID NO: 2775 - DNA, 23 bp, Artificial Sequence
  mitotic kinesin microtubule-associated protein Eg5 (Kif11) siRNA
cttccttaaatgaaagggaacag

SEQ ID NO: 2776 - DNA, 23 bp, Artificial Sequence
  mitotic kinesin microtubule-associated protein Eg5 (Kif11) siRNA
ttccttaaatgaaagggaacagg

SEQ ID NO: 2777 - DNA, 23 bp, Artificial Sequence
  mitotic kinesin microtubule-associated protein Eg5 (Kif11) siRNA
tccttaaatgaaagggaacagga

SEQ ID NO: 2778 - DNA, 23 bp, Artificial Sequence
  mitotic kinesin microtubule-associated protein Eg5 (Kif11) siRNA
ccttaaatgaaagggaacaggaa

SEQ ID NO: 2779 - DNA, 23 bp, Artificial Sequence
  mitotic kinesin microtubule-associated protein Eg5 (Kif11) siRNA
cttaaatgaaagggaacaggaac

SEQ ID NO: 2780 - DNA, 23 bp, Artificial Sequence
  mitotic kinesin microtubule-associated protein Eg5 (Kif11) siRNA
ttaaatgaaagggaacaggaact

SEQ ID NO: 2781 - DNA, 23 bp, Artificial Sequence
  mitotic kinesin microtubule-associated protein Eg5 (Kif11) siRNA
taaatgaaagggaacaggaactt

SEQ ID NO: 2782 - DNA, 23 bp, Artificial Sequence
  mitotic kinesin microtubule-associated protein Eg5 (Kif11) siRNA
aaatgaaagggaacaggaacttc

SEQ ID NO: 2783 - DNA, 23 bp, Artificial Sequence
  mitotic kinesin microtubule-associated protein Eg5 (Kif11) siRNA
aatgaaagggaacaggaacttca

SEQ ID NO: 2784 - DNA, 23 bp, Artificial Sequence
  mitotic kinesin microtubule-associated protein Eg5 (Kif11) siRNA
atgaaagggaacaggaacttcac

SEQ ID NO: 2785 - DNA, 23 bp, Artificial Sequence
  mitotic kinesin microtubule-associated protein Eg5 (Kif11) siRNA
tgaaagggaacaggaacttcaca

SEQ ID NO: 2786 - DNA, 23 bp, Artificial Sequence
  mitotic kinesin microtubule-associated protein Eg5 (Kif11) siRNA
gaaagggaacaggaacttcacaa

SEQ ID NO: 2787 - DNA, 23 bp, Artificial Sequence
  mitotic kinesin microtubule-associated protein Eg5 (Kif11) siRNA
aaagggaacaggaacttcacaac

SEQ ID NO: 2788 - DNA, 23 bp, Artificial Sequence
  mitotic kinesin microtubule-associated protein Eg5 (Kif11) siRNA
aagggaacaggaacttcacaact

SEQ ID NO: 2789 - DNA, 23 bp, Artificial Sequence
  mitotic kinesin microtubule-associated protein Eg5 (Kif11) siRNA
agggaacaggaacttcacaactt

SEQ ID NO: 2790 - DNA, 23 bp, Artificial Sequence
  mitotic kinesin microtubule-associated protein Eg5 (Kif11) siRNA
gggaacaggaacttcacaactta

SEQ ID NO: 2791 - DNA, 23 bp, Artificial Sequence
  mitotic kinesin microtubule-associated protein Eg5 (Kif11) siRNA
ggaacaggaacttcacaacttat

SEQ ID NO: 2792 - DNA, 23 bp, Artificial Sequence
  mitotic kinesin microtubule-associated protein Eg5 (Kif11) siRNA
gaacaggaacttcacaacttatt

SEQ ID NO: 2793 - DNA, 23 bp, Artificial Sequence
  mitotic kinesin microtubule-associated protein Eg5 (Kif11) siRNA
aacaggaacttcacaacttattg

SEQ ID NO: 2794 - DNA, 23 bp, Artificial Sequence
  mitotic kinesin microtubule-associated protein Eg5 (Kif11) siRNA
acaggaacttcacaacttattgg

SEQ ID NO: 2795 - DNA, 23 bp, Artificial Sequence
  mitotic kinesin microtubule-associated protein Eg5 (Kif11) siRNA
caggaacttcacaacttattgga

SEQ ID NO: 2796 - DNA, 23 bp, Artificial Sequence
  mitotic kinesin microtubule-associated protein Eg5 (Kif11) siRNA
aggaacttcacaacttattggag

SEQ ID NO: 2797 - DNA, 23 bp, Artificial Sequence
  mitotic kinesin microtubule-associated protein Eg5 (Kif11) siRNA
ggaacttcacaacttattggagg

SEQ ID NO: 2798 - DNA, 23 bp, Artificial Sequence
  mitotic kinesin microtubule-associated protein Eg5 (Kif11) siRNA
gaacttcacaacttattggaggt

SEQ ID NO: 2799 - DNA, 23 bp, Artificial Sequence
  mitotic kinesin microtubule-associated protein Eg5 (Kif11) siRNA
aacttcacaacttattggaggtt

SEQ ID NO: 2800 - DNA, 23 bp, Artificial Sequence
  mitotic kinesin microtubule-associated protein Eg5 (Kif11) siRNA
acttcacaacttattggaggttg

SEQ ID NO: 2801 - DNA, 23 bp, Artificial Sequence
  mitotic kinesin microtubule-associated protein Eg5 (Kif11) siRNA
cttcacaacttattggaggttgt

SEQ ID NO: 2802 - DNA, 23 bp, Artificial Sequence
  mitotic kinesin microtubule-associated protein Eg5 (Kif11) siRNA
ttcacaacttattggaggttgta

SEQ ID NO: 2803 - DNA, 23 bp, Artificial Sequence
  mitotic kinesin microtubule-associated protein Eg5 (Kif11) siRNA
tcacaacttattggaggttgtaa

SEQ ID NO: 2804 - DNA, 23 bp, Artificial Sequence
  mitotic kinesin microtubule-associated protein Eg5 (Kif11) siRNA
cacaacttattggaggttgtaag

SEQ ID NO: 2805 - DNA, 23 bp, Artificial Sequence
  mitotic kinesin microtubule-associated protein Eg5 (Kif11) siRNA
acaacttattggaggttgtaagc

SEQ ID NO: 2806 - DNA, 23 bp, Artificial Sequence
  mitotic kinesin microtubule-associated protein Eg5 (Kif11) siRNA
caacttattggaggttgtaagcc

SEQ ID NO: 2807 - DNA, 23 bp, Artificial Sequence
  mitotic kinesin microtubule-associated protein Eg5 (Kif11) siRNA
aacttattggaggttgtaagcca

SEQ ID NO: 2808 - DNA, 23 bp, Artificial Sequence
  mitotic kinesin microtubule-associated protein Eg5 (Kif11) siRNA
acttattggaggttgtaagccaa

SEQ ID NO: 2809 - DNA, 23 bp, Artificial Sequence
  mitotic kinesin microtubule-associated protein Eg5 (Kif11) siRNA
cttattggaggttgtaagccaat

SEQ ID NO: 2810 - DNA, 23 bp, Artificial Sequence
  mitotic kinesin microtubule-associated protein Eg5 (Kif11) siRNA
ttattggaggttgtaagccaatg

SEQ ID NO: 2811 - DNA, 23 bp, Artificial Sequence
  mitotic kinesin microtubule-associated protein Eg5 (Kif11) siRNA
tattggaggttgtaagccaatgt

SEQ ID NO: 2812 - DNA, 23 bp, Artificial Sequence
  mitotic kinesin microtubule-associated protein Eg5 (Kif11) siRNA
attggaggttgtaagccaatgtt

SEQ ID NO: 2813 - DNA, 23 bp, Artificial Sequence
  mitotic kinesin microtubule-associated protein Eg5 (Kif11) siRNA
ttggaggttgtaagccaatgttg

SEQ ID NO: 2814 - DNA, 23 bp, Artificial Sequence
  mitotic kinesin microtubule-associated protein Eg5 (Kif11) siRNA
tggaggttgtaagccaatgttgt

SEQ ID NO: 2815 - DNA, 23 bp, Artificial Sequence
  mitotic kinesin microtubule-associated protein Eg5 (Kif11) siRNA
ggaggttgtaagccaatgttgtg

SEQ ID NO: 2816 - DNA, 23 bp, Artificial Sequence
  mitotic kinesin microtubule-associated protein Eg5 (Kif11) siRNA
gaggttgtaagccaatgttgtga

SEQ ID NO: 2817 - DNA, 23 bp, Artificial Sequence
  mitotic kinesin microtubule-associated protein Eg5 (Kif11) siRNA
aggttgtaagccaatgttgtgag

SEQ ID NO: 2818 - DNA, 23 bp, Artificial Sequence
  mitotic kinesin microtubule-associated protein Eg5 (Kif11) siRNA
ggttgtaagccaatgttgtgagg

SEQ ID NO: 2819 - DNA, 23 bp, Artificial Sequence
  mitotic kinesin microtubule-associated protein Eg5 (Kif11) siRNA
gttgtaagccaatgttgtgaggc

SEQ ID NO: 2820 - DNA, 23 bp, Artificial Sequence
  mitotic kinesin microtubule-associated protein Eg5 (Kif11) siRNA
ttgtaagccaatgttgtgaggct

SEQ ID NO: 2821 - DNA, 23 bp, Artificial Sequence
  mitotic kinesin microtubule-associated protein Eg5 (Kif11) siRNA
tgtaagccaatgttgtgaggctt

SEQ ID NO: 2822 - DNA, 23 bp, Artificial Sequence
  mitotic kinesin microtubule-associated protein Eg5 (Kif11) siRNA
gtaagccaatgttgtgaggcttc

SEQ ID NO: 2823 - DNA, 23 bp, Artificial Sequence
  mitotic kinesin microtubule-associated protein Eg5 (Kif11) siRNA
taagccaatgttgtgaggcttca

SEQ ID NO: 2824 - DNA, 23 bp, Artificial Sequence
  mitotic kinesin microtubule-associated protein Eg5 (Kif11) siRNA
aagccaatgttgtgaggcttcaa

SEQ ID NO: 2825 - DNA, 23 bp, Artificial Sequence
  mitotic kinesin microtubule-associated protein Eg5 (Kif11) siRNA
agccaatgttgtgaggcttcaag

SEQ ID NO: 2826 - DNA, 23 bp, Artificial Sequence
  mitotic kinesin microtubule-associated protein Eg5 (Kif11) siRNA
gccaatgttgtgaggcttcaagt

SEQ ID NO: 2827 - DNA, 23 bp, Artificial Sequence
  mitotic kinesin microtubule-associated protein Eg5 (Kif11) siRNA
ccaatgttgtgaggcttcaagtt

SEQ ID NO: 2828 - DNA, 23 bp, Artificial Sequence
  mitotic kinesin microtubule-associated protein Eg5 (Kif11) siRNA
caatgttgtgaggcttcaagttc

SEQ ID NO: 2829 - DNA, 23 bp, Artificial Sequence
  mitotic kinesin microtubule-associated protein Eg5 (Kif11) siRNA
aatgttgtgaggcttcaagttca

SEQ ID NO: 2830 - DNA, 23 bp, Artificial Sequence
  mitotic kinesin microtubule-associated protein Eg5 (Kif11) siRNA
atgttgtgaggcttcaagttcag

SEQ ID NO: 2831 - DNA, 23 bp, Artificial Sequence
  mitotic kinesin microtubule-associated protein Eg5 (Kif11) siRNA
tgttgtgaggcttcaagttcaga

SEQ ID NO: 2832 - DNA, 23 bp, Artificial Sequence
  mitotic kinesin microtubule-associated protein Eg5 (Kif11) siRNA
gttgtgaggcttcaagttcagac

SEQ ID NO: 2833 - DNA, 23 bp, Artificial Sequence
  mitotic kinesin microtubule-associated protein Eg5 (Kif11) siRNA
ttgtgaggcttcaagttcagaca

SEQ ID NO: 2834 - DNA, 23 bp, Artificial Sequence
  mitotic kinesin microtubule-associated protein Eg5 (Kif11) siRNA
tgtgaggcttcaagttcagacat

SEQ ID NO: 2835 - DNA, 23 bp, Artificial Sequence
  mitotic kinesin microtubule-associated protein Eg5 (Kif11) siRNA
gtgaggcttcaagttcagacatc

SEQ ID NO: 2836 - DNA, 23 bp, Artificial Sequence
  mitotic kinesin microtubule-associated protein Eg5 (Kif11) siRNA
tgaggcttcaagttcagacatca

SEQ ID NO: 2837 - DNA, 23 bp, Artificial Sequence
  mitotic kinesin microtubule-associated protein Eg5 (Kif11) siRNA
gaggcttcaagttcagacatcac

SEQ ID NO: 2838 - DNA, 23 bp, Artificial Sequence
  mitotic kinesin microtubule-associated protein Eg5 (Kif11) siRNA
aggcttcaagttcagacatcact

SEQ ID NO: 2839 - DNA, 23 bp, Artificial Sequence
  mitotic kinesin microtubule-associated protein Eg5 (Kif11) siRNA
ggcttcaagttcagacatcactg

SEQ ID NO: 2840 - DNA, 23 bp, Artificial Sequence
  mitotic kinesin microtubule-associated protein Eg5 (Kif11) siRNA
gcttcaagttcagacatcactga

SEQ ID NO: 2841 - DNA, 23 bp, Artificial Sequence
  mitotic kinesin microtubule-associated protein Eg5 (Kif11) siRNA
cttcaagttcagacatcactgag

SEQ ID NO: 2842 - DNA, 23 bp, Artificial Sequence
  mitotic kinesin microtubule-associated protein Eg5 (Kif11) siRNA
ttcaagttcagacatcactgaga

SEQ ID NO: 2843 - DNA, 23 bp, Artificial Sequence
  mitotic kinesin microtubule-associated protein Eg5 (Kif11) siRNA
tcaagttcagacatcactgagaa

SEQ ID NO: 2844 - DNA, 23 bp, Artificial Sequence
  mitotic kinesin microtubule-associated protein Eg5 (Kif11) siRNA
caagttcagacatcactgagaaa

SEQ ID NO: 2845 - DNA, 23 bp, Artificial Sequence
  mitotic kinesin microtubule-associated protein Eg5 (Kif11) siRNA
aagttcagacatcactgagaaat

SEQ ID NO: 2846 - DNA, 23 bp, Artificial Sequence
  mitotic kinesin microtubule-associated protein Eg5 (Kif11) siRNA
agttcagacatcactgagaaatc

SEQ ID NO: 2847 - DNA, 23 bp, Artificial Sequence
  mitotic kinesin microtubule-associated protein Eg5 (Kif11) siRNA
gttcagacatcactgagaaatca

SEQ ID NO: 2848 - DNA, 23 bp, Artificial Sequence
  mitotic kinesin microtubule-associated protein Eg5 (Kif11) siRNA
ttcagacatcactgagaaatcag

SEQ ID NO: 2849 - DNA, 23 bp, Artificial Sequence
  mitotic kinesin microtubule-associated protein Eg5 (Kif11) siRNA
tcagacatcactgagaaatcaga

SEQ ID NO: 2850 - DNA, 23 bp, Artificial Sequence
  mitotic kinesin microtubule-associated protein Eg5 (Kif11) siRNA
cagacatcactgagaaatcagat

SEQ ID NO: 2851 - DNA, 23 bp, Artificial Sequence
  mitotic kinesin microtubule-associated protein Eg5 (Kif11) siRNA
agacatcactgagaaatcagatg

SEQ ID NO: 2852 - DNA, 23 bp, Artificial Sequence
  mitotic kinesin microtubule-associated protein Eg5 (Kif11) siRNA
gacatcactgagaaatcagatgg

SEQ ID NO: 2853 - DNA, 23 bp, Artificial Sequence
  mitotic kinesin microtubule-associated protein Eg5 (Kif11) siRNA
acatcactgagaaatcagatgga

SEQ ID NO: 2854 - DNA, 23 bp, Artificial Sequence
  mitotic kinesin microtubule-associated protein Eg5 (Kif11) siRNA
catcactgagaaatcagatggac

SEQ ID NO: 2855 - DNA, 23 bp, Artificial Sequence
  mitotic kinesin microtubule-associated protein Eg5 (Kif11) siRNA
atcactgagaaatcagatggacg

SEQ ID NO: 2856 - DNA, 23 bp, Artificial Sequence
  mitotic kinesin microtubule-associated protein Eg5 (Kif11) siRNA
tcactgagaaatcagatggacgt

SEQ ID NO: 2857 - DNA, 23 bp, Artificial Sequence
  mitotic kinesin microtubule-associated protein Eg5 (Kif11) siRNA
cactgagaaatcagatggacgta

SEQ ID NO: 2858 - DNA, 23 bp, Artificial Sequence
  mitotic kinesin microtubule-associated protein Eg5 (Kif11) siRNA
actgagaaatcagatggacgtaa

SEQ ID NO: 2859 - DNA, 23 bp, Artificial Sequence
  mitotic kinesin microtubule-associated protein Eg5 (Kif11) siRNA
ctgagaaatcagatggacgtaag

SEQ ID NO: 2860 - DNA, 23 bp, Artificial Sequence
  mitotic kinesin microtubule-associated protein Eg5 (Kif11) siRNA
tgagaaatcagatggacgtaagg

SEQ ID NO: 2861 - DNA, 23 bp, Artificial Sequence
  mitotic kinesin microtubule-associated protein Eg5 (Kif11) siRNA
gagaaatcagatggacgtaaggc

SEQ ID NO: 2862 - DNA, 23 bp, Artificial Sequence
  mitotic kinesin microtubule-associated protein Eg5 (Kif11) siRNA
agaaatcagatggacgtaaggca

SEQ ID NO: 2863 - DNA, 23 bp, Artificial Sequence
  mitotic kinesin microtubule-associated protein Eg5 (Kif11) siRNA
gaaatcagatggacgtaaggcag

SEQ ID NO: 2864 - DNA, 23 bp, Artificial Sequence
  mitotic kinesin microtubule-associated protein Eg5 (Kif11) siRNA
aaatcagatggacgtaaggcagc

SEQ ID NO: 2865 - DNA, 23 bp, Artificial Sequence
  mitotic kinesin microtubule-associated protein Eg5 (Kif11) siRNA
aatcagatggacgtaaggcagct

SEQ ID NO: 2866 - DNA, 23 bp, Artificial Sequence
  mitotic kinesin microtubule-associated protein Eg5 (Kif11) siRNA
atcagatggacgtaaggcagctc

SEQ ID NO: 2867 - DNA, 23 bp, Artificial Sequence
  mitotic kinesin microtubule-associated protein Eg5 (Kif11) siRNA
tcagatggacgtaaggcagctca

SEQ ID NO: 2868 - DNA, 23 bp, Artificial Sequence
  mitotic kinesin microtubule-associated protein Eg5 (Kif11) siRNA
cagatggacgtaaggcagctcat

SEQ ID NO: 2869 - DNA, 23 bp, Artificial Sequence
  mitotic kinesin microtubule-associated protein Eg5 (Kif11) siRNA
agatggacgtaaggcagctcatg

SEQ ID NO: 2870 - DNA, 23 bp, Artificial Sequence
  mitotic kinesin microtubule-associated protein Eg5 (Kif11) siRNA
gatggacgtaaggcagctcatga

SEQ ID NO: 2871 - DNA, 23 bp, Artificial Sequence
  mitotic kinesin microtubule-associated protein Eg5 (Kif11) siRNA
atggacgtaaggcagctcatgag

SEQ ID NO: 2872 - DNA, 23 bp, Artificial Sequence
  mitotic kinesin microtubule-associated protein Eg5 (Kif11) siRNA
tggacgtaaggcagctcatgaga

SEQ ID NO: 2873 - DNA, 23 bp, Artificial Sequence
  mitotic kinesin microtubule-associated protein Eg5 (Kif11) siRNA
ggacgtaaggcagctcatgagaa

SEQ ID NO: 2874 - DNA, 23 bp, Artificial Sequence
  mitotic kinesin microtubule-associated protein Eg5 (Kif11) siRNA
gacgtaaggcagctcatgagaaa

SEQ ID NO: 2875 - DNA, 23 bp, Artificial Sequence
  mitotic kinesin microtubule-associated protein Eg5 (Kif11) siRNA
acgtaaggcagctcatgagaaac

SEQ ID NO: 2876 - DNA, 23 bp, Artificial Sequence
  mitotic kinesin microtubule-associated protein Eg5 (Kif11) siRNA
cgtaaggcagctcatgagaaaca

SEQ ID NO: 2877 - DNA, 23 bp, Artificial Sequence
  mitotic kinesin microtubule-associated protein Eg5 (Kif11) siRNA
gtaaggcagctcatgagaaacag

SEQ ID NO: 2878 - DNA, 23 bp, Artificial Sequence
  mitotic kinesin microtubule-associated protein Eg5 (Kif11) siRNA
taaggcagctcatgagaaacagc

SEQ ID NO: 2879 - DNA, 23 bp, Artificial Sequence
  mitotic kinesin microtubule-associated protein Eg5 (Kif11) siRNA
aaggcagctcatgagaaacagca

SEQ ID NO: 2880 - DNA, 23 bp, Artificial Sequence
  mitotic kinesin microtubule-associated protein Eg5 (Kif11) siRNA
aggcagctcatgagaaacagcat

SEQ ID NO: 2881 - DNA, 23 bp, Artificial Sequence
  mitotic kinesin microtubule-associated protein Eg5 (Kif11) siRNA
ggcagctcatgagaaacagcata

SEQ ID NO: 2882 - DNA, 23 bp, Artificial Sequence
  mitotic kinesin microtubule-associated protein Eg5 (Kif11) siRNA
gcagctcatgagaaacagcataa

SEQ ID NO: 2883 - DNA, 23 bp, Artificial Sequence
  mitotic kinesin microtubule-associated protein Eg5 (Kif11) siRNA
cagctcatgagaaacagcataac

SEQ ID NO: 2884 - DNA, 23 bp, Artificial Sequence
  mitotic kinesin microtubule-associated protein Eg5 (Kif11) siRNA
agctcatgagaaacagcataaca

SEQ ID NO: 2885 - DNA, 23 bp, Artificial Sequence
  mitotic kinesin microtubule-associated protein Eg5 (Kif11) siRNA
gctcatgagaaacagcataacat

SEQ ID NO: 2886 - DNA, 23 bp, Artificial Sequence
  mitotic kinesin microtubule-associated protein Eg5 (Kif11) siRNA
ctcatgagaaacagcataacatt

SEQ ID NO: 2887 - DNA, 23 bp, Artificial Sequence
  mitotic kinesin microtubule-associated protein Eg5 (Kif11) siRNA
tcatgagaaacagcataacattt

SEQ ID NO: 2888 - DNA, 23 bp, Artificial Sequence
  mitotic kinesin microtubule-associated protein Eg5 (Kif11) siRNA
catgagaaacagcataacatttt

SEQ ID NO: 2889 - DNA, 23 bp, Artificial Sequence
  mitotic kinesin microtubule-associated protein Eg5 (Kif11) siRNA
atgagaaacagcataacattttt

SEQ ID NO: 2890 - DNA, 23 bp, Artificial Sequence
  mitotic kinesin microtubule-associated protein Eg5 (Kif11) siRNA
tgagaaacagcataacatttttc

SEQ ID NO: 2891 - DNA, 23 bp, Artificial Sequence
  mitotic kinesin microtubule-associated protein Eg5 (Kif11) siRNA
gagaaacagcataacatttttct

SEQ ID NO: 2892 - DNA, 23 bp, Artificial Sequence
  mitotic kinesin microtubule-associated protein Eg5 (Kif11) siRNA
agaaacagcataacatttttctt

SEQ ID NO: 2893 - DNA, 23 bp, Artificial Sequence
  mitotic kinesin microtubule-associated protein Eg5 (Kif11) siRNA
gaaacagcataacatttttcttg

SEQ ID NO: 2894 - DNA, 23 bp, Artificial Sequence
  mitotic kinesin microtubule-associated protein Eg5 (Kif11) siRNA
aaacagcataacatttttcttga

SEQ ID NO: 2895 - DNA, 23 bp, Artificial Sequence
  mitotic kinesin microtubule-associated protein Eg5 (Kif11) siRNA
aacagcataacatttttcttgat

SEQ ID NO: 2896 - DNA, 23 bp, Artificial Sequence
  mitotic kinesin microtubule-associated protein Eg5 (Kif11) siRNA
acagcataacatttttcttgatc

SEQ ID NO: 2897 - DNA, 23 bp, Artificial Sequence
  mitotic kinesin microtubule-associated protein Eg5 (Kif11) siRNA
cagcataacatttttcttgatca

SEQ ID NO: 2898 - DNA, 23 bp, Artificial Sequence
  mitotic kinesin microtubule-associated protein Eg5 (Kif11) siRNA
agcataacatttttcttgatcag

SEQ ID NO: 2899 - DNA, 23 bp, Artificial Sequence
  mitotic kinesin microtubule-associated protein Eg5 (Kif11) siRNA
gcataacatttttcttgatcaga

SEQ ID NO: 2900 - DNA, 23 bp, Artificial Sequence
  mitotic kinesin microtubule-associated protein Eg5 (Kif11) siRNA
cataacatttttcttgatcagat

SEQ ID NO: 2901 - DNA, 23 bp, Artificial Sequence
  mitotic kinesin microtubule-associated protein Eg5 (Kif11) siRNA
ataacatttttcttgatcagatg

SEQ ID NO: 2902 - DNA, 23 bp, Artificial Sequence
  mitotic kinesin microtubule-associated protein Eg5 (Kif11) siRNA
taacatttttcttgatcagatga

SEQ ID NO: 2903 - DNA, 23 bp, Artificial Sequence
  mitotic kinesin microtubule-associated protein Eg5 (Kif11) siRNA
aacatttttcttgatcagatgac

SEQ ID NO: 2904 - DNA, 23 bp, Artificial Sequence
  mitotic kinesin microtubule-associated protein Eg5 (Kif11) siRNA
acatttttcttgatcagatgact

SEQ ID NO: 2905 - DNA, 23 bp, Artificial Sequence
  mitotic kinesin microtubule-associated protein Eg5 (Kif11) siRNA
catttttcttgatcagatgacta

SEQ ID NO: 2906 - DNA, 23 bp, Artificial Sequence
  mitotic kinesin microtubule-associated protein Eg5 (Kif11) siRNA
atttttcttgatcagatgactat

SEQ ID NO: 2907 - DNA, 23 bp, Artificial Sequence
  mitotic kinesin microtubule-associated protein Eg5 (Kif11) siRNA
tttttcttgatcagatgactatt

SEQ ID NO: 2908 - DNA, 23 bp, Artificial Sequence
  mitotic kinesin microtubule-associated protein Eg5 (Kif11) siRNA
ttttcttgatcagatgactattg

SEQ ID NO: 2909 - DNA, 23 bp, Artificial Sequence
  mitotic kinesin microtubule-associated protein Eg5 (Kif11) siRNA
tttcttgatcagatgactattga

SEQ ID NO: 2910 - DNA, 23 bp, Artificial Sequence
  mitotic kinesin microtubule-associated protein Eg5 (Kif11) siRNA
ttcttgatcagatgactattgat

SEQ ID NO: 2911 - DNA, 23 bp, Artificial Sequence
  mitotic kinesin microtubule-associated protein Eg5 (Kif11) siRNA
tcttgatcagatgactattgatg

SEQ ID NO: 2912 - DNA, 23 bp, Artificial Sequence
  mitotic kinesin microtubule-associated protein Eg5 (Kif11) siRNA
cttgatcagatgactattgatga

SEQ ID NO: 2913 - DNA, 23 bp, Artificial Sequence
  mitotic kinesin microtubule-associated protein Eg5 (Kif11) siRNA
ttgatcagatgactattgatgaa

SEQ ID NO: 2914 - DNA, 23 bp, Artificial Sequence
  mitotic kinesin microtubule-associated protein Eg5 (Kif11) siRNA
tgatcagatgactattgatgaag

SEQ ID NO: 2915 - DNA, 23 bp, Artificial Sequence
  mitotic kinesin microtubule-associated protein Eg5 (Kif11) siRNA
gatcagatgactattgatgaaga

SEQ ID NO: 2916 - DNA, 23 bp, Artificial Sequence
  mitotic kinesin microtubule-associated protein Eg5 (Kif11) siRNA
atcagatgactattgatgaagat

SEQ ID NO: 2917 - DNA, 23 bp, Artificial Sequence
  mitotic kinesin microtubule-associated protein Eg5 (Kif11) siRNA
tcagatgactattgatgaagata

SEQ ID NO: 2918 - DNA, 23 bp, Artificial Sequence
  mitotic kinesin microtubule-associated protein Eg5 (Kif11) siRNA
cagatgactattgatgaagataa

SEQ ID NO: 2919 - DNA, 23 bp, Artificial Sequence
  mitotic kinesin microtubule-associated protein Eg5 (Kif11) siRNA
agatgactattgatgaagataaa

SEQ ID NO: 2920 - DNA, 23 bp, Artificial Sequence
  mitotic kinesin microtubule-associated protein Eg5 (Kif11) siRNA
gatgactattgatgaagataaat

SEQ ID NO: 2921 - DNA, 23 bp, Artificial Sequence
  mitotic kinesin microtubule-associated protein Eg5 (Kif11) siRNA
atgactattgatgaagataaatt

SEQ ID NO: 2922 - DNA, 23 bp, Artificial Sequence
  mitotic kinesin microtubule-associated protein Eg5 (Kif11) siRNA
tgactattgatgaagataaattg

SEQ ID NO: 2923 - DNA, 23 bp, Artificial Sequence
  mitotic kinesin microtubule-associated protein Eg5 (Kif11) siRNA
gactattgatgaagataaattga

SEQ ID NO: 2924 - DNA, 23 bp, Artificial Sequence
  mitotic kinesin microtubule-associated protein Eg5 (Kif11) siRNA
actattgatgaagataaattgat

SEQ ID NO: 2925 - DNA, 23 bp, Artificial Sequence
  mitotic kinesin microtubule-associated protein Eg5 (Kif11) siRNA
ctattgatgaagataaattgata

SEQ ID NO: 2926 - DNA, 23 bp, Artificial Sequence
  mitotic kinesin microtubule-associated protein Eg5 (Kif11) siRNA
tattgatgaagataaattgatag

SEQ ID NO: 2927 - DNA, 23 bp, Artificial Sequence
  mitotic kinesin microtubule-associated protein Eg5 (Kif11) siRNA
attgatgaagataaattgatagc

SEQ ID NO: 2928 - DNA, 23 bp, Artificial Sequence
  mitotic kinesin microtubule-associated protein Eg5 (Kif11) siRNA
ttgatgaagataaattgatagca

SEQ ID NO: 2929 - DNA, 23 bp, Artificial Sequence
  mitotic kinesin microtubule-associated protein Eg5 (Kif11) siRNA
tgatgaagataaattgatagcac

SEQ ID NO: 2930 - DNA, 23 bp, Artificial Sequence
  mitotic kinesin microtubule-associated protein Eg5 (Kif11) siRNA
gatgaagataaattgatagcaca

SEQ ID NO: 2931 - DNA, 23 bp, Artificial Sequence
  mitotic kinesin microtubule-associated protein Eg5 (Kif11) siRNA
atgaagataaattgatagcacaa

SEQ ID NO: 2932 - DNA, 23 bp, Artificial Sequence
  mitotic kinesin microtubule-associated protein Eg5 (Kif11) siRNA
tgaagataaattgatagcacaaa

SEQ ID NO: 2933 - DNA, 23 bp, Artificial Sequence
  mitotic kinesin microtubule-associated protein Eg5 (Kif11) siRNA
gaagataaattgatagcacaaaa

SEQ ID NO: 2934 - DNA, 23 bp, Artificial Sequence
  mitotic kinesin microtubule-associated protein Eg5 (Kif11) siRNA
aagataaattgatagcacaaaat

SEQ ID NO: 2935 - DNA, 23 bp, Artificial Sequence
  mitotic kinesin microtubule-associated protein Eg5 (Kif11) siRNA
agataaattgatagcacaaaatc

SEQ ID NO: 2936 - DNA, 23 bp, Artificial Sequence
  mitotic kinesin microtubule-associated protein Eg5 (Kif11) siRNA
gataaattgatagcacaaaatct

SEQ ID NO: 2937 - DNA, 23 bp, Artificial Sequence
  mitotic kinesin microtubule-associated protein Eg5 (Kif11) siRNA
ataaattgatagcacaaaatcta

SEQ ID NO: 2938 - DNA, 23 bp, Artificial Sequence
  mitotic kinesin microtubule-associated protein Eg5 (Kif11) siRNA
taaattgatagcacaaaatctag

SEQ ID NO: 2939 - DNA, 23 bp, Artificial Sequence
  mitotic kinesin microtubule-associated protein Eg5 (Kif11) siRNA
aaattgatagcacaaaatctaga

SEQ ID NO: 2940 - DNA, 23 bp, Artificial Sequence
  mitotic kinesin microtubule-associated protein Eg5 (Kif11) siRNA
aattgatagcacaaaatctagaa

SEQ ID NO: 2941 - DNA, 23 bp, Artificial Sequence
  mitotic kinesin microtubule-associated protein Eg5 (Kif11) siRNA
attgatagcacaaaatctagaac

SEQ ID NO: 2942 - DNA, 23 bp, Artificial Sequence
  mitotic kinesin microtubule-associated protein Eg5 (Kif11) siRNA
ttgatagcacaaaatctagaact

SEQ ID NO: 2943 - DNA, 23 bp, Artificial Sequence
  mitotic kinesin microtubule-associated protein Eg5 (Kif11) siRNA
tgatagcacaaaatctagaactt

SEQ ID NO: 2944 - DNA, 23 bp, Artificial Sequence
  mitotic kinesin microtubule-associated protein Eg5 (Kif11) siRNA
gatagcacaaaatctagaactta

SEQ ID NO: 2945 - DNA, 23 bp, Artificial Sequence
  mitotic kinesin microtubule-associated protein Eg5 (Kif11) siRNA
atagcacaaaatctagaacttaa

SEQ ID NO: 2946 - DNA, 23 bp, Artificial Sequence
  mitotic kinesin microtubule-associated protein Eg5 (Kif11) siRNA
tagcacaaaatctagaacttaat

SEQ ID NO: 2947 - DNA, 23 bp, Artificial Sequence
  mitotic kinesin microtubule-associated protein Eg5 (Kif11) siRNA
agcacaaaatctagaacttaatg

SEQ ID NO: 2948 - DNA, 23 bp, Artificial Sequence
  mitotic kinesin microtubule-associated protein Eg5 (Kif11) siRNA
gcacaaaatctagaacttaatga

SEQ ID NO: 2949 - DNA, 23 bp, Artificial Sequence
  mitotic kinesin microtubule-associated protein Eg5 (Kif11) siRNA
cacaaaatctagaacttaatgaa

SEQ ID NO: 2950 - DNA, 23 bp, Artificial Sequence
  mitotic kinesin microtubule-associated protein Eg5 (Kif11) siRNA
acaaaatctagaacttaatgaaa

SEQ ID NO: 2951 - DNA, 23 bp, Artificial Sequence
  mitotic kinesin microtubule-associated protein Eg5 (Kif11) siRNA
caaaatctagaacttaatgaaac

SEQ ID NO: 2952 - DNA, 23 bp, Artificial Sequence
  mitotic kinesin microtubule-associated protein Eg5 (Kif11) siRNA
aaaatctagaacttaatgaaacc

SEQ ID NO: 2953 - DNA, 23 bp, Artificial Sequence
  mitotic kinesin microtubule-associated protein Eg5 (Kif11) siRNA
aaatctagaacttaatgaaacca

SEQ ID NO: 2954 - DNA, 23 bp, Artificial Sequence
  mitotic kinesin microtubule-associated protein Eg5 (Kif11) siRNA
aatctagaacttaatgaaaccat

SEQ ID NO: 2955 - DNA, 23 bp, Artificial Sequence
  mitotic kinesin microtubule-associated protein Eg5 (Kif11) siRNA
atctagaacttaatgaaaccata

SEQ ID NO: 2956 - DNA, 23 bp, Artificial Sequence
  mitotic kinesin microtubule-associated protein Eg5 (Kif11) siRNA
tctagaacttaatgaaaccataa

SEQ ID NO: 2957 - DNA, 23 bp, Artificial Sequence
  mitotic kinesin microtubule-associated protein Eg5 (Kif11) siRNA
ctagaacttaatgaaaccataaa

SEQ ID NO: 2958 - DNA, 23 bp, Artificial Sequence
  mitotic kinesin microtubule-associated protein Eg5 (Kif11) siRNA
tagaacttaatgaaaccataaaa

SEQ ID NO: 2959 - DNA, 23 bp, Artificial Sequence
  mitotic kinesin microtubule-associated protein Eg5 (Kif11) siRNA
agaacttaatgaaaccataaaaa

SEQ ID NO: 2960 - DNA, 23 bp, Artificial Sequence
  mitotic kinesin microtubule-associated protein Eg5 (Kif11) siRNA
gaacttaatgaaaccataaaaat

SEQ ID NO: 2961 - DNA, 23 bp, Artificial Sequence
  mitotic kinesin microtubule-associated protein Eg5 (Kif11) siRNA
aacttaatgaaaccataaaaatt

SEQ ID NO: 2962 - DNA, 23 bp, Artificial Sequence
  mitotic kinesin microtubule-associated protein Eg5 (Kif11) siRNA
acttaatgaaaccataaaaattg

SEQ ID NO: 2963 - DNA, 23 bp, Artificial Sequence
  mitotic kinesin microtubule-associated protein Eg5 (Kif11) siRNA
cttaatgaaaccataaaaattgg

SEQ ID NO: 2964 - DNA, 23 bp, Artificial Sequence
  mitotic kinesin microtubule-associated protein Eg5 (Kif11) siRNA
ttaatgaaaccataaaaattggt

SEQ ID NO: 2965 - DNA, 23 bp, Artificial Sequence
  mitotic kinesin microtubule-associated protein Eg5 (Kif11) siRNA
taatgaaaccataaaaattggtt

SEQ ID NO: 2966 - DNA, 23 bp, Artificial Sequence
  mitotic kinesin microtubule-associated protein Eg5 (Kif11) siRNA
aatgaaaccataaaaattggttt

SEQ ID NO: 2967 - DNA, 23 bp, Artificial Sequence
  mitotic kinesin microtubule-associated protein Eg5 (Kif11) siRNA
atgaaaccataaaaattggtttg

SEQ ID NO: 2968 - DNA, 23 bp, Artificial Sequence
  mitotic kinesin microtubule-associated protein Eg5 (Kif11) siRNA
tgaaaccataaaaattggtttga

SEQ ID NO: 2969 - DNA, 23 bp, Artificial Sequence
  mitotic kinesin microtubule-associated protein Eg5 (Kif11) siRNA
gaaaccataaaaattggtttgac

SEQ ID NO: 2970 - DNA, 23 bp, Artificial Sequence
  mitotic kinesin microtubule-associated protein Eg5 (Kif11) siRNA
aaaccataaaaattggtttgact

SEQ ID NO: 2971 - DNA, 23 bp, Artificial Sequence
  mitotic kinesin microtubule-associated protein Eg5 (Kif11) siRNA
aaccataaaaattggtttgacta

SEQ ID NO: 2972 - DNA, 23 bp, Artificial Sequence
  mitotic kinesin microtubule-associated protein Eg5 (Kif11) siRNA
accataaaaattggtttgactaa

SEQ ID NO: 2973 - DNA, 23 bp, Artificial Sequence
  mitotic kinesin microtubule-associated protein Eg5 (Kif11) siRNA
ccataaaaattggtttgactaag

SEQ ID NO: 2974 - DNA, 23 bp, Artificial Sequence
  mitotic kinesin microtubule-associated protein Eg5 (Kif11) siRNA
cataaaaattggtttgactaagc

SEQ ID NO: 2975 - DNA, 23 bp, Artificial Sequence
  mitotic kinesin microtubule-associated protein Eg5 (Kif11) siRNA
ataaaaattggtttgactaagct

SEQ ID NO: 2976 - DNA, 23 bp, Artificial Sequence
  mitotic kinesin microtubule-associated protein Eg5 (Kif11) siRNA
taaaaattggtttgactaagctt

SEQ ID NO: 2977 - DNA, 23 bp, Artificial Sequence
  mitotic kinesin microtubule-associated protein Eg5 (Kif11) siRNA
aaaaattggtttgactaagctta

SEQ ID NO: 2978 - DNA, 23 bp, Artificial Sequence
  mitotic kinesin microtubule-associated protein Eg5 (Kif11) siRNA
aaaattggtttgactaagcttaa

SEQ ID NO: 2979 - DNA, 23 bp, Artificial Sequence
  mitotic kinesin microtubule-associated protein Eg5 (Kif11) siRNA
aaattggtttgactaagcttaat

SEQ ID NO: 2980 - DNA, 23 bp, Artificial Sequence
  mitotic kinesin microtubule-associated protein Eg5 (Kif11) siRNA
aattggtttgactaagcttaatt

SEQ ID NO: 2981 - DNA, 23 bp, Artificial Sequence
  mitotic kinesin microtubule-associated protein Eg5 (Kif11) siRNA
attggtttgactaagcttaattg

SEQ ID NO: 2982 - DNA, 23 bp, Artificial Sequence
  mitotic kinesin microtubule-associated protein Eg5 (Kif11) siRNA
ttggtttgactaagcttaattgc

SEQ ID NO: 2983 - DNA, 23 bp, Artificial Sequence
  mitotic kinesin microtubule-associated protein Eg5 (Kif11) siRNA
tggtttgactaagcttaattgct

SEQ ID NO: 2984 - DNA, 23 bp, Artificial Sequence
  mitotic kinesin microtubule-associated protein Eg5 (Kif11) siRNA
ggtttgactaagcttaattgctt

SEQ ID NO: 2985 - DNA, 23 bp, Artificial Sequence
  mitotic kinesin microtubule-associated protein Eg5 (Kif11) siRNA
gtttgactaagcttaattgcttt

SEQ ID NO: 2986 - DNA, 23 bp, Artificial Sequence
  mitotic kinesin microtubule-associated protein Eg5 (Kif11) siRNA
tttgactaagcttaattgctttc

SEQ ID NO: 2987 - DNA, 23 bp, Artificial Sequence
  mitotic kinesin microtubule-associated protein Eg5 (Kif11) siRNA
ttgactaagcttaattgctttct

SEQ ID NO: 2988 - DNA, 23 bp, Artificial Sequence
  mitotic kinesin microtubule-associated protein Eg5 (Kif11) siRNA
tgactaagcttaattgctttctg

SEQ ID NO: 2989 - DNA, 23 bp, Artificial Sequence
  mitotic kinesin microtubule-associated protein Eg5 (Kif11) siRNA
gactaagcttaattgctttctgg

SEQ ID NO: 2990 - DNA, 23 bp, Artificial Sequence
  mitotic kinesin microtubule-associated protein Eg5 (Kif11) siRNA
actaagcttaattgctttctgga

SEQ ID NO: 2991 - DNA, 23 bp, Artificial Sequence
  mitotic kinesin microtubule-associated protein Eg5 (Kif11) siRNA
ctaagcttaattgctttctggaa

SEQ ID NO: 2992 - DNA, 23 bp, Artificial Sequence
  mitotic kinesin microtubule-associated protein Eg5 (Kif11) siRNA
taagcttaattgctttctggaac

SEQ ID NO: 2993 - DNA, 23 bp, Artificial Sequence
  mitotic kinesin microtubule-associated protein Eg5 (Kif11) siRNA
aagcttaattgctttctggaaca

SEQ ID NO: 2994 - DNA, 23 bp, Artificial Sequence
  mitotic kinesin microtubule-associated protein Eg5 (Kif11) siRNA
agcttaattgctttctggaacag

SEQ ID NO: 2995 - DNA, 23 bp, Artificial Sequence
  mitotic kinesin microtubule-associated protein Eg5 (Kif11) siRNA
gcttaattgctttctggaacagg

SEQ ID NO: 2996 - DNA, 23 bp, Artificial Sequence
  mitotic kinesin microtubule-associated protein Eg5 (Kif11) siRNA
cttaattgctttctggaacagga

SEQ ID NO: 2997 - DNA, 23 bp, Artificial Sequence
  mitotic kinesin microtubule-associated protein Eg5 (Kif11) siRNA
ttaattgctttctggaacaggat

SEQ ID NO: 2998 - DNA, 23 bp, Artificial Sequence
  mitotic kinesin microtubule-associated protein Eg5 (Kif11) siRNA
taattgctttctggaacaggatc

SEQ ID NO: 2999 - DNA, 23 bp, Artificial Sequence
  mitotic kinesin microtubule-associated protein Eg5 (Kif11) siRNA
aattgctttctggaacaggatct

SEQ ID NO: 3000 - DNA, 23 bp, Artificial Sequence
  mitotic kinesin microtubule-associated protein Eg5 (Kif11) siRNA
attgctttctggaacaggatctg

SEQ ID NO: 3001 - DNA, 23 bp, Artificial Sequence
  mitotic kinesin microtubule-associated protein Eg5 (Kif11) siRNA
ttgctttctggaacaggatctga

SEQ ID NO: 3002 - DNA, 23 bp, Artificial Sequence
  mitotic kinesin microtubule-associated protein Eg5 (Kif11) siRNA
tgctttctggaacaggatctgaa

SEQ ID NO: 3003 - DNA, 23 bp, Artificial Sequence
  mitotic kinesin microtubule-associated protein Eg5 (Kif11) siRNA
gctttctggaacaggatctgaaa

SEQ ID NO: 3004 - DNA, 23 bp, Artificial Sequence
  mitotic kinesin microtubule-associated protein Eg5 (Kif11) siRNA
ctttctggaacaggatctgaaac

SEQ ID NO: 3005 - DNA, 23 bp, Artificial Sequence
  mitotic kinesin microtubule-associated protein Eg5 (Kif11) siRNA
tttctggaacaggatctgaaact

SEQ ID NO: 3006 - DNA, 23 bp, Artificial Sequence
  mitotic kinesin microtubule-associated protein Eg5 (Kif11) siRNA
ttctggaacaggatctgaaactg

SEQ ID NO: 3007 - DNA, 23 bp, Artificial Sequence
  mitotic kinesin microtubule-associated protein Eg5 (Kif11) siRNA
tctggaacaggatctgaaactgg

SEQ ID NO: 3008 - DNA, 23 bp, Artificial Sequence
  mitotic kinesin microtubule-associated protein Eg5 (Kif11) siRNA
ctggaacaggatctgaaactgga

SEQ ID NO: 3009 - DNA, 23 bp, Artificial Sequence
  mitotic kinesin microtubule-associated protein Eg5 (Kif11) siRNA
tggaacaggatctgaaactggat

SEQ ID NO: 3010 - DNA, 23 bp, Artificial Sequence
  mitotic kinesin microtubule-associated protein Eg5 (Kif11) siRNA
ggaacaggatctgaaactggata

SEQ ID NO: 3011 - DNA, 23 bp, Artificial Sequence
  mitotic kinesin microtubule-associated protein Eg5 (Kif11) siRNA
gaacaggatctgaaactggatat

SEQ ID NO: 3012 - DNA, 23 bp, Artificial Sequence
  mitotic kinesin microtubule-associated protein Eg5 (Kif11) siRNA
aacaggatctgaaactggatatc

SEQ ID NO: 3013 - DNA, 23 bp, Artificial Sequence
  mitotic kinesin microtubule-associated protein Eg5 (Kif11) siRNA
acaggatctgaaactggatatcc

SEQ ID NO: 3014 - DNA, 23 bp, Artificial Sequence
  mitotic kinesin microtubule-associated protein Eg5 (Kif11) siRNA
caggatctgaaactggatatccc

SEQ ID NO: 3015 - DNA, 23 bp, Artificial Sequence
  mitotic kinesin microtubule-associated protein Eg5 (Kif11) siRNA
aggatctgaaactggatatccca

SEQ ID NO: 3016 - DNA, 23 bp, Artificial Sequence
  mitotic kinesin microtubule-associated protein Eg5 (Kif11) siRNA
ggatctgaaactggatatcccaa

SEQ ID NO: 3017 - DNA, 23 bp, Artificial Sequence
  mitotic kinesin microtubule-associated protein Eg5 (Kif11) siRNA
gatctgaaactggatatcccaac

SEQ ID NO: 3018 - DNA, 23 bp, Artificial Sequence
  mitotic kinesin microtubule-associated protein Eg5 (Kif11) siRNA
atctgaaactggatatcccaaca

SEQ ID NO: 3019 - DNA, 23 bp, Artificial Sequence
  mitotic kinesin microtubule-associated protein Eg5 (Kif11) siRNA
tctgaaactggatatcccaacag

SEQ ID NO: 3020 - DNA, 23 bp, Artificial Sequence
  mitotic kinesin microtubule-associated protein Eg5 (Kif11) siRNA
ctgaaactggatatcccaacagg

SEQ ID NO: 3021 - DNA, 23 bp, Artificial Sequence
  mitotic kinesin microtubule-associated protein Eg5 (Kif11) siRNA
tgaaactggatatcccaacaggt

SEQ ID NO: 3022 - DNA, 23 bp, Artificial Sequence
  mitotic kinesin microtubule-associated protein Eg5 (Kif11) siRNA
gaaactggatatcccaacaggta

SEQ ID NO: 3023 - DNA, 23 bp, Artificial Sequence
  mitotic kinesin microtubule-associated protein Eg5 (Kif11) siRNA
aaactggatatcccaacaggtac

SEQ ID NO: 3024 - DNA, 23 bp, Artificial Sequence
  mitotic kinesin microtubule-associated protein Eg5 (Kif11) siRNA
aactggatatcccaacaggtacg

SEQ ID NO: 3025 - DNA, 23 bp, Artificial Sequence
  mitotic kinesin microtubule-associated protein Eg5 (Kif11) siRNA
actggatatcccaacaggtacga

SEQ ID NO: 3026 - DNA, 23 bp, Artificial Sequence
  mitotic kinesin microtubule-associated protein Eg5 (Kif11) siRNA
ctggatatcccaacaggtacgac

SEQ ID NO: 3027 - DNA, 23 bp, Artificial Sequence
  mitotic kinesin microtubule-associated protein Eg5 (Kif11) siRNA
tggatatcccaacaggtacgaca

SEQ ID NO: 3028 - DNA, 23 bp, Artificial Sequence
  mitotic kinesin microtubule-associated protein Eg5 (Kif11) siRNA
ggatatcccaacaggtacgacac

SEQ ID NO: 3029 - DNA, 23 bp, Artificial Sequence
  mitotic kinesin microtubule-associated protein Eg5 (Kif11) siRNA
gatatcccaacaggtacgacacc

SEQ ID NO: 3030 - DNA, 23 bp, Artificial Sequence
  mitotic kinesin microtubule-associated protein Eg5 (Kif11) siRNA
atatcccaacaggtacgacacca

SEQ ID NO: 3031 - DNA, 23 bp, Artificial Sequence
  mitotic kinesin microtubule-associated protein Eg5 (Kif11) siRNA
tatcccaacaggtacgacaccac

SEQ ID NO: 3032 - DNA, 23 bp, Artificial Sequence
  mitotic kinesin microtubule-associated protein Eg5 (Kif11) siRNA
atcccaacaggtacgacaccaca

SEQ ID NO: 3033 - DNA, 23 bp, Artificial Sequence
  mitotic kinesin microtubule-associated protein Eg5 (Kif11) siRNA
tcccaacaggtacgacaccacag

SEQ ID NO: 3034 - DNA, 23 bp, Artificial Sequence
  mitotic kinesin microtubule-associated protein Eg5 (Kif11) siRNA
cccaacaggtacgacaccacaga

SEQ ID NO: 3035 - DNA, 23 bp, Artificial Sequence
  mitotic kinesin microtubule-associated protein Eg5 (Kif11) siRNA
ccaacaggtacgacaccacagag

SEQ ID NO: 3036 - DNA, 23 bp, Artificial Sequence
  mitotic kinesin microtubule-associated protein Eg5 (Kif11) siRNA
caacaggtacgacaccacagagg

SEQ ID NO: 3037 - DNA, 23 bp, Artificial Sequence
  mitotic kinesin microtubule-associated protein Eg5 (Kif11) siRNA
aacaggtacgacaccacagagga

SEQ ID NO: 3038 - DNA, 23 bp, Artificial Sequence
  mitotic kinesin microtubule-associated protein Eg5 (Kif11) siRNA
acaggtacgacaccacagaggaa

SEQ ID NO: 3039 - DNA, 23 bp, Artificial Sequence
  mitotic kinesin microtubule-associated protein Eg5 (Kif11) siRNA
caggtacgacaccacagaggaaa

SEQ ID NO: 3040 - DNA, 23 bp, Artificial Sequence
  mitotic kinesin microtubule-associated protein Eg5 (Kif11) siRNA
aggtacgacaccacagaggaaaa

SEQ ID NO: 3041 - DNA, 23 bp, Artificial Sequence
  mitotic kinesin microtubule-associated protein Eg5 (Kif11) siRNA
ggtacgacaccacagaggaaaag

SEQ ID NO: 3042 - DNA, 23 bp, Artificial Sequence
  mitotic kinesin microtubule-associated protein Eg5 (Kif11) siRNA
gtacgacaccacagaggaaaagt

SEQ ID NO: 3043 - DNA, 23 bp, Artificial Sequence
  mitotic kinesin microtubule-associated protein Eg5 (Kif11) siRNA
tacgacaccacagaggaaaagtt

SEQ ID NO: 3044 - DNA, 23 bp, Artificial Sequence
  mitotic kinesin microtubule-associated protein Eg5 (Kif11) siRNA
acgacaccacagaggaaaagtta

SEQ ID NO: 3045 - DNA, 23 bp, Artificial Sequence
  mitotic kinesin microtubule-associated protein Eg5 (Kif11) siRNA
cgacaccacagaggaaaagttat

SEQ ID NO: 3046 - DNA, 23 bp, Artificial Sequence
  mitotic kinesin microtubule-associated protein Eg5 (Kif11) siRNA
gacaccacagaggaaaagttatt

SEQ ID NO: 3047 - DNA, 23 bp, Artificial Sequence
  mitotic kinesin microtubule-associated protein Eg5 (Kif11) siRNA
acaccacagaggaaaagttattt

SEQ ID NO: 3048 - DNA, 23 bp, Artificial Sequence
  mitotic kinesin microtubule-associated protein Eg5 (Kif11) siRNA
caccacagaggaaaagttattta

SEQ ID NO: 3049 - DNA, 23 bp, Artificial Sequence
  mitotic kinesin microtubule-associated protein Eg5 (Kif11) siRNA
accacagaggaaaagttatttat

SEQ ID NO: 3050 - DNA, 23 bp, Artificial Sequence
  mitotic kinesin microtubule-associated protein Eg5 (Kif11) siRNA
ccacagaggaaaagttatttata

SEQ ID NO: 3051 - DNA, 23 bp, Artificial Sequence
  mitotic kinesin microtubule-associated protein Eg5 (Kif11) siRNA
cacagaggaaaagttatttatac

SEQ ID NO: 3052 - DNA, 23 bp, Artificial Sequence
  mitotic kinesin microtubule-associated protein Eg5 (Kif11) siRNA
acagaggaaaagttatttatacc

SEQ ID NO: 3053 - DNA, 23 bp, Artificial Sequence
  mitotic kinesin microtubule-associated protein Eg5 (Kif11) siRNA
cagaggaaaagttatttataccc

SEQ ID NO: 3054 - DNA, 23 bp, Artificial Sequence
  mitotic kinesin microtubule-associated protein Eg5 (Kif11) siRNA
agaggaaaagttatttataccca

SEQ ID NO: 3055 - DNA, 23 bp, Artificial Sequence
  mitotic kinesin microtubule-associated protein Eg5 (Kif11) siRNA
gaggaaaagttatttatacccat

SEQ ID NO: 3056 - DNA, 23 bp, Artificial Sequence
  mitotic kinesin microtubule-associated protein Eg5 (Kif11) siRNA
aggaaaagttatttatacccatc

SEQ ID NO: 3057 - DNA, 23 bp, Artificial Sequence
  mitotic kinesin microtubule-associated protein Eg5 (Kif11) siRNA
ggaaaagttatttatacccatca

SEQ ID NO: 3058 - DNA, 23 bp, Artificial Sequence
  mitotic kinesin microtubule-associated protein Eg5 (Kif11) siRNA
gaaaagttatttatacccatcaa

SEQ ID NO: 3059 - DNA, 23 bp, Artificial Sequence
  mitotic kinesin microtubule-associated protein Eg5 (Kif11) siRNA
aaaagttatttatacccatcaac

SEQ ID NO: 3060 - DNA, 23 bp, Artificial Sequence
  mitotic kinesin microtubule-associated protein Eg5 (Kif11) siRNA
aaagttatttatacccatcaaca

SEQ ID NO: 3061 - DNA, 23 bp, Artificial Sequence
  mitotic kinesin microtubule-associated protein Eg5 (Kif11) siRNA
aagttatttatacccatcaacac

SEQ ID NO: 3062 - DNA, 23 bp, Artificial Sequence
  mitotic kinesin microtubule-associated protein Eg5 (Kif11) siRNA
agttatttatacccatcaacact

SEQ ID NO: 3063 - DNA, 23 bp, Artificial Sequence
  mitotic kinesin microtubule-associated protein Eg5 (Kif11) siRNA
gttatttatacccatcaacactg

SEQ ID NO: 3064 - DNA, 23 bp, Artificial Sequence
  mitotic kinesin microtubule-associated protein Eg5 (Kif11) siRNA
ttatttatacccatcaacactgg

SEQ ID NO: 3065 - DNA, 23 bp, Artificial Sequence
  mitotic kinesin microtubule-associated protein Eg5 (Kif11) siRNA
tatttatacccatcaacactggt

SEQ ID NO: 3066 - DNA, 23 bp, Artificial Sequence
  mitotic kinesin microtubule-associated protein Eg5 (Kif11) siRNA
atttatacccatcaacactggta

SEQ ID NO: 3067 - DNA, 23 bp, Artificial Sequence
  mitotic kinesin microtubule-associated protein Eg5 (Kif11) siRNA
tttatacccatcaacactggtaa

SEQ ID NO: 3068 - DNA, 23 bp, Artificial Sequence
  mitotic kinesin microtubule-associated protein Eg5 (Kif11) siRNA
ttatacccatcaacactggtaag

SEQ ID NO: 3069 - DNA, 23 bp, Artificial Sequence
  mitotic kinesin microtubule-associated protein Eg5 (Kif11) siRNA
tatacccatcaacactggtaaga

SEQ ID NO: 3070 - DNA, 23 bp, Artificial Sequence
  mitotic kinesin microtubule-associated protein Eg5 (Kif11) siRNA
atacccatcaacactggtaagaa

SEQ ID NO: 3071 - DNA, 23 bp, Artificial Sequence
  mitotic kinesin microtubule-associated protein Eg5 (Kif11) siRNA
tacccatcaacactggtaagaac

SEQ ID NO: 3072 - DNA, 23 bp, Artificial Sequence
  mitotic kinesin microtubule-associated protein Eg5 (Kif11) siRNA
acccatcaacactggtaagaact

SEQ ID NO: 3073 - DNA, 23 bp, Artificial Sequence
  mitotic kinesin microtubule-associated protein Eg5 (Kif11) siRNA
cccatcaacactggtaagaactg

SEQ ID NO: 3074 - DNA, 23 bp, Artificial Sequence
  mitotic kinesin microtubule-associated protein Eg5 (Kif11) siRNA
ccatcaacactggtaagaactga

SEQ ID NO: 3075 - DNA, 23 bp, Artificial Sequence
  mitotic kinesin microtubule-associated protein Eg5 (Kif11) siRNA
catcaacactggtaagaactgaa

SEQ ID NO: 3076 - DNA, 23 bp, Artificial Sequence
  mitotic kinesin microtubule-associated protein Eg5 (Kif11) siRNA
atcaacactggtaagaactgaac

SEQ ID NO: 3077 - DNA, 23 bp, Artificial Sequence
  mitotic kinesin microtubule-associated protein Eg5 (Kif11) siRNA
tcaacactggtaagaactgaacc

SEQ ID NO: 3078 - DNA, 23 bp, Artificial Sequence
  mitotic kinesin microtubule-associated protein Eg5 (Kif11) siRNA
caacactggtaagaactgaacca

SEQ ID NO: 3079 - DNA, 23 bp, Artificial Sequence
  mitotic kinesin microtubule-associated protein Eg5 (Kif11) siRNA
aacactggtaagaactgaaccac

SEQ ID NO: 3080 - DNA, 23 bp, Artificial Sequence
  mitotic kinesin microtubule-associated protein Eg5 (Kif11) siRNA
acactggtaagaactgaaccacg

SEQ ID NO: 3081 - DNA, 23 bp, Artificial Sequence
  mitotic kinesin microtubule-associated protein Eg5 (Kif11) siRNA
cactggtaagaactgaaccacgt

SEQ ID NO: 3082 - DNA, 23 bp, Artificial Sequence
  mitotic kinesin microtubule-associated protein Eg5 (Kif11) siRNA
actggtaagaactgaaccacgtg

SEQ ID NO: 3083 - DNA, 23 bp, Artificial Sequence
  mitotic kinesin microtubule-associated protein Eg5 (Kif11) siRNA
ctggtaagaactgaaccacgtga

SEQ ID NO: 3084 - DNA, 23 bp, Artificial Sequence
  mitotic kinesin microtubule-associated protein Eg5 (Kif11) siRNA
tggtaagaactgaaccacgtgaa

SEQ ID NO: 3085 - DNA, 23 bp, Artificial Sequence
  mitotic kinesin microtubule-associated protein Eg5 (Kif11) siRNA
ggtaagaactgaaccacgtgaac

SEQ ID NO: 3086 - DNA, 23 bp, Artificial Sequence
  mitotic kinesin microtubule-associated protein Eg5 (Kif11) siRNA
gtaagaactgaaccacgtgaaca

SEQ ID NO: 3087 - DNA, 23 bp, Artificial Sequence
  mitotic kinesin microtubule-associated protein Eg5 (Kif11) siRNA
taagaactgaaccacgtgaacat

SEQ ID NO: 3088 - DNA, 23 bp, Artificial Sequence
  mitotic kinesin microtubule-associated protein Eg5 (Kif11) siRNA
aagaactgaaccacgtgaacatc

SEQ ID NO: 3089 - DNA, 23 bp, Artificial Sequence
  mitotic kinesin microtubule-associated protein Eg5 (Kif11) siRNA
agaactgaaccacgtgaacatct

SEQ ID NO: 3090 - DNA, 23 bp, Artificial Sequence
  mitotic kinesin microtubule-associated protein Eg5 (Kif11) siRNA
gaactgaaccacgtgaacatctc

SEQ ID NO: 3091 - DNA, 23 bp, Artificial Sequence
  mitotic kinesin microtubule-associated protein Eg5 (Kif11) siRNA
aactgaaccacgtgaacatctcc

SEQ ID NO: 3092 - DNA, 23 bp, Artificial Sequence
  mitotic kinesin microtubule-associated protein Eg5 (Kif11) siRNA
actgaaccacgtgaacatctcct

SEQ ID NO: 3093 - DNA, 23 bp, Artificial Sequence
  mitotic kinesin microtubule-associated protein Eg5 (Kif11) siRNA
ctgaaccacgtgaacatctcctt

SEQ ID NO: 3094 - DNA, 23 bp, Artificial Sequence
  mitotic kinesin microtubule-associated protein Eg5 (Kif11) siRNA
tgaaccacgtgaacatctccttg

SEQ ID NO: 3095 - DNA, 23 bp, Artificial Sequence
  mitotic kinesin microtubule-associated protein Eg5 (Kif11) siRNA
gaaccacgtgaacatctccttga

SEQ ID NO: 3096 - DNA, 23 bp, Artificial Sequence
  mitotic kinesin microtubule-associated protein Eg5 (Kif11) siRNA
aaccacgtgaacatctccttgat

SEQ ID NO: 3097 - DNA, 23 bp, Artificial Sequence
  mitotic kinesin microtubule-associated protein Eg5 (Kif11) siRNA
accacgtgaacatctccttgatc

SEQ ID NO: 3098 - DNA, 23 bp, Artificial Sequence
  mitotic kinesin microtubule-associated protein Eg5 (Kif11) siRNA
ccacgtgaacatctccttgatca

SEQ ID NO: 3099 - DNA, 23 bp, Artificial Sequence
  mitotic kinesin microtubule-associated protein Eg5 (Kif11) siRNA
cacgtgaacatctccttgatcag

SEQ ID NO: 3100 - DNA, 23 bp, Artificial Sequence
  mitotic kinesin microtubule-associated protein Eg5 (Kif11) siRNA
acgtgaacatctccttgatcagc

SEQ ID NO: 3101 - DNA, 23 bp, Artificial Sequence
  mitotic kinesin microtubule-associated protein Eg5 (Kif11) siRNA
cgtgaacatctccttgatcagct

SEQ ID NO: 3102 - DNA, 23 bp, Artificial Sequence
  mitotic kinesin microtubule-associated protein Eg5 (Kif11) siRNA
gtgaacatctccttgatcagctg

SEQ ID NO: 3103 - DNA, 23 bp, Artificial Sequence
  mitotic kinesin microtubule-associated protein Eg5 (Kif11) siRNA
tgaacatctccttgatcagctga

SEQ ID NO: 3104 - DNA, 23 bp, Artificial Sequence
  mitotic kinesin microtubule-associated protein Eg5 (Kif11) siRNA
gaacatctccttgatcagctgaa

SEQ ID NO: 3105 - DNA, 23 bp, Artificial Sequence
  mitotic kinesin microtubule-associated protein Eg5 (Kif11) siRNA
aacatctccttgatcagctgaaa

SEQ ID NO: 3106 - DNA, 23 bp, Artificial Sequence
  mitotic kinesin microtubule-associated protein Eg5 (Kif11) siRNA
acatctccttgatcagctgaaaa

SEQ ID NO: 3107 - DNA, 23 bp, Artificial Sequence
  mitotic kinesin microtubule-associated protein Eg5 (Kif11) siRNA
catctccttgatcagctgaaaag

SEQ ID NO: 3108 - DNA, 23 bp, Artificial Sequence
  mitotic kinesin microtubule-associated protein Eg5 (Kif11) siRNA
atctccttgatcagctgaaaagg

SEQ ID NO: 3109 - DNA, 23 bp, Artificial Sequence
  mitotic kinesin microtubule-associated protein Eg5 (Kif11) siRNA
tctccttgatcagctgaaaagga

SEQ ID NO: 3110 - DNA, 23 bp, Artificial Sequence
  mitotic kinesin microtubule-associated protein Eg5 (Kif11) siRNA
ctccttgatcagctgaaaaggaa

SEQ ID NO: 3111 - DNA, 23 bp, Artificial Sequence
  mitotic kinesin microtubule-associated protein Eg5 (Kif11) siRNA
tccttgatcagctgaaaaggaaa

SEQ ID NO: 3112 - DNA, 23 bp, Artificial Sequence
  mitotic kinesin microtubule-associated protein Eg5 (Kif11) siRNA
ccttgatcagctgaaaaggaaac

SEQ ID NO: 3113 - DNA, 23 bp, Artificial Sequence
  mitotic kinesin microtubule-associated protein Eg5 (Kif11) siRNA
cttgatcagctgaaaaggaaaca

SEQ ID NO: 3114 - DNA, 23 bp, Artificial Sequence
  mitotic kinesin microtubule-associated protein Eg5 (Kif11) siRNA
ttgatcagctgaaaaggaaacag

SEQ ID NO: 3115 - DNA, 23 bp, Artificial Sequence
  mitotic kinesin microtubule-associated protein Eg5 (Kif11) siRNA
tgatcagctgaaaaggaaacagc

SEQ ID NO: 3116 - DNA, 23 bp, Artificial Sequence
  mitotic kinesin microtubule-associated protein Eg5 (Kif11) siRNA
gatcagctgaaaaggaaacagcc

SEQ ID NO: 3117 - DNA, 23 bp, Artificial Sequence
  mitotic kinesin microtubule-associated protein Eg5 (Kif11) siRNA
atcagctgaaaaggaaacagcct

SEQ ID NO: 3118 - DNA, 23 bp, Artificial Sequence
  mitotic kinesin microtubule-associated protein Eg5 (Kif11) siRNA
tcagctgaaaaggaaacagcctg

SEQ ID NO: 3119 - DNA, 23 bp, Artificial Sequence
  mitotic kinesin microtubule-associated protein Eg5 (Kif11) siRNA
cagctgaaaaggaaacagcctga

SEQ ID NO: 3120 - DNA, 23 bp, Artificial Sequence
  mitotic kinesin microtubule-associated protein Eg5 (Kif11) siRNA
agctgaaaaggaaacagcctgag

SEQ ID NO: 3121 - DNA, 23 bp, Artificial Sequence
  mitotic kinesin microtubule-associated protein Eg5 (Kif11) siRNA
gctgaaaaggaaacagcctgagc

SEQ ID NO: 3122 - DNA, 23 bp, Artificial Sequence
  mitotic kinesin microtubule-associated protein Eg5 (Kif11) siRNA
ctgaaaaggaaacagcctgagct

SEQ ID NO: 3123 - DNA, 23 bp, Artificial Sequence
  mitotic kinesin microtubule-associated protein Eg5 (Kif11) siRNA
tgaaaaggaaacagcctgagctg

SEQ ID NO: 3124 - DNA, 23 bp, Artificial Sequence
  mitotic kinesin microtubule-associated protein Eg5 (Kif11) siRNA
gaaaaggaaacagcctgagctgt

SEQ ID NO: 3125 - DNA, 23 bp, Artificial Sequence
  mitotic kinesin microtubule-associated protein Eg5 (Kif11) siRNA
aaaaggaaacagcctgagctgtt

SEQ ID NO: 3126 - DNA, 23 bp, Artificial Sequence
  mitotic kinesin microtubule-associated protein Eg5 (Kif11) siRNA
aaaggaaacagcctgagctgtta

SEQ ID NO: 3127 - DNA, 23 bp, Artificial Sequence
  mitotic kinesin microtubule-associated protein Eg5 (Kif11) siRNA
aaggaaacagcctgagctgttaa

SEQ ID NO: 3128 - DNA, 23 bp, Artificial Sequence
  mitotic kinesin microtubule-associated protein Eg5 (Kif11) siRNA
aggaaacagcctgagctgttaat

SEQ ID NO: 3129 - DNA, 23 bp, Artificial Sequence
  mitotic kinesin microtubule-associated protein Eg5 (Kif11) siRNA
ggaaacagcctgagctgttaatg

SEQ ID NO: 3130 - DNA, 23 bp, Artificial Sequence
  mitotic kinesin microtubule-associated protein Eg5 (Kif11) siRNA
gaaacagcctgagctgttaatga

SEQ ID NO: 3131 - DNA, 23 bp, Artificial Sequence
  mitotic kinesin microtubule-associated protein Eg5 (Kif11) siRNA
aaacagcctgagctgttaatgat

SEQ ID NO: 3132 - DNA, 23 bp, Artificial Sequence
  mitotic kinesin microtubule-associated protein Eg5 (Kif11) siRNA
aacagcctgagctgttaatgatg

SEQ ID NO: 3133 - DNA, 23 bp, Artificial Sequence
  mitotic kinesin microtubule-associated protein Eg5 (Kif11) siRNA
acagcctgagctgttaatgatgc

SEQ ID NO: 3134 - DNA, 23 bp, Artificial Sequence
  mitotic kinesin microtubule-associated protein Eg5 (Kif11) siRNA
cagcctgagctgttaatgatgct

SEQ ID NO: 3135 - DNA, 23 bp, Artificial Sequence
  mitotic kinesin microtubule-associated protein Eg5 (Kif11) siRNA
agcctgagctgttaatgatgcta

SEQ ID NO: 3136 - DNA, 23 bp, Artificial Sequence
  mitotic kinesin microtubule-associated protein Eg5 (Kif11) siRNA
gcctgagctgttaatgatgctaa

SEQ ID NO: 3137 - DNA, 23 bp, Artificial Sequence
  mitotic kinesin microtubule-associated protein Eg5 (Kif11) siRNA
cctgagctgttaatgatgctaaa

SEQ ID NO: 3138 - DNA, 23 bp, Artificial Sequence
  mitotic kinesin microtubule-associated protein Eg5 (Kif11) siRNA
ctgagctgttaatgatgctaaac

SEQ ID NO: 3139 - DNA, 23 bp, Artificial Sequence
  mitotic kinesin microtubule-associated protein Eg5 (Kif11) siRNA
tgagctgttaatgatgctaaact

SEQ ID NO: 3140 - DNA, 23 bp, Artificial Sequence
  mitotic kinesin microtubule-associated protein Eg5 (Kif11) siRNA
gagctgttaatgatgctaaactg

SEQ ID NO: 3141 - DNA, 23 bp, Artificial Sequence
  mitotic kinesin microtubule-associated protein Eg5 (Kif11) siRNA
agctgttaatgatgctaaactgt

SEQ ID NO: 3142 - DNA, 23 bp, Artificial Sequence
  mitotic kinesin microtubule-associated protein Eg5 (Kif11) siRNA
gctgttaatgatgctaaactgtt

SEQ ID NO: 3143 - DNA, 23 bp, Artificial Sequence
  mitotic kinesin microtubule-associated protein Eg5 (Kif11) siRNA
ctgttaatgatgctaaactgttc

SEQ ID NO: 3144 - DNA, 23 bp, Artificial Sequence
  mitotic kinesin microtubule-associated protein Eg5 (Kif11) siRNA
tgttaatgatgctaaactgttca

SEQ ID NO: 3145 - DNA, 23 bp, Artificial Sequence
  mitotic kinesin microtubule-associated protein Eg5 (Kif11) siRNA
gttaatgatgctaaactgttcag

SEQ ID NO: 3146 - DNA, 23 bp, Artificial Sequence
  mitotic kinesin microtubule-associated protein Eg5 (Kif11) siRNA
ttaatgatgctaaactgttcaga

SEQ ID NO: 3147 - DNA, 23 bp, Artificial Sequence
  mitotic kinesin microtubule-associated protein Eg5 (Kif11) siRNA
taatgatgctaaactgttcagaa

SEQ ID NO: 3148 - DNA, 23 bp, Artificial Sequence
  mitotic kinesin microtubule-associated protein Eg5 (Kif11) siRNA
aatgatgctaaactgttcagaaa

SEQ ID NO: 3149 - DNA, 23 bp, Artificial Sequence
  mitotic kinesin microtubule-associated protein Eg5 (Kif11) siRNA
atgatgctaaactgttcagaaaa

SEQ ID NO: 3150 - DNA, 23 bp, Artificial Sequence
  mitotic kinesin microtubule-associated protein Eg5 (Kif11) siRNA
tgatgctaaactgttcagaaaac

SEQ ID NO: 3151 - DNA, 23 bp, Artificial Sequence
  mitotic kinesin microtubule-associated protein Eg5 (Kif11) siRNA
gatgctaaactgttcagaaaaca

SEQ ID NO: 3152 - DNA, 23 bp, Artificial Sequence
  mitotic kinesin microtubule-associated protein Eg5 (Kif11) siRNA
atgctaaactgttcagaaaacaa

SEQ ID NO: 3153 - DNA, 23 bp, Artificial Sequence
  mitotic kinesin microtubule-associated protein Eg5 (Kif11) siRNA
tgctaaactgttcagaaaacaac

SEQ ID NO: 3154 - DNA, 23 bp, Artificial Sequence
  mitotic kinesin microtubule-associated protein Eg5 (Kif11) siRNA
gctaaactgttcagaaaacaaca

SEQ ID NO: 3155 - DNA, 23 bp, Artificial Sequence
  mitotic kinesin microtubule-associated protein Eg5 (Kif11) siRNA
ctaaactgttcagaaaacaacaa

SEQ ID NO: 3156 - DNA, 23 bp, Artificial Sequence
  mitotic kinesin microtubule-associated protein Eg5 (Kif11) siRNA
taaactgttcagaaaacaacaaa

SEQ ID NO: 3157 - DNA, 23 bp, Artificial Sequence
  mitotic kinesin microtubule-associated protein Eg5 (Kif11) siRNA
aaactgttcagaaaacaacaaag

SEQ ID NO: 3158 - DNA, 23 bp, Artificial Sequence
  mitotic kinesin microtubule-associated protein Eg5 (Kif11) siRNA
aactgttcagaaaacaacaaaga

SEQ ID NO: 3159 - DNA, 23 bp, Artificial Sequence
  mitotic kinesin microtubule-associated protein Eg5 (Kif11) siRNA
actgttcagaaaacaacaaagaa

SEQ ID NO: 3160 - DNA, 23 bp, Artificial Sequence
  mitotic kinesin microtubule-associated protein Eg5 (Kif11) siRNA
ctgttcagaaaacaacaaagaag

SEQ ID NO: 3161 - DNA, 23 bp, Artificial Sequence
  mitotic kinesin microtubule-associated protein Eg5 (Kif11) siRNA
tgttcagaaaacaacaaagaaga

SEQ ID NO: 3162 - DNA, 23 bp, Artificial Sequence
  mitotic kinesin microtubule-associated protein Eg5 (Kif11) siRNA
gttcagaaaacaacaaagaagag

SEQ ID NO: 3163 - DNA, 23 bp, Artificial Sequence
  mitotic kinesin microtubule-associated protein Eg5 (Kif11) siRNA
ttcagaaaacaacaaagaagaga

SEQ ID NO: 3164 - DNA, 23 bp, Artificial Sequence
  mitotic kinesin microtubule-associated protein Eg5 (Kif11) siRNA
tcagaaaacaacaaagaagagac

SEQ ID NO: 3165 - DNA, 23 bp, Artificial Sequence
  mitotic kinesin microtubule-associated protein Eg5 (Kif11) siRNA
cagaaaacaacaaagaagagaca

SEQ ID NO: 3166 - DNA, 23 bp, Artificial Sequence
  mitotic kinesin microtubule-associated protein Eg5 (Kif11) siRNA
agaaaacaacaaagaagagacaa

SEQ ID NO: 3167 - DNA, 23 bp, Artificial Sequence
  mitotic kinesin microtubule-associated protein Eg5 (Kif11) siRNA
gaaaacaacaaagaagagacaat

SEQ ID NO: 3168 - DNA, 23 bp, Artificial Sequence
  mitotic kinesin microtubule-associated protein Eg5 (Kif11) siRNA
aaaacaacaaagaagagacaatt

SEQ ID NO: 3169 - DNA, 23 bp, Artificial Sequence
  mitotic kinesin microtubule-associated protein Eg5 (Kif11) siRNA
aaacaacaaagaagagacaattc

SEQ ID NO: 3170 - DNA, 23 bp, Artificial Sequence
  mitotic kinesin microtubule-associated protein Eg5 (Kif11) siRNA
aacaacaaagaagagacaattcc

SEQ ID NO: 3171 - DNA, 23 bp, Artificial Sequence
  mitotic kinesin microtubule-associated protein Eg5 (Kif11) siRNA
acaacaaagaagagacaattccg

SEQ ID NO: 3172 - DNA, 23 bp, Artificial Sequence
  mitotic kinesin microtubule-associated protein Eg5 (Kif11) siRNA
caacaaagaagagacaattccgg

SEQ ID NO: 3173 - DNA, 23 bp, Artificial Sequence
  mitotic kinesin microtubule-associated protein Eg5 (Kif11) siRNA
aacaaagaagagacaattccgga

SEQ ID NO: 3174 - DNA, 23 bp, Artificial Sequence
  mitotic kinesin microtubule-associated protein Eg5 (Kif11) siRNA
acaaagaagagacaattccggat

SEQ ID NO: 3175 - DNA, 23 bp, Artificial Sequence
  mitotic kinesin microtubule-associated protein Eg5 (Kif11) siRNA
caaagaagagacaattccggatg

SEQ ID NO: 3176 - DNA, 23 bp, Artificial Sequence
  mitotic kinesin microtubule-associated protein Eg5 (Kif11) siRNA
aaagaagagacaattccggatgt

SEQ ID NO: 3177 - DNA, 23 bp, Artificial Sequence
  mitotic kinesin microtubule-associated protein Eg5 (Kif11) siRNA
aagaagagacaattccggatgtg

SEQ ID NO: 3178 - DNA, 23 bp, Artificial Sequence
  mitotic kinesin microtubule-associated protein Eg5 (Kif11) siRNA
agaagagacaattccggatgtgg

SEQ ID NO: 3179 - DNA, 23 bp, Artificial Sequence
  mitotic kinesin microtubule-associated protein Eg5 (Kif11) siRNA
gaagagacaattccggatgtgga

SEQ ID NO: 3180 - DNA, 23 bp, Artificial Sequence
  mitotic kinesin microtubule-associated protein Eg5 (Kif11) siRNA
aagagacaattccggatgtggat

SEQ ID NO: 3181 - DNA, 23 bp, Artificial Sequence
  mitotic kinesin microtubule-associated protein Eg5 (Kif11) siRNA
agagacaattccggatgtggatg

SEQ ID NO: 3182 - DNA, 23 bp, Artificial Sequence
  mitotic kinesin microtubule-associated protein Eg5 (Kif11) siRNA
gagacaattccggatgtggatgt

SEQ ID NO: 3183 - DNA, 23 bp, Artificial Sequence
  mitotic kinesin microtubule-associated protein Eg5 (Kif11) siRNA
agacaattccggatgtggatgta

SEQ ID NO: 3184 - DNA, 23 bp, Artificial Sequence
  mitotic kinesin microtubule-associated protein Eg5 (Kif11) siRNA
gacaattccggatgtggatgtag

SEQ ID NO: 3185 - DNA, 23 bp, Artificial Sequence
  mitotic kinesin microtubule-associated protein Eg5 (Kif11) siRNA
acaattccggatgtggatgtaga

SEQ ID NO: 3186 - DNA, 23 bp, Artificial Sequence
  mitotic kinesin microtubule-associated protein Eg5 (Kif11) siRNA
caattccggatgtggatgtagaa

SEQ ID NO: 3187 - DNA, 23 bp, Artificial Sequence
  mitotic kinesin microtubule-associated protein Eg5 (Kif11) siRNA
aattccggatgtggatgtagaag

SEQ ID NO: 3188 - DNA, 23 bp, Artificial Sequence
  mitotic kinesin microtubule-associated protein Eg5 (Kif11) siRNA
attccggatgtggatgtagaaga

SEQ ID NO: 3189 - DNA, 23 bp, Artificial Sequence
  mitotic kinesin microtubule-associated protein Eg5 (Kif11) siRNA
ttccggatgtggatgtagaagag

SEQ ID NO: 3190 - DNA, 23 bp, Artificial Sequence
  mitotic kinesin microtubule-associated protein Eg5 (Kif11) siRNA
tccggatgtggatgtagaagagg

SEQ ID NO: 3191 - DNA, 23 bp, Artificial Sequence
  mitotic kinesin microtubule-associated protein Eg5 (Kif11) siRNA
ccggatgtggatgtagaagaggc

SEQ ID NO: 3192 - DNA, 23 bp, Artificial Sequence
  mitotic kinesin microtubule-associated protein Eg5 (Kif11) siRNA
cggatgtggatgtagaagaggca

SEQ ID NO: 3193 - DNA, 23 bp, Artificial Sequence
  mitotic kinesin microtubule-associated protein Eg5 (Kif11) siRNA
ggatgtggatgtagaagaggcag

SEQ ID NO: 3194 - DNA, 23 bp, Artificial Sequence
  mitotic kinesin microtubule-associated protein Eg5 (Kif11) siRNA
gatgtggatgtagaagaggcagt

SEQ ID NO: 3195 - DNA, 23 bp, Artificial Sequence
  mitotic kinesin microtubule-associated protein Eg5 (Kif11) siRNA
atgtggatgtagaagaggcagtt

SEQ ID NO: 3196 - DNA, 23 bp, Artificial Sequence
  mitotic kinesin microtubule-associated protein Eg5 (Kif11) siRNA
tgtggatgtagaagaggcagttc

SEQ ID NO: 3197 - DNA, 23 bp, Artificial Sequence
  mitotic kinesin microtubule-associated protein Eg5 (Kif11) siRNA
gtggatgtagaagaggcagttct

SEQ ID NO: 3198 - DNA, 23 bp, Artificial Sequence
  mitotic kinesin microtubule-associated protein Eg5 (Kif11) siRNA
tggatgtagaagaggcagttctg

SEQ ID NO: 3199 - DNA, 23 bp, Artificial Sequence
  mitotic kinesin microtubule-associated protein Eg5 (Kif11) siRNA
ggatgtagaagaggcagttctgg

SEQ ID NO: 3200 - DNA, 23 bp, Artificial Sequence
  mitotic kinesin microtubule-associated protein Eg5 (Kif11) siRNA
gatgtagaagaggcagttctggg

SEQ ID NO: 3201 - DNA, 23 bp, Artificial Sequence
  mitotic kinesin microtubule-associated protein Eg5 (Kif11) siRNA
atgtagaagaggcagttctgggg

SEQ ID NO: 3202 - DNA, 23 bp, Artificial Sequence
  mitotic kinesin microtubule-associated protein Eg5 (Kif11) siRNA
tgtagaagaggcagttctggggc

SEQ ID NO: 3203 - DNA, 23 bp, Artificial Sequence
  mitotic kinesin microtubule-associated protein Eg5 (Kif11) siRNA
gtagaagaggcagttctggggca

SEQ ID NO: 3204 - DNA, 23 bp, Artificial Sequence
  mitotic kinesin microtubule-associated protein Eg5 (Kif11) siRNA
tagaagaggcagttctggggcag

SEQ ID NO: 3205 - DNA, 23 bp, Artificial Sequence
  mitotic kinesin microtubule-associated protein Eg5 (Kif11) siRNA
agaagaggcagttctggggcagt

SEQ ID NO: 3206 - DNA, 23 bp, Artificial Sequence
  mitotic kinesin microtubule-associated protein Eg5 (Kif11) siRNA
gaagaggcagttctggggcagta

SEQ ID NO: 3207 - DNA, 23 bp, Artificial Sequence
  mitotic kinesin microtubule-associated protein Eg5 (Kif11) siRNA
aagaggcagttctggggcagtat

SEQ ID NO: 3208 - DNA, 23 bp, Artificial Sequence
  mitotic kinesin microtubule-associated protein Eg5 (Kif11) siRNA
agaggcagttctggggcagtata

SEQ ID NO: 3209 - DNA, 23 bp, Artificial Sequence
  mitotic kinesin microtubule-associated protein Eg5 (Kif11) siRNA
gaggcagttctggggcagtatac

SEQ ID NO: 3210 - DNA, 23 bp, Artificial Sequence
  mitotic kinesin microtubule-associated protein Eg5 (Kif11) siRNA
aggcagttctggggcagtatact

SEQ ID NO: 3211 - DNA, 23 bp, Artificial Sequence
  mitotic kinesin microtubule-associated protein Eg5 (Kif11) siRNA
ggcagttctggggcagtatactg

SEQ ID NO: 3212 - DNA, 23 bp, Artificial Sequence
  mitotic kinesin microtubule-associated protein Eg5 (Kif11) siRNA
gcagttctggggcagtatactga

SEQ ID NO: 3213 - DNA, 23 bp, Artificial Sequence
  mitotic kinesin microtubule-associated protein Eg5 (Kif11) siRNA
cagttctggggcagtatactgaa

SEQ ID NO: 3214 - DNA, 23 bp, Artificial Sequence
  mitotic kinesin microtubule-associated protein Eg5 (Kif11) siRNA
agttctggggcagtatactgaag

SEQ ID NO: 3215 - DNA, 23 bp, Artificial Sequence
  mitotic kinesin microtubule-associated protein Eg5 (Kif11) siRNA
gttctggggcagtatactgaaga

SEQ ID NO: 3216 - DNA, 23 bp, Artificial Sequence
  mitotic kinesin microtubule-associated protein Eg5 (Kif11) siRNA
ttctggggcagtatactgaagaa

SEQ ID NO: 3217 - DNA, 23 bp, Artificial Sequence
  mitotic kinesin microtubule-associated protein Eg5 (Kif11) siRNA
tctggggcagtatactgaagaac

SEQ ID NO: 3218 - DNA, 23 bp, Artificial Sequence
  mitotic kinesin microtubule-associated protein Eg5 (Kif11) siRNA
ctggggcagtatactgaagaacc

SEQ ID NO: 3219 - DNA, 23 bp, Artificial Sequence
  mitotic kinesin microtubule-associated protein Eg5 (Kif11) siRNA
tggggcagtatactgaagaacct

SEQ ID NO: 3220 - DNA, 23 bp, Artificial Sequence
  mitotic kinesin microtubule-associated protein Eg5 (Kif11) siRNA
ggggcagtatactgaagaacctc

SEQ ID NO: 3221 - DNA, 23 bp, Artificial Sequence
  mitotic kinesin microtubule-associated protein Eg5 (Kif11) siRNA
gggcagtatactgaagaacctct

SEQ ID NO: 3222 - DNA, 23 bp, Artificial Sequence
  mitotic kinesin microtubule-associated protein Eg5 (Kif11) siRNA
ggcagtatactgaagaacctcta

SEQ ID NO: 3223 - DNA, 23 bp, Artificial Sequence
  mitotic kinesin microtubule-associated protein Eg5 (Kif11) siRNA
gcagtatactgaagaacctctaa

SEQ ID NO: 3224 - DNA, 23 bp, Artificial Sequence
  mitotic kinesin microtubule-associated protein Eg5 (Kif11) siRNA
cagtatactgaagaacctctaag

SEQ ID NO: 3225 - DNA, 23 bp, Artificial Sequence
  mitotic kinesin microtubule-associated protein Eg5 (Kif11) siRNA
agtatactgaagaacctctaagt

SEQ ID NO: 3226 - DNA, 23 bp, Artificial Sequence
  mitotic kinesin microtubule-associated protein Eg5 (Kif11) siRNA
gtatactgaagaacctctaagtc

SEQ ID NO: 3227 - DNA, 23 bp, Artificial Sequence
  mitotic kinesin microtubule-associated protein Eg5 (Kif11) siRNA
tatactgaagaacctctaagtca

SEQ ID NO: 3228 - DNA, 23 bp, Artificial Sequence
  mitotic kinesin microtubule-associated protein Eg5 (Kif11) siRNA
atactgaagaacctctaagtcaa

SEQ ID NO: 3229 - DNA, 23 bp, Artificial Sequence
  mitotic kinesin microtubule-associated protein Eg5 (Kif11) siRNA
tactgaagaacctctaagtcaag

SEQ ID NO: 3230 - DNA, 23 bp, Artificial Sequence
  mitotic kinesin microtubule-associated protein Eg5 (Kif11) siRNA
actgaagaacctctaagtcaaga

SEQ ID NO: 3231 - DNA, 23 bp, Artificial Sequence
  mitotic kinesin microtubule-associated protein Eg5 (Kif11) siRNA
ctgaagaacctctaagtcaagag

SEQ ID NO: 3232 - DNA, 23 bp, Artificial Sequence
  mitotic kinesin microtubule-associated protein Eg5 (Kif11) siRNA
tgaagaacctctaagtcaagagc

SEQ ID NO: 3233 - DNA, 23 bp, Artificial Sequence
  mitotic kinesin microtubule-associated protein Eg5 (Kif11) siRNA
gaagaacctctaagtcaagagcc

SEQ ID NO: 3234 - DNA, 23 bp, Artificial Sequence
  mitotic kinesin microtubule-associated protein Eg5 (Kif11) siRNA
aagaacctctaagtcaagagcca

SEQ ID NO: 3235 - DNA, 23 bp, Artificial Sequence
  mitotic kinesin microtubule-associated protein Eg5 (Kif11) siRNA
agaacctctaagtcaagagccat

SEQ ID NO: 3236 - DNA, 23 bp, Artificial Sequence
  mitotic kinesin microtubule-associated protein Eg5 (Kif11) siRNA
gaacctctaagtcaagagccatc

SEQ ID NO: 3237 - DNA, 23 bp, Artificial Sequence
  mitotic kinesin microtubule-associated protein Eg5 (Kif11) siRNA
aacctctaagtcaagagccatct

SEQ ID NO: 3238 - DNA, 23 bp, Artificial Sequence
  mitotic kinesin microtubule-associated protein Eg5 (Kif11) siRNA
acctctaagtcaagagccatctg

SEQ ID NO: 3239 - DNA, 23 bp, Artificial Sequence
  mitotic kinesin microtubule-associated protein Eg5 (Kif11) siRNA
cctctaagtcaagagccatctgt

SEQ ID NO: 3240 - DNA, 23 bp, Artificial Sequence
  mitotic kinesin microtubule-associated protein Eg5 (Kif11) siRNA
ctctaagtcaagagccatctgta

SEQ ID NO: 3241 - DNA, 23 bp, Artificial Sequence
  mitotic kinesin microtubule-associated protein Eg5 (Kif11) siRNA
tctaagtcaagagccatctgtag

SEQ ID NO: 3242 - DNA, 23 bp, Artificial Sequence
  mitotic kinesin microtubule-associated protein Eg5 (Kif11) siRNA
ctaagtcaagagccatctgtaga

SEQ ID NO: 3243 - DNA, 23 bp, Artificial Sequence
  mitotic kinesin microtubule-associated protein Eg5 (Kif11) siRNA
taagtcaagagccatctgtagat

SEQ ID NO: 3244 - DNA, 23 bp, Artificial Sequence
  mitotic kinesin microtubule-associated protein Eg5 (Kif11) siRNA
aagtcaagagccatctgtagatg

SEQ ID NO: 3245 - DNA, 23 bp, Artificial Sequence
  mitotic kinesin microtubule-associated protein Eg5 (Kif11) siRNA
agtcaagagccatctgtagatgc

SEQ ID NO: 3246 - DNA, 23 bp, Artificial Sequence
  mitotic kinesin microtubule-associated protein Eg5 (Kif11) siRNA
gtcaagagccatctgtagatgct

SEQ ID NO: 3247 - DNA, 23 bp, Artificial Sequence
  mitotic kinesin microtubule-associated protein Eg5 (Kif11) siRNA
tcaagagccatctgtagatgctg

SEQ ID NO: 3248 - DNA, 23 bp, Artificial Sequence
  mitotic kinesin microtubule-associated protein Eg5 (Kif11) siRNA
caagagccatctgtagatgctgg

SEQ ID NO: 3249 - DNA, 23 bp, Artificial Sequence
  mitotic kinesin microtubule-associated protein Eg5 (Kif11) siRNA
aagagccatctgtagatgctggt

SEQ ID NO: 3250 - DNA, 23 bp, Artificial Sequence
  mitotic kinesin microtubule-associated protein Eg5 (Kif11) siRNA
agagccatctgtagatgctggtg

SEQ ID NO: 3251 - DNA, 23 bp, Artificial Sequence
  mitotic kinesin microtubule-associated protein Eg5 (Kif11) siRNA
gagccatctgtagatgctggtgt

SEQ ID NO: 3252 - DNA, 23 bp, Artificial Sequence
  mitotic kinesin microtubule-associated protein Eg5 (Kif11) siRNA
agccatctgtagatgctggtgtg

SEQ ID NO: 3253 - DNA, 23 bp, Artificial Sequence
  mitotic kinesin microtubule-associated protein Eg5 (Kif11) siRNA
gccatctgtagatgctggtgtgg

SEQ ID NO: 3254 - DNA, 23 bp, Artificial Sequence
  mitotic kinesin microtubule-associated protein Eg5 (Kif11) siRNA
ccatctgtagatgctggtgtgga

SEQ ID NO: 3255 - DNA, 23 bp, Artificial Sequence
  mitotic kinesin microtubule-associated protein Eg5 (Kif11) siRNA
catctgtagatgctggtgtggat

SEQ ID NO: 3256 - DNA, 23 bp, Artificial Sequence
  mitotic kinesin microtubule-associated protein Eg5 (Kif11) siRNA
atctgtagatgctggtgtggatt

SEQ ID NO: 3257 - DNA, 23 bp, Artificial Sequence
  mitotic kinesin microtubule-associated protein Eg5 (Kif11) siRNA
tctgtagatgctggtgtggattg

SEQ ID NO: 3258 - DNA, 23 bp, Artificial Sequence
  mitotic kinesin microtubule-associated protein Eg5 (Kif11) siRNA
ctgtagatgctggtgtggattgt

SEQ ID NO: 3259 - DNA, 23 bp, Artificial Sequence
  mitotic kinesin microtubule-associated protein Eg5 (Kif11) siRNA
tgtagatgctggtgtggattgtt

SEQ ID NO: 3260 - DNA, 23 bp, Artificial Sequence
  mitotic kinesin microtubule-associated protein Eg5 (Kif11) siRNA
gtagatgctggtgtggattgttc

SEQ ID NO: 3261 - DNA, 23 bp, Artificial Sequence
  mitotic kinesin microtubule-associated protein Eg5 (Kif11) siRNA
tagatgctggtgtggattgttca

SEQ ID NO: 3262 - DNA, 23 bp, Artificial Sequence
  mitotic kinesin microtubule-associated protein Eg5 (Kif11) siRNA
agatgctggtgtggattgttcat

SEQ ID NO: 3263 - DNA, 23 bp, Artificial Sequence
  mitotic kinesin microtubule-associated protein Eg5 (Kif11) siRNA
gatgctggtgtggattgttcatc

SEQ ID NO: 3264 - DNA, 23 bp, Artificial Sequence
  mitotic kinesin microtubule-associated protein Eg5 (Kif11) siRNA
atgctggtgtggattgttcatca

SEQ ID NO: 3265 - DNA, 23 bp, Artificial Sequence
  mitotic kinesin microtubule-associated protein Eg5 (Kif11) siRNA
tgctggtgtggattgttcatcaa

SEQ ID NO: 3266 - DNA, 23 bp, Artificial Sequence
  mitotic kinesin microtubule-associated protein Eg5 (Kif11) siRNA
gctggtgtggattgttcatcaat

SEQ ID NO: 3267 - DNA, 23 bp, Artificial Sequence
  mitotic kinesin microtubule-associated protein Eg5 (Kif11) siRNA
ctggtgtggattgttcatcaatt

SEQ ID NO: 3268 - DNA, 23 bp, Artificial Sequence
  mitotic kinesin microtubule-associated protein Eg5 (Kif11) siRNA
tggtgtggattgttcatcaattg

SEQ ID NO: 3269 - DNA, 23 bp, Artificial Sequence
  mitotic kinesin microtubule-associated protein Eg5 (Kif11) siRNA
ggtgtggattgttcatcaattgg

SEQ ID NO: 3270 - DNA, 23 bp, Artificial Sequence
  mitotic kinesin microtubule-associated protein Eg5 (Kif11) siRNA
gtgtggattgttcatcaattggc

SEQ ID NO: 3271 - DNA, 23 bp, Artificial Sequence
  mitotic kinesin microtubule-associated protein Eg5 (Kif11) siRNA
tgtggattgttcatcaattggcg

SEQ ID NO: 3272 - DNA, 23 bp, Artificial Sequence
  mitotic kinesin microtubule-associated protein Eg5 (Kif11) siRNA
gtggattgttcatcaattggcgg

SEQ ID NO: 3273 - DNA, 23 bp, Artificial Sequence
  mitotic kinesin microtubule-associated protein Eg5 (Kif11) siRNA
tggattgttcatcaattggcggg

SEQ ID NO: 3274 - DNA, 23 bp, Artificial Sequence
  mitotic kinesin microtubule-associated protein Eg5 (Kif11) siRNA
ggattgttcatcaattggcgggg

SEQ ID NO: 3275 - DNA, 23 bp, Artificial Sequence
  mitotic kinesin microtubule-associated protein Eg5 (Kif11) siRNA
gattgttcatcaattggcggggt

SEQ ID NO: 3276 - DNA, 23 bp, Artificial Sequence
  mitotic kinesin microtubule-associated protein Eg5 (Kif11) siRNA
attgttcatcaattggcggggtt

SEQ ID NO: 3277 - DNA, 23 bp, Artificial Sequence
  mitotic kinesin microtubule-associated protein Eg5 (Kif11) siRNA
ttgttcatcaattggcggggttc

SEQ ID NO: 3278 - DNA, 23 bp, Artificial Sequence
  mitotic kinesin microtubule-associated protein Eg5 (Kif11) siRNA
tgttcatcaattggcggggttcc

SEQ ID NO: 3279 - DNA, 23 bp, Artificial Sequence
  mitotic kinesin microtubule-associated protein Eg5 (Kif11) siRNA
gttcatcaattggcggggttcca

SEQ ID NO: 3280 - DNA, 23 bp, Artificial Sequence
  mitotic kinesin microtubule-associated protein Eg5 (Kif11) siRNA
ttcatcaattggcggggttccat

SEQ ID NO: 3281 - DNA, 23 bp, Artificial Sequence
  mitotic kinesin microtubule-associated protein Eg5 (Kif11) siRNA
tcatcaattggcggggttccatt

SEQ ID NO: 3282 - DNA, 23 bp, Artificial Sequence
  mitotic kinesin microtubule-associated protein Eg5 (Kif11) siRNA
catcaattggcggggttccattt

SEQ ID NO: 3283 - DNA, 23 bp, Artificial Sequence
  mitotic kinesin microtubule-associated protein Eg5 (Kif11) siRNA
atcaattggcggggttccatttt

SEQ ID NO: 3284 - DNA, 23 bp, Artificial Sequence
  mitotic kinesin microtubule-associated protein Eg5 (Kif11) siRNA
tcaattggcggggttccattttt

SEQ ID NO: 3285 - DNA, 23 bp, Artificial Sequence
  mitotic kinesin microtubule-associated protein Eg5 (Kif11) siRNA
caattggcggggttccatttttc

SEQ ID NO: 3286 - DNA, 23 bp, Artificial Sequence
  mitotic kinesin microtubule-associated protein Eg5 (Kif11) siRNA
aattggcggggttccatttttcc

SEQ ID NO: 3287 - DNA, 23 bp, Artificial Sequence
  mitotic kinesin microtubule-associated protein Eg5 (Kif11) siRNA
attggcggggttccatttttcca

SEQ ID NO: 3288 - DNA, 23 bp, Artificial Sequence
  mitotic kinesin microtubule-associated protein Eg5 (Kif11) siRNA
ttggcggggttccatttttccag

SEQ ID NO: 3289 - DNA, 23 bp, Artificial Sequence
  mitotic kinesin microtubule-associated protein Eg5 (Kif11) siRNA
tggcggggttccatttttccagc

SEQ ID NO: 3290 - DNA, 23 bp, Artificial Sequence
  mitotic kinesin microtubule-associated protein Eg5 (Kif11) siRNA
ggcggggttccatttttccagca

SEQ ID NO: 3291 - DNA, 23 bp, Artificial Sequence
  mitotic kinesin microtubule-associated protein Eg5 (Kif11) siRNA
gcggggttccatttttccagcat

SEQ ID NO: 3292 - DNA, 23 bp, Artificial Sequence
  mitotic kinesin microtubule-associated protein Eg5 (Kif11) siRNA
cggggttccatttttccagcata

SEQ ID NO: 3293 - DNA, 23 bp, Artificial Sequence
  mitotic kinesin microtubule-associated protein Eg5 (Kif11) siRNA
ggggttccatttttccagcataa

SEQ ID NO: 3294 - DNA, 23 bp, Artificial Sequence
  mitotic kinesin microtubule-associated protein Eg5 (Kif11) siRNA
gggttccatttttccagcataaa

SEQ ID NO: 3295 - DNA, 23 bp, Artificial Sequence
  mitotic kinesin microtubule-associated protein Eg5 (Kif11) siRNA
ggttccatttttccagcataaaa

SEQ ID NO: 3296 - DNA, 23 bp, Artificial Sequence
  mitotic kinesin microtubule-associated protein Eg5 (Kif11) siRNA
gttccatttttccagcataaaaa

SEQ ID NO: 3297 - DNA, 23 bp, Artificial Sequence
  mitotic kinesin microtubule-associated protein Eg5 (Kif11) siRNA
ttccatttttccagcataaaaaa

SEQ ID NO: 3298 - DNA, 23 bp, Artificial Sequence
  mitotic kinesin microtubule-associated protein Eg5 (Kif11) siRNA
tccatttttccagcataaaaaat

SEQ ID NO: 3299 - DNA, 23 bp, Artificial Sequence
  mitotic kinesin microtubule-associated protein Eg5 (Kif11) siRNA
ccatttttccagcataaaaaatc

SEQ ID NO: 3300 - DNA, 23 bp, Artificial Sequence
  mitotic kinesin microtubule-associated protein Eg5 (Kif11) siRNA
catttttccagcataaaaaatca

SEQ ID NO: 3301 - DNA, 23 bp, Artificial Sequence
  mitotic kinesin microtubule-associated protein Eg5 (Kif11) siRNA
atttttccagcataaaaaatcac

SEQ ID NO: 3302 - DNA, 23 bp, Artificial Sequence
  mitotic kinesin microtubule-associated protein Eg5 (Kif11) siRNA
tttttccagcataaaaaatcaca

SEQ ID NO: 3303 - DNA, 23 bp, Artificial Sequence
  mitotic kinesin microtubule-associated protein Eg5 (Kif11) siRNA
ttttccagcataaaaaatcacat

SEQ ID NO: 3304 - DNA, 23 bp, Artificial Sequence
  mitotic kinesin microtubule-associated protein Eg5 (Kif11) siRNA
tttccagcataaaaaatcacatg

SEQ ID NO: 3305 - DNA, 23 bp, Artificial Sequence
  mitotic kinesin microtubule-associated protein Eg5 (Kif11) siRNA
ttccagcataaaaaatcacatgg

SEQ ID NO: 3306 - DNA, 23 bp, Artificial Sequence
  mitotic kinesin microtubule-associated protein Eg5 (Kif11) siRNA
tccagcataaaaaatcacatgga

SEQ ID NO: 3307 - DNA, 23 bp, Artificial Sequence
  mitotic kinesin microtubule-associated protein Eg5 (Kif11) siRNA
ccagcataaaaaatcacatggaa

SEQ ID NO: 3308 - DNA, 23 bp, Artificial Sequence
  mitotic kinesin microtubule-associated protein Eg5 (Kif11) siRNA
cagcataaaaaatcacatggaaa

SEQ ID NO: 3309 - DNA, 23 bp, Artificial Sequence
  mitotic kinesin microtubule-associated protein Eg5 (Kif11) siRNA
agcataaaaaatcacatggaaaa

SEQ ID NO: 3310 - DNA, 23 bp, Artificial Sequence
  mitotic kinesin microtubule-associated protein Eg5 (Kif11) siRNA
gcataaaaaatcacatggaaaag

SEQ ID NO: 3311 - DNA, 23 bp, Artificial Sequence
  mitotic kinesin microtubule-associated protein Eg5 (Kif11) siRNA
cataaaaaatcacatggaaaaga

SEQ ID NO: 3312 - DNA, 23 bp, Artificial Sequence
  mitotic kinesin microtubule-associated protein Eg5 (Kif11) siRNA
ataaaaaatcacatggaaaagac

SEQ ID NO: 3313 - DNA, 23 bp, Artificial Sequence
  mitotic kinesin microtubule-associated protein Eg5 (Kif11) siRNA
taaaaaatcacatggaaaagaca

SEQ ID NO: 3314 - DNA, 23 bp, Artificial Sequence
  mitotic kinesin microtubule-associated protein Eg5 (Kif11) siRNA
aaaaaatcacatggaaaagacaa

SEQ ID NO: 3315 - DNA, 23 bp, Artificial Sequence
  mitotic kinesin microtubule-associated protein Eg5 (Kif11) siRNA
aaaaatcacatggaaaagacaaa

SEQ ID NO: 3316 - DNA, 23 bp, Artificial Sequence
  mitotic kinesin microtubule-associated protein Eg5 (Kif11) siRNA
aaaatcacatggaaaagacaaag

SEQ ID NO: 3317 - DNA, 23 bp, Artificial Sequence
  mitotic kinesin microtubule-associated protein Eg5 (Kif11) siRNA
aaatcacatggaaaagacaaaga

SEQ ID NO: 3318 - DNA, 23 bp, Artificial Sequence
  mitotic kinesin microtubule-associated protein Eg5 (Kif11) siRNA
aatcacatggaaaagacaaagaa

SEQ ID NO: 3319 - DNA, 23 bp, Artificial Sequence
  mitotic kinesin microtubule-associated protein Eg5 (Kif11) siRNA
atcacatggaaaagacaaagaaa

SEQ ID NO: 3320 - DNA, 23 bp, Artificial Sequence
  mitotic kinesin microtubule-associated protein Eg5 (Kif11) siRNA
tcacatggaaaagacaaagaaaa

SEQ ID NO: 3321 - DNA, 23 bp, Artificial Sequence
  mitotic kinesin microtubule-associated protein Eg5 (Kif11) siRNA
cacatggaaaagacaaagaaaac

SEQ ID NO: 3322 - DNA, 23 bp, Artificial Sequence
  mitotic kinesin microtubule-associated protein Eg5 (Kif11) siRNA
acatggaaaagacaaagaaaaca

SEQ ID NO: 3323 - DNA, 23 bp, Artificial Sequence
  mitotic kinesin microtubule-associated protein Eg5 (Kif11) siRNA
catggaaaagacaaagaaaacag

SEQ ID NO: 3324 - DNA, 23 bp, Artificial Sequence
  mitotic kinesin microtubule-associated protein Eg5 (Kif11) siRNA
atggaaaagacaaagaaaacaga

SEQ ID NO: 3325 - DNA, 23 bp, Artificial Sequence
  mitotic kinesin microtubule-associated protein Eg5 (Kif11) siRNA
tggaaaagacaaagaaaacagag

SEQ ID NO: 3326 - DNA, 23 bp, Artificial Sequence
  mitotic kinesin microtubule-associated protein Eg5 (Kif11) siRNA
ggaaaagacaaagaaaacagagg

SEQ ID NO: 3327 - DNA, 23 bp, Artificial Sequence
  mitotic kinesin microtubule-associated protein Eg5 (Kif11) siRNA
gaaaagacaaagaaaacagaggc

SEQ ID NO: 3328 - DNA, 23 bp, Artificial Sequence
  mitotic kinesin microtubule-associated protein Eg5 (Kif11) siRNA
aaaagacaaagaaaacagaggca

SEQ ID NO: 3329 - DNA, 23 bp, Artificial Sequence
  mitotic kinesin microtubule-associated protein Eg5 (Kif11) siRNA
aaagacaaagaaaacagaggcat

SEQ ID NO: 3330 - DNA, 23 bp, Artificial Sequence
  mitotic kinesin microtubule-associated protein Eg5 (Kif11) siRNA
aagacaaagaaaacagaggcatt

SEQ ID NO: 3331 - DNA, 23 bp, Artificial Sequence
  mitotic kinesin microtubule-associated protein Eg5 (Kif11) siRNA
agacaaagaaaacagaggcatta

SEQ ID NO: 3332 - DNA, 23 bp, Artificial Sequence
  mitotic kinesin microtubule-associated protein Eg5 (Kif11) siRNA
gacaaagaaaacagaggcattaa

SEQ ID NO: 3333 - DNA, 23 bp, Artificial Sequence
  mitotic kinesin microtubule-associated protein Eg5 (Kif11) siRNA
acaaagaaaacagaggcattaac

SEQ ID NO: 3334 - DNA, 23 bp, Artificial Sequence
  mitotic kinesin microtubule-associated protein Eg5 (Kif11) siRNA
caaagaaaacagaggcattaaca

SEQ ID NO: 3335 - DNA, 23 bp, Artificial Sequence
  mitotic kinesin microtubule-associated protein Eg5 (Kif11) siRNA
aaagaaaacagaggcattaacac

SEQ ID NO: 3336 - DNA, 23 bp, Artificial Sequence
  mitotic kinesin microtubule-associated protein Eg5 (Kif11) siRNA
aagaaaacagaggcattaacaca

SEQ ID NO: 3337 - DNA, 23 bp, Artificial Sequence
  mitotic kinesin microtubule-associated protein Eg5 (Kif11) siRNA
agaaaacagaggcattaacacac

SEQ ID NO: 3338 - DNA, 23 bp, Artificial Sequence
  mitotic kinesin microtubule-associated protein Eg5 (Kif11) siRNA
gaaaacagaggcattaacacact

SEQ ID NO: 3339 - DNA, 23 bp, Artificial Sequence
  mitotic kinesin microtubule-associated protein Eg5 (Kif11) siRNA
aaaacagaggcattaacacactg

SEQ ID NO: 3340 - DNA, 23 bp, Artificial Sequence
  mitotic kinesin microtubule-associated protein Eg5 (Kif11) siRNA
aaacagaggcattaacacactgg

SEQ ID NO: 3341 - DNA, 23 bp, Artificial Sequence
  mitotic kinesin microtubule-associated protein Eg5 (Kif11) siRNA
aacagaggcattaacacactgga

SEQ ID NO: 3342 - DNA, 23 bp, Artificial Sequence
  mitotic kinesin microtubule-associated protein Eg5 (Kif11) siRNA
acagaggcattaacacactggag

SEQ ID NO: 3343 - DNA, 23 bp, Artificial Sequence
  mitotic kinesin microtubule-associated protein Eg5 (Kif11) siRNA
cagaggcattaacacactggaga

SEQ ID NO: 3344 - DNA, 23 bp, Artificial Sequence
  mitotic kinesin microtubule-associated protein Eg5 (Kif11) siRNA
agaggcattaacacactggagag

SEQ ID NO: 3345 - DNA, 23 bp, Artificial Sequence
  mitotic kinesin microtubule-associated protein Eg5 (Kif11) siRNA
gaggcattaacacactggagagg

SEQ ID NO: 3346 - DNA, 23 bp, Artificial Sequence
  mitotic kinesin microtubule-associated protein Eg5 (Kif11) siRNA
aggcattaacacactggagaggt

SEQ ID NO: 3347 - DNA, 23 bp, Artificial Sequence
  mitotic kinesin microtubule-associated protein Eg5 (Kif11) siRNA
ggcattaacacactggagaggtc

SEQ ID NO: 3348 - DNA, 23 bp, Artificial Sequence
  mitotic kinesin microtubule-associated protein Eg5 (Kif11) siRNA
gcattaacacactggagaggtct

SEQ ID NO: 3349 - DNA, 23 bp, Artificial Sequence
  mitotic kinesin microtubule-associated protein Eg5 (Kif11) siRNA
cattaacacactggagaggtcta

SEQ ID NO: 3350 - DNA, 23 bp, Artificial Sequence
  mitotic kinesin microtubule-associated protein Eg5 (Kif11) siRNA
attaacacactggagaggtctaa

SEQ ID NO: 3351 - DNA, 23 bp, Artificial Sequence
  mitotic kinesin microtubule-associated protein Eg5 (Kif11) siRNA
ttaacacactggagaggtctaaa

SEQ ID NO: 3352 - DNA, 23 bp, Artificial Sequence
  mitotic kinesin microtubule-associated protein Eg5 (Kif11) siRNA
taacacactggagaggtctaaag

SEQ ID NO: 3353 - DNA, 23 bp, Artificial Sequence
  mitotic kinesin microtubule-associated protein Eg5 (Kif11) siRNA
aacacactggagaggtctaaagt

SEQ ID NO: 3354 - DNA, 23 bp, Artificial Sequence
  mitotic kinesin microtubule-associated protein Eg5 (Kif11) siRNA
acacactggagaggtctaaagtg

SEQ ID NO: 3355 - DNA, 23 bp, Artificial Sequence
  mitotic kinesin microtubule-associated protein Eg5 (Kif11) siRNA
cacactggagaggtctaaagtgg

SEQ ID NO: 3356 - DNA, 23 bp, Artificial Sequence
  mitotic kinesin microtubule-associated protein Eg5 (Kif11) siRNA
acactggagaggtctaaagtgga

SEQ ID NO: 3357 - DNA, 23 bp, Artificial Sequence
  mitotic kinesin microtubule-associated protein Eg5 (Kif11) siRNA
cactggagaggtctaaagtggaa

SEQ ID NO: 3358 - DNA, 23 bp, Artificial Sequence
  mitotic kinesin microtubule-associated protein Eg5 (Kif11) siRNA
actggagaggtctaaagtggaag

SEQ ID NO: 3359 - DNA, 23 bp, Artificial Sequence
  mitotic kinesin microtubule-associated protein Eg5 (Kif11) siRNA
ctggagaggtctaaagtggaaga

SEQ ID NO: 3360 - DNA, 23 bp, Artificial Sequence
  mitotic kinesin microtubule-associated protein Eg5 (Kif11) siRNA
tggagaggtctaaagtggaagaa

SEQ ID NO: 3361 - DNA, 23 bp, Artificial Sequence
  mitotic kinesin microtubule-associated protein Eg5 (Kif11) siRNA
ggagaggtctaaagtggaagaaa

SEQ ID NO: 3362 - DNA, 23 bp, Artificial Sequence
  mitotic kinesin microtubule-associated protein Eg5 (Kif11) siRNA
gagaggtctaaagtggaagaaac

SEQ ID NO: 3363 - DNA, 23 bp, Artificial Sequence
  mitotic kinesin microtubule-associated protein Eg5 (Kif11) siRNA
agaggtctaaagtggaagaaact

SEQ ID NO: 3364 - DNA, 23 bp, Artificial Sequence
  mitotic kinesin microtubule-associated protein Eg5 (Kif11) siRNA
gaggtctaaagtggaagaaacta

SEQ ID NO: 3365 - DNA, 23 bp, Artificial Sequence
  mitotic kinesin microtubule-associated protein Eg5 (Kif11) siRNA
aggtctaaagtggaagaaactac

SEQ ID NO: 3366 - DNA, 23 bp, Artificial Sequence
  mitotic kinesin microtubule-associated protein Eg5 (Kif11) siRNA
ggtctaaagtggaagaaactaca

SEQ ID NO: 3367 - DNA, 23 bp, Artificial Sequence
  mitotic kinesin microtubule-associated protein Eg5 (Kif11) siRNA
gtctaaagtggaagaaactacag

SEQ ID NO: 3368 - DNA, 23 bp, Artificial Sequence
  mitotic kinesin microtubule-associated protein Eg5 (Kif11) siRNA
tctaaagtggaagaaactacaga

SEQ ID NO: 3369 - DNA, 23 bp, Artificial Sequence
  mitotic kinesin microtubule-associated protein Eg5 (Kif11) siRNA
ctaaagtggaagaaactacagag

SEQ ID NO: 3370 - DNA, 23 bp, Artificial Sequence
  mitotic kinesin microtubule-associated protein Eg5 (Kif11) siRNA
taaagtggaagaaactacagagc

SEQ ID NO: 3371 - DNA, 23 bp, Artificial Sequence
  mitotic kinesin microtubule-associated protein Eg5 (Kif11) siRNA
aaagtggaagaaactacagagca

SEQ ID NO: 3372 - DNA, 23 bp, Artificial Sequence
  mitotic kinesin microtubule-associated protein Eg5 (Kif11) siRNA
aagtggaagaaactacagagcac

SEQ ID NO: 3373 - DNA, 23 bp, Artificial Sequence
  mitotic kinesin microtubule-associated protein Eg5 (Kif11) siRNA
agtggaagaaactacagagcact

SEQ ID NO: 3374 - DNA, 23 bp, Artificial Sequence
  mitotic kinesin microtubule-associated protein Eg5 (Kif11) siRNA
gtggaagaaactacagagcactt

SEQ ID NO: 3375 - DNA, 23 bp, Artificial Sequence
  mitotic kinesin microtubule-associated protein Eg5 (Kif11) siRNA
tggaagaaactacagagcacttg

SEQ ID NO: 3376 - DNA, 23 bp, Artificial Sequence
  mitotic kinesin microtubule-associated protein Eg5 (Kif11) siRNA
ggaagaaactacagagcacttgg

SEQ ID NO: 3377 - DNA, 23 bp, Artificial Sequence
  mitotic kinesin microtubule-associated protein Eg5 (Kif11) siRNA
gaagaaactacagagcacttggt

SEQ ID NO: 3378 - DNA, 23 bp, Artificial Sequence
  mitotic kinesin microtubule-associated protein Eg5 (Kif11) siRNA
aagaaactacagagcacttggtt

SEQ ID NO: 3379 - DNA, 23 bp, Artificial Sequence
  mitotic kinesin microtubule-associated protein Eg5 (Kif11) siRNA
agaaactacagagcacttggtta

SEQ ID NO: 3380 - DNA, 23 bp, Artificial Sequence
  mitotic kinesin microtubule-associated protein Eg5 (Kif11) siRNA
gaaactacagagcacttggttac

SEQ ID NO: 3381 - DNA, 23 bp, Artificial Sequence
  mitotic kinesin microtubule-associated protein Eg5 (Kif11) siRNA
aaactacagagcacttggttaca

SEQ ID NO: 3382 - DNA, 23 bp, Artificial Sequence
  mitotic kinesin microtubule-associated protein Eg5 (Kif11) siRNA
aactacagagcacttggttacaa

SEQ ID NO: 3383 - DNA, 23 bp, Artificial Sequence
  mitotic kinesin microtubule-associated protein Eg5 (Kif11) siRNA
actacagagcacttggttacaaa

SEQ ID NO: 3384 - DNA, 23 bp, Artificial Sequence
  mitotic kinesin microtubule-associated protein Eg5 (Kif11) siRNA
ctacagagcacttggttacaaag

SEQ ID NO: 3385 - DNA, 23 bp, Artificial Sequence
  mitotic kinesin microtubule-associated protein Eg5 (Kif11) siRNA
tacagagcacttggttacaaaga

SEQ ID NO: 3386 - DNA, 23 bp, Artificial Sequence
  mitotic kinesin microtubule-associated protein Eg5 (Kif11) siRNA
acagagcacttggttacaaagag

SEQ ID NO: 3387 - DNA, 23 bp, Artificial Sequence
  mitotic kinesin microtubule-associated protein Eg5 (Kif11) siRNA
cagagcacttggttacaaagagc

SEQ ID NO: 3388 - DNA, 23 bp, Artificial Sequence
  mitotic kinesin microtubule-associated protein Eg5 (Kif11) siRNA
agagcacttggttacaaagagca

SEQ ID NO: 3389 - DNA, 23 bp, Artificial Sequence
  mitotic kinesin microtubule-associated protein Eg5 (Kif11) siRNA
gagcacttggttacaaagagcag

SEQ ID NO: 3390 - DNA, 23 bp, Artificial Sequence
  mitotic kinesin microtubule-associated protein Eg5 (Kif11) siRNA
agcacttggttacaaagagcaga

SEQ ID NO: 3391 - DNA, 23 bp, Artificial Sequence
  mitotic kinesin microtubule-associated protein Eg5 (Kif11) siRNA
gcacttggttacaaagagcagat

SEQ ID NO: 3392 - DNA, 23 bp, Artificial Sequence
  mitotic kinesin microtubule-associated protein Eg5 (Kif11) siRNA
cacttggttacaaagagcagatt

SEQ ID NO: 3393 - DNA, 23 bp, Artificial Sequence
  mitotic kinesin microtubule-associated protein Eg5 (Kif11) siRNA
acttggttacaaagagcagatta

SEQ ID NO: 3394 - DNA, 23 bp, Artificial Sequence
  mitotic kinesin microtubule-associated protein Eg5 (Kif11) siRNA
cttggttacaaagagcagattac

SEQ ID NO: 3395 - DNA, 23 bp, Artificial Sequence
  mitotic kinesin microtubule-associated protein Eg5 (Kif11) siRNA
ttggttacaaagagcagattacc

SEQ ID NO: 3396 - DNA, 23 bp, Artificial Sequence
  mitotic kinesin microtubule-associated protein Eg5 (Kif11) siRNA
tggttacaaagagcagattacct

SEQ ID NO: 3397 - DNA, 23 bp, Artificial Sequence
  mitotic kinesin microtubule-associated protein Eg5 (Kif11) siRNA
ggttacaaagagcagattacctc

SEQ ID NO: 3398 - DNA, 23 bp, Artificial Sequence
  mitotic kinesin microtubule-associated protein Eg5 (Kif11) siRNA
gttacaaagagcagattacctct

SEQ ID NO: 3399 - DNA, 23 bp, Artificial Sequence
  mitotic kinesin microtubule-associated protein Eg5 (Kif11) siRNA
ttacaaagagcagattacctctg

SEQ ID NO: 3400 - DNA, 23 bp, Artificial Sequence
  mitotic kinesin microtubule-associated protein Eg5 (Kif11) siRNA
tacaaagagcagattacctctgc

SEQ ID NO: 3401 - DNA, 23 bp, Artificial Sequence
  mitotic kinesin microtubule-associated protein Eg5 (Kif11) siRNA
acaaagagcagattacctctgcg

SEQ ID NO: 3402 - DNA, 23 bp, Artificial Sequence
  mitotic kinesin microtubule-associated protein Eg5 (Kif11) siRNA
caaagagcagattacctctgcga

SEQ ID NO: 3403 - DNA, 23 bp, Artificial Sequence
  mitotic kinesin microtubule-associated protein Eg5 (Kif11) siRNA
aaagagcagattacctctgcgag

SEQ ID NO: 3404 - DNA, 23 bp, Artificial Sequence
  mitotic kinesin microtubule-associated protein Eg5 (Kif11) siRNA
aagagcagattacctctgcgagc

SEQ ID NO: 3405 - DNA, 23 bp, Artificial Sequence
  mitotic kinesin microtubule-associated protein Eg5 (Kif11) siRNA
agagcagattacctctgcgagcc

SEQ ID NO: 3406 - DNA, 23 bp, Artificial Sequence
  mitotic kinesin microtubule-associated protein Eg5 (Kif11) siRNA
gagcagattacctctgcgagccc

SEQ ID NO: 3407 - DNA, 23 bp, Artificial Sequence
  mitotic kinesin microtubule-associated protein Eg5 (Kif11) siRNA
agcagattacctctgcgagccca

SEQ ID NO: 3408 - DNA, 23 bp, Artificial Sequence
  mitotic kinesin microtubule-associated protein Eg5 (Kif11) siRNA
gcagattacctctgcgagcccag

SEQ ID NO: 3409 - DNA, 23 bp, Artificial Sequence
  mitotic kinesin microtubule-associated protein Eg5 (Kif11) siRNA
cagattacctctgcgagcccaga

SEQ ID NO: 3410 - DNA, 23 bp, Artificial Sequence
  mitotic kinesin microtubule-associated protein Eg5 (Kif11) siRNA
agattacctctgcgagcccagat

SEQ ID NO: 3411 - DNA, 23 bp, Artificial Sequence
  mitotic kinesin microtubule-associated protein Eg5 (Kif11) siRNA
gattacctctgcgagcccagatc

SEQ ID NO: 3412 - DNA, 23 bp, Artificial Sequence
  mitotic kinesin microtubule-associated protein Eg5 (Kif11) siRNA
attacctctgcgagcccagatca

SEQ ID NO: 3413 - DNA, 23 bp, Artificial Sequence
  mitotic kinesin microtubule-associated protein Eg5 (Kif11) siRNA
ttacctctgcgagcccagatcaa

SEQ ID NO: 3414 - DNA, 23 bp, Artificial Sequence
  mitotic kinesin microtubule-associated protein Eg5 (Kif11) siRNA
tacctctgcgagcccagatcaac

SEQ ID NO: 3415 - DNA, 23 bp, Artificial Sequence
  mitotic kinesin microtubule-associated protein Eg5 (Kif11) siRNA
acctctgcgagcccagatcaacc

SEQ ID NO: 3416 - DNA, 23 bp, Artificial Sequence
  mitotic kinesin microtubule-associated protein Eg5 (Kif11) siRNA
cctctgcgagcccagatcaacct

SEQ ID NO: 3417 - DNA, 23 bp, Artificial Sequence
  mitotic kinesin microtubule-associated protein Eg5 (Kif11) siRNA
ctctgcgagcccagatcaacctt

SEQ ID NO: 3418 - DNA, 23 bp, Artificial Sequence
  mitotic kinesin microtubule-associated protein Eg5 (Kif11) siRNA
tctgcgagcccagatcaaccttt

SEQ ID NO: 3419 - DNA, 23 bp, Artificial Sequence
  mitotic kinesin microtubule-associated protein Eg5 (Kif11) siRNA
ctgcgagcccagatcaaccttta

SEQ ID NO: 3420 - DNA, 23 bp, Artificial Sequence
  mitotic kinesin microtubule-associated protein Eg5 (Kif11) siRNA
ttcacttgggggttggcaatttt

SEQ ID NO: 3421 - DNA, 23 bp, Artificial Sequence
  mitotic kinesin microtubule-associated protein Eg5 (Kif11) siRNA
tcacttgggggttggcaatttta

SEQ ID NO: 3422 - DNA, 23 bp, Artificial Sequence
  mitotic kinesin microtubule-associated protein Eg5 (Kif11) siRNA
cacttgggggttggcaattttat

SEQ ID NO: 3423 - DNA, 23 bp, Artificial Sequence
  mitotic kinesin microtubule-associated protein Eg5 (Kif11) siRNA
acttgggggttggcaattttatt

SEQ ID NO: 3424 - DNA, 23 bp, Artificial Sequence
  mitotic kinesin microtubule-associated protein Eg5 (Kif11) siRNA
cttgggggttggcaattttattt

SEQ ID NO: 3425 - DNA, 23 bp, Artificial Sequence
  mitotic kinesin microtubule-associated protein Eg5 (Kif11) siRNA
ttgggggttggcaattttatttt

SEQ ID NO: 3426 - DNA, 23 bp, Artificial Sequence
  mitotic kinesin microtubule-associated protein Eg5 (Kif11) siRNA
tgggggttggcaattttattttt

SEQ ID NO: 3427 - DNA, 23 bp, Artificial Sequence
  mitotic kinesin microtubule-associated protein Eg5 (Kif11) siRNA
gggggttggcaattttattttta

SEQ ID NO: 3428 - DNA, 23 bp, Artificial Sequence
  mitotic kinesin microtubule-associated protein Eg5 (Kif11) siRNA
ggggttggcaattttatttttaa

SEQ ID NO: 3429 - DNA, 23 bp, Artificial Sequence
  mitotic kinesin microtubule-associated protein Eg5 (Kif11) siRNA
gggttggcaattttatttttaaa

SEQ ID NO: 3430 - DNA, 23 bp, Artificial Sequence
  mitotic kinesin microtubule-associated protein Eg5 (Kif11) siRNA
ggttggcaattttatttttaaag

SEQ ID NO: 3431 - DNA, 23 bp, Artificial Sequence
  mitotic kinesin microtubule-associated protein Eg5 (Kif11) siRNA
gttggcaattttatttttaaaga

SEQ ID NO: 3432 - DNA, 23 bp, Artificial Sequence
  mitotic kinesin microtubule-associated protein Eg5 (Kif11) siRNA
ttggcaattttatttttaaagaa

SEQ ID NO: 3433 - DNA, 23 bp, Artificial Sequence
  mitotic kinesin microtubule-associated protein Eg5 (Kif11) siRNA
tggcaattttatttttaaagaaa

SEQ ID NO: 3434 - DNA, 23 bp, Artificial Sequence
  mitotic kinesin microtubule-associated protein Eg5 (Kif11) siRNA
ggcaattttatttttaaagaaaa

SEQ ID NO: 3435 - DNA, 23 bp, Artificial Sequence
  mitotic kinesin microtubule-associated protein Eg5 (Kif11) siRNA
gcaattttatttttaaagaaaac

SEQ ID NO: 3436 - DNA, 23 bp, Artificial Sequence
  mitotic kinesin microtubule-associated protein Eg5 (Kif11) siRNA
caattttatttttaaagaaaact

SEQ ID NO: 3437 - DNA, 23 bp, Artificial Sequence
  mitotic kinesin microtubule-associated protein Eg5 (Kif11) siRNA
aattttatttttaaagaaaactt

SEQ ID NO: 3438 - DNA, 23 bp, Artificial Sequence
  mitotic kinesin microtubule-associated protein Eg5 (Kif11) siRNA
attttatttttaaagaaaactta

SEQ ID NO: 3439 - DNA, 23 bp, Artificial Sequence
  mitotic kinesin microtubule-associated protein Eg5 (Kif11) siRNA
ttttatttttaaagaaaacttaa

SEQ ID NO: 3440 - DNA, 23 bp, Artificial Sequence
  mitotic kinesin microtubule-associated protein Eg5 (Kif11) siRNA
tttatttttaaagaaaacttaaa

SEQ ID NO: 3441 - DNA, 23 bp, Artificial Sequence
  mitotic kinesin microtubule-associated protein Eg5 (Kif11) siRNA
ttatttttaaagaaaacttaaaa

SEQ ID NO: 3442 - DNA, 23 bp, Artificial Sequence
  mitotic kinesin microtubule-associated protein Eg5 (Kif11) siRNA
tatttttaaagaaaacttaaaaa

SEQ ID NO: 3443 - DNA, 23 bp, Artificial Sequence
  mitotic kinesin microtubule-associated protein Eg5 (Kif11) siRNA
atttttaaagaaaacttaaaaat

SEQ ID NO: 3444 - DNA, 23 bp, Artificial Sequence
  mitotic kinesin microtubule-associated protein Eg5 (Kif11) siRNA
tttttaaagaaaacttaaaaata

SEQ ID NO: 3445 - DNA, 23 bp, Artificial Sequence
  mitotic kinesin microtubule-associated protein Eg5 (Kif11) siRNA
ttttaaagaaaacttaaaaataa

SEQ ID NO: 3446 - DNA, 23 bp, Artificial Sequence
  mitotic kinesin microtubule-associated protein Eg5 (Kif11) siRNA
tttaaagaaaacttaaaaataaa

SEQ ID NO: 3447 - DNA, 23 bp, Artificial Sequence
  mitotic kinesin microtubule-associated protein Eg5 (Kif11) siRNA
ttaaagaaaacttaaaaataaaa

SEQ ID NO: 3448 - DNA, 23 bp, Artificial Sequence
  mitotic kinesin microtubule-associated protein Eg5 (Kif11) siRNA
taaagaaaacttaaaaataaaac

SEQ ID NO: 3449 - DNA, 23 bp, Artificial Sequence
  mitotic kinesin microtubule-associated protein Eg5 (Kif11) siRNA
aaagaaaacttaaaaataaaacc

SEQ ID NO: 3450 - DNA, 23 bp, Artificial Sequence
  mitotic kinesin microtubule-associated protein Eg5 (Kif11) siRNA
aagaaaacttaaaaataaaacct

SEQ ID NO: 3451 - DNA, 23 bp, Artificial Sequence
  mitotic kinesin microtubule-associated protein Eg5 (Kif11) siRNA
agaaaacttaaaaataaaacctg

SEQ ID NO: 3452 - DNA, 23 bp, Artificial Sequence
  mitotic kinesin microtubule-associated protein Eg5 (Kif11) siRNA
gaaaacttaaaaataaaacctga

SEQ ID NO: 3453 - DNA, 23 bp, Artificial Sequence
  mitotic kinesin microtubule-associated protein Eg5 (Kif11) siRNA
aaaacttaaaaataaaacctgaa

SEQ ID NO: 3454 - DNA, 23 bp, Artificial Sequence
  mitotic kinesin microtubule-associated protein Eg5 (Kif11) siRNA
aaacttaaaaataaaacctgaaa

SEQ ID NO: 3455 - DNA, 23 bp, Artificial Sequence
  mitotic kinesin microtubule-associated protein Eg5 (Kif11) siRNA
aacttaaaaataaaacctgaaac

SEQ ID NO: 3456 - DNA, 23 bp, Artificial Sequence
  mitotic kinesin microtubule-associated protein Eg5 (Kif11) siRNA
acttaaaaataaaacctgaaacc

SEQ ID NO: 3457 - DNA, 23 bp, Artificial Sequence
  mitotic kinesin microtubule-associated protein Eg5 (Kif11) siRNA
cttaaaaataaaacctgaaaccc

SEQ ID NO: 3458 - DNA, 23 bp, Artificial Sequence
  mitotic kinesin microtubule-associated protein Eg5 (Kif11) siRNA
ttaaaaataaaacctgaaacccc

SEQ ID NO: 3459 - DNA, 23 bp, Artificial Sequence
  mitotic kinesin microtubule-associated protein Eg5 (Kif11) siRNA
taaaaataaaacctgaaacccca

SEQ ID NO: 3460 - DNA, 23 bp, Artificial Sequence
  mitotic kinesin microtubule-associated protein Eg5 (Kif11) siRNA
aaaaataaaacctgaaaccccag

SEQ ID NO: 3461 - DNA, 23 bp, Artificial Sequence
  mitotic kinesin microtubule-associated protein Eg5 (Kif11) siRNA
aaaataaaacctgaaaccccaga

SEQ ID NO: 3462 - DNA, 23 bp, Artificial Sequence
  mitotic kinesin microtubule-associated protein Eg5 (Kif11) siRNA
aaataaaacctgaaaccccagaa

SEQ ID NO: 3463 - DNA, 23 bp, Artificial Sequence
  mitotic kinesin microtubule-associated protein Eg5 (Kif11) siRNA
aataaaacctgaaaccccagaac

SEQ ID NO: 3464 - DNA, 23 bp, Artificial Sequence
  mitotic kinesin microtubule-associated protein Eg5 (Kif11) siRNA
ataaaacctgaaaccccagaact

SEQ ID NO: 3465 - DNA, 23 bp, Artificial Sequence
  mitotic kinesin microtubule-associated protein Eg5 (Kif11) siRNA
taaaacctgaaaccccagaactt

SEQ ID NO: 3466 - DNA, 23 bp, Artificial Sequence
  mitotic kinesin microtubule-associated protein Eg5 (Kif11) siRNA
aaaacctgaaaccccagaacttg

SEQ ID NO: 3467 - DNA, 23 bp, Artificial Sequence
  mitotic kinesin microtubule-associated protein Eg5 (Kif11) siRNA
aaacctgaaaccccagaacttga

SEQ ID NO: 3468 - DNA, 23 bp, Artificial Sequence
  mitotic kinesin microtubule-associated protein Eg5 (Kif11) siRNA
aacctgaaaccccagaacttgag

SEQ ID NO: 3469 - DNA, 23 bp, Artificial Sequence
  mitotic kinesin microtubule-associated protein Eg5 (Kif11) siRNA
acctgaaaccccagaacttgagc

SEQ ID NO: 3470 - DNA, 23 bp, Artificial Sequence
  mitotic kinesin microtubule-associated protein Eg5 (Kif11) siRNA
cctgaaaccccagaacttgagcc

SEQ ID NO: 3471 - DNA, 23 bp, Artificial Sequence
  mitotic kinesin microtubule-associated protein Eg5 (Kif11) siRNA
ctgaaaccccagaacttgagcct

SEQ ID NO: 3472 - DNA, 23 bp, Artificial Sequence
  mitotic kinesin microtubule-associated protein Eg5 (Kif11) siRNA
tgaaaccccagaacttgagcctt

SEQ ID NO: 3473 - DNA, 23 bp, Artificial Sequence
  mitotic kinesin microtubule-associated protein Eg5 (Kif11) siRNA
gaaaccccagaacttgagccttg

SEQ ID NO: 3474 - DNA, 23 bp, Artificial Sequence
  mitotic kinesin microtubule-associated protein Eg5 (Kif11) siRNA
aaaccccagaacttgagccttgt

SEQ ID NO: 3475 - DNA, 23 bp, Artificial Sequence
  mitotic kinesin microtubule-associated protein Eg5 (Kif11) siRNA
aaccccagaacttgagccttgtg

SEQ ID NO: 3476 - DNA, 23 bp, Artificial Sequence
  mitotic kinesin microtubule-associated protein Eg5 (Kif11) siRNA
accccagaacttgagccttgtgt

SEQ ID NO: 3477 - DNA, 23 bp, Artificial Sequence
  mitotic kinesin microtubule-associated protein Eg5 (Kif11) siRNA
ccccagaacttgagccttgtgta

SEQ ID NO: 3478 - DNA, 23 bp, Artificial Sequence
  mitotic kinesin microtubule-associated protein Eg5 (Kif11) siRNA
cccagaacttgagccttgtgtat

SEQ ID NO: 3479 - DNA, 23 bp, Artificial Sequence
  mitotic kinesin microtubule-associated protein Eg5 (Kif11) siRNA
ccagaacttgagccttgtgtata

SEQ ID NO: 3480 - DNA, 23 bp, Artificial Sequence
  mitotic kinesin microtubule-associated protein Eg5 (Kif11) siRNA
cagaacttgagccttgtgtatag

SEQ ID NO: 3481 - DNA, 23 bp, Artificial Sequence
  mitotic kinesin microtubule-associated protein Eg5 (Kif11) siRNA
agaacttgagccttgtgtataga

SEQ ID NO: 3482 - DNA, 23 bp, Artificial Sequence
  mitotic kinesin microtubule-associated protein Eg5 (Kif11) siRNA
gaacttgagccttgtgtatagat

SEQ ID NO: 3483 - DNA, 23 bp, Artificial Sequence
  mitotic kinesin microtubule-associated protein Eg5 (Kif11) siRNA
aacttgagccttgtgtatagatt

SEQ ID NO: 3484 - DNA, 23 bp, Artificial Sequence
  mitotic kinesin microtubule-associated protein Eg5 (Kif11) siRNA
acttgagccttgtgtatagattt

SEQ ID NO: 3485 - DNA, 23 bp, Artificial Sequence
  mitotic kinesin microtubule-associated protein Eg5 (Kif11) siRNA
cttgagccttgtgtatagatttt

SEQ ID NO: 3486 - DNA, 23 bp, Artificial Sequence
  mitotic kinesin microtubule-associated protein Eg5 (Kif11) siRNA
ttgagccttgtgtatagatttta

SEQ ID NO: 3487 - DNA, 23 bp, Artificial Sequence
  mitotic kinesin microtubule-associated protein Eg5 (Kif11) siRNA
tgagccttgtgtatagattttaa

SEQ ID NO: 3488 - DNA, 23 bp, Artificial Sequence
  mitotic kinesin microtubule-associated protein Eg5 (Kif11) siRNA
gagccttgtgtatagattttaaa

SEQ ID NO: 3489 - DNA, 23 bp, Artificial Sequence
  mitotic kinesin microtubule-associated protein Eg5 (Kif11) siRNA
agccttgtgtatagattttaaaa

SEQ ID NO: 3490 - DNA, 23 bp, Artificial Sequence
  mitotic kinesin microtubule-associated protein Eg5 (Kif11) siRNA
gccttgtgtatagattttaaaag

SEQ ID NO: 3491 - DNA, 23 bp, Artificial Sequence
  mitotic kinesin microtubule-associated protein Eg5 (Kif11) siRNA
ccttgtgtatagattttaaaaga

SEQ ID NO: 3492 - DNA, 23 bp, Artificial Sequence
  mitotic kinesin microtubule-associated protein Eg5 (Kif11) siRNA
cttgtgtatagattttaaaagaa

SEQ ID NO: 3493 - DNA, 23 bp, Artificial Sequence
  mitotic kinesin microtubule-associated protein Eg5 (Kif11) siRNA
ttgtgtatagattttaaaagaat

SEQ ID NO: 3494 - DNA, 23 bp, Artificial Sequence
  mitotic kinesin microtubule-associated protein Eg5 (Kif11) siRNA
tgtgtatagattttaaaagaata

SEQ ID NO: 3495 - DNA, 23 bp, Artificial Sequence
  mitotic kinesin microtubule-associated protein Eg5 (Kif11) siRNA
gtgtatagattttaaaagaatat

SEQ ID NO: 3496 - DNA, 23 bp, Artificial Sequence
  mitotic kinesin microtubule-associated protein Eg5 (Kif11) siRNA
tgtatagattttaaaagaatata

SEQ ID NO: 3497 - DNA, 23 bp, Artificial Sequence
  mitotic kinesin microtubule-associated protein Eg5 (Kif11) siRNA
gtatagattttaaaagaatatat

SEQ ID NO: 3498 - DNA, 23 bp, Artificial Sequence
  mitotic kinesin microtubule-associated protein Eg5 (Kif11) siRNA
tatagattttaaaagaatatata

SEQ ID NO: 3499 - DNA, 23 bp, Artificial Sequence
  mitotic kinesin microtubule-associated protein Eg5 (Kif11) siRNA
atagattttaaaagaatatatat

SEQ ID NO: 3500 - DNA, 23 bp, Artificial Sequence
  mitotic kinesin microtubule-associated protein Eg5 (Kif11) siRNA
tagattttaaaagaatatatata

SEQ ID NO: 3501 - DNA, 23 bp, Artificial Sequence
  mitotic kinesin microtubule-associated protein Eg5 (Kif11) siRNA
agattttaaaagaatatatatat

SEQ ID NO: 3502 - DNA, 23 bp, Artificial Sequence
  mitotic kinesin microtubule-associated protein Eg5 (Kif11) siRNA
gattttaaaagaatatatatatc

SEQ ID NO: 3503 - DNA, 23 bp, Artificial Sequence
  mitotic kinesin microtubule-associated protein Eg5 (Kif11) siRNA
attttaaaagaatatatatatca

SEQ ID NO: 3504 - DNA, 23 bp, Artificial Sequence
  mitotic kinesin microtubule-associated protein Eg5 (Kif11) siRNA
ttttaaaagaatatatatatcag

SEQ ID NO: 3505 - DNA, 23 bp, Artificial Sequence
  mitotic kinesin microtubule-associated protein Eg5 (Kif11) siRNA
tttaaaagaatatatatatcagc

SEQ ID NO: 3506 - DNA, 23 bp, Artificial Sequence
  mitotic kinesin microtubule-associated protein Eg5 (Kif11) siRNA
ttaaaagaatatatatatcagcc

SEQ ID NO: 3507 - DNA, 23 bp, Artificial Sequence
  mitotic kinesin microtubule-associated protein Eg5 (Kif11) siRNA
taaaagaatatatatatcagccg

SEQ ID NO: 3508 - DNA, 23 bp, Artificial Sequence
  mitotic kinesin microtubule-associated protein Eg5 (Kif11) siRNA
aaaagaatatatatatcagccgg

SEQ ID NO: 3509 - DNA, 23 bp, Artificial Sequence
  mitotic kinesin microtubule-associated protein Eg5 (Kif11) siRNA
aaagaatatatatatcagccggg

SEQ ID NO: 3510 - DNA, 23 bp, Artificial Sequence
  mitotic kinesin microtubule-associated protein Eg5 (Kif11) siRNA
aagaatatatatatcagccgggc

SEQ ID NO: 3511 - DNA, 23 bp, Artificial Sequence
  mitotic kinesin microtubule-associated protein Eg5 (Kif11) siRNA
agaatatatatatcagccgggcg

SEQ ID NO: 3512 - DNA, 23 bp, Artificial Sequence
  mitotic kinesin microtubule-associated protein Eg5 (Kif11) siRNA
gggcgcggtggctcatgcctgta

SEQ ID NO: 3513 - DNA, 23 bp, Artificial Sequence
  mitotic kinesin microtubule-associated protein Eg5 (Kif11) siRNA
ggcgcggtggctcatgcctgtaa

SEQ ID NO: 3514 - DNA, 23 bp, Artificial Sequence
  mitotic kinesin microtubule-associated protein Eg5 (Kif11) siRNA
gcgcggtggctcatgcctgtaat

SEQ ID NO: 3515 - DNA, 23 bp, Artificial Sequence
  mitotic kinesin microtubule-associated protein Eg5 (Kif11) siRNA
cgcggtggctcatgcctgtaatc

SEQ ID NO: 3516 - DNA, 23 bp, Artificial Sequence
  mitotic kinesin microtubule-associated protein Eg5 (Kif11) siRNA
gcggtggctcatgcctgtaatcc

SEQ ID NO: 3517 - DNA, 23 bp, Artificial Sequence
  mitotic kinesin microtubule-associated protein Eg5 (Kif11) siRNA
cggtggctcatgcctgtaatccc

SEQ ID NO: 3518 - DNA, 23 bp, Artificial Sequence
  mitotic kinesin microtubule-associated protein Eg5 (Kif11) siRNA
ggtggctcatgcctgtaatccca

SEQ ID NO: 3519 - DNA, 23 bp, Artificial Sequence
  mitotic kinesin microtubule-associated protein Eg5 (Kif11) siRNA
gtggctcatgcctgtaatcccag

SEQ ID NO: 3520 - DNA, 23 bp, Artificial Sequence
  mitotic kinesin microtubule-associated protein Eg5 (Kif11) siRNA
tggctcatgcctgtaatcccagc

SEQ ID NO: 3521 - DNA, 23 bp, Artificial Sequence
  mitotic kinesin microtubule-associated protein Eg5 (Kif11) siRNA
ggctcatgcctgtaatcccagca

SEQ ID NO: 3522 - DNA, 23 bp, Artificial Sequence
  mitotic kinesin microtubule-associated protein Eg5 (Kif11) siRNA
gctcatgcctgtaatcccagcac

SEQ ID NO: 3523 - DNA, 23 bp, Artificial Sequence
  mitotic kinesin microtubule-associated protein Eg5 (Kif11) siRNA
ctcatgcctgtaatcccagcact

SEQ ID NO: 3524 - DNA, 23 bp, Artificial Sequence
  mitotic kinesin microtubule-associated protein Eg5 (Kif11) siRNA
tcatgcctgtaatcccagcactt

SEQ ID NO: 3525 - DNA, 23 bp, Artificial Sequence
  mitotic kinesin microtubule-associated protein Eg5 (Kif11) siRNA
catgcctgtaatcccagcacttt

SEQ ID NO: 3526 - DNA, 23 bp, Artificial Sequence
  mitotic kinesin microtubule-associated protein Eg5 (Kif11) siRNA
atgcctgtaatcccagcactttg

SEQ ID NO: 3527 - DNA, 23 bp, Artificial Sequence
  mitotic kinesin microtubule-associated protein Eg5 (Kif11) siRNA
tgcctgtaatcccagcactttgg

SEQ ID NO: 3528 - DNA, 23 bp, Artificial Sequence
  mitotic kinesin microtubule-associated protein Eg5 (Kif11) siRNA
gcctgtaatcccagcactttggg

SEQ ID NO: 3529 - DNA, 23 bp, Artificial Sequence
  mitotic kinesin microtubule-associated protein Eg5 (Kif11) siRNA
cctgtaatcccagcactttggga

SEQ ID NO: 3530 - DNA, 23 bp, Artificial Sequence
  mitotic kinesin microtubule-associated protein Eg5 (Kif11) siRNA
ctgtaatcccagcactttgggag

SEQ ID NO: 3531 - DNA, 23 bp, Artificial Sequence
  mitotic kinesin microtubule-associated protein Eg5 (Kif11) siRNA
tgtaatcccagcactttgggagg

SEQ ID NO: 3532 - DNA, 23 bp, Artificial Sequence
  mitotic kinesin microtubule-associated protein Eg5 (Kif11) siRNA
gtaatcccagcactttgggaggc

SEQ ID NO: 3533 - DNA, 23 bp, Artificial Sequence
  mitotic kinesin microtubule-associated protein Eg5 (Kif11) siRNA
taatcccagcactttgggaggct

SEQ ID NO: 3534 - DNA, 23 bp, Artificial Sequence
  mitotic kinesin microtubule-associated protein Eg5 (Kif11) siRNA
aatcccagcactttgggaggctg

SEQ ID NO: 3535 - DNA, 23 bp, Artificial Sequence
  mitotic kinesin microtubule-associated protein Eg5 (Kif11) siRNA
atcccagcactttgggaggctga

SEQ ID NO: 3536 - DNA, 23 bp, Artificial Sequence
  mitotic kinesin microtubule-associated protein Eg5 (Kif11) siRNA
tcccagcactttgggaggctgag

SEQ ID NO: 3537 - DNA, 23 bp, Artificial Sequence
  mitotic kinesin microtubule-associated protein Eg5 (Kif11) siRNA
cccagcactttgggaggctgagg

SEQ ID NO: 3538 - DNA, 23 bp, Artificial Sequence
  mitotic kinesin microtubule-associated protein Eg5 (Kif11) siRNA
ccagcactttgggaggctgaggc

SEQ ID NO: 3539 - DNA, 23 bp, Artificial Sequence
  mitotic kinesin microtubule-associated protein Eg5 (Kif11) siRNA
cagcactttgggaggctgaggcg

SEQ ID NO: 3540 - DNA, 23 bp, Artificial Sequence
  mitotic kinesin microtubule-associated protein Eg5 (Kif11) siRNA
agcactttgggaggctgaggcgg

SEQ ID NO: 3541 - DNA, 23 bp, Artificial Sequence
  mitotic kinesin microtubule-associated protein Eg5 (Kif11) siRNA
gcactttgggaggctgaggcggg

SEQ ID NO: 3542 - DNA, 23 bp, Artificial Sequence
  mitotic kinesin microtubule-associated protein Eg5 (Kif11) siRNA
cactttgggaggctgaggcgggt

SEQ ID NO: 3543 - DNA, 23 bp, Artificial Sequence
  mitotic kinesin microtubule-associated protein Eg5 (Kif11) siRNA
actttgggaggctgaggcgggtg

SEQ ID NO: 3544 - DNA, 23 bp, Artificial Sequence
  mitotic kinesin microtubule-associated protein Eg5 (Kif11) siRNA
ctttgggaggctgaggcgggtgg

SEQ ID NO: 3545 - DNA, 23 bp, Artificial Sequence
  mitotic kinesin microtubule-associated protein Eg5 (Kif11) siRNA
tttgggaggctgaggcgggtgga

SEQ ID NO: 3546 - DNA, 23 bp, Artificial Sequence
  mitotic kinesin microtubule-associated protein Eg5 (Kif11) siRNA
ttgggaggctgaggcgggtggat

SEQ ID NO: 3547 - DNA, 23 bp, Artificial Sequence
  mitotic kinesin microtubule-associated protein Eg5 (Kif11) siRNA
tgggaggctgaggcgggtggatt

SEQ ID NO: 3548 - DNA, 23 bp, Artificial Sequence
  mitotic kinesin microtubule-associated protein Eg5 (Kif11) siRNA
gggaggctgaggcgggtggattg

SEQ ID NO: 3549 - DNA, 23 bp, Artificial Sequence
  mitotic kinesin microtubule-associated protein Eg5 (Kif11) siRNA
ggaggctgaggcgggtggattgc

SEQ ID NO: 3550 - DNA, 23 bp, Artificial Sequence
  mitotic kinesin microtubule-associated protein Eg5 (Kif11) siRNA
gaggctgaggcgggtggattgct

SEQ ID NO: 3551 - DNA, 23 bp, Artificial Sequence
  mitotic kinesin microtubule-associated protein Eg5 (Kif11) siRNA
aggctgaggcgggtggattgctt

SEQ ID NO: 3552 - DNA, 23 bp, Artificial Sequence
  mitotic kinesin microtubule-associated protein Eg5 (Kif11) siRNA
ggctgaggcgggtggattgcttg

SEQ ID NO: 3553 - DNA, 23 bp, Artificial Sequence
  mitotic kinesin microtubule-associated protein Eg5 (Kif11) siRNA
gctgaggcgggtggattgcttga

SEQ ID NO: 3554 - DNA, 23 bp, Artificial Sequence
  mitotic kinesin microtubule-associated protein Eg5 (Kif11) siRNA
ctgaggcgggtggattgcttgag

SEQ ID NO: 3555 - DNA, 23 bp, Artificial Sequence
  mitotic kinesin microtubule-associated protein Eg5 (Kif11) siRNA
tgaggcgggtggattgcttgagc

SEQ ID NO: 3556 - DNA, 23 bp, Artificial Sequence
  mitotic kinesin microtubule-associated protein Eg5 (Kif11) siRNA
gaggcgggtggattgcttgagcc

SEQ ID NO: 3557 - DNA, 23 bp, Artificial Sequence
  mitotic kinesin microtubule-associated protein Eg5 (Kif11) siRNA
aggcgggtggattgcttgagccc

SEQ ID NO: 3558 - DNA, 23 bp, Artificial Sequence
  mitotic kinesin microtubule-associated protein Eg5 (Kif11) siRNA
ggcgggtggattgcttgagccca

SEQ ID NO: 3559 - DNA, 23 bp, Artificial Sequence
  mitotic kinesin microtubule-associated protein Eg5 (Kif11) siRNA
gcgggtggattgcttgagcccag

SEQ ID NO: 3560 - DNA, 23 bp, Artificial Sequence
  mitotic kinesin microtubule-associated protein Eg5 (Kif11) siRNA
cgggtggattgcttgagcccagg

SEQ ID NO: 3561 - DNA, 23 bp, Artificial Sequence
  mitotic kinesin microtubule-associated protein Eg5 (Kif11) siRNA
gggtggattgcttgagcccagga

SEQ ID NO: 3562 - DNA, 23 bp, Artificial Sequence
  mitotic kinesin microtubule-associated protein Eg5 (Kif11) siRNA
ggtggattgcttgagcccaggag

SEQ ID NO: 3563 - DNA, 23 bp, Artificial Sequence
  mitotic kinesin microtubule-associated protein Eg5 (Kif11) siRNA
gtggattgcttgagcccaggagt

SEQ ID NO: 3564 - DNA, 23 bp, Artificial Sequence
  mitotic kinesin microtubule-associated protein Eg5 (Kif11) siRNA
tggattgcttgagcccaggagtt

SEQ ID NO: 3565 - DNA, 23 bp, Artificial Sequence
  mitotic kinesin microtubule-associated protein Eg5 (Kif11) siRNA
ggattgcttgagcccaggagttt

SEQ ID NO: 3566 - DNA, 23 bp, Artificial Sequence
  mitotic kinesin microtubule-associated protein Eg5 (Kif11) siRNA
gattgcttgagcccaggagtttg

SEQ ID NO: 3567 - DNA, 23 bp, Artificial Sequence
  mitotic kinesin microtubule-associated protein Eg5 (Kif11) siRNA
attgcttgagcccaggagtttga

SEQ ID NO: 3568 - DNA, 23 bp, Artificial Sequence
  mitotic kinesin microtubule-associated protein Eg5 (Kif11) siRNA
ttgcttgagcccaggagtttgag

SEQ ID NO: 3569 - DNA, 23 bp, Artificial Sequence
  mitotic kinesin microtubule-associated protein Eg5 (Kif11) siRNA
tgcttgagcccaggagtttgaga

SEQ ID NO: 3570 - DNA, 23 bp, Artificial Sequence
  mitotic kinesin microtubule-associated protein Eg5 (Kif11) siRNA
gcttgagcccaggagtttgagac

SEQ ID NO: 3571 - DNA, 23 bp, Artificial Sequence
  mitotic kinesin microtubule-associated protein Eg5 (Kif11) siRNA
cttgagcccaggagtttgagacc

SEQ ID NO: 3572 - DNA, 23 bp, Artificial Sequence
  mitotic kinesin microtubule-associated protein Eg5 (Kif11) siRNA
ttgagcccaggagtttgagacca

SEQ ID NO: 3573 - DNA, 23 bp, Artificial Sequence
  mitotic kinesin microtubule-associated protein Eg5 (Kif11) siRNA
tgagcccaggagtttgagaccag

SEQ ID NO: 3574 - DNA, 23 bp, Artificial Sequence
  mitotic kinesin microtubule-associated protein Eg5 (Kif11) siRNA
gagcccaggagtttgagaccagc

SEQ ID NO: 3575 - DNA, 23 bp, Artificial Sequence
  mitotic kinesin microtubule-associated protein Eg5 (Kif11) siRNA
agcccaggagtttgagaccagcc

SEQ ID NO: 3576 - DNA, 23 bp, Artificial Sequence
  mitotic kinesin microtubule-associated protein Eg5 (Kif11) siRNA
gcccaggagtttgagaccagcct

SEQ ID NO: 3577 - DNA, 23 bp, Artificial Sequence
  mitotic kinesin microtubule-associated protein Eg5 (Kif11) siRNA
cccaggagtttgagaccagcctg

SEQ ID NO: 3578 - DNA, 23 bp, Artificial Sequence
  mitotic kinesin microtubule-associated protein Eg5 (Kif11) siRNA
ccaggagtttgagaccagcctgg

SEQ ID NO: 3579 - DNA, 23 bp, Artificial Sequence
  mitotic kinesin microtubule-associated protein Eg5 (Kif11) siRNA
caggagtttgagaccagcctggc

SEQ ID NO: 3580 - DNA, 23 bp, Artificial Sequence
  mitotic kinesin microtubule-associated protein Eg5 (Kif11) siRNA
aggagtttgagaccagcctggcc

SEQ ID NO: 3581 - DNA, 23 bp, Artificial Sequence
  mitotic kinesin microtubule-associated protein Eg5 (Kif11) siRNA
ggagtttgagaccagcctggcca

SEQ ID NO: 3582 - DNA, 23 bp, Artificial Sequence
  mitotic kinesin microtubule-associated protein Eg5 (Kif11) siRNA
gagtttgagaccagcctggccaa

SEQ ID NO: 3583 - DNA, 23 bp, Artificial Sequence
  mitotic kinesin microtubule-associated protein Eg5 (Kif11) siRNA
agtttgagaccagcctggccaac

SEQ ID NO: 3584 - DNA, 23 bp, Artificial Sequence
  mitotic kinesin microtubule-associated protein Eg5 (Kif11) siRNA
gtttgagaccagcctggccaacg

SEQ ID NO: 3585 - DNA, 23 bp, Artificial Sequence
  mitotic kinesin microtubule-associated protein Eg5 (Kif11) siRNA
tttgagaccagcctggccaacgt

SEQ ID NO: 3586 - DNA, 23 bp, Artificial Sequence
  mitotic kinesin microtubule-associated protein Eg5 (Kif11) siRNA
ttgagaccagcctggccaacgtg

SEQ ID NO: 3587 - DNA, 23 bp, Artificial Sequence
  mitotic kinesin microtubule-associated protein Eg5 (Kif11) siRNA
tgagaccagcctggccaacgtgg

SEQ ID NO: 3588 - DNA, 23 bp, Artificial Sequence
  mitotic kinesin microtubule-associated protein Eg5 (Kif11) siRNA
gagaccagcctggccaacgtggc

SEQ ID NO: 3589 - DNA, 23 bp, Artificial Sequence
  mitotic kinesin microtubule-associated protein Eg5 (Kif11) siRNA
agaccagcctggccaacgtggca

SEQ ID NO: 3590 - DNA, 23 bp, Artificial Sequence
  mitotic kinesin microtubule-associated protein Eg5 (Kif11) siRNA
gaccagcctggccaacgtggcaa

SEQ ID NO: 3591 - DNA, 23 bp, Artificial Sequence
  mitotic kinesin microtubule-associated protein Eg5 (Kif11) siRNA
accagcctggccaacgtggcaaa

SEQ ID NO: 3592 - DNA, 23 bp, Artificial Sequence
  mitotic kinesin microtubule-associated protein Eg5 (Kif11) siRNA
ccagcctggccaacgtggcaaaa

SEQ ID NO: 3593 - DNA, 23 bp, Artificial Sequence
  mitotic kinesin microtubule-associated protein Eg5 (Kif11) siRNA
cagcctggccaacgtggcaaaac

SEQ ID NO: 3594 - DNA, 23 bp, Artificial Sequence
  mitotic kinesin microtubule-associated protein Eg5 (Kif11) siRNA
agcctggccaacgtggcaaaacc

SEQ ID NO: 3595 - DNA, 23 bp, Artificial Sequence
  mitotic kinesin microtubule-associated protein Eg5 (Kif11) siRNA
gcctggccaacgtggcaaaacct

SEQ ID NO: 3596 - DNA, 23 bp, Artificial Sequence
  mitotic kinesin microtubule-associated protein Eg5 (Kif11) siRNA
cctggccaacgtggcaaaacctc

SEQ ID NO: 3597 - DNA, 23 bp, Artificial Sequence
  mitotic kinesin microtubule-associated protein Eg5 (Kif11) siRNA
ctggccaacgtggcaaaacctcg

SEQ ID NO: 3598 - DNA, 23 bp, Artificial Sequence
  mitotic kinesin microtubule-associated protein Eg5 (Kif11) siRNA
tggccaacgtggcaaaacctcgt

SEQ ID NO: 3599 - DNA, 23 bp, Artificial Sequence
  mitotic kinesin microtubule-associated protein Eg5 (Kif11) siRNA
ggccaacgtggcaaaacctcgtc

SEQ ID NO: 3600 - DNA, 23 bp, Artificial Sequence
  mitotic kinesin microtubule-associated protein Eg5 (Kif11) siRNA
gccaacgtggcaaaacctcgtct

SEQ ID NO: 3601 - DNA, 23 bp, Artificial Sequence
  mitotic kinesin microtubule-associated protein Eg5 (Kif11) siRNA
ccaacgtggcaaaacctcgtctc

SEQ ID NO: 3602 - DNA, 23 bp, Artificial Sequence
  mitotic kinesin microtubule-associated protein Eg5 (Kif11) siRNA
caacgtggcaaaacctcgtctct

SEQ ID NO: 3603 - DNA, 23 bp, Artificial Sequence
  mitotic kinesin microtubule-associated protein Eg5 (Kif11) siRNA
aacgtggcaaaacctcgtctctg

SEQ ID NO: 3604 - DNA, 23 bp, Artificial Sequence
  mitotic kinesin microtubule-associated protein Eg5 (Kif11) siRNA
acgtggcaaaacctcgtctctgt

SEQ ID NO: 3605 - DNA, 23 bp, Artificial Sequence
  mitotic kinesin microtubule-associated protein Eg5 (Kif11) siRNA
cgtggcaaaacctcgtctctgtt

SEQ ID NO: 3606 - DNA, 23 bp, Artificial Sequence
  mitotic kinesin microtubule-associated protein Eg5 (Kif11) siRNA
gtggcaaaacctcgtctctgtta

SEQ ID NO: 3607 - DNA, 23 bp, Artificial Sequence
  mitotic kinesin microtubule-associated protein Eg5 (Kif11) siRNA
tggcaaaacctcgtctctgttaa

SEQ ID NO: 3608 - DNA, 23 bp, Artificial Sequence
  mitotic kinesin microtubule-associated protein Eg5 (Kif11) siRNA
ggcaaaacctcgtctctgttaaa

SEQ ID NO: 3609 - DNA, 23 bp, Artificial Sequence
  mitotic kinesin microtubule-associated protein Eg5 (Kif11) siRNA
gcaaaacctcgtctctgttaaaa

SEQ ID NO: 3610 - DNA, 23 bp, Artificial Sequence
  mitotic kinesin microtubule-associated protein Eg5 (Kif11) siRNA
caaaacctcgtctctgttaaaaa

SEQ ID NO: 3611 - DNA, 23 bp, Artificial Sequence
  mitotic kinesin microtubule-associated protein Eg5 (Kif11) siRNA
aaaacctcgtctctgttaaaaat

SEQ ID NO: 3612 - DNA, 23 bp, Artificial Sequence
  mitotic kinesin microtubule-associated protein Eg5 (Kif11) siRNA
aaacctcgtctctgttaaaaatt

SEQ ID NO: 3613 - DNA, 23 bp, Artificial Sequence
  mitotic kinesin microtubule-associated protein Eg5 (Kif11) siRNA
aacctcgtctctgttaaaaatta

SEQ ID NO: 3614 - DNA, 23 bp, Artificial Sequence
  mitotic kinesin microtubule-associated protein Eg5 (Kif11) siRNA
acctcgtctctgttaaaaattag

SEQ ID NO: 3615 - DNA, 23 bp, Artificial Sequence
  mitotic kinesin microtubule-associated protein Eg5 (Kif11) siRNA
cctcgtctctgttaaaaattagc

SEQ ID NO: 3616 - DNA, 23 bp, Artificial Sequence
  mitotic kinesin microtubule-associated protein Eg5 (Kif11) siRNA
ctcgtctctgttaaaaattagcc

SEQ ID NO: 3617 - DNA, 23 bp, Artificial Sequence
  mitotic kinesin microtubule-associated protein Eg5 (Kif11) siRNA
tcgtctctgttaaaaattagccg

SEQ ID NO: 3618 - DNA, 23 bp, Artificial Sequence
  mitotic kinesin microtubule-associated protein Eg5 (Kif11) siRNA
cgtctctgttaaaaattagccgg

SEQ ID NO: 3619 - DNA, 23 bp, Artificial Sequence
  mitotic kinesin microtubule-associated protein Eg5 (Kif11) siRNA
gtctctgttaaaaattagccggg

SEQ ID NO: 3620 - DNA, 23 bp, Artificial Sequence
  mitotic kinesin microtubule-associated protein Eg5 (Kif11) siRNA
tctctgttaaaaattagccgggc

SEQ ID NO: 3621 - DNA, 23 bp, Artificial Sequence
  mitotic kinesin microtubule-associated protein Eg5 (Kif11) siRNA
ctctgttaaaaattagccgggcg

SEQ ID NO: 3622 - DNA, 23 bp, Artificial Sequence
  mitotic kinesin microtubule-associated protein Eg5 (Kif11) siRNA
tctgttaaaaattagccgggcgt

SEQ ID NO: 3623 - DNA, 23 bp, Artificial Sequence
  mitotic kinesin microtubule-associated protein Eg5 (Kif11) siRNA
ctgttaaaaattagccgggcgtg

SEQ ID NO: 3624 - DNA, 23 bp, Artificial Sequence
  mitotic kinesin microtubule-associated protein Eg5 (Kif11) siRNA
tgttaaaaattagccgggcgtgg

SEQ ID NO: 3625 - DNA, 23 bp, Artificial Sequence
  mitotic kinesin microtubule-associated protein Eg5 (Kif11) siRNA
gttaaaaattagccgggcgtggt

SEQ ID NO: 3626 - DNA, 23 bp, Artificial Sequence
  mitotic kinesin microtubule-associated protein Eg5 (Kif11) siRNA
ttaaaaattagccgggcgtggtg

SEQ ID NO: 3627 - DNA, 23 bp, Artificial Sequence
  mitotic kinesin microtubule-associated protein Eg5 (Kif11) siRNA
taaaaattagccgggcgtggtgg

SEQ ID NO: 3628 - DNA, 23 bp, Artificial Sequence
  mitotic kinesin microtubule-associated protein Eg5 (Kif11) siRNA
aaaaattagccgggcgtggtggc

SEQ ID NO: 3629 - DNA, 23 bp, Artificial Sequence
  mitotic kinesin microtubule-associated protein Eg5 (Kif11) siRNA
aaaattagccgggcgtggtggca

SEQ ID NO: 3630 - DNA, 23 bp, Artificial Sequence
  mitotic kinesin microtubule-associated protein Eg5 (Kif11) siRNA
aaattagccgggcgtggtggcac

SEQ ID NO: 3631 - DNA, 23 bp, Artificial Sequence
  mitotic kinesin microtubule-associated protein Eg5 (Kif11) siRNA
aattagccgggcgtggtggcaca

SEQ ID NO: 3632 - DNA, 23 bp, Artificial Sequence
  mitotic kinesin microtubule-associated protein Eg5 (Kif11) siRNA
attagccgggcgtggtggcacac

SEQ ID NO: 3633 - DNA, 23 bp, Artificial Sequence
  mitotic kinesin microtubule-associated protein Eg5 (Kif11) siRNA
ttagccgggcgtggtggcacact

SEQ ID NO: 3634 - DNA, 23 bp, Artificial Sequence
  mitotic kinesin microtubule-associated protein Eg5 (Kif11) siRNA
tagccgggcgtggtggcacactc

SEQ ID NO: 3635 - DNA, 23 bp, Artificial Sequence
  mitotic kinesin microtubule-associated protein Eg5 (Kif11) siRNA
agccgggcgtggtggcacactcc

SEQ ID NO: 3636 - DNA, 23 bp, Artificial Sequence
  mitotic kinesin microtubule-associated protein Eg5 (Kif11) siRNA
gccgggcgtggtggcacactcct

SEQ ID NO: 3637 - DNA, 23 bp, Artificial Sequence
  mitotic kinesin microtubule-associated protein Eg5 (Kif11) siRNA
ccgggcgtggtggcacactcctg

SEQ ID NO: 3638 - DNA, 23 bp, Artificial Sequence
  mitotic kinesin microtubule-associated protein Eg5 (Kif11) siRNA
cgggcgtggtggcacactcctgt

SEQ ID NO: 3639 - DNA, 23 bp, Artificial Sequence
  mitotic kinesin microtubule-associated protein Eg5 (Kif11) siRNA
gggcgtggtggcacactcctgta

SEQ ID NO: 3640 - DNA, 23 bp, Artificial Sequence
  mitotic kinesin microtubule-associated protein Eg5 (Kif11) siRNA
ggcgtggtggcacactcctgtaa

SEQ ID NO: 3641 - DNA, 23 bp, Artificial Sequence
  mitotic kinesin microtubule-associated protein Eg5 (Kif11) siRNA
gcgtggtggcacactcctgtaat

SEQ ID NO: 3642 - DNA, 23 bp, Artificial Sequence
  mitotic kinesin microtubule-associated protein Eg5 (Kif11) siRNA
cgtggtggcacactcctgtaatc

SEQ ID NO: 3643 - DNA, 23 bp, Artificial Sequence
  mitotic kinesin microtubule-associated protein Eg5 (Kif11) siRNA
gtggtggcacactcctgtaatcc

SEQ ID NO: 3644 - DNA, 23 bp, Artificial Sequence
  mitotic kinesin microtubule-associated protein Eg5 (Kif11) siRNA
tggtggcacactcctgtaatccc

SEQ ID NO: 3645 - DNA, 23 bp, Artificial Sequence
  mitotic kinesin microtubule-associated protein Eg5 (Kif11) siRNA
ggtggcacactcctgtaatccca

SEQ ID NO: 3646 - DNA, 23 bp, Artificial Sequence
  mitotic kinesin microtubule-associated protein Eg5 (Kif11) siRNA
gtggcacactcctgtaatcccag

SEQ ID NO: 3647 - DNA, 23 bp, Artificial Sequence
  mitotic kinesin microtubule-associated protein Eg5 (Kif11) siRNA
tggcacactcctgtaatcccagc

SEQ ID NO: 3648 - DNA, 23 bp, Artificial Sequence
  mitotic kinesin microtubule-associated protein Eg5 (Kif11) siRNA
ggcacactcctgtaatcccagct

SEQ ID NO: 3649 - DNA, 23 bp, Artificial Sequence
  mitotic kinesin microtubule-associated protein Eg5 (Kif11) siRNA
gcacactcctgtaatcccagcta

SEQ ID NO: 3650 - DNA, 23 bp, Artificial Sequence
  mitotic kinesin microtubule-associated protein Eg5 (Kif11) siRNA
cacactcctgtaatcccagctac

SEQ ID NO: 3651 - DNA, 23 bp, Artificial Sequence
  mitotic kinesin microtubule-associated protein Eg5 (Kif11) siRNA
acactcctgtaatcccagctact

SEQ ID NO: 3652 - DNA, 23 bp, Artificial Sequence
  mitotic kinesin microtubule-associated protein Eg5 (Kif11) siRNA
cactcctgtaatcccagctactg

SEQ ID NO: 3653 - DNA, 23 bp, Artificial Sequence
  mitotic kinesin microtubule-associated protein Eg5 (Kif11) siRNA
actcctgtaatcccagctactgg

SEQ ID NO: 3654 - DNA, 23 bp, Artificial Sequence
  mitotic kinesin microtubule-associated protein Eg5 (Kif11) siRNA
ctcctgtaatcccagctactggg

SEQ ID NO: 3655 - DNA, 23 bp, Artificial Sequence
  mitotic kinesin microtubule-associated protein Eg5 (Kif11) siRNA
tcctgtaatcccagctactgggg

SEQ ID NO: 3656 - DNA, 23 bp, Artificial Sequence
  mitotic kinesin microtubule-associated protein Eg5 (Kif11) siRNA
cctgtaatcccagctactgggga

SEQ ID NO: 3657 - DNA, 23 bp, Artificial Sequence
  mitotic kinesin microtubule-associated protein Eg5 (Kif11) siRNA
ctgtaatcccagctactggggag

SEQ ID NO: 3658 - DNA, 23 bp, Artificial Sequence
  mitotic kinesin microtubule-associated protein Eg5 (Kif11) siRNA
tgtaatcccagctactggggagg

SEQ ID NO: 3659 - DNA, 23 bp, Artificial Sequence
  mitotic kinesin microtubule-associated protein Eg5 (Kif11) siRNA
gtaatcccagctactggggaggc

SEQ ID NO: 3660 - DNA, 23 bp, Artificial Sequence
  mitotic kinesin microtubule-associated protein Eg5 (Kif11) siRNA
taatcccagctactggggaggct

SEQ ID NO: 3661 - DNA, 23 bp, Artificial Sequence
  mitotic kinesin microtubule-associated protein Eg5 (Kif11) siRNA
aatcccagctactggggaggctg

SEQ ID NO: 3662 - DNA, 23 bp, Artificial Sequence
  mitotic kinesin microtubule-associated protein Eg5 (Kif11) siRNA
atcccagctactggggaggctga

SEQ ID NO: 3663 - DNA, 23 bp, Artificial Sequence
  mitotic kinesin microtubule-associated protein Eg5 (Kif11) siRNA
tcccagctactggggaggctgag

SEQ ID NO: 3664 - DNA, 23 bp, Artificial Sequence
  mitotic kinesin microtubule-associated protein Eg5 (Kif11) siRNA
cccagctactggggaggctgagg

SEQ ID NO: 3665 - DNA, 23 bp, Artificial Sequence
  mitotic kinesin microtubule-associated protein Eg5 (Kif11) siRNA
ccagctactggggaggctgaggc

SEQ ID NO: 3666 - DNA, 23 bp, Artificial Sequence
  mitotic kinesin microtubule-associated protein Eg5 (Kif11) siRNA
cagctactggggaggctgaggca

SEQ ID NO: 3667 - DNA, 23 bp, Artificial Sequence
  mitotic kinesin microtubule-associated protein Eg5 (Kif11) siRNA
agctactggggaggctgaggcac

SEQ ID NO: 3668 - DNA, 23 bp, Artificial Sequence
  mitotic kinesin microtubule-associated protein Eg5 (Kif11) siRNA
gctactggggaggctgaggcacg

SEQ ID NO: 3669 - DNA, 23 bp, Artificial Sequence
  mitotic kinesin microtubule-associated protein Eg5 (Kif11) siRNA
ctactggggaggctgaggcacga

SEQ ID NO: 3670 - DNA, 23 bp, Artificial Sequence
  mitotic kinesin microtubule-associated protein Eg5 (Kif11) siRNA
tactggggaggctgaggcacgag

SEQ ID NO: 3671 - DNA, 23 bp, Artificial Sequence
  mitotic kinesin microtubule-associated protein Eg5 (Kif11) siRNA
actggggaggctgaggcacgaga

SEQ ID NO: 3672 - DNA, 23 bp, Artificial Sequence
  mitotic kinesin microtubule-associated protein Eg5 (Kif11) siRNA
ctggggaggctgaggcacgagaa

SEQ ID NO: 3673 - DNA, 23 bp, Artificial Sequence
  mitotic kinesin microtubule-associated protein Eg5 (Kif11) siRNA
tggggaggctgaggcacgagaat

SEQ ID NO: 3674 - DNA, 23 bp, Artificial Sequence
  mitotic kinesin microtubule-associated protein Eg5 (Kif11) siRNA
ggggaggctgaggcacgagaatc

SEQ ID NO: 3675 - DNA, 23 bp, Artificial Sequence
  mitotic kinesin microtubule-associated protein Eg5 (Kif11) siRNA
gggaggctgaggcacgagaatca

SEQ ID NO: 3676 - DNA, 23 bp, Artificial Sequence
  mitotic kinesin microtubule-associated protein Eg5 (Kif11) siRNA
ggaggctgaggcacgagaatcac

SEQ ID NO: 3677 - DNA, 23 bp, Artificial Sequence
  mitotic kinesin microtubule-associated protein Eg5 (Kif11) siRNA
gaggctgaggcacgagaatcact

SEQ ID NO: 3678 - DNA, 23 bp, Artificial Sequence
  mitotic kinesin microtubule-associated protein Eg5 (Kif11) siRNA
aggctgaggcacgagaatcactt

SEQ ID NO: 3679 - DNA, 23 bp, Artificial Sequence
  mitotic kinesin microtubule-associated protein Eg5 (Kif11) siRNA
ggctgaggcacgagaatcacttg

SEQ ID NO: 3680 - DNA, 23 bp, Artificial Sequence
  mitotic kinesin microtubule-associated protein Eg5 (Kif11) siRNA
gctgaggcacgagaatcacttga

SEQ ID NO: 3681 - DNA, 23 bp, Artificial Sequence
  mitotic kinesin microtubule-associated protein Eg5 (Kif11) siRNA
ctgaggcacgagaatcacttgaa

SEQ ID NO: 3682 - DNA, 23 bp, Artificial Sequence
  mitotic kinesin microtubule-associated protein Eg5 (Kif11) siRNA
tgaggcacgagaatcacttgaac

SEQ ID NO: 3683 - DNA, 23 bp, Artificial Sequence
  mitotic kinesin microtubule-associated protein Eg5 (Kif11) siRNA
gaggcacgagaatcacttgaacc

SEQ ID NO: 3684 - DNA, 23 bp, Artificial Sequence
  mitotic kinesin microtubule-associated protein Eg5 (Kif11) siRNA
aggcacgagaatcacttgaaccc

SEQ ID NO: 3685 - DNA, 23 bp, Artificial Sequence
  mitotic kinesin microtubule-associated protein Eg5 (Kif11) siRNA
ggcacgagaatcacttgaaccca

SEQ ID NO: 3686 - DNA, 23 bp, Artificial Sequence
  mitotic kinesin microtubule-associated protein Eg5 (Kif11) siRNA
gcacgagaatcacttgaacccag

SEQ ID NO: 3687 - DNA, 23 bp, Artificial Sequence
  mitotic kinesin microtubule-associated protein Eg5 (Kif11) siRNA
cacgagaatcacttgaacccagg

SEQ ID NO: 3688 - DNA, 23 bp, Artificial Sequence
  mitotic kinesin microtubule-associated protein Eg5 (Kif11) siRNA
acgagaatcacttgaacccagga

SEQ ID NO: 3689 - DNA, 23 bp, Artificial Sequence
  mitotic kinesin microtubule-associated protein Eg5 (Kif11) siRNA
cgagaatcacttgaacccaggaa

SEQ ID NO: 3690 - DNA, 23 bp, Artificial Sequence
  mitotic kinesin microtubule-associated protein Eg5 (Kif11) siRNA
gagaatcacttgaacccaggaag

SEQ ID NO: 3691 - DNA, 23 bp, Artificial Sequence
  mitotic kinesin microtubule-associated protein Eg5 (Kif11) siRNA
agaatcacttgaacccaggaagc

SEQ ID NO: 3692 - DNA, 23 bp, Artificial Sequence
  mitotic kinesin microtubule-associated protein Eg5 (Kif11) siRNA
gaatcacttgaacccaggaagcg

SEQ ID NO: 3693 - DNA, 23 bp, Artificial Sequence
  mitotic kinesin microtubule-associated protein Eg5 (Kif11) siRNA
aatcacttgaacccaggaagcgg

SEQ ID NO: 3694 - DNA, 23 bp, Artificial Sequence
  mitotic kinesin microtubule-associated protein Eg5 (Kif11) siRNA
atcacttgaacccaggaagcggg

SEQ ID NO: 3695 - DNA, 23 bp, Artificial Sequence
  mitotic kinesin microtubule-associated protein Eg5 (Kif11) siRNA
tcacttgaacccaggaagcgggg

SEQ ID NO: 3696 - DNA, 23 bp, Artificial Sequence
  mitotic kinesin microtubule-associated protein Eg5 (Kif11) siRNA
cacttgaacccaggaagcggggt

SEQ ID NO: 3697 - DNA, 23 bp, Artificial Sequence
  mitotic kinesin microtubule-associated protein Eg5 (Kif11) siRNA
acttgaacccaggaagcggggtt

SEQ ID NO: 3698 - DNA, 23 bp, Artificial Sequence
  mitotic kinesin microtubule-associated protein Eg5 (Kif11) siRNA
cttgaacccaggaagcggggttg

SEQ ID NO: 3699 - DNA, 23 bp, Artificial Sequence
  mitotic kinesin microtubule-associated protein Eg5 (Kif11) siRNA
ttgaacccaggaagcggggttgc

SEQ ID NO: 3700 - DNA, 23 bp, Artificial Sequence
  mitotic kinesin microtubule-associated protein Eg5 (Kif11) siRNA
tgaacccaggaagcggggttgca

SEQ ID NO: 3701 - DNA, 23 bp, Artificial Sequence
  mitotic kinesin microtubule-associated protein Eg5 (Kif11) siRNA
gaacccaggaagcggggttgcag

SEQ ID NO: 3702 - DNA, 23 bp, Artificial Sequence
  mitotic kinesin microtubule-associated protein Eg5 (Kif11) siRNA
aacccaggaagcggggttgcagt

SEQ ID NO: 3703 - DNA, 23 bp, Artificial Sequence
  mitotic kinesin microtubule-associated protein Eg5 (Kif11) siRNA
acccaggaagcggggttgcagtg

SEQ ID NO: 3704 - DNA, 23 bp, Artificial Sequence
  mitotic kinesin microtubule-associated protein Eg5 (Kif11) siRNA
cccaggaagcggggttgcagtga

SEQ ID NO: 3705 - DNA, 23 bp, Artificial Sequence
  mitotic kinesin microtubule-associated protein Eg5 (Kif11) siRNA
ccaggaagcggggttgcagtgag

SEQ ID NO: 3706 - DNA, 23 bp, Artificial Sequence
  mitotic kinesin microtubule-associated protein Eg5 (Kif11) siRNA
caggaagcggggttgcagtgagc

SEQ ID NO: 3707 - DNA, 23 bp, Artificial Sequence
  mitotic kinesin microtubule-associated protein Eg5 (Kif11) siRNA
aggaagcggggttgcagtgagcc

SEQ ID NO: 3708 - DNA, 23 bp, Artificial Sequence
  mitotic kinesin microtubule-associated protein Eg5 (Kif11) siRNA
ggaagcggggttgcagtgagcca

SEQ ID NO: 3709 - DNA, 23 bp, Artificial Sequence
  mitotic kinesin microtubule-associated protein Eg5 (Kif11) siRNA
gaagcggggttgcagtgagccaa

SEQ ID NO: 3710 - DNA, 23 bp, Artificial Sequence
  mitotic kinesin microtubule-associated protein Eg5 (Kif11) siRNA
aagcggggttgcagtgagccaaa

SEQ ID NO: 3711 - DNA, 23 bp, Artificial Sequence
  mitotic kinesin microtubule-associated protein Eg5 (Kif11) siRNA
agcggggttgcagtgagccaaag

SEQ ID NO: 3712 - DNA, 23 bp, Artificial Sequence
  mitotic kinesin microtubule-associated protein Eg5 (Kif11) siRNA
gcggggttgcagtgagccaaagg

SEQ ID NO: 3713 - DNA, 23 bp, Artificial Sequence
  mitotic kinesin microtubule-associated protein Eg5 (Kif11) siRNA
cggggttgcagtgagccaaaggt

SEQ ID NO: 3714 - DNA, 23 bp, Artificial Sequence
  mitotic kinesin microtubule-associated protein Eg5 (Kif11) siRNA
ggggttgcagtgagccaaaggta

SEQ ID NO: 3715 - DNA, 23 bp, Artificial Sequence
  mitotic kinesin microtubule-associated protein Eg5 (Kif11) siRNA
gggttgcagtgagccaaaggtac

SEQ ID NO: 3716 - DNA, 23 bp, Artificial Sequence
  mitotic kinesin microtubule-associated protein Eg5 (Kif11) siRNA
ggttgcagtgagccaaaggtaca

SEQ ID NO: 3717 - DNA, 23 bp, Artificial Sequence
  mitotic kinesin microtubule-associated protein Eg5 (Kif11) siRNA
gttgcagtgagccaaaggtacac

SEQ ID NO: 3718 - DNA, 23 bp, Artificial Sequence
  mitotic kinesin microtubule-associated protein Eg5 (Kif11) siRNA
ttgcagtgagccaaaggtacacc

SEQ ID NO: 3719 - DNA, 23 bp, Artificial Sequence
  mitotic kinesin microtubule-associated protein Eg5 (Kif11) siRNA
tgcagtgagccaaaggtacacca

SEQ ID NO: 3720 - DNA, 23 bp, Artificial Sequence
  mitotic kinesin microtubule-associated protein Eg5 (Kif11) siRNA
gcagtgagccaaaggtacaccac

SEQ ID NO: 3721 - DNA, 23 bp, Artificial Sequence
  mitotic kinesin microtubule-associated protein Eg5 (Kif11) siRNA
cagtgagccaaaggtacaccact

SEQ ID NO: 3722 - DNA, 23 bp, Artificial Sequence
  mitotic kinesin microtubule-associated protein Eg5 (Kif11) siRNA
agtgagccaaaggtacaccacta

SEQ ID NO: 3723 - DNA, 23 bp, Artificial Sequence
  mitotic kinesin microtubule-associated protein Eg5 (Kif11) siRNA
gtgagccaaaggtacaccactac

SEQ ID NO: 3724 - DNA, 23 bp, Artificial Sequence
  mitotic kinesin microtubule-associated protein Eg5 (Kif11) siRNA
tgagccaaaggtacaccactaca

SEQ ID NO: 3725 - DNA, 23 bp, Artificial Sequence
  mitotic kinesin microtubule-associated protein Eg5 (Kif11) siRNA
gagccaaaggtacaccactacac

SEQ ID NO: 3726 - DNA, 23 bp, Artificial Sequence
  mitotic kinesin microtubule-associated protein Eg5 (Kif11) siRNA
agccaaaggtacaccactacact

SEQ ID NO: 3727 - DNA, 23 bp, Artificial Sequence
  mitotic kinesin microtubule-associated protein Eg5 (Kif11) siRNA
gccaaaggtacaccactacactc

SEQ ID NO: 3728 - DNA, 23 bp, Artificial Sequence
  mitotic kinesin microtubule-associated protein Eg5 (Kif11) siRNA
ccaaaggtacaccactacactcc

SEQ ID NO: 3729 - DNA, 23 bp, Artificial Sequence
  mitotic kinesin microtubule-associated protein Eg5 (Kif11) siRNA
caaaggtacaccactacactcca

SEQ ID NO: 3730 - DNA, 23 bp, Artificial Sequence
  mitotic kinesin microtubule-associated protein Eg5 (Kif11) siRNA
aaaggtacaccactacactccag

SEQ ID NO: 3731 - DNA, 23 bp, Artificial Sequence
  mitotic kinesin microtubule-associated protein Eg5 (Kif11) siRNA
aaggtacaccactacactccagc

SEQ ID NO: 3732 - DNA, 23 bp, Artificial Sequence
  mitotic kinesin microtubule-associated protein Eg5 (Kif11) siRNA
aggtacaccactacactccagcc

SEQ ID NO: 3733 - DNA, 23 bp, Artificial Sequence
  mitotic kinesin microtubule-associated protein Eg5 (Kif11) siRNA
ggtacaccactacactccagcct

SEQ ID NO: 3734 - DNA, 23 bp, Artificial Sequence
  mitotic kinesin microtubule-associated protein Eg5 (Kif11) siRNA
gtacaccactacactccagcctg

SEQ ID NO: 3735 - DNA, 23 bp, Artificial Sequence
  mitotic kinesin microtubule-associated protein Eg5 (Kif11) siRNA
tacaccactacactccagcctgg

SEQ ID NO: 3736 - DNA, 23 bp, Artificial Sequence
  mitotic kinesin microtubule-associated protein Eg5 (Kif11) siRNA
acaccactacactccagcctggg

SEQ ID NO: 3737 - DNA, 23 bp, Artificial Sequence
  mitotic kinesin microtubule-associated protein Eg5 (Kif11) siRNA
caccactacactccagcctgggc

SEQ ID NO: 3738 - DNA, 23 bp, Artificial Sequence
  mitotic kinesin microtubule-associated protein Eg5 (Kif11) siRNA
accactacactccagcctgggca

SEQ ID NO: 3739 - DNA, 23 bp, Artificial Sequence
  mitotic kinesin microtubule-associated protein Eg5 (Kif11) siRNA
ccactacactccagcctgggcaa

SEQ ID NO: 3740 - DNA, 23 bp, Artificial Sequence
  mitotic kinesin microtubule-associated protein Eg5 (Kif11) siRNA
cactacactccagcctgggcaac

SEQ ID NO: 3741 - DNA, 23 bp, Artificial Sequence
  mitotic kinesin microtubule-associated protein Eg5 (Kif11) siRNA
actacactccagcctgggcaaca

SEQ ID NO: 3742 - DNA, 23 bp, Artificial Sequence
  mitotic kinesin microtubule-associated protein Eg5 (Kif11) siRNA
ctacactccagcctgggcaacag

SEQ ID NO: 3743 - DNA, 23 bp, Artificial Sequence
  mitotic kinesin microtubule-associated protein Eg5 (Kif11) siRNA
tacactccagcctgggcaacaga

SEQ ID NO: 3744 - DNA, 23 bp, Artificial Sequence
  mitotic kinesin microtubule-associated protein Eg5 (Kif11) siRNA
acactccagcctgggcaacagag

SEQ ID NO: 3745 - DNA, 23 bp, Artificial Sequence
  mitotic kinesin microtubule-associated protein Eg5 (Kif11) siRNA
cactccagcctgggcaacagagc

SEQ ID NO: 3746 - DNA, 23 bp, Artificial Sequence
  mitotic kinesin microtubule-associated protein Eg5 (Kif11) siRNA
actccagcctgggcaacagagca

SEQ ID NO: 3747 - DNA, 23 bp, Artificial Sequence
  mitotic kinesin microtubule-associated protein Eg5 (Kif11) siRNA
ctccagcctgggcaacagagcaa

SEQ ID NO: 3748 - DNA, 23 bp, Artificial Sequence
  mitotic kinesin microtubule-associated protein Eg5 (Kif11) siRNA
tccagcctgggcaacagagcaag

SEQ ID NO: 3749 - DNA, 23 bp, Artificial Sequence
  mitotic kinesin microtubule-associated protein Eg5 (Kif11) siRNA
ccagcctgggcaacagagcaaga

SEQ ID NO: 3750 - DNA, 23 bp, Artificial Sequence
  mitotic kinesin microtubule-associated protein Eg5 (Kif11) siRNA
cagcctgggcaacagagcaagac

SEQ ID NO: 3751 - DNA, 23 bp, Artificial Sequence
  mitotic kinesin microtubule-associated protein Eg5 (Kif11) siRNA
agcctgggcaacagagcaagact

SEQ ID NO: 3752 - DNA, 23 bp, Artificial Sequence
  mitotic kinesin microtubule-associated protein Eg5 (Kif11) siRNA
gcctgggcaacagagcaagactc

SEQ ID NO: 3753 - DNA, 23 bp, Artificial Sequence
  mitotic kinesin microtubule-associated protein Eg5 (Kif11) siRNA
cctgggcaacagagcaagactcg

SEQ ID NO: 3754 - DNA, 23 bp, Artificial Sequence
  mitotic kinesin microtubule-associated protein Eg5 (Kif11) siRNA
ctgggcaacagagcaagactcgg

SEQ ID NO: 3755 - DNA, 23 bp, Artificial Sequence
  mitotic kinesin microtubule-associated protein Eg5 (Kif11) siRNA
tgggcaacagagcaagactcggt

SEQ ID NO: 3756 - DNA, 23 bp, Artificial Sequence
  mitotic kinesin microtubule-associated protein Eg5 (Kif11) siRNA
gggcaacagagcaagactcggtc

SEQ ID NO: 3757 - DNA, 23 bp, Artificial Sequence
  mitotic kinesin microtubule-associated protein Eg5 (Kif11) siRNA
ggcaacagagcaagactcggtct

SEQ ID NO: 3758 - DNA, 23 bp, Artificial Sequence
  mitotic kinesin microtubule-associated protein Eg5 (Kif11) siRNA
gcaacagagcaagactcggtctc

SEQ ID NO: 3759 - DNA, 23 bp, Artificial Sequence
  mitotic kinesin microtubule-associated protein Eg5 (Kif11) siRNA
caacagagcaagactcggtctca

SEQ ID NO: 3760 - DNA, 23 bp, Artificial Sequence
  mitotic kinesin microtubule-associated protein Eg5 (Kif11) siRNA
aacagagcaagactcggtctcaa

SEQ ID NO: 3761 - DNA, 23 bp, Artificial Sequence
  mitotic kinesin microtubule-associated protein Eg5 (Kif11) siRNA
acagagcaagactcggtctcaaa

SEQ ID NO: 3762 - DNA, 23 bp, Artificial Sequence
  mitotic kinesin microtubule-associated protein Eg5 (Kif11) siRNA
cagagcaagactcggtctcaaaa

SEQ ID NO: 3763 - DNA, 23 bp, Artificial Sequence
  mitotic kinesin microtubule-associated protein Eg5 (Kif11) siRNA
agagcaagactcggtctcaaaaa

SEQ ID NO: 3764 - DNA, 23 bp, Artificial Sequence
  mitotic kinesin microtubule-associated protein Eg5 (Kif11) siRNA
gagcaagactcggtctcaaaaac

SEQ ID NO: 3765 - DNA, 23 bp, Artificial Sequence
  mitotic kinesin microtubule-associated protein Eg5 (Kif11) siRNA
agcaagactcggtctcaaaaaca

SEQ ID NO: 3766 - DNA, 23 bp, Artificial Sequence
  mitotic kinesin microtubule-associated protein Eg5 (Kif11) siRNA
gcaagactcggtctcaaaaacaa

SEQ ID NO: 3767 - DNA, 23 bp, Artificial Sequence
  mitotic kinesin microtubule-associated protein Eg5 (Kif11) siRNA
caagactcggtctcaaaaacaaa

SEQ ID NO: 3768 - DNA, 23 bp, Artificial Sequence
  mitotic kinesin microtubule-associated protein Eg5 (Kif11) siRNA
aagactcggtctcaaaaacaaaa

SEQ ID NO: 3769 - DNA, 23 bp, Artificial Sequence
  mitotic kinesin microtubule-associated protein Eg5 (Kif11) siRNA
agactcggtctcaaaaacaaaat

SEQ ID NO: 3770 - DNA, 23 bp, Artificial Sequence
  mitotic kinesin microtubule-associated protein Eg5 (Kif11) siRNA
gactcggtctcaaaaacaaaatt

SEQ ID NO: 3771 - DNA, 23 bp, Artificial Sequence
  mitotic kinesin microtubule-associated protein Eg5 (Kif11) siRNA
actcggtctcaaaaacaaaattt

SEQ ID NO: 3772 - DNA, 23 bp, Artificial Sequence
  mitotic kinesin microtubule-associated protein Eg5 (Kif11) siRNA
ctcggtctcaaaaacaaaattta

SEQ ID NO: 3773 - DNA, 23 bp, Artificial Sequence
  mitotic kinesin microtubule-associated protein Eg5 (Kif11) siRNA
tcggtctcaaaaacaaaatttaa

SEQ ID NO: 3774 - DNA, 23 bp, Artificial Sequence
  mitotic kinesin microtubule-associated protein Eg5 (Kif11) siRNA
cggtctcaaaaacaaaatttaaa

SEQ ID NO: 3775 - DNA, 23 bp, Artificial Sequence
  mitotic kinesin microtubule-associated protein Eg5 (Kif11) siRNA
ggtctcaaaaacaaaatttaaaa

SEQ ID NO: 3776 - DNA, 23 bp, Artificial Sequence
  mitotic kinesin microtubule-associated protein Eg5 (Kif11) siRNA
gtctcaaaaacaaaatttaaaaa

SEQ ID NO: 3777 - DNA, 23 bp, Artificial Sequence
  mitotic kinesin microtubule-associated protein Eg5 (Kif11) siRNA
tctcaaaaacaaaatttaaaaaa

SEQ ID NO: 3778 - DNA, 23 bp, Artificial Sequence
  mitotic kinesin microtubule-associated protein Eg5 (Kif11) siRNA
ctcaaaaacaaaatttaaaaaag

SEQ ID NO: 3779 - DNA, 23 bp, Artificial Sequence
  mitotic kinesin microtubule-associated protein Eg5 (Kif11) siRNA
tcaaaaacaaaatttaaaaaaga

SEQ ID NO: 3780 - DNA, 23 bp, Artificial Sequence
  mitotic kinesin microtubule-associated protein Eg5 (Kif11) siRNA
caaaaacaaaatttaaaaaagat

SEQ ID NO: 3781 - DNA, 23 bp, Artificial Sequence
  mitotic kinesin microtubule-associated protein Eg5 (Kif11) siRNA
aaaaacaaaatttaaaaaagata

SEQ ID NO: 3782 - DNA, 23 bp, Artificial Sequence
  mitotic kinesin microtubule-associated protein Eg5 (Kif11) siRNA
aaaacaaaatttaaaaaagatat

SEQ ID NO: 3783 - DNA, 23 bp, Artificial Sequence
  mitotic kinesin microtubule-associated protein Eg5 (Kif11) siRNA
aaacaaaatttaaaaaagatata

SEQ ID NO: 3784 - DNA, 23 bp, Artificial Sequence
  mitotic kinesin microtubule-associated protein Eg5 (Kif11) siRNA
aacaaaatttaaaaaagatataa

SEQ ID NO: 3785 - DNA, 23 bp, Artificial Sequence
  mitotic kinesin microtubule-associated protein Eg5 (Kif11) siRNA
acaaaatttaaaaaagatataag

SEQ ID NO: 3786 - DNA, 23 bp, Artificial Sequence
  mitotic kinesin microtubule-associated protein Eg5 (Kif11) siRNA
caaaatttaaaaaagatataagg

SEQ ID NO: 3787 - DNA, 23 bp, Artificial Sequence
  mitotic kinesin microtubule-associated protein Eg5 (Kif11) siRNA
aaaatttaaaaaagatataaggc

SEQ ID NO: 3788 - DNA, 23 bp, Artificial Sequence
  mitotic kinesin microtubule-associated protein Eg5 (Kif11) siRNA
aaatttaaaaaagatataaggca

SEQ ID NO: 3789 - DNA, 23 bp, Artificial Sequence
  mitotic kinesin microtubule-associated protein Eg5 (Kif11) siRNA
aatttaaaaaagatataaggcag

SEQ ID NO: 3790 - DNA, 23 bp, Artificial Sequence
  mitotic kinesin microtubule-associated protein Eg5 (Kif11) siRNA
atttaaaaaagatataaggcagt

SEQ ID NO: 3791 - DNA, 23 bp, Artificial Sequence
  mitotic kinesin microtubule-associated protein Eg5 (Kif11) siRNA
tttaaaaaagatataaggcagta

SEQ ID NO: 3792 - DNA, 23 bp, Artificial Sequence
  mitotic kinesin microtubule-associated protein Eg5 (Kif11) siRNA
ttaaaaaagatataaggcagtac

SEQ ID NO: 3793 - DNA, 23 bp, Artificial Sequence
  mitotic kinesin microtubule-associated protein Eg5 (Kif11) siRNA
taaaaaagatataaggcagtact

SEQ ID NO: 3794 - DNA, 23 bp, Artificial Sequence
  mitotic kinesin microtubule-associated protein Eg5 (Kif11) siRNA
aaaaaagatataaggcagtactg

SEQ ID NO: 3795 - DNA, 23 bp, Artificial Sequence
  mitotic kinesin microtubule-associated protein Eg5 (Kif11) siRNA
aaaaagatataaggcagtactgt

SEQ ID NO: 3796 - DNA, 23 bp, Artificial Sequence
  mitotic kinesin microtubule-associated protein Eg5 (Kif11) siRNA
aaaagatataaggcagtactgta

SEQ ID NO: 3797 - DNA, 23 bp, Artificial Sequence
  mitotic kinesin microtubule-associated protein Eg5 (Kif11) siRNA
aaagatataaggcagtactgtaa

SEQ ID NO: 3798 - DNA, 23 bp, Artificial Sequence
  mitotic kinesin microtubule-associated protein Eg5 (Kif11) siRNA
aagatataaggcagtactgtaaa

SEQ ID NO: 3799 - DNA, 23 bp, Artificial Sequence
  mitotic kinesin microtubule-associated protein Eg5 (Kif11) siRNA
agatataaggcagtactgtaaat

SEQ ID NO: 3800 - DNA, 23 bp, Artificial Sequence
  mitotic kinesin microtubule-associated protein Eg5 (Kif11) siRNA
gatataaggcagtactgtaaatt

SEQ ID NO: 3801 - DNA, 23 bp, Artificial Sequence
  mitotic kinesin microtubule-associated protein Eg5 (Kif11) siRNA
atataaggcagtactgtaaattc

SEQ ID NO: 3802 - DNA, 23 bp, Artificial Sequence
  mitotic kinesin microtubule-associated protein Eg5 (Kif11) siRNA
tataaggcagtactgtaaattca

SEQ ID NO: 3803 - DNA, 23 bp, Artificial Sequence
  mitotic kinesin microtubule-associated protein Eg5 (Kif11) siRNA
ataaggcagtactgtaaattcag

SEQ ID NO: 3804 - DNA, 23 bp, Artificial Sequence
  mitotic kinesin microtubule-associated protein Eg5 (Kif11) siRNA
taaggcagtactgtaaattcagt

SEQ ID NO: 3805 - DNA, 23 bp, Artificial Sequence
  mitotic kinesin microtubule-associated protein Eg5 (Kif11) siRNA
aaggcagtactgtaaattcagtt

SEQ ID NO: 3806 - DNA, 23 bp, Artificial Sequence
  mitotic kinesin microtubule-associated protein Eg5 (Kif11) siRNA
aggcagtactgtaaattcagttg

SEQ ID NO: 3807 - DNA, 23 bp, Artificial Sequence
  mitotic kinesin microtubule-associated protein Eg5 (Kif11) siRNA
ggcagtactgtaaattcagttga

SEQ ID NO: 3808 - DNA, 23 bp, Artificial Sequence
  mitotic kinesin microtubule-associated protein Eg5 (Kif11) siRNA
gcagtactgtaaattcagttgaa

SEQ ID NO: 3809 - DNA, 23 bp, Artificial Sequence
  mitotic kinesin microtubule-associated protein Eg5 (Kif11) siRNA
cagtactgtaaattcagttgaat

SEQ ID NO: 3810 - DNA, 23 bp, Artificial Sequence
  mitotic kinesin microtubule-associated protein Eg5 (Kif11) siRNA
agtactgtaaattcagttgaatt

SEQ ID NO: 3811 - DNA, 23 bp, Artificial Sequence
  mitotic kinesin microtubule-associated protein Eg5 (Kif11) siRNA
gtactgtaaattcagttgaattt

SEQ ID NO: 3812 - DNA, 23 bp, Artificial Sequence
  mitotic kinesin microtubule-associated protein Eg5 (Kif11) siRNA
tactgtaaattcagttgaatttt

SEQ ID NO: 3813 - DNA, 23 bp, Artificial Sequence
  mitotic kinesin microtubule-associated protein Eg5 (Kif11) siRNA
actgtaaattcagttgaattttg

SEQ ID NO: 3814 - DNA, 23 bp, Artificial Sequence
  mitotic kinesin microtubule-associated protein Eg5 (Kif11) siRNA
ctgtaaattcagttgaattttga

SEQ ID NO: 3815 - DNA, 23 bp, Artificial Sequence
  mitotic kinesin microtubule-associated protein Eg5 (Kif11) siRNA
tgtaaattcagttgaattttgat

SEQ ID NO: 3816 - DNA, 23 bp, Artificial Sequence
  mitotic kinesin microtubule-associated protein Eg5 (Kif11) siRNA
gtaaattcagttgaattttgata

SEQ ID NO: 3817 - DNA, 23 bp, Artificial Sequence
  mitotic kinesin microtubule-associated protein Eg5 (Kif11) siRNA
taaattcagttgaattttgatat

SEQ ID NO: 3818 - DNA, 23 bp, Artificial Sequence
  mitotic kinesin microtubule-associated protein Eg5 (Kif11) siRNA
aaattcagttgaattttgatatc

SEQ ID NO: 3819 - DNA, 23 bp, Artificial Sequence
  mitotic kinesin microtubule-associated protein Eg5 (Kif11) siRNA
aattcagttgaattttgatatct

SEQ ID NO: 3820 - DNA, 23 bp, Artificial Sequence
  mitotic kinesin microtubule-associated protein Eg5 (Kif11) siRNA
attcagttgaattttgatatcta

SEQ ID NO: 3821 - DNA, 23 bp, Artificial Sequence
  mitotic kinesin microtubule-associated protein Eg5 (Kif11) siRNA
ttcagttgaattttgatatctac

SEQ ID NO: 3822 - DNA, 23 bp, Artificial Sequence
  mitotic kinesin microtubule-associated protein Eg5 (Kif11) siRNA
tcagttgaattttgatatctacc

SEQ ID NO: 3823 - DNA, 23 bp, Artificial Sequence
  mitotic kinesin microtubule-associated protein Eg5 (Kif11) siRNA
cagttgaattttgatatctaccc

SEQ ID NO: 3824 - DNA, 23 bp, Artificial Sequence
  mitotic kinesin microtubule-associated protein Eg5 (Kif11) siRNA
agttgaattttgatatctaccca

SEQ ID NO: 3825 - DNA, 23 bp, Artificial Sequence
  mitotic kinesin microtubule-associated protein Eg5 (Kif11) siRNA
gttgaattttgatatctacccat

SEQ ID NO: 3826 - DNA, 23 bp, Artificial Sequence
  mitotic kinesin microtubule-associated protein Eg5 (Kif11) siRNA
ttgaattttgatatctacccatt

SEQ ID NO: 3827 - DNA, 23 bp, Artificial Sequence
  mitotic kinesin microtubule-associated protein Eg5 (Kif11) siRNA
tgaattttgatatctacccattt

SEQ ID NO: 3828 - DNA, 23 bp, Artificial Sequence
  mitotic kinesin microtubule-associated protein Eg5 (Kif11) siRNA
gaattttgatatctacccatttt

SEQ ID NO: 3829 - DNA, 23 bp, Artificial Sequence
  mitotic kinesin microtubule-associated protein Eg5 (Kif11) siRNA
aattttgatatctacccattttt

SEQ ID NO: 3830 - DNA, 23 bp, Artificial Sequence
  mitotic kinesin microtubule-associated protein Eg5 (Kif11) siRNA
attttgatatctacccatttttc

SEQ ID NO: 3831 - DNA, 23 bp, Artificial Sequence
  mitotic kinesin microtubule-associated protein Eg5 (Kif11) siRNA
ttttgatatctacccatttttct

SEQ ID NO: 3832 - DNA, 23 bp, Artificial Sequence
  mitotic kinesin microtubule-associated protein Eg5 (Kif11) siRNA
tttgatatctacccatttttctg

SEQ ID NO: 3833 - DNA, 23 bp, Artificial Sequence
  mitotic kinesin microtubule-associated protein Eg5 (Kif11) siRNA
ttgatatctacccatttttctgt

SEQ ID NO: 3834 - DNA, 23 bp, Artificial Sequence
  mitotic kinesin microtubule-associated protein Eg5 (Kif11) siRNA
tgatatctacccatttttctgtc

SEQ ID NO: 3835 - DNA, 23 bp, Artificial Sequence
  mitotic kinesin microtubule-associated protein Eg5 (Kif11) siRNA
gatatctacccatttttctgtca

SEQ ID NO: 3836 - DNA, 23 bp, Artificial Sequence
  mitotic kinesin microtubule-associated protein Eg5 (Kif11) siRNA
atatctacccatttttctgtcat

SEQ ID NO: 3837 - DNA, 23 bp, Artificial Sequence
  mitotic kinesin microtubule-associated protein Eg5 (Kif11) siRNA
tatctacccatttttctgtcatc

SEQ ID NO: 3838 - DNA, 23 bp, Artificial Sequence
  mitotic kinesin microtubule-associated protein Eg5 (Kif11) siRNA
atctacccatttttctgtcatcc

SEQ ID NO: 3839 - DNA, 23 bp, Artificial Sequence
  mitotic kinesin microtubule-associated protein Eg5 (Kif11) siRNA
tctacccatttttctgtcatccc

SEQ ID NO: 3840 - DNA, 23 bp, Artificial Sequence
  mitotic kinesin microtubule-associated protein Eg5 (Kif11) siRNA
ctacccatttttctgtcatccct

SEQ ID NO: 3841 - DNA, 23 bp, Artificial Sequence
  mitotic kinesin microtubule-associated protein Eg5 (Kif11) siRNA
tacccatttttctgtcatcccta

SEQ ID NO: 3842 - DNA, 23 bp, Artificial Sequence
  mitotic kinesin microtubule-associated protein Eg5 (Kif11) siRNA
acccatttttctgtcatccctat

SEQ ID NO: 3843 - DNA, 23 bp, Artificial Sequence
  mitotic kinesin microtubule-associated protein Eg5 (Kif11) siRNA
cccatttttctgtcatccctata

SEQ ID NO: 3844 - DNA, 23 bp, Artificial Sequence
  mitotic kinesin microtubule-associated protein Eg5 (Kif11) siRNA
ccatttttctgtcatccctatag

SEQ ID NO: 3845 - DNA, 23 bp, Artificial Sequence
  mitotic kinesin microtubule-associated protein Eg5 (Kif11) siRNA
catttttctgtcatccctatagt

SEQ ID NO: 3846 - DNA, 23 bp, Artificial Sequence
  mitotic kinesin microtubule-associated protein Eg5 (Kif11) siRNA
atttttctgtcatccctatagtt

SEQ ID NO: 3847 - DNA, 23 bp, Artificial Sequence
  mitotic kinesin microtubule-associated protein Eg5 (Kif11) siRNA
tttttctgtcatccctatagttc

SEQ ID NO: 3848 - DNA, 23 bp, Artificial Sequence
  mitotic kinesin microtubule-associated protein Eg5 (Kif11) siRNA
ttttctgtcatccctatagttca

SEQ ID NO: 3849 - DNA, 23 bp, Artificial Sequence
  mitotic kinesin microtubule-associated protein Eg5 (Kif11) siRNA
tttctgtcatccctatagttcac

SEQ ID NO: 3850 - DNA, 23 bp, Artificial Sequence
  mitotic kinesin microtubule-associated protein Eg5 (Kif11) siRNA
ttctgtcatccctatagttcact

SEQ ID NO: 3851 - DNA, 23 bp, Artificial Sequence
  mitotic kinesin microtubule-associated protein Eg5 (Kif11) siRNA
tctgtcatccctatagttcactt

SEQ ID NO: 3852 - DNA, 23 bp, Artificial Sequence
  mitotic kinesin microtubule-associated protein Eg5 (Kif11) siRNA
ctgtcatccctatagttcacttt

SEQ ID NO: 3853 - DNA, 23 bp, Artificial Sequence
  mitotic kinesin microtubule-associated protein Eg5 (Kif11) siRNA
tgtcatccctatagttcactttg

SEQ ID NO: 3854 - DNA, 23 bp, Artificial Sequence
  mitotic kinesin microtubule-associated protein Eg5 (Kif11) siRNA
gtcatccctatagttcactttgt

SEQ ID NO: 3855 - DNA, 23 bp, Artificial Sequence
  mitotic kinesin microtubule-associated protein Eg5 (Kif11) siRNA
tcatccctatagttcactttgta

SEQ ID NO: 3856 - DNA, 23 bp, Artificial Sequence
  mitotic kinesin microtubule-associated protein Eg5 (Kif11) siRNA
catccctatagttcactttgtat

SEQ ID NO: 3857 - DNA, 23 bp, Artificial Sequence
  mitotic kinesin microtubule-associated protein Eg5 (Kif11) siRNA
atccctatagttcactttgtatt

SEQ ID NO: 3858 - DNA, 23 bp, Artificial Sequence
  mitotic kinesin microtubule-associated protein Eg5 (Kif11) siRNA
tccctatagttcactttgtatta

SEQ ID NO: 3859 - DNA, 23 bp, Artificial Sequence
  mitotic kinesin microtubule-associated protein Eg5 (Kif11) siRNA
ccctatagttcactttgtattaa

SEQ ID NO: 3860 - DNA, 23 bp, Artificial Sequence
  mitotic kinesin microtubule-associated protein Eg5 (Kif11) siRNA
cctatagttcactttgtattaaa

SEQ ID NO: 3861 - DNA, 23 bp, Artificial Sequence
  mitotic kinesin microtubule-associated protein Eg5 (Kif11) siRNA
ctatagttcactttgtattaaat

SEQ ID NO: 3862 - DNA, 23 bp, Artificial Sequence
  mitotic kinesin microtubule-associated protein Eg5 (Kif11) siRNA
tatagttcactttgtattaaatt

SEQ ID NO: 3863 - DNA, 23 bp, Artificial Sequence
  mitotic kinesin microtubule-associated protein Eg5 (Kif11) siRNA
atagttcactttgtattaaattg

SEQ ID NO: 3864 - DNA, 23 bp, Artificial Sequence
  mitotic kinesin microtubule-associated protein Eg5 (Kif11) siRNA
tagttcactttgtattaaattgg

SEQ ID NO: 3865 - DNA, 23 bp, Artificial Sequence
  mitotic kinesin microtubule-associated protein Eg5 (Kif11) siRNA
agttcactttgtattaaattggg

SEQ ID NO: 3866 - DNA, 23 bp, Artificial Sequence
  mitotic kinesin microtubule-associated protein Eg5 (Kif11) siRNA
gttcactttgtattaaattgggt

SEQ ID NO: 3867 - DNA, 23 bp, Artificial Sequence
  mitotic kinesin microtubule-associated protein Eg5 (Kif11) siRNA
ttcactttgtattaaattgggtt

SEQ ID NO: 3868 - DNA, 23 bp, Artificial Sequence
  mitotic kinesin microtubule-associated protein Eg5 (Kif11) siRNA
tcactttgtattaaattgggttt

SEQ ID NO: 3869 - DNA, 23 bp, Artificial Sequence
  mitotic kinesin microtubule-associated protein Eg5 (Kif11) siRNA
cactttgtattaaattgggtttc

SEQ ID NO: 3870 - DNA, 23 bp, Artificial Sequence
  mitotic kinesin microtubule-associated protein Eg5 (Kif11) siRNA
actttgtattaaattgggtttca

SEQ ID NO: 3871 - DNA, 23 bp, Artificial Sequence
  mitotic kinesin microtubule-associated protein Eg5 (Kif11) siRNA
ctttgtattaaattgggtttcat

SEQ ID NO: 3872 - DNA, 23 bp, Artificial Sequence
  mitotic kinesin microtubule-associated protein Eg5 (Kif11) siRNA
tttgtattaaattgggtttcatt

SEQ ID NO: 3873 - DNA, 23 bp, Artificial Sequence
  mitotic kinesin microtubule-associated protein Eg5 (Kif11) siRNA
ttgtattaaattgggtttcattt

SEQ ID NO: 3874 - DNA, 23 bp, Artificial Sequence
  mitotic kinesin microtubule-associated protein Eg5 (Kif11) siRNA
tgtattaaattgggtttcatttg

SEQ ID NO: 3875 - DNA, 23 bp, Artificial Sequence
  mitotic kinesin microtubule-associated protein Eg5 (Kif11) siRNA
gtattaaattgggtttcatttgg

SEQ ID NO: 3876 - DNA, 23 bp, Artificial Sequence
  mitotic kinesin microtubule-associated protein Eg5 (Kif11) siRNA
tattaaattgggtttcatttggg

SEQ ID NO: 3877 - DNA, 23 bp, Artificial Sequence
  mitotic kinesin microtubule-associated protein Eg5 (Kif11) siRNA
attaaattgggtttcatttggga

SEQ ID NO: 3878 - DNA, 23 bp, Artificial Sequence
  mitotic kinesin microtubule-associated protein Eg5 (Kif11) siRNA
ttaaattgggtttcatttgggat

SEQ ID NO: 3879 - DNA, 23 bp, Artificial Sequence
  mitotic kinesin microtubule-associated protein Eg5 (Kif11) siRNA
taaattgggtttcatttgggatt

SEQ ID NO: 3880 - DNA, 23 bp, Artificial Sequence
  mitotic kinesin microtubule-associated protein Eg5 (Kif11) siRNA
aaattgggtttcatttgggattt

SEQ ID NO: 3881 - DNA, 23 bp, Artificial Sequence
  mitotic kinesin microtubule-associated protein Eg5 (Kif11) siRNA
aattgggtttcatttgggatttg

SEQ ID NO: 3882 - DNA, 23 bp, Artificial Sequence
  mitotic kinesin microtubule-associated protein Eg5 (Kif11) siRNA
attgggtttcatttgggatttgc

SEQ ID NO: 3883 - DNA, 23 bp, Artificial Sequence
  mitotic kinesin microtubule-associated protein Eg5 (Kif11) siRNA
ttgggtttcatttgggatttgca

SEQ ID NO: 3884 - DNA, 23 bp, Artificial Sequence
  mitotic kinesin microtubule-associated protein Eg5 (Kif11) siRNA
tgggtttcatttgggatttgcaa

SEQ ID NO: 3885 - DNA, 23 bp, Artificial Sequence
  mitotic kinesin microtubule-associated protein Eg5 (Kif11) siRNA
gggtttcatttgggatttgcaat

SEQ ID NO: 3886 - DNA, 23 bp, Artificial Sequence
  mitotic kinesin microtubule-associated protein Eg5 (Kif11) siRNA
ggtttcatttgggatttgcaatg

SEQ ID NO: 3887 - DNA, 23 bp, Artificial Sequence
  mitotic kinesin microtubule-associated protein Eg5 (Kif11) siRNA
gtttcatttgggatttgcaatgt

SEQ ID NO: 3888 - DNA, 23 bp, Artificial Sequence
  mitotic kinesin microtubule-associated protein Eg5 (Kif11) siRNA
tttcatttgggatttgcaatgta

SEQ ID NO: 3889 - DNA, 23 bp, Artificial Sequence
  mitotic kinesin microtubule-associated protein Eg5 (Kif11) siRNA
ttcatttgggatttgcaatgtaa

SEQ ID NO: 3890 - DNA, 23 bp, Artificial Sequence
  mitotic kinesin microtubule-associated protein Eg5 (Kif11) siRNA
tcatttgggatttgcaatgtaaa

SEQ ID NO: 3891 - DNA, 23 bp, Artificial Sequence
  mitotic kinesin microtubule-associated protein Eg5 (Kif11) siRNA
catttgggatttgcaatgtaaat

SEQ ID NO: 3892 - DNA, 23 bp, Artificial Sequence
  mitotic kinesin microtubule-associated protein Eg5 (Kif11) siRNA
atttgggatttgcaatgtaaata

SEQ ID NO: 3893 - DNA, 23 bp, Artificial Sequence
  mitotic kinesin microtubule-associated protein Eg5 (Kif11) siRNA
tttgggatttgcaatgtaaatac

SEQ ID NO: 3894 - DNA, 23 bp, Artificial Sequence
  mitotic kinesin microtubule-associated protein Eg5 (Kif11) siRNA
ttgggatttgcaatgtaaatacg

SEQ ID NO: 3895 - DNA, 23 bp, Artificial Sequence
  mitotic kinesin microtubule-associated protein Eg5 (Kif11) siRNA
tgggatttgcaatgtaaatacgt

SEQ ID NO: 3896 - DNA, 23 bp, Artificial Sequence
  mitotic kinesin microtubule-associated protein Eg5 (Kif11) siRNA
gggatttgcaatgtaaatacgta

SEQ ID NO: 3897 - DNA, 23 bp, Artificial Sequence
  mitotic kinesin microtubule-associated protein Eg5 (Kif11) siRNA
ggatttgcaatgtaaatacgtat

SEQ ID NO: 3898 - DNA, 23 bp, Artificial Sequence
  mitotic kinesin microtubule-associated protein Eg5 (Kif11) siRNA
gatttgcaatgtaaatacgtatt

SEQ ID NO: 3899 - DNA, 23 bp, Artificial Sequence
  mitotic kinesin microtubule-associated protein Eg5 (Kif11) siRNA
atttgcaatgtaaatacgtattt

SEQ ID NO: 3900 - DNA, 23 bp, Artificial Sequence
  mitotic kinesin microtubule-associated protein Eg5 (Kif11) siRNA
tttgcaatgtaaatacgtatttc

SEQ ID NO: 3901 - DNA, 23 bp, Artificial Sequence
  mitotic kinesin microtubule-associated protein Eg5 (Kif11) siRNA
ttgcaatgtaaatacgtatttct

SEQ ID NO: 3902 - DNA, 23 bp, Artificial Sequence
  mitotic kinesin microtubule-associated protein Eg5 (Kif11) siRNA
tgcaatgtaaatacgtatttcta

SEQ ID NO: 3903 - DNA, 23 bp, Artificial Sequence
  mitotic kinesin microtubule-associated protein Eg5 (Kif11) siRNA
gcaatgtaaatacgtatttctag

SEQ ID NO: 3904 - DNA, 23 bp, Artificial Sequence
  mitotic kinesin microtubule-associated protein Eg5 (Kif11) siRNA
caatgtaaatacgtatttctagt

SEQ ID NO: 3905 - DNA, 23 bp, Artificial Sequence
  mitotic kinesin microtubule-associated protein Eg5 (Kif11) siRNA
aatgtaaatacgtatttctagtt

SEQ ID NO: 3906 - DNA, 23 bp, Artificial Sequence
  mitotic kinesin microtubule-associated protein Eg5 (Kif11) siRNA
atgtaaatacgtatttctagttt

SEQ ID NO: 3907 - DNA, 23 bp, Artificial Sequence
  mitotic kinesin microtubule-associated protein Eg5 (Kif11) siRNA
tgtaaatacgtatttctagtttt

SEQ ID NO: 3908 - DNA, 23 bp, Artificial Sequence
  mitotic kinesin microtubule-associated protein Eg5 (Kif11) siRNA
gtaaatacgtatttctagttttc

SEQ ID NO: 3909 - DNA, 23 bp, Artificial Sequence
  mitotic kinesin microtubule-associated protein Eg5 (Kif11) siRNA
taaatacgtatttctagttttca

SEQ ID NO: 3910 - DNA, 23 bp, Artificial Sequence
  mitotic kinesin microtubule-associated protein Eg5 (Kif11) siRNA
aaatacgtatttctagttttcat

SEQ ID NO: 3911 - DNA, 23 bp, Artificial Sequence
  mitotic kinesin microtubule-associated protein Eg5 (Kif11) siRNA
aatacgtatttctagttttcata

SEQ ID NO: 3912 - DNA, 23 bp, Artificial Sequence
  mitotic kinesin microtubule-associated protein Eg5 (Kif11) siRNA
atacgtatttctagttttcatat

SEQ ID NO: 3913 - DNA, 23 bp, Artificial Sequence
  mitotic kinesin microtubule-associated protein Eg5 (Kif11) siRNA
tacgtatttctagttttcatata

SEQ ID NO: 3914 - DNA, 23 bp, Artificial Sequence
  mitotic kinesin microtubule-associated protein Eg5 (Kif11) siRNA
acgtatttctagttttcatataa

SEQ ID NO: 3915 - DNA, 23 bp, Artificial Sequence
  mitotic kinesin microtubule-associated protein Eg5 (Kif11) siRNA
cgtatttctagttttcatataaa

SEQ ID NO: 3916 - DNA, 23 bp, Artificial Sequence
  mitotic kinesin microtubule-associated protein Eg5 (Kif11) siRNA
gtatttctagttttcatataaag

SEQ ID NO: 3917 - DNA, 23 bp, Artificial Sequence
  mitotic kinesin microtubule-associated protein Eg5 (Kif11) siRNA
tatttctagttttcatataaagt

SEQ ID NO: 3918 - DNA, 23 bp, Artificial Sequence
  mitotic kinesin microtubule-associated protein Eg5 (Kif11) siRNA
atttctagttttcatataaagta

SEQ ID NO: 3919 - DNA, 23 bp, Artificial Sequence
  mitotic kinesin microtubule-associated protein Eg5 (Kif11) siRNA
tttctagttttcatataaagtag

SEQ ID NO: 3920 - DNA, 23 bp, Artificial Sequence
  mitotic kinesin microtubule-associated protein Eg5 (Kif11) siRNA
ttctagttttcatataaagtagt

SEQ ID NO: 3921 - DNA, 23 bp, Artificial Sequence
  mitotic kinesin microtubule-associated protein Eg5 (Kif11) siRNA
tctagttttcatataaagtagtt

SEQ ID NO: 3922 - DNA, 23 bp, Artificial Sequence
  mitotic kinesin microtubule-associated protein Eg5 (Kif11) siRNA
ctagttttcatataaagtagttc

SEQ ID NO: 3923 - DNA, 23 bp, Artificial Sequence
  mitotic kinesin microtubule-associated protein Eg5 (Kif11) siRNA
tagttttcatataaagtagttct

SEQ ID NO: 3924 - DNA, 23 bp, Artificial Sequence
  mitotic kinesin microtubule-associated protein Eg5 (Kif11) siRNA
agttttcatataaagtagttctt

SEQ ID NO: 3925 - DNA, 23 bp, Artificial Sequence
  mitotic kinesin microtubule-associated protein Eg5 (Kif11) siRNA
gttttcatataaagtagttcttt

SEQ ID NO: 3926 - DNA, 23 bp, Artificial Sequence
  mitotic kinesin microtubule-associated protein Eg5 (Kif11) siRNA
ttttcatataaagtagttctttt

SEQ ID NO: 3927 - DNA, 23 bp, Artificial Sequence
  mitotic kinesin microtubule-associated protein Eg5 (Kif11) siRNA
tttcatataaagtagttctttta

SEQ ID NO: 3928 - DNA, 23 bp, Artificial Sequence
  mitotic kinesin microtubule-associated protein Eg5 (Kif11) siRNA
ttcatataaagtagttcttttat

SEQ ID NO: 3929 - DNA, 23 bp, Artificial Sequence
  mitotic kinesin microtubule-associated protein Eg5 (Kif11) siRNA
tcatataaagtagttcttttata

SEQ ID NO: 3930 - DNA, 23 bp, Artificial Sequence
  mitotic kinesin microtubule-associated protein Eg5 (Kif11) siRNA
catataaagtagttcttttataa

SEQ ID NO: 3931 - DNA, 23 bp, Artificial Sequence
  mitotic kinesin microtubule-associated protein Eg5 (Kif11) siRNA
atataaagtagttcttttataac

SEQ ID NO: 3932 - DNA, 23 bp, Artificial Sequence
  mitotic kinesin microtubule-associated protein Eg5 (Kif11) siRNA
tataaagtagttcttttataaca

SEQ ID NO: 3933 - DNA, 23 bp, Artificial Sequence
  mitotic kinesin microtubule-associated protein Eg5 (Kif11) siRNA
ataaagtagttcttttataacaa

SEQ ID NO: 3934 - DNA, 23 bp, Artificial Sequence
  mitotic kinesin microtubule-associated protein Eg5 (Kif11) siRNA
taaagtagttcttttataacaaa

SEQ ID NO: 3935 - DNA, 23 bp, Artificial Sequence
  mitotic kinesin microtubule-associated protein Eg5 (Kif11) siRNA
aaagtagttcttttataacaaat

SEQ ID NO: 3936 - DNA, 23 bp, Artificial Sequence
  mitotic kinesin microtubule-associated protein Eg5 (Kif11) siRNA
aagtagttcttttataacaaatg

SEQ ID NO: 3937 - DNA, 23 bp, Artificial Sequence
  mitotic kinesin microtubule-associated protein Eg5 (Kif11) siRNA
agtagttcttttataacaaatga

SEQ ID NO: 3938 - DNA, 23 bp, Artificial Sequence
  mitotic kinesin microtubule-associated protein Eg5 (Kif11) siRNA
gtagttcttttataacaaatgaa

SEQ ID NO: 3939 - DNA, 23 bp, Artificial Sequence
  mitotic kinesin microtubule-associated protein Eg5 (Kif11) siRNA
tagttcttttataacaaatgaaa

SEQ ID NO: 3940 - DNA, 23 bp, Artificial Sequence
  mitotic kinesin microtubule-associated protein Eg5 (Kif11) siRNA
agttcttttataacaaatgaaaa

SEQ ID NO: 3941 - DNA, 23 bp, Artificial Sequence
  mitotic kinesin microtubule-associated protein Eg5 (Kif11) siRNA
gttcttttataacaaatgaaaag

SEQ ID NO: 3942 - DNA, 23 bp, Artificial Sequence
  mitotic kinesin microtubule-associated protein Eg5 (Kif11) siRNA
ttcttttataacaaatgaaaagt

SEQ ID NO: 3943 - DNA, 23 bp, Artificial Sequence
  mitotic kinesin microtubule-associated protein Eg5 (Kif11) siRNA
tcttttataacaaatgaaaagta

SEQ ID NO: 3944 - DNA, 23 bp, Artificial Sequence
  mitotic kinesin microtubule-associated protein Eg5 (Kif11) siRNA
cttttataacaaatgaaaagtat

SEQ ID NO: 3945 - DNA, 23 bp, Artificial Sequence
  mitotic kinesin microtubule-associated protein Eg5 (Kif11) siRNA
ttttataacaaatgaaaagtatt

SEQ ID NO: 3946 - DNA, 23 bp, Artificial Sequence
  mitotic kinesin microtubule-associated protein Eg5 (Kif11) siRNA
tttataacaaatgaaaagtattt

SEQ ID NO: 3947 - DNA, 23 bp, Artificial Sequence
  mitotic kinesin microtubule-associated protein Eg5 (Kif11) siRNA
ttataacaaatgaaaagtatttt

SEQ ID NO: 3948 - DNA, 23 bp, Artificial Sequence
  mitotic kinesin microtubule-associated protein Eg5 (Kif11) siRNA
tataacaaatgaaaagtattttt

SEQ ID NO: 3949 - DNA, 23 bp, Artificial Sequence
  mitotic kinesin microtubule-associated protein Eg5 (Kif11) siRNA
ataacaaatgaaaagtatttttc

SEQ ID NO: 3950 - DNA, 23 bp, Artificial Sequence
  mitotic kinesin microtubule-associated protein Eg5 (Kif11) siRNA
taacaaatgaaaagtatttttct

SEQ ID NO: 3951 - DNA, 23 bp, Artificial Sequence
  mitotic kinesin microtubule-associated protein Eg5 (Kif11) siRNA
aacaaatgaaaagtatttttctt

SEQ ID NO: 3952 - DNA, 23 bp, Artificial Sequence
  mitotic kinesin microtubule-associated protein Eg5 (Kif11) siRNA
acaaatgaaaagtatttttcttg

SEQ ID NO: 3953 - DNA, 23 bp, Artificial Sequence
  mitotic kinesin microtubule-associated protein Eg5 (Kif11) siRNA
caaatgaaaagtatttttcttgt

SEQ ID NO: 3954 - DNA, 23 bp, Artificial Sequence
  mitotic kinesin microtubule-associated protein Eg5 (Kif11) siRNA
aaatgaaaagtatttttcttgta

SEQ ID NO: 3955 - DNA, 23 bp, Artificial Sequence
  mitotic kinesin microtubule-associated protein Eg5 (Kif11) siRNA
aatgaaaagtatttttcttgtat

SEQ ID NO: 3956 - DNA, 23 bp, Artificial Sequence
  mitotic kinesin microtubule-associated protein Eg5 (Kif11) siRNA
atgaaaagtatttttcttgtata

SEQ ID NO: 3957 - DNA, 23 bp, Artificial Sequence
  mitotic kinesin microtubule-associated protein Eg5 (Kif11) siRNA
tgaaaagtatttttcttgtatat

SEQ ID NO: 3958 - DNA, 23 bp, Artificial Sequence
  mitotic kinesin microtubule-associated protein Eg5 (Kif11) siRNA
gaaaagtatttttcttgtatatt

SEQ ID NO: 3959 - DNA, 23 bp, Artificial Sequence
  mitotic kinesin microtubule-associated protein Eg5 (Kif11) siRNA
aaaagtatttttcttgtatatta

SEQ ID NO: 3960 - DNA, 23 bp, Artificial Sequence
  mitotic kinesin microtubule-associated protein Eg5 (Kif11) siRNA
aaagtatttttcttgtatattat

SEQ ID NO: 3961 - DNA, 23 bp, Artificial Sequence
  mitotic kinesin microtubule-associated protein Eg5 (Kif11) siRNA
aagtatttttcttgtatattatt

SEQ ID NO: 3962 - DNA, 23 bp, Artificial Sequence
  mitotic kinesin microtubule-associated protein Eg5 (Kif11) siRNA
agtatttttcttgtatattatta

SEQ ID NO: 3963 - DNA, 23 bp, Artificial Sequence
  mitotic kinesin microtubule-associated protein Eg5 (Kif11) siRNA
gtatttttcttgtatattattaa

SEQ ID NO: 3964 - DNA, 23 bp, Artificial Sequence
  mitotic kinesin microtubule-associated protein Eg5 (Kif11) siRNA
tatttttcttgtatattattaag

SEQ ID NO: 3965 - DNA, 23 bp, Artificial Sequence
  mitotic kinesin microtubule-associated protein Eg5 (Kif11) siRNA
atttttcttgtatattattaagt

SEQ ID NO: 3966 - DNA, 23 bp, Artificial Sequence
  mitotic kinesin microtubule-associated protein Eg5 (Kif11) siRNA
tttttcttgtatattattaagta

SEQ ID NO: 3967 - DNA, 23 bp, Artificial Sequence
  mitotic kinesin microtubule-associated protein Eg5 (Kif11) siRNA
ttttcttgtatattattaagtaa

SEQ ID NO: 3968 - DNA, 23 bp, Artificial Sequence
  mitotic kinesin microtubule-associated protein Eg5 (Kif11) siRNA
tttcttgtatattattaagtaat

SEQ ID NO: 3969 - DNA, 23 bp, Artificial Sequence
  mitotic kinesin microtubule-associated protein Eg5 (Kif11) siRNA
ttcttgtatattattaagtaatg

SEQ ID NO: 3970 - DNA, 23 bp, Artificial Sequence
  mitotic kinesin microtubule-associated protein Eg5 (Kif11) siRNA
tcttgtatattattaagtaatga

SEQ ID NO: 3971 - DNA, 23 bp, Artificial Sequence
  mitotic kinesin microtubule-associated protein Eg5 (Kif11) siRNA
cttgtatattattaagtaatgaa

SEQ ID NO: 3972 - DNA, 23 bp, Artificial Sequence
  mitotic kinesin microtubule-associated protein Eg5 (Kif11) siRNA
ttgtatattattaagtaatgaat

SEQ ID NO: 3973 - DNA, 23 bp, Artificial Sequence
  mitotic kinesin microtubule-associated protein Eg5 (Kif11) siRNA
tgtatattattaagtaatgaata

SEQ ID NO: 3974 - DNA, 23 bp, Artificial Sequence
  mitotic kinesin microtubule-associated protein Eg5 (Kif11) siRNA
gtatattattaagtaatgaatat

SEQ ID NO: 3975 - DNA, 23 bp, Artificial Sequence
  mitotic kinesin microtubule-associated protein Eg5 (Kif11) siRNA
tatattattaagtaatgaatata

SEQ ID NO: 3976 - DNA, 23 bp, Artificial Sequence
  mitotic kinesin microtubule-associated protein Eg5 (Kif11) siRNA
atattattaagtaatgaatatat

SEQ ID NO: 3977 - DNA, 23 bp, Artificial Sequence
  mitotic kinesin microtubule-associated protein Eg5 (Kif11) siRNA
tattattaagtaatgaatatata

SEQ ID NO: 3978 - DNA, 23 bp, Artificial Sequence
  mitotic kinesin microtubule-associated protein Eg5 (Kif11) siRNA
attattaagtaatgaatatataa

SEQ ID NO: 3979 - DNA, 23 bp, Artificial Sequence
  mitotic kinesin microtubule-associated protein Eg5 (Kif11) siRNA
ttattaagtaatgaatatataag

SEQ ID NO: 3980 - DNA, 23 bp, Artificial Sequence
  mitotic kinesin microtubule-associated protein Eg5 (Kif11) siRNA
tattaagtaatgaatatataaga

SEQ ID NO: 3981 - DNA, 23 bp, Artificial Sequence
  mitotic kinesin microtubule-associated protein Eg5 (Kif11) siRNA
attaagtaatgaatatataagaa

SEQ ID NO: 3982 - DNA, 23 bp, Artificial Sequence
  mitotic kinesin microtubule-associated protein Eg5 (Kif11) siRNA
ttaagtaatgaatatataagaac

SEQ ID NO: 3983 - DNA, 23 bp, Artificial Sequence
  mitotic kinesin microtubule-associated protein Eg5 (Kif11) siRNA
taagtaatgaatatataagaact

SEQ ID NO: 3984 - DNA, 23 bp, Artificial Sequence
  mitotic kinesin microtubule-associated protein Eg5 (Kif11) siRNA
aagtaatgaatatataagaactg

SEQ ID NO: 3985 - DNA, 23 bp, Artificial Sequence
  mitotic kinesin microtubule-associated protein Eg5 (Kif11) siRNA
agtaatgaatatataagaactgt

SEQ ID NO: 3986 - DNA, 23 bp, Artificial Sequence
  mitotic kinesin microtubule-associated protein Eg5 (Kif11) siRNA
gtaatgaatatataagaactgta

SEQ ID NO: 3987 - DNA, 23 bp, Artificial Sequence
  mitotic kinesin microtubule-associated protein Eg5 (Kif11) siRNA
taatgaatatataagaactgtac

SEQ ID NO: 3988 - DNA, 23 bp, Artificial Sequence
  mitotic kinesin microtubule-associated protein Eg5 (Kif11) siRNA
aatgaatatataagaactgtact

SEQ ID NO: 3989 - DNA, 23 bp, Artificial Sequence
  mitotic kinesin microtubule-associated protein Eg5 (Kif11) siRNA
atgaatatataagaactgtactc

SEQ ID NO: 3990 - DNA, 23 bp, Artificial Sequence
  mitotic kinesin microtubule-associated protein Eg5 (Kif11) siRNA
tgaatatataagaactgtactct

SEQ ID NO: 3991 - DNA, 23 bp, Artificial Sequence
  mitotic kinesin microtubule-associated protein Eg5 (Kif11) siRNA
gaatatataagaactgtactctt

SEQ ID NO: 3992 - DNA, 23 bp, Artificial Sequence
  mitotic kinesin microtubule-associated protein Eg5 (Kif11) siRNA
aatatataagaactgtactcttc

SEQ ID NO: 3993 - DNA, 23 bp, Artificial Sequence
  mitotic kinesin microtubule-associated protein Eg5 (Kif11) siRNA
atatataagaactgtactcttct

SEQ ID NO: 3994 - DNA, 23 bp, Artificial Sequence
  mitotic kinesin microtubule-associated protein Eg5 (Kif11) siRNA
tatataagaactgtactcttctc

SEQ ID NO: 3995 - DNA, 23 bp, Artificial Sequence
  mitotic kinesin microtubule-associated protein Eg5 (Kif11) siRNA
atataagaactgtactcttctca

SEQ ID NO: 3996 - DNA, 23 bp, Artificial Sequence
  mitotic kinesin microtubule-associated protein Eg5 (Kif11) siRNA
tataagaactgtactcttctcag

SEQ ID NO: 3997 - DNA, 23 bp, Artificial Sequence
  mitotic kinesin microtubule-associated protein Eg5 (Kif11) siRNA
ataagaactgtactcttctcagc

SEQ ID NO: 3998 - DNA, 23 bp, Artificial Sequence
  mitotic kinesin microtubule-associated protein Eg5 (Kif11) siRNA
taagaactgtactcttctcagct

SEQ ID NO: 3999 - DNA, 23 bp, Artificial Sequence
  mitotic kinesin microtubule-associated protein Eg5 (Kif11) siRNA
aagaactgtactcttctcagctt

SEQ ID NO: 4000 - DNA, 23 bp, Artificial Sequence
  mitotic kinesin microtubule-associated protein Eg5 (Kif11) siRNA
agaactgtactcttctcagcttg

SEQ ID NO: 4001 - DNA, 23 bp, Artificial Sequence
  mitotic kinesin microtubule-associated protein Eg5 (Kif11) siRNA
gaactgtactcttctcagcttga

SEQ ID NO: 4002 - DNA, 23 bp, Artificial Sequence
  mitotic kinesin microtubule-associated protein Eg5 (Kif11) siRNA
aactgtactcttctcagcttgag

SEQ ID NO: 4003 - DNA, 23 bp, Artificial Sequence
  mitotic kinesin microtubule-associated protein Eg5 (Kif11) siRNA
actgtactcttctcagcttgagc

SEQ ID NO: 4004 - DNA, 23 bp, Artificial Sequence
  mitotic kinesin microtubule-associated protein Eg5 (Kif11) siRNA
ctgtactcttctcagcttgagct

SEQ ID NO: 4005 - DNA, 23 bp, Artificial Sequence
  mitotic kinesin microtubule-associated protein Eg5 (Kif11) siRNA
tgtactcttctcagcttgagctt

SEQ ID NO: 4006 - DNA, 23 bp, Artificial Sequence
  mitotic kinesin microtubule-associated protein Eg5 (Kif11) siRNA
gtactcttctcagcttgagctta

SEQ ID NO: 4007 - DNA, 23 bp, Artificial Sequence
  mitotic kinesin microtubule-associated protein Eg5 (Kif11) siRNA
tactcttctcagcttgagcttaa

SEQ ID NO: 4008 - DNA, 23 bp, Artificial Sequence
  mitotic kinesin microtubule-associated protein Eg5 (Kif11) siRNA
actcttctcagcttgagcttaac

SEQ ID NO: 4009 - DNA, 23 bp, Artificial Sequence
  mitotic kinesin microtubule-associated protein Eg5 (Kif11) siRNA
ctcttctcagcttgagcttaaca

SEQ ID NO: 4010 - DNA, 23 bp, Artificial Sequence
  mitotic kinesin microtubule-associated protein Eg5 (Kif11) siRNA
tcttctcagcttgagcttaacat

SEQ ID NO: 4011 - DNA, 23 bp, Artificial Sequence
  mitotic kinesin microtubule-associated protein Eg5 (Kif11) siRNA
cttctcagcttgagcttaacata

SEQ ID NO: 4012 - DNA, 23 bp, Artificial Sequence
  mitotic kinesin microtubule-associated protein Eg5 (Kif11) siRNA
ttctcagcttgagcttaacatag

SEQ ID NO: 4013 - DNA, 23 bp, Artificial Sequence
  mitotic kinesin microtubule-associated protein Eg5 (Kif11) siRNA
tctcagcttgagcttaacatagg

SEQ ID NO: 4014 - DNA, 23 bp, Artificial Sequence
  mitotic kinesin microtubule-associated protein Eg5 (Kif11) siRNA
ctcagcttgagcttaacataggt

SEQ ID NO: 4015 - DNA, 23 bp, Artificial Sequence
  mitotic kinesin microtubule-associated protein Eg5 (Kif11) siRNA
tcagcttgagcttaacataggta

SEQ ID NO: 4016 - DNA, 23 bp, Artificial Sequence
  mitotic kinesin microtubule-associated protein Eg5 (Kif11) siRNA
cagcttgagcttaacataggtaa

SEQ ID NO: 4017 - DNA, 23 bp, Artificial Sequence
  mitotic kinesin microtubule-associated protein Eg5 (Kif11) siRNA
agcttgagcttaacataggtaaa

SEQ ID NO: 4018 - DNA, 23 bp, Artificial Sequence
  mitotic kinesin microtubule-associated protein Eg5 (Kif11) siRNA
gcttgagcttaacataggtaaat

SEQ ID NO: 4019 - DNA, 23 bp, Artificial Sequence
  mitotic kinesin microtubule-associated protein Eg5 (Kif11) siRNA
cttgagcttaacataggtaaata

SEQ ID NO: 4020 - DNA, 23 bp, Artificial Sequence
  mitotic kinesin microtubule-associated protein Eg5 (Kif11) siRNA
ttgagcttaacataggtaaatat

SEQ ID NO: 4021 - DNA, 23 bp, Artificial Sequence
  mitotic kinesin microtubule-associated protein Eg5 (Kif11) siRNA
tgagcttaacataggtaaatatc

SEQ ID NO: 4022 - DNA, 23 bp, Artificial Sequence
  mitotic kinesin microtubule-associated protein Eg5 (Kif11) siRNA
gagcttaacataggtaaatatca

SEQ ID NO: 4023 - DNA, 23 bp, Artificial Sequence
  mitotic kinesin microtubule-associated protein Eg5 (Kif11) siRNA
agcttaacataggtaaatatcac

SEQ ID NO: 4024 - DNA, 23 bp, Artificial Sequence
  mitotic kinesin microtubule-associated protein Eg5 (Kif11) siRNA
gcttaacataggtaaatatcacc

SEQ ID NO: 4025 - DNA, 23 bp, Artificial Sequence
  mitotic kinesin microtubule-associated protein Eg5 (Kif11) siRNA
cttaacataggtaaatatcacca

SEQ ID NO: 4026 - DNA, 23 bp, Artificial Sequence
  mitotic kinesin microtubule-associated protein Eg5 (Kif11) siRNA
ttaacataggtaaatatcaccaa

SEQ ID NO: 4027 - DNA, 23 bp, Artificial Sequence
  mitotic kinesin microtubule-associated protein Eg5 (Kif11) siRNA
taacataggtaaatatcaccaac

SEQ ID NO: 4028 - DNA, 23 bp, Artificial Sequence
  mitotic kinesin microtubule-associated protein Eg5 (Kif11) siRNA
aacataggtaaatatcaccaaca

SEQ ID NO: 4029 - DNA, 23 bp, Artificial Sequence
  mitotic kinesin microtubule-associated protein Eg5 (Kif11) siRNA
acataggtaaatatcaccaacat

SEQ ID NO: 4030 - DNA, 23 bp, Artificial Sequence
  mitotic kinesin microtubule-associated protein Eg5 (Kif11) siRNA
cataggtaaatatcaccaacatc

SEQ ID NO: 4031 - DNA, 23 bp, Artificial Sequence
  mitotic kinesin microtubule-associated protein Eg5 (Kif11) siRNA
ataggtaaatatcaccaacatct

SEQ ID NO: 4032 - DNA, 23 bp, Artificial Sequence
  mitotic kinesin microtubule-associated protein Eg5 (Kif11) siRNA
taggtaaatatcaccaacatctg

SEQ ID NO: 4033 - DNA, 23 bp, Artificial Sequence
  mitotic kinesin microtubule-associated protein Eg5 (Kif11) siRNA
aggtaaatatcaccaacatctgt

SEQ ID NO: 4034 - DNA, 23 bp, Artificial Sequence
  mitotic kinesin microtubule-associated protein Eg5 (Kif11) siRNA
ggtaaatatcaccaacatctgtc

SEQ ID NO: 4035 - DNA, 23 bp, Artificial Sequence
  mitotic kinesin microtubule-associated protein Eg5 (Kif11) siRNA
gtaaatatcaccaacatctgtcc

SEQ ID NO: 4036 - DNA, 23 bp, Artificial Sequence
  mitotic kinesin microtubule-associated protein Eg5 (Kif11) siRNA
taaatatcaccaacatctgtcct

SEQ ID NO: 4037 - DNA, 23 bp, Artificial Sequence
  mitotic kinesin microtubule-associated protein Eg5 (Kif11) siRNA
aaatatcaccaacatctgtcctt

SEQ ID NO: 4038 - DNA, 23 bp, Artificial Sequence
  mitotic kinesin microtubule-associated protein Eg5 (Kif11) siRNA
aatatcaccaacatctgtcctta

SEQ ID NO: 4039 - DNA, 23 bp, Artificial Sequence
  mitotic kinesin microtubule-associated protein Eg5 (Kif11) siRNA
atatcaccaacatctgtccttag

SEQ ID NO: 4040 - DNA, 23 bp, Artificial Sequence
  mitotic kinesin microtubule-associated protein Eg5 (Kif11) siRNA
tatcaccaacatctgtccttaga

SEQ ID NO: 4041 - DNA, 23 bp, Artificial Sequence
  mitotic kinesin microtubule-associated protein Eg5 (Kif11) siRNA
atcaccaacatctgtccttagaa

SEQ ID NO: 4042 - DNA, 23 bp, Artificial Sequence
  mitotic kinesin microtubule-associated protein Eg5 (Kif11) siRNA
tcaccaacatctgtccttagaaa

SEQ ID NO: 4043 - DNA, 23 bp, Artificial Sequence
  mitotic kinesin microtubule-associated protein Eg5 (Kif11) siRNA
caccaacatctgtccttagaaag

SEQ ID NO: 4044 - DNA, 23 bp, Artificial Sequence
  mitotic kinesin microtubule-associated protein Eg5 (Kif11) siRNA
accaacatctgtccttagaaagg

SEQ ID NO: 4045 - DNA, 23 bp, Artificial Sequence
  mitotic kinesin microtubule-associated protein Eg5 (Kif11) siRNA
ccaacatctgtccttagaaagga

SEQ ID NO: 4046 - DNA, 23 bp, Artificial Sequence
  mitotic kinesin microtubule-associated protein Eg5 (Kif11) siRNA
caacatctgtccttagaaaggac

SEQ ID NO: 4047 - DNA, 23 bp, Artificial Sequence
  mitotic kinesin microtubule-associated protein Eg5 (Kif11) siRNA
aacatctgtccttagaaaggacc

SEQ ID NO: 4048 - DNA, 23 bp, Artificial Sequence
  mitotic kinesin microtubule-associated protein Eg5 (Kif11) siRNA
acatctgtccttagaaaggacca

SEQ ID NO: 4049 - DNA, 23 bp, Artificial Sequence
  mitotic kinesin microtubule-associated protein Eg5 (Kif11) siRNA
catctgtccttagaaaggaccat

SEQ ID NO: 4050 - DNA, 23 bp, Artificial Sequence
  mitotic kinesin microtubule-associated protein Eg5 (Kif11) siRNA
atctgtccttagaaaggaccatc

SEQ ID NO: 4051 - DNA, 23 bp, Artificial Sequence
  mitotic kinesin microtubule-associated protein Eg5 (Kif11) siRNA
tctgtccttagaaaggaccatct

SEQ ID NO: 4052 - DNA, 23 bp, Artificial Sequence
  mitotic kinesin microtubule-associated protein Eg5 (Kif11) siRNA
ctgtccttagaaaggaccatctc

SEQ ID NO: 4053 - DNA, 23 bp, Artificial Sequence
  mitotic kinesin microtubule-associated protein Eg5 (Kif11) siRNA
tgtccttagaaaggaccatctca

SEQ ID NO: 4054 - DNA, 23 bp, Artificial Sequence
  mitotic kinesin microtubule-associated protein Eg5 (Kif11) siRNA
gtccttagaaaggaccatctcat

SEQ ID NO: 4055 - DNA, 23 bp, Artificial Sequence
  mitotic kinesin microtubule-associated protein Eg5 (Kif11) siRNA
tccttagaaaggaccatctcatg

SEQ ID NO: 4056 - DNA, 23 bp, Artificial Sequence
  mitotic kinesin microtubule-associated protein Eg5 (Kif11) siRNA
ccttagaaaggaccatctcatgt

SEQ ID NO: 4057 - DNA, 23 bp, Artificial Sequence
  mitotic kinesin microtubule-associated protein Eg5 (Kif11) siRNA
cttagaaaggaccatctcatgtt

SEQ ID NO: 4058 - DNA, 23 bp, Artificial Sequence
  mitotic kinesin microtubule-associated protein Eg5 (Kif11) siRNA
ttagaaaggaccatctcatgttt

SEQ ID NO: 4059 - DNA, 23 bp, Artificial Sequence
  mitotic kinesin microtubule-associated protein Eg5 (Kif11) siRNA
tagaaaggaccatctcatgtttt

SEQ ID NO: 4060 - DNA, 23 bp, Artificial Sequence
  mitotic kinesin microtubule-associated protein Eg5 (Kif11) siRNA
agaaaggaccatctcatgttttt

SEQ ID NO: 4061 - DNA, 23 bp, Artificial Sequence
  mitotic kinesin microtubule-associated protein Eg5 (Kif11) siRNA
gaaaggaccatctcatgtttttt

SEQ ID NO: 4062 - DNA, 23 bp, Artificial Sequence
  mitotic kinesin microtubule-associated protein Eg5 (Kif11) siRNA
aaaggaccatctcatgttttttt

SEQ ID NO: 4063 - DNA, 23 bp, Artificial Sequence
  mitotic kinesin microtubule-associated protein Eg5 (Kif11) siRNA
aaggaccatctcatgtttttttt

SEQ ID NO: 4064 - DNA, 23 bp, Artificial Sequence
  mitotic kinesin microtubule-associated protein Eg5 (Kif11) siRNA
aggaccatctcatgttttttttc

SEQ ID NO: 4065 - DNA, 23 bp, Artificial Sequence
  mitotic kinesin microtubule-associated protein Eg5 (Kif11) siRNA
ggaccatctcatgttttttttct

SEQ ID NO: 4066 - DNA, 23 bp, Artificial Sequence
  mitotic kinesin microtubule-associated protein Eg5 (Kif11) siRNA
gaccatctcatgttttttttctt

SEQ ID NO: 4067 - DNA, 23 bp, Artificial Sequence
  mitotic kinesin microtubule-associated protein Eg5 (Kif11) siRNA
accatctcatgttttttttcttg

SEQ ID NO: 4068 - DNA, 23 bp, Artificial Sequence
  mitotic kinesin microtubule-associated protein Eg5 (Kif11) siRNA
ccatctcatgttttttttcttgc

SEQ ID NO: 4069 - DNA, 23 bp, Artificial Sequence
  mitotic kinesin microtubule-associated protein Eg5 (Kif11) siRNA
catctcatgttttttttcttgct

SEQ ID NO: 4070 - DNA, 23 bp, Artificial Sequence
  mitotic kinesin microtubule-associated protein Eg5 (Kif11) siRNA
atctcatgttttttttcttgcta

SEQ ID NO: 4071 - DNA, 23 bp, Artificial Sequence
  mitotic kinesin microtubule-associated protein Eg5 (Kif11) siRNA
tctcatgttttttttcttgctat

SEQ ID NO: 4072 - DNA, 23 bp, Artificial Sequence
  mitotic kinesin microtubule-associated protein Eg5 (Kif11) siRNA
ctcatgttttttttcttgctatg

SEQ ID NO: 4073 - DNA, 23 bp, Artificial Sequence
  mitotic kinesin microtubule-associated protein Eg5 (Kif11) siRNA
tcatgttttttttcttgctatga

SEQ ID NO: 4074 - DNA, 23 bp, Artificial Sequence
  mitotic kinesin microtubule-associated protein Eg5 (Kif11) siRNA
catgttttttttcttgctatgac

SEQ ID NO: 4075 - DNA, 23 bp, Artificial Sequence
  mitotic kinesin microtubule-associated protein Eg5 (Kif11) siRNA
atgttttttttcttgctatgact

SEQ ID NO: 4076 - DNA, 23 bp, Artificial Sequence
  mitotic kinesin microtubule-associated protein Eg5 (Kif11) siRNA
tgttttttttcttgctatgactt

SEQ ID NO: 4077 - DNA, 23 bp, Artificial Sequence
  mitotic kinesin microtubule-associated protein Eg5 (Kif11) siRNA
gttttttttcttgctatgacttg

SEQ ID NO: 4078 - DNA, 23 bp, Artificial Sequence
  mitotic kinesin microtubule-associated protein Eg5 (Kif11) siRNA
ttttttttcttgctatgacttgt

SEQ ID NO: 4079 - DNA, 23 bp, Artificial Sequence
  mitotic kinesin microtubule-associated protein Eg5 (Kif11) siRNA
tttttttcttgctatgacttgtg

SEQ ID NO: 4080 - DNA, 23 bp, Artificial Sequence
  mitotic kinesin microtubule-associated protein Eg5 (Kif11) siRNA
ttttttcttgctatgacttgtgt

SEQ ID NO: 4081 - DNA, 23 bp, Artificial Sequence
  mitotic kinesin microtubule-associated protein Eg5 (Kif11) siRNA
tttttcttgctatgacttgtgta

SEQ ID NO: 4082 - DNA, 23 bp, Artificial Sequence
  mitotic kinesin microtubule-associated protein Eg5 (Kif11) siRNA
ttttcttgctatgacttgtgtat

SEQ ID NO: 4083 - DNA, 23 bp, Artificial Sequence
  mitotic kinesin microtubule-associated protein Eg5 (Kif11) siRNA
tttcttgctatgacttgtgtatt

SEQ ID NO: 4084 - DNA, 23 bp, Artificial Sequence
  mitotic kinesin microtubule-associated protein Eg5 (Kif11) siRNA
ttcttgctatgacttgtgtattt

SEQ ID NO: 4085 - DNA, 23 bp, Artificial Sequence
  mitotic kinesin microtubule-associated protein Eg5 (Kif11) siRNA
tcttgctatgacttgtgtatttt

SEQ ID NO: 4086 - DNA, 23 bp, Artificial Sequence
  mitotic kinesin microtubule-associated protein Eg5 (Kif11) siRNA
cttgctatgacttgtgtattttc

SEQ ID NO: 4087 - DNA, 23 bp, Artificial Sequence
  mitotic kinesin microtubule-associated protein Eg5 (Kif11) siRNA
ttgctatgacttgtgtattttct

SEQ ID NO: 4088 - DNA, 23 bp, Artificial Sequence
  mitotic kinesin microtubule-associated protein Eg5 (Kif11) siRNA
tgctatgacttgtgtattttctt

SEQ ID NO: 4089 - DNA, 23 bp, Artificial Sequence
  mitotic kinesin microtubule-associated protein Eg5 (Kif11) siRNA
gctatgacttgtgtattttcttg

SEQ ID NO: 4090 - DNA, 23 bp, Artificial Sequence
  mitotic kinesin microtubule-associated protein Eg5 (Kif11) siRNA
ctatgacttgtgtattttcttgc

SEQ ID NO: 4091 - DNA, 23 bp, Artificial Sequence
  mitotic kinesin microtubule-associated protein Eg5 (Kif11) siRNA
tatgacttgtgtattttcttgca

SEQ ID NO: 4092 - DNA, 23 bp, Artificial Sequence
  mitotic kinesin microtubule-associated protein Eg5 (Kif11) siRNA
atgacttgtgtattttcttgcat

SEQ ID NO: 4093 - DNA, 23 bp, Artificial Sequence
  mitotic kinesin microtubule-associated protein Eg5 (Kif11) siRNA
tgacttgtgtattttcttgcatc

SEQ ID NO: 4094 - DNA, 23 bp, Artificial Sequence
  mitotic kinesin microtubule-associated protein Eg5 (Kif11) siRNA
gacttgtgtattttcttgcatcc

SEQ ID NO: 4095 - DNA, 23 bp, Artificial Sequence
  mitotic kinesin microtubule-associated protein Eg5 (Kif11) siRNA
acttgtgtattttcttgcatcct

SEQ ID NO: 4096 - DNA, 23 bp, Artificial Sequence
  mitotic kinesin microtubule-associated protein Eg5 (Kif11) siRNA
cttgtgtattttcttgcatcctc

SEQ ID NO: 4097 - DNA, 23 bp, Artificial Sequence
  mitotic kinesin microtubule-associated protein Eg5 (Kif11) siRNA
ttgtgtattttcttgcatcctcc

SEQ ID NO: 4098 - DNA, 23 bp, Artificial Sequence
  mitotic kinesin microtubule-associated protein Eg5 (Kif11) siRNA
tgtgtattttcttgcatcctccc

SEQ ID NO: 4099 - DNA, 23 bp, Artificial Sequence
  mitotic kinesin microtubule-associated protein Eg5 (Kif11) siRNA
gtgtattttcttgcatcctccct

SEQ ID NO: 4100 - DNA, 23 bp, Artificial Sequence
  mitotic kinesin microtubule-associated protein Eg5 (Kif11) siRNA
tgtattttcttgcatcctcccta

SEQ ID NO: 4101 - DNA, 23 bp, Artificial Sequence
  mitotic kinesin microtubule-associated protein Eg5 (Kif11) siRNA
gtattttcttgcatcctccctag

SEQ ID NO: 4102 - DNA, 23 bp, Artificial Sequence
  mitotic kinesin microtubule-associated protein Eg5 (Kif11) siRNA
tattttcttgcatcctccctaga

SEQ ID NO: 4103 - DNA, 23 bp, Artificial Sequence
  mitotic kinesin microtubule-associated protein Eg5 (Kif11) siRNA
attttcttgcatcctccctagac

SEQ ID NO: 4104 - DNA, 23 bp, Artificial Sequence
  mitotic kinesin microtubule-associated protein Eg5 (Kif11) siRNA
ttttcttgcatcctccctagact

SEQ ID NO: 4105 - DNA, 23 bp, Artificial Sequence
  mitotic kinesin microtubule-associated protein Eg5 (Kif11) siRNA
tttcttgcatcctccctagactt

SEQ ID NO: 4106 - DNA, 23 bp, Artificial Sequence
  mitotic kinesin microtubule-associated protein Eg5 (Kif11) siRNA
ttcttgcatcctccctagacttc

SEQ ID NO: 4107 - DNA, 23 bp, Artificial Sequence
  mitotic kinesin microtubule-associated protein Eg5 (Kif11) siRNA
tcttgcatcctccctagacttcc

SEQ ID NO: 4108 - DNA, 23 bp, Artificial Sequence
  mitotic kinesin microtubule-associated protein Eg5 (Kif11) siRNA
cttgcatcctccctagacttccc

SEQ ID NO: 4109 - DNA, 23 bp, Artificial Sequence
  mitotic kinesin microtubule-associated protein Eg5 (Kif11) siRNA
ttgcatcctccctagacttccct

SEQ ID NO: 4110 - DNA, 23 bp, Artificial Sequence
  mitotic kinesin microtubule-associated protein Eg5 (Kif11) siRNA
tgcatcctccctagacttcccta

SEQ ID NO: 4111 - DNA, 23 bp, Artificial Sequence
  mitotic kinesin microtubule-associated protein Eg5 (Kif11) siRNA
gcatcctccctagacttccctat

SEQ ID NO: 4112 - DNA, 23 bp, Artificial Sequence
  mitotic kinesin microtubule-associated protein Eg5 (Kif11) siRNA
catcctccctagacttccctatt

SEQ ID NO: 4113 - DNA, 23 bp, Artificial Sequence
  mitotic kinesin microtubule-associated protein Eg5 (Kif11) siRNA
atcctccctagacttccctattt

SEQ ID NO: 4114 - DNA, 23 bp, Artificial Sequence
  mitotic kinesin microtubule-associated protein Eg5 (Kif11) siRNA
tcctccctagacttccctatttc

SEQ ID NO: 4115 - DNA, 23 bp, Artificial Sequence
  mitotic kinesin microtubule-associated protein Eg5 (Kif11) siRNA
cctccctagacttccctatttcg

SEQ ID NO: 4116 - DNA, 23 bp, Artificial Sequence
  mitotic kinesin microtubule-associated protein Eg5 (Kif11) siRNA
ctccctagacttccctatttcgc

SEQ ID NO: 4117 - DNA, 23 bp, Artificial Sequence
  mitotic kinesin microtubule-associated protein Eg5 (Kif11) siRNA
tccctagacttccctatttcgct

SEQ ID NO: 4118 - DNA, 23 bp, Artificial Sequence
  mitotic kinesin microtubule-associated protein Eg5 (Kif11) siRNA
ccctagacttccctatttcgctt

SEQ ID NO: 4119 - DNA, 23 bp, Artificial Sequence
  mitotic kinesin microtubule-associated protein Eg5 (Kif11) siRNA
cctagacttccctatttcgcttt

SEQ ID NO: 4120 - DNA, 23 bp, Artificial Sequence
  mitotic kinesin microtubule-associated protein Eg5 (Kif11) siRNA
ctagacttccctatttcgctttc

SEQ ID NO: 4121 - DNA, 23 bp, Artificial Sequence
  mitotic kinesin microtubule-associated protein Eg5 (Kif11) siRNA
tagacttccctatttcgctttct

SEQ ID NO: 4122 - DNA, 23 bp, Artificial Sequence
  mitotic kinesin microtubule-associated protein Eg5 (Kif11) siRNA
agacttccctatttcgctttctc

SEQ ID NO: 4123 - DNA, 23 bp, Artificial Sequence
  mitotic kinesin microtubule-associated protein Eg5 (Kif11) siRNA
gacttccctatttcgctttctcc

SEQ ID NO: 4124 - DNA, 23 bp, Artificial Sequence
  mitotic kinesin microtubule-associated protein Eg5 (Kif11) siRNA
acttccctatttcgctttctcct

SEQ ID NO: 4125 - DNA, 23 bp, Artificial Sequence
  mitotic kinesin microtubule-associated protein Eg5 (Kif11) siRNA
cttccctatttcgctttctcctc

SEQ ID NO: 4126 - DNA, 23 bp, Artificial Sequence
  mitotic kinesin microtubule-associated protein Eg5 (Kif11) siRNA
ttccctatttcgctttctcctcg

SEQ ID NO: 4127 - DNA, 23 bp, Artificial Sequence
  mitotic kinesin microtubule-associated protein Eg5 (Kif11) siRNA
tccctatttcgctttctcctcgg

SEQ ID NO: 4128 - DNA, 23 bp, Artificial Sequence
  mitotic kinesin microtubule-associated protein Eg5 (Kif11) siRNA
ccctatttcgctttctcctcggc

SEQ ID NO: 4129 - DNA, 23 bp, Artificial Sequence
  mitotic kinesin microtubule-associated protein Eg5 (Kif11) siRNA
cctatttcgctttctcctcggct

SEQ ID NO: 4130 - DNA, 23 bp, Artificial Sequence
  mitotic kinesin microtubule-associated protein Eg5 (Kif11) siRNA
ctatttcgctttctcctcggctc

SEQ ID NO: 4131 - DNA, 23 bp, Artificial Sequence
  mitotic kinesin microtubule-associated protein Eg5 (Kif11) siRNA
tatttcgctttctcctcggctca

SEQ ID NO: 4132 - DNA, 23 bp, Artificial Sequence
  mitotic kinesin microtubule-associated protein Eg5 (Kif11) siRNA
atttcgctttctcctcggctcac

SEQ ID NO: 4133 - DNA, 23 bp, Artificial Sequence
  mitotic kinesin microtubule-associated protein Eg5 (Kif11) siRNA
tttcgctttctcctcggctcact

SEQ ID NO: 4134 - DNA, 23 bp, Artificial Sequence
  mitotic kinesin microtubule-associated protein Eg5 (Kif11) siRNA
ttcgctttctcctcggctcactt

SEQ ID NO: 4135 - DNA, 23 bp, Artificial Sequence
  mitotic kinesin microtubule-associated protein Eg5 (Kif11) siRNA
tcgctttctcctcggctcacttt

SEQ ID NO: 4136 - DNA, 23 bp, Artificial Sequence
  mitotic kinesin microtubule-associated protein Eg5 (Kif11) siRNA
cgctttctcctcggctcactttc

SEQ ID NO: 4137 - DNA, 23 bp, Artificial Sequence
  mitotic kinesin microtubule-associated protein Eg5 (Kif11) siRNA
gctttctcctcggctcactttct

SEQ ID NO: 4138 - DNA, 23 bp, Artificial Sequence
  mitotic kinesin microtubule-associated protein Eg5 (Kif11) siRNA
ctttctcctcggctcactttctc

SEQ ID NO: 4139 - DNA, 23 bp, Artificial Sequence
  mitotic kinesin microtubule-associated protein Eg5 (Kif11) siRNA
tttctcctcggctcactttctcc

SEQ ID NO: 4140 - DNA, 23 bp, Artificial Sequence
  mitotic kinesin microtubule-associated protein Eg5 (Kif11) siRNA
ttctcctcggctcactttctccc

SEQ ID NO: 4141 - DNA, 23 bp, Artificial Sequence
  mitotic kinesin microtubule-associated protein Eg5 (Kif11) siRNA
tctcctcggctcactttctccct

SEQ ID NO: 4142 - DNA, 23 bp, Artificial Sequence
  mitotic kinesin microtubule-associated protein Eg5 (Kif11) siRNA
ctcctcggctcactttctccctt

SEQ ID NO: 4143 - DNA, 23 bp, Artificial Sequence
  mitotic kinesin microtubule-associated protein Eg5 (Kif11) siRNA
tcctcggctcactttctcccttt

SEQ ID NO: 4144 - DNA, 23 bp, Artificial Sequence
  mitotic kinesin microtubule-associated protein Eg5 (Kif11) siRNA
cctcggctcactttctccctttt

SEQ ID NO: 4145 - DNA, 23 bp, Artificial Sequence
  mitotic kinesin microtubule-associated protein Eg5 (Kif11) siRNA
ctcggctcactttctcccttttt

SEQ ID NO: 4146 - DNA, 23 bp, Artificial Sequence
  mitotic kinesin microtubule-associated protein Eg5 (Kif11) siRNA
tcggctcactttctcccttttta

SEQ ID NO: 4147 - DNA, 23 bp, Artificial Sequence
  mitotic kinesin microtubule-associated protein Eg5 (Kif11) siRNA
cggctcactttctccctttttat

SEQ ID NO: 4148 - DNA, 23 bp, Artificial Sequence
  mitotic kinesin microtubule-associated protein Eg5 (Kif11) siRNA
ggctcactttctccctttttatt

SEQ ID NO: 4149 - DNA, 23 bp, Artificial Sequence
  mitotic kinesin microtubule-associated protein Eg5 (Kif11) siRNA
gctcactttctccctttttattt

SEQ ID NO: 4150 - DNA, 23 bp, Artificial Sequence
  mitotic kinesin microtubule-associated protein Eg5 (Kif11) siRNA
ctcactttctccctttttatttt

SEQ ID NO: 4151 - DNA, 23 bp, Artificial Sequence
  mitotic kinesin microtubule-associated protein Eg5 (Kif11) siRNA
tcactttctccctttttattttt

SEQ ID NO: 4152 - DNA, 23 bp, Artificial Sequence
  mitotic kinesin microtubule-associated protein Eg5 (Kif11) siRNA
cactttctccctttttatttttc

SEQ ID NO: 4153 - DNA, 23 bp, Artificial Sequence
  mitotic kinesin microtubule-associated protein Eg5 (Kif11) siRNA
actttctccctttttatttttca

SEQ ID NO: 4154 - DNA, 23 bp, Artificial Sequence
  mitotic kinesin microtubule-associated protein Eg5 (Kif11) siRNA
ctttctccctttttatttttcac

SEQ ID NO: 4155 - DNA, 23 bp, Artificial Sequence
  mitotic kinesin microtubule-associated protein Eg5 (Kif11) siRNA
tttctccctttttatttttcacc

SEQ ID NO: 4156 - DNA, 23 bp, Artificial Sequence
  mitotic kinesin microtubule-associated protein Eg5 (Kif11) siRNA
ttctccctttttatttttcacca

SEQ ID NO: 4157 - DNA, 23 bp, Artificial Sequence
  mitotic kinesin microtubule-associated protein Eg5 (Kif11) siRNA
tctccctttttatttttcaccaa

SEQ ID NO: 4158 - DNA, 23 bp, Artificial Sequence
  mitotic kinesin microtubule-associated protein Eg5 (Kif11) siRNA
ctccctttttatttttcaccaaa

SEQ ID NO: 4159 - DNA, 23 bp, Artificial Sequence
  mitotic kinesin microtubule-associated protein Eg5 (Kif11) siRNA
tccctttttatttttcaccaaac

SEQ ID NO: 4160 - DNA, 23 bp, Artificial Sequence
  mitotic kinesin microtubule-associated protein Eg5 (Kif11) siRNA
ccctttttatttttcaccaaacc

SEQ ID NO: 4161 - DNA, 23 bp, Artificial Sequence
  mitotic kinesin microtubule-associated protein Eg5 (Kif11) siRNA
cctttttatttttcaccaaacca

SEQ ID NO: 4162 - DNA, 23 bp, Artificial Sequence
  mitotic kinesin microtubule-associated protein Eg5 (Kif11) siRNA
ctttttatttttcaccaaaccat

SEQ ID NO: 4163 - DNA, 23 bp, Artificial Sequence
  mitotic kinesin microtubule-associated protein Eg5 (Kif11) siRNA
tttttatttttcaccaaaccatt

SEQ ID NO: 4164 - DNA, 23 bp, Artificial Sequence
  mitotic kinesin microtubule-associated protein Eg5 (Kif11) siRNA
ttttatttttcaccaaaccattt

SEQ ID NO: 4165 - DNA, 23 bp, Artificial Sequence
  mitotic kinesin microtubule-associated protein Eg5 (Kif11) siRNA
tttatttttcaccaaaccatttg

SEQ ID NO: 4166 - DNA, 23 bp, Artificial Sequence
  mitotic kinesin microtubule-associated protein Eg5 (Kif11) siRNA
ttatttttcaccaaaccatttgt

SEQ ID NO: 4167 - DNA, 23 bp, Artificial Sequence
  mitotic kinesin microtubule-associated protein Eg5 (Kif11) siRNA
tatttttcaccaaaccatttgta

SEQ ID NO: 4168 - DNA, 23 bp, Artificial Sequence
  mitotic kinesin microtubule-associated protein Eg5 (Kif11) siRNA
atttttcaccaaaccatttgtag

SEQ ID NO: 4169 - DNA, 23 bp, Artificial Sequence
  mitotic kinesin microtubule-associated protein Eg5 (Kif11) siRNA
tttttcaccaaaccatttgtaga

SEQ ID NO: 4170 - DNA, 23 bp, Artificial Sequence
  mitotic kinesin microtubule-associated protein Eg5 (Kif11) siRNA
ttttcaccaaaccatttgtagag

SEQ ID NO: 4171 - DNA, 23 bp, Artificial Sequence
  mitotic kinesin microtubule-associated protein Eg5 (Kif11) siRNA
tttcaccaaaccatttgtagagc

SEQ ID NO: 4172 - DNA, 23 bp, Artificial Sequence
  mitotic kinesin microtubule-associated protein Eg5 (Kif11) siRNA
ttcaccaaaccatttgtagagct

SEQ ID NO: 4173 - DNA, 23 bp, Artificial Sequence
  mitotic kinesin microtubule-associated protein Eg5 (Kif11) siRNA
tcaccaaaccatttgtagagcta

SEQ ID NO: 4174 - DNA, 23 bp, Artificial Sequence
  mitotic kinesin microtubule-associated protein Eg5 (Kif11) siRNA
caccaaaccatttgtagagctac

SEQ ID NO: 4175 - DNA, 23 bp, Artificial Sequence
  mitotic kinesin microtubule-associated protein Eg5 (Kif11) siRNA
accaaaccatttgtagagctaca

SEQ ID NO: 4176 - DNA, 23 bp, Artificial Sequence
  mitotic kinesin microtubule-associated protein Eg5 (Kif11) siRNA
ccaaaccatttgtagagctacaa

SEQ ID NO: 4177 - DNA, 23 bp, Artificial Sequence
  mitotic kinesin microtubule-associated protein Eg5 (Kif11) siRNA
caaaccatttgtagagctacaaa

SEQ ID NO: 4178 - DNA, 23 bp, Artificial Sequence
  mitotic kinesin microtubule-associated protein Eg5 (Kif11) siRNA
aaaccatttgtagagctacaaaa

SEQ ID NO: 4179 - DNA, 23 bp, Artificial Sequence
  mitotic kinesin microtubule-associated protein Eg5 (Kif11) siRNA
aaccatttgtagagctacaaaac

SEQ ID NO: 4180 - DNA, 23 bp, Artificial Sequence
  mitotic kinesin microtubule-associated protein Eg5 (Kif11) siRNA
accatttgtagagctacaaaacc

SEQ ID NO: 4181 - DNA, 23 bp, Artificial Sequence
  mitotic kinesin microtubule-associated protein Eg5 (Kif11) siRNA
ccatttgtagagctacaaaacct

SEQ ID NO: 4182 - DNA, 23 bp, Artificial Sequence
  mitotic kinesin microtubule-associated protein Eg5 (Kif11) siRNA
catttgtagagctacaaaaccta

SEQ ID NO: 4183 - DNA, 23 bp, Artificial Sequence
  mitotic kinesin microtubule-associated protein Eg5 (Kif11) siRNA
atttgtagagctacaaaacctat

SEQ ID NO: 4184 - DNA, 23 bp, Artificial Sequence
  mitotic kinesin microtubule-associated protein Eg5 (Kif11) siRNA
tttgtagagctacaaaacctatc

SEQ ID NO: 4185 - DNA, 23 bp, Artificial Sequence
  mitotic kinesin microtubule-associated protein Eg5 (Kif11) siRNA
ttgtagagctacaaaacctatcc

SEQ ID NO: 4186 - DNA, 23 bp, Artificial Sequence
  mitotic kinesin microtubule-associated protein Eg5 (Kif11) siRNA
tgtagagctacaaaacctatcct

SEQ ID NO: 4187 - DNA, 23 bp, Artificial Sequence
  mitotic kinesin microtubule-associated protein Eg5 (Kif11) siRNA
gtagagctacaaaacctatcctt

SEQ ID NO: 4188 - DNA, 23 bp, Artificial Sequence
  mitotic kinesin microtubule-associated protein Eg5 (Kif11) siRNA
tagagctacaaaacctatccttt

SEQ ID NO: 4189 - DNA, 23 bp, Artificial Sequence
  mitotic kinesin microtubule-associated protein Eg5 (Kif11) siRNA
agagctacaaaacctatcctttc

SEQ ID NO: 4190 - DNA, 23 bp, Artificial Sequence
  mitotic kinesin microtubule-associated protein Eg5 (Kif11) siRNA
gagctacaaaacctatcctttct

SEQ ID NO: 4191 - DNA, 23 bp, Artificial Sequence
  mitotic kinesin microtubule-associated protein Eg5 (Kif11) siRNA
agctacaaaacctatcctttctt

SEQ ID NO: 4192 - DNA, 23 bp, Artificial Sequence
  mitotic kinesin microtubule-associated protein Eg5 (Kif11) siRNA
gctacaaaacctatcctttctta

SEQ ID NO: 4193 - DNA, 23 bp, Artificial Sequence
  mitotic kinesin microtubule-associated protein Eg5 (Kif11) siRNA
ctacaaaacctatcctttcttat

SEQ ID NO: 4194 - DNA, 23 bp, Artificial Sequence
  mitotic kinesin microtubule-associated protein Eg5 (Kif11) siRNA
tacaaaacctatcctttcttatt

SEQ ID NO: 4195 - DNA, 23 bp, Artificial Sequence
  mitotic kinesin microtubule-associated protein Eg5 (Kif11) siRNA
acaaaacctatcctttcttattt

SEQ ID NO: 4196 - DNA, 23 bp, Artificial Sequence
  mitotic kinesin microtubule-associated protein Eg5 (Kif11) siRNA
caaaacctatcctttcttatttt

SEQ ID NO: 4197 - DNA, 23 bp, Artificial Sequence
  mitotic kinesin microtubule-associated protein Eg5 (Kif11) siRNA
aaaacctatcctttcttattttc

SEQ ID NO: 4198 - DNA, 23 bp, Artificial Sequence
  mitotic kinesin microtubule-associated protein Eg5 (Kif11) siRNA
aaacctatcctttcttattttca

SEQ ID NO: 4199 - DNA, 23 bp, Artificial Sequence
  mitotic kinesin microtubule-associated protein Eg5 (Kif11) siRNA
aacctatcctttcttattttcag

SEQ ID NO: 4200 - DNA, 23 bp, Artificial Sequence
  mitotic kinesin microtubule-associated protein Eg5 (Kif11) siRNA
acctatcctttcttattttcagt

SEQ ID NO: 4201 - DNA, 23 bp, Artificial Sequence
  mitotic kinesin microtubule-associated protein Eg5 (Kif11) siRNA
cctatcctttcttattttcagta

SEQ ID NO: 4202 - DNA, 23 bp, Artificial Sequence
  mitotic kinesin microtubule-associated protein Eg5 (Kif11) siRNA
ctatcctttcttattttcagtag

SEQ ID NO: 4203 - DNA, 23 bp, Artificial Sequence
  mitotic kinesin microtubule-associated protein Eg5 (Kif11) siRNA
tatcctttcttattttcagtagt

SEQ ID NO: 4204 - DNA, 23 bp, Artificial Sequence
  mitotic kinesin microtubule-associated protein Eg5 (Kif11) siRNA
atcctttcttattttcagtagtc

SEQ ID NO: 4205 - DNA, 23 bp, Artificial Sequence
  mitotic kinesin microtubule-associated protein Eg5 (Kif11) siRNA
tcctttcttattttcagtagtca

SEQ ID NO: 4206 - DNA, 23 bp, Artificial Sequence
  mitotic kinesin microtubule-associated protein Eg5 (Kif11) siRNA
cctttcttattttcagtagtcag

SEQ ID NO: 4207 - DNA, 23 bp, Artificial Sequence
  mitotic kinesin microtubule-associated protein Eg5 (Kif11) siRNA
ctttcttattttcagtagtcaga

SEQ ID NO: 4208 - DNA, 23 bp, Artificial Sequence
  mitotic kinesin microtubule-associated protein Eg5 (Kif11) siRNA
tttcttattttcagtagtcagaa

SEQ ID NO: 4209 - DNA, 23 bp, Artificial Sequence
  mitotic kinesin microtubule-associated protein Eg5 (Kif11) siRNA
ttcttattttcagtagtcagaat

SEQ ID NO: 4210 - DNA, 23 bp, Artificial Sequence
  mitotic kinesin microtubule-associated protein Eg5 (Kif11) siRNA
tcttattttcagtagtcagaatt

SEQ ID NO: 4211 - DNA, 23 bp, Artificial Sequence
  mitotic kinesin microtubule-associated protein Eg5 (Kif11) siRNA
cttattttcagtagtcagaattt

SEQ ID NO: 4212 - DNA, 23 bp, Artificial Sequence
  mitotic kinesin microtubule-associated protein Eg5 (Kif11) siRNA
ttattttcagtagtcagaatttt

SEQ ID NO: 4213 - DNA, 23 bp, Artificial Sequence
  mitotic kinesin microtubule-associated protein Eg5 (Kif11) siRNA
tattttcagtagtcagaatttta

SEQ ID NO: 4214 - DNA, 23 bp, Artificial Sequence
  mitotic kinesin microtubule-associated protein Eg5 (Kif11) siRNA
attttcagtagtcagaattttat

SEQ ID NO: 4215 - DNA, 23 bp, Artificial Sequence
  mitotic kinesin microtubule-associated protein Eg5 (Kif11) siRNA
ttttcagtagtcagaattttatc

SEQ ID NO: 4216 - DNA, 23 bp, Artificial Sequence
  mitotic kinesin microtubule-associated protein Eg5 (Kif11) siRNA
tttcagtagtcagaattttatct

SEQ ID NO: 4217 - DNA, 23 bp, Artificial Sequence
  mitotic kinesin microtubule-associated protein Eg5 (Kif11) siRNA
ttcagtagtcagaattttatcta

SEQ ID NO: 4218 - DNA, 23 bp, Artificial Sequence
  mitotic kinesin microtubule-associated protein Eg5 (Kif11) siRNA
tcagtagtcagaattttatctag

SEQ ID NO: 4219 - DNA, 23 bp, Artificial Sequence
  mitotic kinesin microtubule-associated protein Eg5 (Kif11) siRNA
cagtagtcagaattttatctaga

SEQ ID NO: 4220 - DNA, 23 bp, Artificial Sequence
  mitotic kinesin microtubule-associated protein Eg5 (Kif11) siRNA
agtagtcagaattttatctagaa

SEQ ID NO: 4221 - DNA, 23 bp, Artificial Sequence
  mitotic kinesin microtubule-associated protein Eg5 (Kif11) siRNA
gtagtcagaattttatctagaaa

SEQ ID NO: 4222 - DNA, 23 bp, Artificial Sequence
  mitotic kinesin microtubule-associated protein Eg5 (Kif11) siRNA
tagtcagaattttatctagaaat

SEQ ID NO: 4223 - DNA, 23 bp, Artificial Sequence
  mitotic kinesin microtubule-associated protein Eg5 (Kif11) siRNA
agtcagaattttatctagaaatc

SEQ ID NO: 4224 - DNA, 23 bp, Artificial Sequence
  mitotic kinesin microtubule-associated protein Eg5 (Kif11) siRNA
gtcagaattttatctagaaatct

SEQ ID NO: 4225 - DNA, 23 bp, Artificial Sequence
  mitotic kinesin microtubule-associated protein Eg5 (Kif11) siRNA
tcagaattttatctagaaatctt

SEQ ID NO: 4226 - DNA, 23 bp, Artificial Sequence
  mitotic kinesin microtubule-associated protein Eg5 (Kif11) siRNA
cagaattttatctagaaatcttt

SEQ ID NO: 4227 - DNA, 23 bp, Artificial Sequence
  mitotic kinesin microtubule-associated protein Eg5 (Kif11) siRNA
agaattttatctagaaatctttt

SEQ ID NO: 4228 - DNA, 23 bp, Artificial Sequence
  mitotic kinesin microtubule-associated protein Eg5 (Kif11) siRNA
gaattttatctagaaatctttta

SEQ ID NO: 4229 - DNA, 23 bp, Artificial Sequence
  mitotic kinesin microtubule-associated protein Eg5 (Kif11) siRNA
aattttatctagaaatcttttaa

SEQ ID NO: 4230 - DNA, 23 bp, Artificial Sequence
  mitotic kinesin microtubule-associated protein Eg5 (Kif11) siRNA
attttatctagaaatcttttaac

SEQ ID NO: 4231 - DNA, 23 bp, Artificial Sequence
  mitotic kinesin microtubule-associated protein Eg5 (Kif11) siRNA
ttttatctagaaatcttttaaca

SEQ ID NO: 4232 - DNA, 23 bp, Artificial Sequence
  mitotic kinesin microtubule-associated protein Eg5 (Kif11) siRNA
tttatctagaaatcttttaacac

SEQ ID NO: 4233 - DNA, 23 bp, Artificial Sequence
  mitotic kinesin microtubule-associated protein Eg5 (Kif11) siRNA
ttatctagaaatcttttaacacc

SEQ ID NO: 4234 - DNA, 23 bp, Artificial Sequence
  mitotic kinesin microtubule-associated protein Eg5 (Kif11) siRNA
tatctagaaatcttttaacacct

SEQ ID NO: 4235 - DNA, 23 bp, Artificial Sequence
  mitotic kinesin microtubule-associated protein Eg5 (Kif11) siRNA
atctagaaatcttttaacacctt

SEQ ID NO: 4236 - DNA, 23 bp, Artificial Sequence
  mitotic kinesin microtubule-associated protein Eg5 (Kif11) siRNA
tctagaaatcttttaacaccttt

SEQ ID NO: 4237 - DNA, 23 bp, Artificial Sequence
  mitotic kinesin microtubule-associated protein Eg5 (Kif11) siRNA
ctagaaatcttttaacacctttt

SEQ ID NO: 4238 - DNA, 23 bp, Artificial Sequence
  mitotic kinesin microtubule-associated protein Eg5 (Kif11) siRNA
tagaaatcttttaacaccttttt

SEQ ID NO: 4239 - DNA, 23 bp, Artificial Sequence
  mitotic kinesin microtubule-associated protein Eg5 (Kif11) siRNA
agaaatcttttaacaccttttta

SEQ ID NO: 4240 - DNA, 23 bp, Artificial Sequence
  mitotic kinesin microtubule-associated protein Eg5 (Kif11) siRNA
gaaatcttttaacacctttttag

SEQ ID NO: 4241 - DNA, 23 bp, Artificial Sequence
  mitotic kinesin microtubule-associated protein Eg5 (Kif11) siRNA
aaatcttttaacacctttttagt

SEQ ID NO: 4242 - DNA, 23 bp, Artificial Sequence
  mitotic kinesin microtubule-associated protein Eg5 (Kif11) siRNA
aatcttttaacacctttttagtg

SEQ ID NO: 4243 - DNA, 23 bp, Artificial Sequence
  mitotic kinesin microtubule-associated protein Eg5 (Kif11) siRNA
atcttttaacacctttttagtgg

SEQ ID NO: 4244 - DNA, 23 bp, Artificial Sequence
  mitotic kinesin microtubule-associated protein Eg5 (Kif11) siRNA
tcttttaacacctttttagtggt

SEQ ID NO: 4245 - DNA, 23 bp, Artificial Sequence
  mitotic kinesin microtubule-associated protein Eg5 (Kif11) siRNA
cttttaacacctttttagtggtt

SEQ ID NO: 4246 - DNA, 23 bp, Artificial Sequence
  mitotic kinesin microtubule-associated protein Eg5 (Kif11) siRNA
ttttaacacctttttagtggtta

SEQ ID NO: 4247 - DNA, 23 bp, Artificial Sequence
  mitotic kinesin microtubule-associated protein Eg5 (Kif11) siRNA
tttaacacctttttagtggttat

SEQ ID NO: 4248 - DNA, 23 bp, Artificial Sequence
  mitotic kinesin microtubule-associated protein Eg5 (Kif11) siRNA
ttaacacctttttagtggttatt

SEQ ID NO: 4249 - DNA, 23 bp, Artificial Sequence
  mitotic kinesin microtubule-associated protein Eg5 (Kif11) siRNA
taacacctttttagtggttattt

SEQ ID NO: 4250 - DNA, 23 bp, Artificial Sequence
  mitotic kinesin microtubule-associated protein Eg5 (Kif11) siRNA
aacacctttttagtggttatttc

SEQ ID NO: 4251 - DNA, 23 bp, Artificial Sequence
  mitotic kinesin microtubule-associated protein Eg5 (Kif11) siRNA
acacctttttagtggttatttct

SEQ ID NO: 4252 - DNA, 23 bp, Artificial Sequence
  mitotic kinesin microtubule-associated protein Eg5 (Kif11) siRNA
cacctttttagtggttatttcta

SEQ ID NO: 4253 - DNA, 23 bp, Artificial Sequence
  mitotic kinesin microtubule-associated protein Eg5 (Kif11) siRNA
acctttttagtggttatttctaa

SEQ ID NO: 4254 - DNA, 23 bp, Artificial Sequence
  mitotic kinesin microtubule-associated protein Eg5 (Kif11) siRNA
cctttttagtggttatttctaaa

SEQ ID NO: 4255 - DNA, 23 bp, Artificial Sequence
  mitotic kinesin microtubule-associated protein Eg5 (Kif11) siRNA
ctttttagtggttatttctaaaa

SEQ ID NO: 4256 - DNA, 23 bp, Artificial Sequence
  mitotic kinesin microtubule-associated protein Eg5 (Kif11) siRNA
tttttagtggttatttctaaaat

SEQ ID NO: 4257 - DNA, 23 bp, Artificial Sequence
  mitotic kinesin microtubule-associated protein Eg5 (Kif11) siRNA
ttttagtggttatttctaaaatc

SEQ ID NO: 4258 - DNA, 23 bp, Artificial Sequence
  mitotic kinesin microtubule-associated protein Eg5 (Kif11) siRNA
tttagtggttatttctaaaatca

SEQ ID NO: 4259 - DNA, 23 bp, Artificial Sequence
  mitotic kinesin microtubule-associated protein Eg5 (Kif11) siRNA
ttagtggttatttctaaaatcac

SEQ ID NO: 4260 - DNA, 23 bp, Artificial Sequence
  mitotic kinesin microtubule-associated protein Eg5 (Kif11) siRNA
tagtggttatttctaaaatcact

SEQ ID NO: 4261 - DNA, 23 bp, Artificial Sequence
  mitotic kinesin microtubule-associated protein Eg5 (Kif11) siRNA
agtggttatttctaaaatcactg

SEQ ID NO: 4262 - DNA, 23 bp, Artificial Sequence
  mitotic kinesin microtubule-associated protein Eg5 (Kif11) siRNA
gtggttatttctaaaatcactgt

SEQ ID NO: 4263 - DNA, 23 bp, Artificial Sequence
  mitotic kinesin microtubule-associated protein Eg5 (Kif11) siRNA
tggttatttctaaaatcactgtc

SEQ ID NO: 4264 - DNA, 23 bp, Artificial Sequence
  mitotic kinesin microtubule-associated protein Eg5 (Kif11) siRNA
ggttatttctaaaatcactgtca

SEQ ID NO: 4265 - DNA, 23 bp, Artificial Sequence
  mitotic kinesin microtubule-associated protein Eg5 (Kif11) siRNA
gttatttctaaaatcactgtcaa

SEQ ID NO: 4266 - DNA, 23 bp, Artificial Sequence
  mitotic kinesin microtubule-associated protein Eg5 (Kif11) siRNA
ttatttctaaaatcactgtcaac

SEQ ID NO: 4267 - DNA, 23 bp, Artificial Sequence
  mitotic kinesin microtubule-associated protein Eg5 (Kif11) siRNA
tatttctaaaatcactgtcaaca

SEQ ID NO: 4268 - DNA, 23 bp, Artificial Sequence
  mitotic kinesin microtubule-associated protein Eg5 (Kif11) siRNA
atttctaaaatcactgtcaacaa

SEQ ID NO: 4269 - DNA, 23 bp, Artificial Sequence
  mitotic kinesin microtubule-associated protein Eg5 (Kif11) siRNA
tttctaaaatcactgtcaacaat

SEQ ID NO: 4270 - DNA, 23 bp, Artificial Sequence
  mitotic kinesin microtubule-associated protein Eg5 (Kif11) siRNA
ttctaaaatcactgtcaacaata

SEQ ID NO: 4271 - DNA, 23 bp, Artificial Sequence
  mitotic kinesin microtubule-associated protein Eg5 (Kif11) siRNA
tctaaaatcactgtcaacaataa

SEQ ID NO: 4272 - DNA, 23 bp, Artificial Sequence
  mitotic kinesin microtubule-associated protein Eg5 (Kif11) siRNA
ctaaaatcactgtcaacaataaa

SEQ ID NO: 4273 - DNA, 23 bp, Artificial Sequence
  mitotic kinesin microtubule-associated protein Eg5 (Kif11) siRNA
taaaatcactgtcaacaataaat

SEQ ID NO: 4274 - DNA, 23 bp, Artificial Sequence
  mitotic kinesin microtubule-associated protein Eg5 (Kif11) siRNA
aaaatcactgtcaacaataaatc

SEQ ID NO: 4275 - DNA, 23 bp, Artificial Sequence
  mitotic kinesin microtubule-associated protein Eg5 (Kif11) siRNA
aaatcactgtcaacaataaatct

SEQ ID NO: 4276 - DNA, 23 bp, Artificial Sequence
  mitotic kinesin microtubule-associated protein Eg5 (Kif11) siRNA
aatcactgtcaacaataaatcta

SEQ ID NO: 4277 - DNA, 23 bp, Artificial Sequence
  mitotic kinesin microtubule-associated protein Eg5 (Kif11) siRNA
atcactgtcaacaataaatctaa

SEQ ID NO: 4278 - DNA, 23 bp, Artificial Sequence
  mitotic kinesin microtubule-associated protein Eg5 (Kif11) siRNA
tcactgtcaacaataaatctaac

SEQ ID NO: 4279 - DNA, 23 bp, Artificial Sequence
  mitotic kinesin microtubule-associated protein Eg5 (Kif11) siRNA
cactgtcaacaataaatctaacc

SEQ ID NO: 4280 - DNA, 23 bp, Artificial Sequence
  mitotic kinesin microtubule-associated protein Eg5 (Kif11) siRNA
actgtcaacaataaatctaaccc

SEQ ID NO: 4281 - DNA, 23 bp, Artificial Sequence
  mitotic kinesin microtubule-associated protein Eg5 (Kif11) siRNA
ctgtcaacaataaatctaaccct

SEQ ID NO: 4282 - DNA, 23 bp, Artificial Sequence
  mitotic kinesin microtubule-associated protein Eg5 (Kif11) siRNA
tgtcaacaataaatctaacccta

SEQ ID NO: 4283 - DNA, 23 bp, Artificial Sequence
  mitotic kinesin microtubule-associated protein Eg5 (Kif11) siRNA
gtcaacaataaatctaaccctag

SEQ ID NO: 4284 - DNA, 23 bp, Artificial Sequence
  mitotic kinesin microtubule-associated protein Eg5 (Kif11) siRNA
tcaacaataaatctaaccctagt

SEQ ID NO: 4285 - DNA, 23 bp, Artificial Sequence
  mitotic kinesin microtubule-associated protein Eg5 (Kif11) siRNA
caacaataaatctaaccctagtt

SEQ ID NO: 4286 - DNA, 23 bp, Artificial Sequence
  mitotic kinesin microtubule-associated protein Eg5 (Kif11) siRNA
aacaataaatctaaccctagttg

SEQ ID NO: 4287 - DNA, 23 bp, Artificial Sequence
  mitotic kinesin microtubule-associated protein Eg5 (Kif11) siRNA
acaataaatctaaccctagttgt

SEQ ID NO: 4288 - DNA, 23 bp, Artificial Sequence
  mitotic kinesin microtubule-associated protein Eg5 (Kif11) siRNA
caataaatctaaccctagttgta

SEQ ID NO: 4289 - DNA, 23 bp, Artificial Sequence
  mitotic kinesin microtubule-associated protein Eg5 (Kif11) siRNA
aataaatctaaccctagttgtat

SEQ ID NO: 4290 - DNA, 23 bp, Artificial Sequence
  mitotic kinesin microtubule-associated protein Eg5 (Kif11) siRNA
ataaatctaaccctagttgtatc

SEQ ID NO: 4291 - DNA, 23 bp, Artificial Sequence
  mitotic kinesin microtubule-associated protein Eg5 (Kif11) siRNA
taaatctaaccctagttgtatcc

SEQ ID NO: 4292 - DNA, 23 bp, Artificial Sequence
  mitotic kinesin microtubule-associated protein Eg5 (Kif11) siRNA
aaatctaaccctagttgtatccc

SEQ ID NO: 4293 - DNA, 23 bp, Artificial Sequence
  mitotic kinesin microtubule-associated protein Eg5 (Kif11) siRNA
aatctaaccctagttgtatccct

SEQ ID NO: 4294 - DNA, 23 bp, Artificial Sequence
  mitotic kinesin microtubule-associated protein Eg5 (Kif11) siRNA
atctaaccctagttgtatccctc

SEQ ID NO: 4295 - DNA, 23 bp, Artificial Sequence
  mitotic kinesin microtubule-associated protein Eg5 (Kif11) siRNA
tctaaccctagttgtatccctcc

SEQ ID NO: 4296 - DNA, 23 bp, Artificial Sequence
  mitotic kinesin microtubule-associated protein Eg5 (Kif11) siRNA
ctaaccctagttgtatccctcct

SEQ ID NO: 4297 - DNA, 23 bp, Artificial Sequence
  mitotic kinesin microtubule-associated protein Eg5 (Kif11) siRNA
taaccctagttgtatccctcctt

SEQ ID NO: 4298 - DNA, 23 bp, Artificial Sequence
  mitotic kinesin microtubule-associated protein Eg5 (Kif11) siRNA
aaccctagttgtatccctccttt

SEQ ID NO: 4299 - DNA, 23 bp, Artificial Sequence
  mitotic kinesin microtubule-associated protein Eg5 (Kif11) siRNA
accctagttgtatccctccttta

SEQ ID NO: 4300 - DNA, 23 bp, Artificial Sequence
  mitotic kinesin microtubule-associated protein Eg5 (Kif11) siRNA
ccctagttgtatccctcctttaa

SEQ ID NO: 4301 - DNA, 23 bp, Artificial Sequence
  mitotic kinesin microtubule-associated protein Eg5 (Kif11) siRNA
cctagttgtatccctcctttaag

SEQ ID NO: 4302 - DNA, 23 bp, Artificial Sequence
  mitotic kinesin microtubule-associated protein Eg5 (Kif11) siRNA
ctagttgtatccctcctttaagt

SEQ ID NO: 4303 - DNA, 23 bp, Artificial Sequence
  mitotic kinesin microtubule-associated protein Eg5 (Kif11) siRNA
tagttgtatccctcctttaagta

SEQ ID NO: 4304 - DNA, 23 bp, Artificial Sequence
  mitotic kinesin microtubule-associated protein Eg5 (Kif11) siRNA
agttgtatccctcctttaagtat

SEQ ID NO: 4305 - DNA, 23 bp, Artificial Sequence
  mitotic kinesin microtubule-associated protein Eg5 (Kif11) siRNA
gttgtatccctcctttaagtatt

SEQ ID NO: 4306 - DNA, 23 bp, Artificial Sequence
  mitotic kinesin microtubule-associated protein Eg5 (Kif11) siRNA
ttgtatccctcctttaagtattt

SEQ ID NO: 4307 - DNA, 23 bp, Artificial Sequence
  mitotic kinesin microtubule-associated protein Eg5 (Kif11) siRNA
tgtatccctcctttaagtattta

SEQ ID NO: 4308 - DNA, 23 bp, Artificial Sequence
  mitotic kinesin microtubule-associated protein Eg5 (Kif11) siRNA
gtatccctcctttaagtatttaa

SEQ ID NO: 4309 - DNA, 23 bp, Artificial Sequence
  mitotic kinesin microtubule-associated protein Eg5 (Kif11) siRNA
tatccctcctttaagtatttaaa

SEQ ID NO: 4310 - DNA, 23 bp, Artificial Sequence
  mitotic kinesin microtubule-associated protein Eg5 (Kif11) siRNA
atccctcctttaagtatttaaaa

SEQ ID NO: 4311 - DNA, 23 bp, Artificial Sequence
  mitotic kinesin microtubule-associated protein Eg5 (Kif11) siRNA
tccctcctttaagtatttaaaac

SEQ ID NO: 4312 - DNA, 23 bp, Artificial Sequence
  mitotic kinesin microtubule-associated protein Eg5 (Kif11) siRNA
ccctcctttaagtatttaaaact

SEQ ID NO: 4313 - DNA, 23 bp, Artificial Sequence
  mitotic kinesin microtubule-associated protein Eg5 (Kif11) siRNA
cctcctttaagtatttaaaactt

SEQ ID NO: 4314 - DNA, 23 bp, Artificial Sequence
  mitotic kinesin microtubule-associated protein Eg5 (Kif11) siRNA
ctcctttaagtatttaaaacttg

SEQ ID NO: 4315 - DNA, 23 bp, Artificial Sequence
  mitotic kinesin microtubule-associated protein Eg5 (Kif11) siRNA
tcctttaagtatttaaaacttgt

SEQ ID NO: 4316 - DNA, 23 bp, Artificial Sequence
  mitotic kinesin microtubule-associated protein Eg5 (Kif11) siRNA
cctttaagtatttaaaacttgtt

SEQ ID NO: 4317 - DNA, 23 bp, Artificial Sequence
  mitotic kinesin microtubule-associated protein Eg5 (Kif11) siRNA
ctttaagtatttaaaacttgttg

SEQ ID NO: 4318 - DNA, 23 bp, Artificial Sequence
  mitotic kinesin microtubule-associated protein Eg5 (Kif11) siRNA
tttaagtatttaaaacttgttgc

SEQ ID NO: 4319 - DNA, 23 bp, Artificial Sequence
  mitotic kinesin microtubule-associated protein Eg5 (Kif11) siRNA
ttaagtatttaaaacttgttgcc

SEQ ID NO: 4320 - DNA, 23 bp, Artificial Sequence
  mitotic kinesin microtubule-associated protein Eg5 (Kif11) siRNA
taagtatttaaaacttgttgccc

SEQ ID NO: 4321 - DNA, 23 bp, Artificial Sequence
  mitotic kinesin microtubule-associated protein Eg5 (Kif11) siRNA
aagtatttaaaacttgttgcccc

SEQ ID NO: 4322 - DNA, 23 bp, Artificial Sequence
  mitotic kinesin microtubule-associated protein Eg5 (Kif11) siRNA
agtatttaaaacttgttgcccca

SEQ ID NO: 4323 - DNA, 23 bp, Artificial Sequence
  mitotic kinesin microtubule-associated protein Eg5 (Kif11) siRNA
gtatttaaaacttgttgccccaa

SEQ ID NO: 4324 - DNA, 23 bp, Artificial Sequence
  mitotic kinesin microtubule-associated protein Eg5 (Kif11) siRNA
tatttaaaacttgttgccccaaa

SEQ ID NO: 4325 - DNA, 23 bp, Artificial Sequence
  mitotic kinesin microtubule-associated protein Eg5 (Kif11) siRNA
atttaaaacttgttgccccaaat

SEQ ID NO: 4326 - DNA, 23 bp, Artificial Sequence
  mitotic kinesin microtubule-associated protein Eg5 (Kif11) siRNA
tttaaaacttgttgccccaaatg

SEQ ID NO: 4327 - DNA, 23 bp, Artificial Sequence
  mitotic kinesin microtubule-associated protein Eg5 (Kif11) siRNA
ttaaaacttgttgccccaaatgt

SEQ ID NO: 4328 - DNA, 23 bp, Artificial Sequence
  mitotic kinesin microtubule-associated protein Eg5 (Kif11) siRNA
taaaacttgttgccccaaatgtg

SEQ ID NO: 4329 - DNA, 23 bp, Artificial Sequence
  mitotic kinesin microtubule-associated protein Eg5 (Kif11) siRNA
aaaacttgttgccccaaatgtga

SEQ ID NO: 4330 - DNA, 23 bp, Artificial Sequence
  mitotic kinesin microtubule-associated protein Eg5 (Kif11) siRNA
aaacttgttgccccaaatgtgaa

SEQ ID NO: 4331 - DNA, 23 bp, Artificial Sequence
  mitotic kinesin microtubule-associated protein Eg5 (Kif11) siRNA
aacttgttgccccaaatgtgaaa

SEQ ID NO: 4332 - DNA, 23 bp, Artificial Sequence
  mitotic kinesin microtubule-associated protein Eg5 (Kif11) siRNA
acttgttgccccaaatgtgaaag

SEQ ID NO: 4333 - DNA, 23 bp, Artificial Sequence
  mitotic kinesin microtubule-associated protein Eg5 (Kif11) siRNA
cttgttgccccaaatgtgaaagc

SEQ ID NO: 4334 - DNA, 23 bp, Artificial Sequence
  mitotic kinesin microtubule-associated protein Eg5 (Kif11) siRNA
ttgttgccccaaatgtgaaagca

SEQ ID NO: 4335 - DNA, 23 bp, Artificial Sequence
  mitotic kinesin microtubule-associated protein Eg5 (Kif11) siRNA
tgttgccccaaatgtgaaagcat

SEQ ID NO: 4336 - DNA, 23 bp, Artificial Sequence
  mitotic kinesin microtubule-associated protein Eg5 (Kif11) siRNA
gttgccccaaatgtgaaagcatt

SEQ ID NO: 4337 - DNA, 23 bp, Artificial Sequence
  mitotic kinesin microtubule-associated protein Eg5 (Kif11) siRNA
ttgccccaaatgtgaaagcattt

SEQ ID NO: 4338 - DNA, 23 bp, Artificial Sequence
  mitotic kinesin microtubule-associated protein Eg5 (Kif11) siRNA
tgccccaaatgtgaaagcattta

SEQ ID NO: 4339 - DNA, 23 bp, Artificial Sequence
  mitotic kinesin microtubule-associated protein Eg5 (Kif11) siRNA
gccccaaatgtgaaagcatttaa

SEQ ID NO: 4340 - DNA, 23 bp, Artificial Sequence
  mitotic kinesin microtubule-associated protein Eg5 (Kif11) siRNA
ccccaaatgtgaaagcatttaat

SEQ ID NO: 4341 - DNA, 23 bp, Artificial Sequence
  mitotic kinesin microtubule-associated protein Eg5 (Kif11) siRNA
cccaaatgtgaaagcatttaatt

SEQ ID NO: 4342 - DNA, 23 bp, Artificial Sequence
  mitotic kinesin microtubule-associated protein Eg5 (Kif11) siRNA
ccaaatgtgaaagcatttaattc

SEQ ID NO: 4343 - DNA, 23 bp, Artificial Sequence
  mitotic kinesin microtubule-associated protein Eg5 (Kif11) siRNA
caaatgtgaaagcatttaattcc

SEQ ID NO: 4344 - DNA, 23 bp, Artificial Sequence
  mitotic kinesin microtubule-associated protein Eg5 (Kif11) siRNA
aaatgtgaaagcatttaattcct

SEQ ID NO: 4345 - DNA, 23 bp, Artificial Sequence
  mitotic kinesin microtubule-associated protein Eg5 (Kif11) siRNA
aatgtgaaagcatttaattcctt

SEQ ID NO: 4346 - DNA, 23 bp, Artificial Sequence
  mitotic kinesin microtubule-associated protein Eg5 (Kif11) siRNA
atgtgaaagcatttaattccttt

SEQ ID NO: 4347 - DNA, 23 bp, Artificial Sequence
  mitotic kinesin microtubule-associated protein Eg5 (Kif11) siRNA
tgtgaaagcatttaattccttta

SEQ ID NO: 4348 - DNA, 23 bp, Artificial Sequence
  mitotic kinesin microtubule-associated protein Eg5 (Kif11) siRNA
gtgaaagcatttaattcctttaa

SEQ ID NO: 4349 - DNA, 23 bp, Artificial Sequence
  mitotic kinesin microtubule-associated protein Eg5 (Kif11) siRNA
tgaaagcatttaattcctttaag

SEQ ID NO: 4350 - DNA, 23 bp, Artificial Sequence
  mitotic kinesin microtubule-associated protein Eg5 (Kif11) siRNA
gaaagcatttaattcctttaaga

SEQ ID NO: 4351 - DNA, 23 bp, Artificial Sequence
  mitotic kinesin microtubule-associated protein Eg5 (Kif11) siRNA
aaagcatttaattcctttaagag

SEQ ID NO: 4352 - DNA, 23 bp, Artificial Sequence
  mitotic kinesin microtubule-associated protein Eg5 (Kif11) siRNA
aagcatttaattcctttaagagg

SEQ ID NO: 4353 - DNA, 23 bp, Artificial Sequence
  mitotic kinesin microtubule-associated protein Eg5 (Kif11) siRNA
agcatttaattcctttaagaggc

SEQ ID NO: 4354 - DNA, 23 bp, Artificial Sequence
  mitotic kinesin microtubule-associated protein Eg5 (Kif11) siRNA
gcatttaattcctttaagaggcc

SEQ ID NO: 4355 - DNA, 23 bp, Artificial Sequence
  mitotic kinesin microtubule-associated protein Eg5 (Kif11) siRNA
catttaattcctttaagaggcct

SEQ ID NO: 4356 - DNA, 23 bp, Artificial Sequence
  mitotic kinesin microtubule-associated protein Eg5 (Kif11) siRNA
atttaattcctttaagaggccta

SEQ ID NO: 4357 - DNA, 23 bp, Artificial Sequence
  mitotic kinesin microtubule-associated protein Eg5 (Kif11) siRNA
tttaattcctttaagaggcctaa

SEQ ID NO: 4358 - DNA, 23 bp, Artificial Sequence
  mitotic kinesin microtubule-associated protein Eg5 (Kif11) siRNA
ttaattcctttaagaggcctaac

SEQ ID NO: 4359 - DNA, 23 bp, Artificial Sequence
  mitotic kinesin microtubule-associated protein Eg5 (Kif11) siRNA
taattcctttaagaggcctaact

SEQ ID NO: 4360 - DNA, 23 bp, Artificial Sequence
  mitotic kinesin microtubule-associated protein Eg5 (Kif11) siRNA
aattcctttaagaggcctaactc

SEQ ID NO: 4361 - DNA, 23 bp, Artificial Sequence
  mitotic kinesin microtubule-associated protein Eg5 (Kif11) siRNA
attcctttaagaggcctaactca

SEQ ID NO: 4362 - DNA, 23 bp, Artificial Sequence
  mitotic kinesin microtubule-associated protein Eg5 (Kif11) siRNA
ttcctttaagaggcctaactcat

SEQ ID NO: 4363 - DNA, 23 bp, Artificial Sequence
  mitotic kinesin microtubule-associated protein Eg5 (Kif11) siRNA
tcctttaagaggcctaactcatt

SEQ ID NO: 4364 - DNA, 23 bp, Artificial Sequence
  mitotic kinesin microtubule-associated protein Eg5 (Kif11) siRNA
cctttaagaggcctaactcattc

SEQ ID NO: 4365 - DNA, 23 bp, Artificial Sequence
  mitotic kinesin microtubule-associated protein Eg5 (Kif11) siRNA
ctttaagaggcctaactcattca

SEQ ID NO: 4366 - DNA, 23 bp, Artificial Sequence
  mitotic kinesin microtubule-associated protein Eg5 (Kif11) siRNA
tttaagaggcctaactcattcac

SEQ ID NO: 4367 - DNA, 23 bp, Artificial Sequence
  mitotic kinesin microtubule-associated protein Eg5 (Kif11) siRNA
ttaagaggcctaactcattcacc

SEQ ID NO: 4368 - DNA, 23 bp, Artificial Sequence
  mitotic kinesin microtubule-associated protein Eg5 (Kif11) siRNA
taagaggcctaactcattcaccc

SEQ ID NO: 4369 - DNA, 23 bp, Artificial Sequence
  mitotic kinesin microtubule-associated protein Eg5 (Kif11) siRNA
aagaggcctaactcattcaccct

SEQ ID NO: 4370 - DNA, 23 bp, Artificial Sequence
  mitotic kinesin microtubule-associated protein Eg5 (Kif11) siRNA
agaggcctaactcattcaccctg

SEQ ID NO: 4371 - DNA, 23 bp, Artificial Sequence
  mitotic kinesin microtubule-associated protein Eg5 (Kif11) siRNA
gaggcctaactcattcaccctga

SEQ ID NO: 4372 - DNA, 23 bp, Artificial Sequence
  mitotic kinesin microtubule-associated protein Eg5 (Kif11) siRNA
aggcctaactcattcaccctgac

SEQ ID NO: 4373 - DNA, 23 bp, Artificial Sequence
  mitotic kinesin microtubule-associated protein Eg5 (Kif11) siRNA
ggcctaactcattcaccctgaca

SEQ ID NO: 4374 - DNA, 23 bp, Artificial Sequence
  mitotic kinesin microtubule-associated protein Eg5 (Kif11) siRNA
gcctaactcattcaccctgacag

SEQ ID NO: 4375 - DNA, 23 bp, Artificial Sequence
  mitotic kinesin microtubule-associated protein Eg5 (Kif11) siRNA
cctaactcattcaccctgacaga

SEQ ID NO: 4376 - DNA, 23 bp, Artificial Sequence
  mitotic kinesin microtubule-associated protein Eg5 (Kif11) siRNA
ctaactcattcaccctgacagag

SEQ ID NO: 4377 - DNA, 23 bp, Artificial Sequence
  mitotic kinesin microtubule-associated protein Eg5 (Kif11) siRNA
taactcattcaccctgacagagt

SEQ ID NO: 4378 - DNA, 23 bp, Artificial Sequence
  mitotic kinesin microtubule-associated protein Eg5 (Kif11) siRNA
aactcattcaccctgacagagtt

SEQ ID NO: 4379 - DNA, 23 bp, Artificial Sequence
  mitotic kinesin microtubule-associated protein Eg5 (Kif11) siRNA
actcattcaccctgacagagttc

SEQ ID NO: 4380 - DNA, 23 bp, Artificial Sequence
  mitotic kinesin microtubule-associated protein Eg5 (Kif11) siRNA
ctcattcaccctgacagagttca

SEQ ID NO: 4381 - DNA, 23 bp, Artificial Sequence
  mitotic kinesin microtubule-associated protein Eg5 (Kif11) siRNA
tcattcaccctgacagagttcac

SEQ ID NO: 4382 - DNA, 23 bp, Artificial Sequence
  mitotic kinesin microtubule-associated protein Eg5 (Kif11) siRNA
cattcaccctgacagagttcaca

SEQ ID NO: 4383 - DNA, 23 bp, Artificial Sequence
  mitotic kinesin microtubule-associated protein Eg5 (Kif11) siRNA
attcaccctgacagagttcacaa

SEQ ID NO: 4384 - DNA, 23 bp, Artificial Sequence
  mitotic kinesin microtubule-associated protein Eg5 (Kif11) siRNA
ttcaccctgacagagttcacaaa

SEQ ID NO: 4385 - DNA, 23 bp, Artificial Sequence
  mitotic kinesin microtubule-associated protein Eg5 (Kif11) siRNA
tcaccctgacagagttcacaaaa

SEQ ID NO: 4386 - DNA, 23 bp, Artificial Sequence
  mitotic kinesin microtubule-associated protein Eg5 (Kif11) siRNA
caccctgacagagttcacaaaaa

SEQ ID NO: 4387 - DNA, 23 bp, Artificial Sequence
  mitotic kinesin microtubule-associated protein Eg5 (Kif11) siRNA
accctgacagagttcacaaaaag

SEQ ID NO: 4388 - DNA, 23 bp, Artificial Sequence
  mitotic kinesin microtubule-associated protein Eg5 (Kif11) siRNA
ccctgacagagttcacaaaaagc

SEQ ID NO: 4389 - DNA, 23 bp, Artificial Sequence
  mitotic kinesin microtubule-associated protein Eg5 (Kif11) siRNA
cctgacagagttcacaaaaagcc

SEQ ID NO: 4390 - DNA, 23 bp, Artificial Sequence
  mitotic kinesin microtubule-associated protein Eg5 (Kif11) siRNA
ctgacagagttcacaaaaagccc

SEQ ID NO: 4391 - DNA, 23 bp, Artificial Sequence
  mitotic kinesin microtubule-associated protein Eg5 (Kif11) siRNA
tgacagagttcacaaaaagccca

SEQ ID NO: 4392 - DNA, 23 bp, Artificial Sequence
  mitotic kinesin microtubule-associated protein Eg5 (Kif11) siRNA
gacagagttcacaaaaagcccac

SEQ ID NO: 4393 - DNA, 23 bp, Artificial Sequence
  mitotic kinesin microtubule-associated protein Eg5 (Kif11) siRNA
acagagttcacaaaaagcccact

SEQ ID NO: 4394 - DNA, 23 bp, Artificial Sequence
  mitotic kinesin microtubule-associated protein Eg5 (Kif11) siRNA
cagagttcacaaaaagcccactt

SEQ ID NO: 4395 - DNA, 23 bp, Artificial Sequence
  mitotic kinesin microtubule-associated protein Eg5 (Kif11) siRNA
agagttcacaaaaagcccacttt

SEQ ID NO: 4396 - DNA, 23 bp, Artificial Sequence
  mitotic kinesin microtubule-associated protein Eg5 (Kif11) siRNA
gagttcacaaaaagcccacttta

SEQ ID NO: 4397 - DNA, 23 bp, Artificial Sequence
  mitotic kinesin microtubule-associated protein Eg5 (Kif11) siRNA
agttcacaaaaagcccactttag

SEQ ID NO: 4398 - DNA, 23 bp, Artificial Sequence
  mitotic kinesin microtubule-associated protein Eg5 (Kif11) siRNA
gttcacaaaaagcccactttaga

SEQ ID NO: 4399 - DNA, 23 bp, Artificial Sequence
  mitotic kinesin microtubule-associated protein Eg5 (Kif11) siRNA
ttcacaaaaagcccactttagag

SEQ ID NO: 4400 - DNA, 23 bp, Artificial Sequence
  mitotic kinesin microtubule-associated protein Eg5 (Kif11) siRNA
tcacaaaaagcccactttagagt

SEQ ID NO: 4401 - DNA, 23 bp, Artificial Sequence
  mitotic kinesin microtubule-associated protein Eg5 (Kif11) siRNA
cacaaaaagcccactttagagta

SEQ ID NO: 4402 - DNA, 23 bp, Artificial Sequence
  mitotic kinesin microtubule-associated protein Eg5 (Kif11) siRNA
acaaaaagcccactttagagtat

SEQ ID NO: 4403 - DNA, 23 bp, Artificial Sequence
  mitotic kinesin microtubule-associated protein Eg5 (Kif11) siRNA
caaaaagcccactttagagtata

SEQ ID NO: 4404 - DNA, 23 bp, Artificial Sequence
  mitotic kinesin microtubule-associated protein Eg5 (Kif11) siRNA
aaaaagcccactttagagtatac

SEQ ID NO: 4405 - DNA, 23 bp, Artificial Sequence
  mitotic kinesin microtubule-associated protein Eg5 (Kif11) siRNA
aaaagcccactttagagtataca

SEQ ID NO: 4406 - DNA, 23 bp, Artificial Sequence
  mitotic kinesin microtubule-associated protein Eg5 (Kif11) siRNA
aaagcccactttagagtatacat

SEQ ID NO: 4407 - DNA, 23 bp, Artificial Sequence
  mitotic kinesin microtubule-associated protein Eg5 (Kif11) siRNA
aagcccactttagagtatacatt

SEQ ID NO: 4408 - DNA, 23 bp, Artificial Sequence
  mitotic kinesin microtubule-associated protein Eg5 (Kif11) siRNA
agcccactttagagtatacattg

SEQ ID NO: 4409 - DNA, 23 bp, Artificial Sequence
  mitotic kinesin microtubule-associated protein Eg5 (Kif11) siRNA
gcccactttagagtatacattgc

SEQ ID NO: 4410 - DNA, 23 bp, Artificial Sequence
  mitotic kinesin microtubule-associated protein Eg5 (Kif11) siRNA
cccactttagagtatacattgct

SEQ ID NO: 4411 - DNA, 23 bp, Artificial Sequence
  mitotic kinesin microtubule-associated protein Eg5 (Kif11) siRNA
ccactttagagtatacattgcta

SEQ ID NO: 4412 - DNA, 23 bp, Artificial Sequence
  mitotic kinesin microtubule-associated protein Eg5 (Kif11) siRNA
cactttagagtatacattgctat

SEQ ID NO: 4413 - DNA, 23 bp, Artificial Sequence
  mitotic kinesin microtubule-associated protein Eg5 (Kif11) siRNA
actttagagtatacattgctatt

SEQ ID NO: 4414 - DNA, 23 bp, Artificial Sequence
  mitotic kinesin microtubule-associated protein Eg5 (Kif11) siRNA
ctttagagtatacattgctatta

SEQ ID NO: 4415 - DNA, 23 bp, Artificial Sequence
  mitotic kinesin microtubule-associated protein Eg5 (Kif11) siRNA
tttagagtatacattgctattat

SEQ ID NO: 4416 - DNA, 23 bp, Artificial Sequence
  mitotic kinesin microtubule-associated protein Eg5 (Kif11) siRNA
ttagagtatacattgctattatg

SEQ ID NO: 4417 - DNA, 23 bp, Artificial Sequence
  mitotic kinesin microtubule-associated protein Eg5 (Kif11) siRNA
tagagtatacattgctattatgg

SEQ ID NO: 4418 - DNA, 23 bp, Artificial Sequence
  mitotic kinesin microtubule-associated protein Eg5 (Kif11) siRNA
agagtatacattgctattatggg

SEQ ID NO: 4419 - DNA, 23 bp, Artificial Sequence
  mitotic kinesin microtubule-associated protein Eg5 (Kif11) siRNA
gagtatacattgctattatggga

SEQ ID NO: 4420 - DNA, 23 bp, Artificial Sequence
  mitotic kinesin microtubule-associated protein Eg5 (Kif11) siRNA
agtatacattgctattatgggag

SEQ ID NO: 4421 - DNA, 23 bp, Artificial Sequence
  mitotic kinesin microtubule-associated protein Eg5 (Kif11) siRNA
gtatacattgctattatgggaga

SEQ ID NO: 4422 - DNA, 23 bp, Artificial Sequence
  mitotic kinesin microtubule-associated protein Eg5 (Kif11) siRNA
tatacattgctattatgggagac

SEQ ID NO: 4423 - DNA, 23 bp, Artificial Sequence
  mitotic kinesin microtubule-associated protein Eg5 (Kif11) siRNA
atacattgctattatgggagacc

SEQ ID NO: 4424 - DNA, 23 bp, Artificial Sequence
  mitotic kinesin microtubule-associated protein Eg5 (Kif11) siRNA
tacattgctattatgggagacca

SEQ ID NO: 4425 - DNA, 23 bp, Artificial Sequence
  mitotic kinesin microtubule-associated protein Eg5 (Kif11) siRNA
acattgctattatgggagaccac

SEQ ID NO: 4426 - DNA, 23 bp, Artificial Sequence
  mitotic kinesin microtubule-associated protein Eg5 (Kif11) siRNA
cattgctattatgggagaccacc

SEQ ID NO: 4427 - DNA, 23 bp, Artificial Sequence
  mitotic kinesin microtubule-associated protein Eg5 (Kif11) siRNA
attgctattatgggagaccaccc

SEQ ID NO: 4428 - DNA, 23 bp, Artificial Sequence
  mitotic kinesin microtubule-associated protein Eg5 (Kif11) siRNA
ttgctattatgggagaccaccca

SEQ ID NO: 4429 - DNA, 23 bp, Artificial Sequence
  mitotic kinesin microtubule-associated protein Eg5 (Kif11) siRNA
tgctattatgggagaccacccag

SEQ ID NO: 4430 - DNA, 23 bp, Artificial Sequence
  mitotic kinesin microtubule-associated protein Eg5 (Kif11) siRNA
gctattatgggagaccacccaga

SEQ ID NO: 4431 - DNA, 23 bp, Artificial Sequence
  mitotic kinesin microtubule-associated protein Eg5 (Kif11) siRNA
ctattatgggagaccacccagac

SEQ ID NO: 4432 - DNA, 23 bp, Artificial Sequence
  mitotic kinesin microtubule-associated protein Eg5 (Kif11) siRNA
tattatgggagaccacccagaca

SEQ ID NO: 4433 - DNA, 23 bp, Artificial Sequence
  mitotic kinesin microtubule-associated protein Eg5 (Kif11) siRNA
attatgggagaccacccagacat

SEQ ID NO: 4434 - DNA, 23 bp, Artificial Sequence
  mitotic kinesin microtubule-associated protein Eg5 (Kif11) siRNA
ttatgggagaccacccagacatc

SEQ ID NO: 4435 - DNA, 23 bp, Artificial Sequence
  mitotic kinesin microtubule-associated protein Eg5 (Kif11) siRNA
tatgggagaccacccagacatct

SEQ ID NO: 4436 - DNA, 23 bp, Artificial Sequence
  mitotic kinesin microtubule-associated protein Eg5 (Kif11) siRNA
atgggagaccacccagacatctg

SEQ ID NO: 4437 - DNA, 23 bp, Artificial Sequence
  mitotic kinesin microtubule-associated protein Eg5 (Kif11) siRNA
tgggagaccacccagacatctga

SEQ ID NO: 4438 - DNA, 23 bp, Artificial Sequence
  mitotic kinesin microtubule-associated protein Eg5 (Kif11) siRNA
gggagaccacccagacatctgac

SEQ ID NO: 4439 - DNA, 23 bp, Artificial Sequence
  mitotic kinesin microtubule-associated protein Eg5 (Kif11) siRNA
ggagaccacccagacatctgact

SEQ ID NO: 4440 - DNA, 23 bp, Artificial Sequence
  mitotic kinesin microtubule-associated protein Eg5 (Kif11) siRNA
gagaccacccagacatctgacta

SEQ ID NO: 4441 - DNA, 23 bp, Artificial Sequence
  mitotic kinesin microtubule-associated protein Eg5 (Kif11) siRNA
agaccacccagacatctgactaa

SEQ ID NO: 4442 - DNA, 23 bp, Artificial Sequence
  mitotic kinesin microtubule-associated protein Eg5 (Kif11) siRNA
gaccacccagacatctgactaat

SEQ ID NO: 4443 - DNA, 23 bp, Artificial Sequence
  mitotic kinesin microtubule-associated protein Eg5 (Kif11) siRNA
accacccagacatctgactaatg

SEQ ID NO: 4444 - DNA, 23 bp, Artificial Sequence
  mitotic kinesin microtubule-associated protein Eg5 (Kif11) siRNA
ccacccagacatctgactaatgg

SEQ ID NO: 4445 - DNA, 23 bp, Artificial Sequence
  mitotic kinesin microtubule-associated protein Eg5 (Kif11) siRNA
cacccagacatctgactaatggc

SEQ ID NO: 4446 - DNA, 23 bp, Artificial Sequence
  mitotic kinesin microtubule-associated protein Eg5 (Kif11) siRNA
acccagacatctgactaatggct

SEQ ID NO: 4447 - DNA, 23 bp, Artificial Sequence
  mitotic kinesin microtubule-associated protein Eg5 (Kif11) siRNA
cccagacatctgactaatggctc

SEQ ID NO: 4448 - DNA, 23 bp, Artificial Sequence
  mitotic kinesin microtubule-associated protein Eg5 (Kif11) siRNA
ccagacatctgactaatggctct

SEQ ID NO: 4449 - DNA, 23 bp, Artificial Sequence
  mitotic kinesin microtubule-associated protein Eg5 (Kif11) siRNA
cagacatctgactaatggctctg

SEQ ID NO: 4450 - DNA, 23 bp, Artificial Sequence
  mitotic kinesin microtubule-associated protein Eg5 (Kif11) siRNA
agacatctgactaatggctctgt

SEQ ID NO: 4451 - DNA, 23 bp, Artificial Sequence
  mitotic kinesin microtubule-associated protein Eg5 (Kif11) siRNA
gacatctgactaatggctctgtg

SEQ ID NO: 4452 - DNA, 23 bp, Artificial Sequence
  mitotic kinesin microtubule-associated protein Eg5 (Kif11) siRNA
acatctgactaatggctctgtgc

SEQ ID NO: 4453 - DNA, 23 bp, Artificial Sequence
  mitotic kinesin microtubule-associated protein Eg5 (Kif11) siRNA
catctgactaatggctctgtgcc

SEQ ID NO: 4454 - DNA, 23 bp, Artificial Sequence
  mitotic kinesin microtubule-associated protein Eg5 (Kif11) siRNA
atctgactaatggctctgtgcca

SEQ ID NO: 4455 - DNA, 23 bp, Artificial Sequence
  mitotic kinesin microtubule-associated protein Eg5 (Kif11) siRNA
tctgactaatggctctgtgccac

SEQ ID NO: 4456 - DNA, 23 bp, Artificial Sequence
  mitotic kinesin microtubule-associated protein Eg5 (Kif11) siRNA
ctgactaatggctctgtgccaca

SEQ ID NO: 4457 - DNA, 23 bp, Artificial Sequence
  mitotic kinesin microtubule-associated protein Eg5 (Kif11) siRNA
tgactaatggctctgtgccacac

SEQ ID NO: 4458 - DNA, 23 bp, Artificial Sequence
  mitotic kinesin microtubule-associated protein Eg5 (Kif11) siRNA
gactaatggctctgtgccacact

SEQ ID NO: 4459 - DNA, 23 bp, Artificial Sequence
  mitotic kinesin microtubule-associated protein Eg5 (Kif11) siRNA
actaatggctctgtgccacactc

SEQ ID NO: 4460 - DNA, 23 bp, Artificial Sequence
  mitotic kinesin microtubule-associated protein Eg5 (Kif11) siRNA
ctaatggctctgtgccacactcc

SEQ ID NO: 4461 - DNA, 23 bp, Artificial Sequence
  mitotic kinesin microtubule-associated protein Eg5 (Kif11) siRNA
taatggctctgtgccacactcca

SEQ ID NO: 4462 - DNA, 23 bp, Artificial Sequence
  mitotic kinesin microtubule-associated protein Eg5 (Kif11) siRNA
aatggctctgtgccacactccaa

SEQ ID NO: 4463 - DNA, 23 bp, Artificial Sequence
  mitotic kinesin microtubule-associated protein Eg5 (Kif11) siRNA
atggctctgtgccacactccaag

SEQ ID NO: 4464 - DNA, 23 bp, Artificial Sequence
  mitotic kinesin microtubule-associated protein Eg5 (Kif11) siRNA
tggctctgtgccacactccaaga

SEQ ID NO: 4465 - DNA, 23 bp, Artificial Sequence
  mitotic kinesin microtubule-associated protein Eg5 (Kif11) siRNA
ggctctgtgccacactccaagac

SEQ ID NO: 4466 - DNA, 23 bp, Artificial Sequence
  mitotic kinesin microtubule-associated protein Eg5 (Kif11) siRNA
gctctgtgccacactccaagacc

SEQ ID NO: 4467 - DNA, 23 bp, Artificial Sequence
  mitotic kinesin microtubule-associated protein Eg5 (Kif11) siRNA
ctctgtgccacactccaagacct

SEQ ID NO: 4468 - DNA, 23 bp, Artificial Sequence
  mitotic kinesin microtubule-associated protein Eg5 (Kif11) siRNA
tctgtgccacactccaagacctg

SEQ ID NO: 4469 - DNA, 23 bp, Artificial Sequence
  mitotic kinesin microtubule-associated protein Eg5 (Kif11) siRNA
ctgtgccacactccaagacctgt

SEQ ID NO: 4470 - DNA, 23 bp, Artificial Sequence
  mitotic kinesin microtubule-associated protein Eg5 (Kif11) siRNA
tgtgccacactccaagacctgtg

SEQ ID NO: 4471 - DNA, 23 bp, Artificial Sequence
  mitotic kinesin microtubule-associated protein Eg5 (Kif11) siRNA
gtgccacactccaagacctgtgc

SEQ ID NO: 4472 - DNA, 23 bp, Artificial Sequence
  mitotic kinesin microtubule-associated protein Eg5 (Kif11) siRNA
tgccacactccaagacctgtgcc

SEQ ID NO: 4473 - DNA, 23 bp, Artificial Sequence
  mitotic kinesin microtubule-associated protein Eg5 (Kif11) siRNA
gccacactccaagacctgtgcct

SEQ ID NO: 4474 - DNA, 23 bp, Artificial Sequence
  mitotic kinesin microtubule-associated protein Eg5 (Kif11) siRNA
ccacactccaagacctgtgcctt

SEQ ID NO: 4475 - DNA, 23 bp, Artificial Sequence
  mitotic kinesin microtubule-associated protein Eg5 (Kif11) siRNA
cacactccaagacctgtgccttt

SEQ ID NO: 4476 - DNA, 23 bp, Artificial Sequence
  mitotic kinesin microtubule-associated protein Eg5 (Kif11) siRNA
acactccaagacctgtgcctttt

SEQ ID NO: 4477 - DNA, 23 bp, Artificial Sequence
  mitotic kinesin microtubule-associated protein Eg5 (Kif11) siRNA
cactccaagacctgtgcctttta

SEQ ID NO: 4478 - DNA, 23 bp, Artificial Sequence
  mitotic kinesin microtubule-associated protein Eg5 (Kif11) siRNA
actccaagacctgtgccttttag

SEQ ID NO: 4479 - DNA, 23 bp, Artificial Sequence
  mitotic kinesin microtubule-associated protein Eg5 (Kif11) siRNA
ctccaagacctgtgccttttaga

SEQ ID NO: 4480 - DNA, 23 bp, Artificial Sequence
  mitotic kinesin microtubule-associated protein Eg5 (Kif11) siRNA
tccaagacctgtgccttttagag

SEQ ID NO: 4481 - DNA, 23 bp, Artificial Sequence
  mitotic kinesin microtubule-associated protein Eg5 (Kif11) siRNA
ccaagacctgtgccttttagaga

SEQ ID NO: 4482 - DNA, 23 bp, Artificial Sequence
  mitotic kinesin microtubule-associated protein Eg5 (Kif11) siRNA
caagacctgtgccttttagagaa

SEQ ID NO: 4483 - DNA, 23 bp, Artificial Sequence
  mitotic kinesin microtubule-associated protein Eg5 (Kif11) siRNA
aagacctgtgccttttagagaag

SEQ ID NO: 4484 - DNA, 23 bp, Artificial Sequence
  mitotic kinesin microtubule-associated protein Eg5 (Kif11) siRNA
agacctgtgccttttagagaagc

SEQ ID NO: 4485 - DNA, 23 bp, Artificial Sequence
  mitotic kinesin microtubule-associated protein Eg5 (Kif11) siRNA
gacctgtgccttttagagaagct

SEQ ID NO: 4486 - DNA, 23 bp, Artificial Sequence
  mitotic kinesin microtubule-associated protein Eg5 (Kif11) siRNA
acctgtgccttttagagaagctc

SEQ ID NO: 4487 - DNA, 23 bp, Artificial Sequence
  mitotic kinesin microtubule-associated protein Eg5 (Kif11) siRNA
cctgtgccttttagagaagctca

SEQ ID NO: 4488 - DNA, 23 bp, Artificial Sequence
  mitotic kinesin microtubule-associated protein Eg5 (Kif11) siRNA
ctgtgccttttagagaagctcac

SEQ ID NO: 4489 - DNA, 23 bp, Artificial Sequence
  mitotic kinesin microtubule-associated protein Eg5 (Kif11) siRNA
tgtgccttttagagaagctcaca

SEQ ID NO: 4490 - DNA, 23 bp, Artificial Sequence
  mitotic kinesin microtubule-associated protein Eg5 (Kif11) siRNA
gtgccttttagagaagctcacaa

SEQ ID NO: 4491 - DNA, 23 bp, Artificial Sequence
  mitotic kinesin microtubule-associated protein Eg5 (Kif11) siRNA
tgccttttagagaagctcacaat

SEQ ID NO: 4492 - DNA, 23 bp, Artificial Sequence
  mitotic kinesin microtubule-associated protein Eg5 (Kif11) siRNA
gccttttagagaagctcacaatg

SEQ ID NO: 4493 - DNA, 23 bp, Artificial Sequence
  mitotic kinesin microtubule-associated protein Eg5 (Kif11) siRNA
ccttttagagaagctcacaatga

SEQ ID NO: 4494 - DNA, 23 bp, Artificial Sequence
  mitotic kinesin microtubule-associated protein Eg5 (Kif11) siRNA
cttttagagaagctcacaatgat

SEQ ID NO: 4495 - DNA, 23 bp, Artificial Sequence
  mitotic kinesin microtubule-associated protein Eg5 (Kif11) siRNA
ttttagagaagctcacaatgatt

SEQ ID NO: 4496 - DNA, 23 bp, Artificial Sequence
  mitotic kinesin microtubule-associated protein Eg5 (Kif11) siRNA
tttagagaagctcacaatgattt

SEQ ID NO: 4497 - DNA, 23 bp, Artificial Sequence
  mitotic kinesin microtubule-associated protein Eg5 (Kif11) siRNA
ttagagaagctcacaatgattta

SEQ ID NO: 4498 - DNA, 23 bp, Artificial Sequence
  mitotic kinesin microtubule-associated protein Eg5 (Kif11) siRNA
tagagaagctcacaatgatttaa

SEQ ID NO: 4499 - DNA, 23 bp, Artificial Sequence
  mitotic kinesin microtubule-associated protein Eg5 (Kif11) siRNA
agagaagctcacaatgatttaag

SEQ ID NO: 4500 - DNA, 23 bp, Artificial Sequence
  mitotic kinesin microtubule-associated protein Eg5 (Kif11) siRNA
gagaagctcacaatgatttaagg

SEQ ID NO: 4501 - DNA, 23 bp, Artificial Sequence
  mitotic kinesin microtubule-associated protein Eg5 (Kif11) siRNA
agaagctcacaatgatttaagga

SEQ ID NO: 4502 - DNA, 23 bp, Artificial Sequence
  mitotic kinesin microtubule-associated protein Eg5 (Kif11) siRNA
gaagctcacaatgatttaaggac

SEQ ID NO: 4503 - DNA, 23 bp, Artificial Sequence
  mitotic kinesin microtubule-associated protein Eg5 (Kif11) siRNA
aagctcacaatgatttaaggact

SEQ ID NO: 4504 - DNA, 23 bp, Artificial Sequence
  mitotic kinesin microtubule-associated protein Eg5 (Kif11) siRNA
agctcacaatgatttaaggactg

SEQ ID NO: 4505 - DNA, 23 bp, Artificial Sequence
  mitotic kinesin microtubule-associated protein Eg5 (Kif11) siRNA
gctcacaatgatttaaggactgt

SEQ ID NO: 4506 - DNA, 23 bp, Artificial Sequence
  mitotic kinesin microtubule-associated protein Eg5 (Kif11) siRNA
ctcacaatgatttaaggactgtt

SEQ ID NO: 4507 - DNA, 23 bp, Artificial Sequence
  mitotic kinesin microtubule-associated protein Eg5 (Kif11) siRNA
tcacaatgatttaaggactgttt

SEQ ID NO: 4508 - DNA, 23 bp, Artificial Sequence
  mitotic kinesin microtubule-associated protein Eg5 (Kif11) siRNA
cacaatgatttaaggactgtttg

SEQ ID NO: 4509 - DNA, 23 bp, Artificial Sequence
  mitotic kinesin microtubule-associated protein Eg5 (Kif11) siRNA
acaatgatttaaggactgtttga

SEQ ID NO: 4510 - DNA, 23 bp, Artificial Sequence
  mitotic kinesin microtubule-associated protein Eg5 (Kif11) siRNA
caatgatttaaggactgtttgaa

SEQ ID NO: 4511 - DNA, 23 bp, Artificial Sequence
  mitotic kinesin microtubule-associated protein Eg5 (Kif11) siRNA
aatgatttaaggactgtttgaaa

SEQ ID NO: 4512 - DNA, 23 bp, Artificial Sequence
  mitotic kinesin microtubule-associated protein Eg5 (Kif11) siRNA
atgatttaaggactgtttgaaac

SEQ ID NO: 4513 - DNA, 23 bp, Artificial Sequence
  mitotic kinesin microtubule-associated protein Eg5 (Kif11) siRNA
tgatttaaggactgtttgaaact

SEQ ID NO: 4514 - DNA, 23 bp, Artificial Sequence
  mitotic kinesin microtubule-associated protein Eg5 (Kif11) siRNA
gatttaaggactgtttgaaactt

SEQ ID NO: 4515 - DNA, 23 bp, Artificial Sequence
  mitotic kinesin microtubule-associated protein Eg5 (Kif11) siRNA
atttaaggactgtttgaaacttc

SEQ ID NO: 4516 - DNA, 23 bp, Artificial Sequence
  mitotic kinesin microtubule-associated protein Eg5 (Kif11) siRNA
tttaaggactgtttgaaacttcc

SEQ ID NO: 4517 - DNA, 23 bp, Artificial Sequence
  mitotic kinesin microtubule-associated protein Eg5 (Kif11) siRNA
ttaaggactgtttgaaacttcca

SEQ ID NO: 4518 - DNA, 23 bp, Artificial Sequence
  mitotic kinesin microtubule-associated protein Eg5 (Kif11) siRNA
taaggactgtttgaaacttccaa

SEQ ID NO: 4519 - DNA, 23 bp, Artificial Sequence
  mitotic kinesin microtubule-associated protein Eg5 (Kif11) siRNA
aaggactgtttgaaacttccaat

SEQ ID NO: 4520 - DNA, 23 bp, Artificial Sequence
  mitotic kinesin microtubule-associated protein Eg5 (Kif11) siRNA
aggactgtttgaaacttccaatt

SEQ ID NO: 4521 - DNA, 23 bp, Artificial Sequence
  mitotic kinesin microtubule-associated protein Eg5 (Kif11) siRNA
ggactgtttgaaacttccaatta

SEQ ID NO: 4522 - DNA, 23 bp, Artificial Sequence
  mitotic kinesin microtubule-associated protein Eg5 (Kif11) siRNA
gactgtttgaaacttccaattat

SEQ ID NO: 4523 - DNA, 23 bp, Artificial Sequence
  mitotic kinesin microtubule-associated protein Eg5 (Kif11) siRNA
actgtttgaaacttccaattatg

SEQ ID NO: 4524 - DNA, 23 bp, Artificial Sequence
  mitotic kinesin microtubule-associated protein Eg5 (Kif11) siRNA
ctgtttgaaacttccaattatgt

SEQ ID NO: 4525 - DNA, 23 bp, Artificial Sequence
  mitotic kinesin microtubule-associated protein Eg5 (Kif11) siRNA
tgtttgaaacttccaattatgtc

SEQ ID NO: 4526 - DNA, 23 bp, Artificial Sequence
  mitotic kinesin microtubule-associated protein Eg5 (Kif11) siRNA
gtttgaaacttccaattatgtct

SEQ ID NO: 4527 - DNA, 23 bp, Artificial Sequence
  mitotic kinesin microtubule-associated protein Eg5 (Kif11) siRNA
tttgaaacttccaattatgtcta

SEQ ID NO: 4528 - DNA, 23 bp, Artificial Sequence
  mitotic kinesin microtubule-associated protein Eg5 (Kif11) siRNA
ttgaaacttccaattatgtctat

SEQ ID NO: 4529 - DNA, 23 bp, Artificial Sequence
  mitotic kinesin microtubule-associated protein Eg5 (Kif11) siRNA
tgaaacttccaattatgtctata

SEQ ID NO: 4530 - DNA, 23 bp, Artificial Sequence
  mitotic kinesin microtubule-associated protein Eg5 (Kif11) siRNA
gaaacttccaattatgtctataa

SEQ ID NO: 4531 - DNA, 23 bp, Artificial Sequence
  mitotic kinesin microtubule-associated protein Eg5 (Kif11) siRNA
aaacttccaattatgtctataat

SEQ ID NO: 4532 - DNA, 23 bp, Artificial Sequence
  mitotic kinesin microtubule-associated protein Eg5 (Kif11) siRNA
aacttccaattatgtctataatt

SEQ ID NO: 4533 - DNA, 23 bp, Artificial Sequence
  mitotic kinesin microtubule-associated protein Eg5 (Kif11) siRNA
acttccaattatgtctataattt

SEQ ID NO: 4534 - DNA, 23 bp, Artificial Sequence
  mitotic kinesin microtubule-associated protein Eg5 (Kif11) siRNA
cttccaattatgtctataattta

SEQ ID NO: 4535 - DNA, 23 bp, Artificial Sequence
  mitotic kinesin microtubule-associated protein Eg5 (Kif11) siRNA
ttccaattatgtctataatttat

SEQ ID NO: 4536 - DNA, 23 bp, Artificial Sequence
  mitotic kinesin microtubule-associated protein Eg5 (Kif11) siRNA
tccaattatgtctataatttata

SEQ ID NO: 4537 - DNA, 23 bp, Artificial Sequence
  mitotic kinesin microtubule-associated protein Eg5 (Kif11) siRNA
ccaattatgtctataatttatat

SEQ ID NO: 4538 - DNA, 23 bp, Artificial Sequence
  mitotic kinesin microtubule-associated protein Eg5 (Kif11) siRNA
caattatgtctataatttatatt

SEQ ID NO: 4539 - DNA, 23 bp, Artificial Sequence
  mitotic kinesin microtubule-associated protein Eg5 (Kif11) siRNA
aattatgtctataatttatattc

SEQ ID NO: 4540 - DNA, 23 bp, Artificial Sequence
  mitotic kinesin microtubule-associated protein Eg5 (Kif11) siRNA
attatgtctataatttatattct

SEQ ID NO: 4541 - DNA, 23 bp, Artificial Sequence
  mitotic kinesin microtubule-associated protein Eg5 (Kif11) siRNA
ttatgtctataatttatattctt

SEQ ID NO: 4542 - DNA, 23 bp, Artificial Sequence
  mitotic kinesin microtubule-associated protein Eg5 (Kif11) siRNA
tatgtctataatttatattcttt

SEQ ID NO: 4543 - DNA, 23 bp, Artificial Sequence
  mitotic kinesin microtubule-associated protein Eg5 (Kif11) siRNA
atgtctataatttatattctttt

SEQ ID NO: 4544 - DNA, 23 bp, Artificial Sequence
  mitotic kinesin microtubule-associated protein Eg5 (Kif11) siRNA
tgtctataatttatattcttttg

SEQ ID NO: 4545 - DNA, 23 bp, Artificial Sequence
  mitotic kinesin microtubule-associated protein Eg5 (Kif11) siRNA
gtctataatttatattcttttgt

SEQ ID NO: 4546 - DNA, 23 bp, Artificial Sequence
  mitotic kinesin microtubule-associated protein Eg5 (Kif11) siRNA
tctataatttatattcttttgtt

SEQ ID NO: 4547 - DNA, 23 bp, Artificial Sequence
  mitotic kinesin microtubule-associated protein Eg5 (Kif11) siRNA
ctataatttatattcttttgttt

SEQ ID NO: 4548 - DNA, 23 bp, Artificial Sequence
  mitotic kinesin microtubule-associated protein Eg5 (Kif11) siRNA
tataatttatattcttttgttta

SEQ ID NO: 4549 - DNA, 23 bp, Artificial Sequence
  mitotic kinesin microtubule-associated protein Eg5 (Kif11) siRNA
ataatttatattcttttgtttac

SEQ ID NO: 4550 - DNA, 23 bp, Artificial Sequence
  mitotic kinesin microtubule-associated protein Eg5 (Kif11) siRNA
taatttatattcttttgtttaca

SEQ ID NO: 4551 - DNA, 23 bp, Artificial Sequence
  mitotic kinesin microtubule-associated protein Eg5 (Kif11) siRNA
aatttatattcttttgtttacat

SEQ ID NO: 4552 - DNA, 23 bp, Artificial Sequence
  mitotic kinesin microtubule-associated protein Eg5 (Kif11) siRNA
atttatattcttttgtttacatg

SEQ ID NO: 4553 - DNA, 23 bp, Artificial Sequence
  mitotic kinesin microtubule-associated protein Eg5 (Kif11) siRNA
tttatattcttttgtttacatga

SEQ ID NO: 4554 - DNA, 23 bp, Artificial Sequence
  mitotic kinesin microtubule-associated protein Eg5 (Kif11) siRNA
ttatattcttttgtttacatgat

SEQ ID NO: 4555 - DNA, 23 bp, Artificial Sequence
  mitotic kinesin microtubule-associated protein Eg5 (Kif11) siRNA
tatattcttttgtttacatgatg

SEQ ID NO: 4556 - DNA, 23 bp, Artificial Sequence
  mitotic kinesin microtubule-associated protein Eg5 (Kif11) siRNA
atattcttttgtttacatgatga

SEQ ID NO: 4557 - DNA, 23 bp, Artificial Sequence
  mitotic kinesin microtubule-associated protein Eg5 (Kif11) siRNA
tattcttttgtttacatgatgaa

SEQ ID NO: 4558 - DNA, 23 bp, Artificial Sequence
  mitotic kinesin microtubule-associated protein Eg5 (Kif11) siRNA
attcttttgtttacatgatgaaa

SEQ ID NO: 4559 - DNA, 23 bp, Artificial Sequence
  mitotic kinesin microtubule-associated protein Eg5 (Kif11) siRNA
ttcttttgtttacatgatgaaac

SEQ ID NO: 4560 - DNA, 23 bp, Artificial Sequence
  mitotic kinesin microtubule-associated protein Eg5 (Kif11) siRNA
tcttttgtttacatgatgaaact

SEQ ID NO: 4561 - DNA, 23 bp, Artificial Sequence
  mitotic kinesin microtubule-associated protein Eg5 (Kif11) siRNA
cttttgtttacatgatgaaactt

SEQ ID NO: 4562 - DNA, 23 bp, Artificial Sequence
  mitotic kinesin microtubule-associated protein Eg5 (Kif11) siRNA
ttttgtttacatgatgaaacttt

SEQ ID NO: 4563 - DNA, 23 bp, Artificial Sequence
  mitotic kinesin microtubule-associated protein Eg5 (Kif11) siRNA
tttgtttacatgatgaaactttt

SEQ ID NO: 4564 - DNA, 23 bp, Artificial Sequence
  mitotic kinesin microtubule-associated protein Eg5 (Kif11) siRNA
ttgtttacatgatgaaacttttt

SEQ ID NO: 4565 - DNA, 23 bp, Artificial Sequence
  mitotic kinesin microtubule-associated protein Eg5 (Kif11) siRNA
tgtttacatgatgaaactttttg

SEQ ID NO: 4566 - DNA, 23 bp, Artificial Sequence
  mitotic kinesin microtubule-associated protein Eg5 (Kif11) siRNA
gtttacatgatgaaactttttgt

SEQ ID NO: 4567 - DNA, 23 bp, Artificial Sequence
  mitotic kinesin microtubule-associated protein Eg5 (Kif11) siRNA
tttacatgatgaaactttttgtt

SEQ ID NO: 4568 - DNA, 23 bp, Artificial Sequence
  mitotic kinesin microtubule-associated protein Eg5 (Kif11) siRNA
ttacatgatgaaactttttgttg

SEQ ID NO: 4569 - DNA, 23 bp, Artificial Sequence
  mitotic kinesin microtubule-associated protein Eg5 (Kif11) siRNA
tacatgatgaaactttttgttgt

SEQ ID NO: 4570 - DNA, 23 bp, Artificial Sequence
  mitotic kinesin microtubule-associated protein Eg5 (Kif11) siRNA
acatgatgaaactttttgttgtt

SEQ ID NO: 4571 - DNA, 23 bp, Artificial Sequence
  mitotic kinesin microtubule-associated protein Eg5 (Kif11) siRNA
catgatgaaactttttgttgttg

SEQ ID NO: 4572 - DNA, 23 bp, Artificial Sequence
  mitotic kinesin microtubule-associated protein Eg5 (Kif11) siRNA
atgatgaaactttttgttgttgc

SEQ ID NO: 4573 - DNA, 23 bp, Artificial Sequence
  mitotic kinesin microtubule-associated protein Eg5 (Kif11) siRNA
tgatgaaactttttgttgttgct

SEQ ID NO: 4574 - DNA, 23 bp, Artificial Sequence
  mitotic kinesin microtubule-associated protein Eg5 (Kif11) siRNA
gatgaaactttttgttgttgctt

SEQ ID NO: 4575 - DNA, 23 bp, Artificial Sequence
  mitotic kinesin microtubule-associated protein Eg5 (Kif11) siRNA
atgaaactttttgttgttgcttg

SEQ ID NO: 4576 - DNA, 23 bp, Artificial Sequence
  mitotic kinesin microtubule-associated protein Eg5 (Kif11) siRNA
tgaaactttttgttgttgcttgt

SEQ ID NO: 4577 - DNA, 23 bp, Artificial Sequence
  mitotic kinesin microtubule-associated protein Eg5 (Kif11) siRNA
gaaactttttgttgttgcttgtt

SEQ ID NO: 4578 - DNA, 23 bp, Artificial Sequence
  mitotic kinesin microtubule-associated protein Eg5 (Kif11) siRNA
aaactttttgttgttgcttgttt

SEQ ID NO: 4579 - DNA, 23 bp, Artificial Sequence
  mitotic kinesin microtubule-associated protein Eg5 (Kif11) siRNA
aactttttgttgttgcttgtttg

SEQ ID NO: 4580 - DNA, 23 bp, Artificial Sequence
  mitotic kinesin microtubule-associated protein Eg5 (Kif11) siRNA
actttttgttgttgcttgtttgt

SEQ ID NO: 4581 - DNA, 23 bp, Artificial Sequence
  mitotic kinesin microtubule-associated protein Eg5 (Kif11) siRNA
ctttttgttgttgcttgtttgta

SEQ ID NO: 4582 - DNA, 23 bp, Artificial Sequence
  mitotic kinesin microtubule-associated protein Eg5 (Kif11) siRNA
tttttgttgttgcttgtttgtat

SEQ ID NO: 4583 - DNA, 23 bp, Artificial Sequence
  mitotic kinesin microtubule-associated protein Eg5 (Kif11) siRNA
ttttgttgttgcttgtttgtata

SEQ ID NO: 4584 - DNA, 23 bp, Artificial Sequence
  mitotic kinesin microtubule-associated protein Eg5 (Kif11) siRNA
tttgttgttgcttgtttgtatat

SEQ ID NO: 4585 - DNA, 23 bp, Artificial Sequence
  mitotic kinesin microtubule-associated protein Eg5 (Kif11) siRNA
ttgttgttgcttgtttgtatata

SEQ ID NO: 4586 - DNA, 23 bp, Artificial Sequence
  mitotic kinesin microtubule-associated protein Eg5 (Kif11) siRNA
tgttgttgcttgtttgtatataa

SEQ ID NO: 4587 - DNA, 23 bp, Artificial Sequence
  mitotic kinesin microtubule-associated protein Eg5 (Kif11) siRNA
gttgttgcttgtttgtatataat

SEQ ID NO: 4588 - DNA, 23 bp, Artificial Sequence
  mitotic kinesin microtubule-associated protein Eg5 (Kif11) siRNA
ttgttgcttgtttgtatataata

SEQ ID NO: 4589 - DNA, 23 bp, Artificial Sequence
  mitotic kinesin microtubule-associated protein Eg5 (Kif11) siRNA
tgttgcttgtttgtatataatac

SEQ ID NO: 4590 - DNA, 23 bp, Artificial Sequence
  mitotic kinesin microtubule-associated protein Eg5 (Kif11) siRNA
gttgcttgtttgtatataataca

SEQ ID NO: 4591 - DNA, 23 bp, Artificial Sequence
  mitotic kinesin microtubule-associated protein Eg5 (Kif11) siRNA
ttgcttgtttgtatataatacaa

SEQ ID NO: 4592 - DNA, 23 bp, Artificial Sequence
  mitotic kinesin microtubule-associated protein Eg5 (Kif11) siRNA
tgcttgtttgtatataatacaat

SEQ ID NO: 4593 - DNA, 23 bp, Artificial Sequence
  mitotic kinesin microtubule-associated protein Eg5 (Kif11) siRNA
gcttgtttgtatataatacaatg

SEQ ID NO: 4594 - DNA, 23 bp, Artificial Sequence
  mitotic kinesin microtubule-associated protein Eg5 (Kif11) siRNA
cttgtttgtatataatacaatgt

SEQ ID NO: 4595 - DNA, 23 bp, Artificial Sequence
  mitotic kinesin microtubule-associated protein Eg5 (Kif11) siRNA
ttgtttgtatataatacaatgtg

SEQ ID NO: 4596 - DNA, 23 bp, Artificial Sequence
  mitotic kinesin microtubule-associated protein Eg5 (Kif11) siRNA
tgtttgtatataatacaatgtgt

SEQ ID NO: 4597 - DNA, 23 bp, Artificial Sequence
  mitotic kinesin microtubule-associated protein Eg5 (Kif11) siRNA
gtttgtatataatacaatgtgta

SEQ ID NO: 4598 - DNA, 23 bp, Artificial Sequence
  mitotic kinesin microtubule-associated protein Eg5 (Kif11) siRNA
tttgtatataatacaatgtgtac

SEQ ID NO: 4599 - DNA, 23 bp, Artificial Sequence
  mitotic kinesin microtubule-associated protein Eg5 (Kif11) siRNA
ttgtatataatacaatgtgtaca

SEQ ID NO: 4600 - DNA, 23 bp, Artificial Sequence
  mitotic kinesin microtubule-associated protein Eg5 (Kif11) siRNA
tgtatataatacaatgtgtacat

SEQ ID NO: 4601 - DNA, 23 bp, Artificial Sequence
  mitotic kinesin microtubule-associated protein Eg5 (Kif11) siRNA
gtatataatacaatgtgtacatg

SEQ ID NO: 4602 - DNA, 23 bp, Artificial Sequence
  mitotic kinesin microtubule-associated protein Eg5 (Kif11) siRNA
tatataatacaatgtgtacatgt

SEQ ID NO: 4603 - DNA, 23 bp, Artificial Sequence
  mitotic kinesin microtubule-associated protein Eg5 (Kif11) siRNA
atataatacaatgtgtacatgta

SEQ ID NO: 4604 - DNA, 23 bp, Artificial Sequence
  mitotic kinesin microtubule-associated protein Eg5 (Kif11) siRNA
tataatacaatgtgtacatgtat

SEQ ID NO: 4605 - DNA, 23 bp, Artificial Sequence
  mitotic kinesin microtubule-associated protein Eg5 (Kif11) siRNA
ataatacaatgtgtacatgtatc

SEQ ID NO: 4606 - DNA, 23 bp, Artificial Sequence
  mitotic kinesin microtubule-associated protein Eg5 (Kif11) siRNA
taatacaatgtgtacatgtatct

SEQ ID NO: 4607 - DNA, 23 bp, Artificial Sequence
  mitotic kinesin microtubule-associated protein Eg5 (Kif11) siRNA
aatacaatgtgtacatgtatctt

SEQ ID NO: 4608 - DNA, 23 bp, Artificial Sequence
  mitotic kinesin microtubule-associated protein Eg5 (Kif11) siRNA
atacaatgtgtacatgtatcttt

SEQ ID NO: 4609 - DNA, 23 bp, Artificial Sequence
  mitotic kinesin microtubule-associated protein Eg5 (Kif11) siRNA
tacaatgtgtacatgtatctttt

SEQ ID NO: 4610 - DNA, 23 bp, Artificial Sequence
  mitotic kinesin microtubule-associated protein Eg5 (Kif11) siRNA
acaatgtgtacatgtatcttttt

SEQ ID NO: 4611 - DNA, 23 bp, Artificial Sequence
  mitotic kinesin microtubule-associated protein Eg5 (Kif11) siRNA
caatgtgtacatgtatctttttc

SEQ ID NO: 4612 - DNA, 23 bp, Artificial Sequence
  mitotic kinesin microtubule-associated protein Eg5 (Kif11) siRNA
aatgtgtacatgtatctttttct

SEQ ID NO: 4613 - DNA, 23 bp, Artificial Sequence
  mitotic kinesin microtubule-associated protein Eg5 (Kif11) siRNA
atgtgtacatgtatctttttctc

SEQ ID NO: 4614 - DNA, 23 bp, Artificial Sequence
  mitotic kinesin microtubule-associated protein Eg5 (Kif11) siRNA
tgtgtacatgtatctttttctcg

SEQ ID NO: 4615 - DNA, 23 bp, Artificial Sequence
  mitotic kinesin microtubule-associated protein Eg5 (Kif11) siRNA
gtgtacatgtatctttttctcga

SEQ ID NO: 4616 - DNA, 23 bp, Artificial Sequence
  mitotic kinesin microtubule-associated protein Eg5 (Kif11) siRNA
tgtacatgtatctttttctcgat

SEQ ID NO: 4617 - DNA, 23 bp, Artificial Sequence
  mitotic kinesin microtubule-associated protein Eg5 (Kif11) siRNA
gtacatgtatctttttctcgatt

SEQ ID NO: 4618 - DNA, 23 bp, Artificial Sequence
  mitotic kinesin microtubule-associated protein Eg5 (Kif11) siRNA
tacatgtatctttttctcgattc

SEQ ID NO: 4619 - DNA, 23 bp, Artificial Sequence
  mitotic kinesin microtubule-associated protein Eg5 (Kif11) siRNA
acatgtatctttttctcgattca

SEQ ID NO: 4620 - DNA, 23 bp, Artificial Sequence
  mitotic kinesin microtubule-associated protein Eg5 (Kif11) siRNA
catgtatctttttctcgattcaa

SEQ ID NO: 4621 - DNA, 23 bp, Artificial Sequence
  mitotic kinesin microtubule-associated protein Eg5 (Kif11) siRNA
atgtatctttttctcgattcaaa

SEQ ID NO: 4622 - DNA, 23 bp, Artificial Sequence
  mitotic kinesin microtubule-associated protein Eg5 (Kif11) siRNA
tgtatctttttctcgattcaaat

SEQ ID NO: 4623 - DNA, 23 bp, Artificial Sequence
  mitotic kinesin microtubule-associated protein Eg5 (Kif11) siRNA
gtatctttttctcgattcaaatc

SEQ ID NO: 4624 - DNA, 23 bp, Artificial Sequence
  mitotic kinesin microtubule-associated protein Eg5 (Kif11) siRNA
tatctttttctcgattcaaatct

SEQ ID NO: 4625 - DNA, 23 bp, Artificial Sequence
  mitotic kinesin microtubule-associated protein Eg5 (Kif11) siRNA
atctttttctcgattcaaatctt

SEQ ID NO: 4626 - DNA, 23 bp, Artificial Sequence
  mitotic kinesin microtubule-associated protein Eg5 (Kif11) siRNA
tctttttctcgattcaaatctta

SEQ ID NO: 4627 - DNA, 23 bp, Artificial Sequence
  mitotic kinesin microtubule-associated protein Eg5 (Kif11) siRNA
ctttttctcgattcaaatcttaa

SEQ ID NO: 4628 - DNA, 23 bp, Artificial Sequence
  mitotic kinesin microtubule-associated protein Eg5 (Kif11) siRNA
tttttctcgattcaaatcttaac

SEQ ID NO: 4629 - DNA, 23 bp, Artificial Sequence
  mitotic kinesin microtubule-associated protein Eg5 (Kif11) siRNA
ttttctcgattcaaatcttaacc

SEQ ID NO: 4630 - DNA, 23 bp, Artificial Sequence
  mitotic kinesin microtubule-associated protein Eg5 (Kif11) siRNA
tttctcgattcaaatcttaaccc

SEQ ID NO: 4631 - DNA, 23 bp, Artificial Sequence
  mitotic kinesin microtubule-associated protein Eg5 (Kif11) siRNA
ttctcgattcaaatcttaaccct

SEQ ID NO: 4632 - DNA, 23 bp, Artificial Sequence
  mitotic kinesin microtubule-associated protein Eg5 (Kif11) siRNA
tctcgattcaaatcttaaccctt

SEQ ID NO: 4633 - DNA, 23 bp, Artificial Sequence
  mitotic kinesin microtubule-associated protein Eg5 (Kif11) siRNA
ctcgattcaaatcttaaccctta

SEQ ID NO: 4634 - DNA, 23 bp, Artificial Sequence
  mitotic kinesin microtubule-associated protein Eg5 (Kif11) siRNA
tcgattcaaatcttaacccttag

SEQ ID NO: 4635 - DNA, 23 bp, Artificial Sequence
  mitotic kinesin microtubule-associated protein Eg5 (Kif11) siRNA
cgattcaaatcttaacccttagg

SEQ ID NO: 4636 - DNA, 23 bp, Artificial Sequence
  mitotic kinesin microtubule-associated protein Eg5 (Kif11) siRNA
gattcaaatcttaacccttagga

SEQ ID NO: 4637 - DNA, 23 bp, Artificial Sequence
  mitotic kinesin microtubule-associated protein Eg5 (Kif11) siRNA
attcaaatcttaacccttaggac

SEQ ID NO: 4638 - DNA, 23 bp, Artificial Sequence
  mitotic kinesin microtubule-associated protein Eg5 (Kif11) siRNA
ttcaaatcttaacccttaggact

SEQ ID NO: 4639 - DNA, 23 bp, Artificial Sequence
  mitotic kinesin microtubule-associated protein Eg5 (Kif11) siRNA
tcaaatcttaacccttaggactc

SEQ ID NO: 4640 - DNA, 23 bp, Artificial Sequence
  mitotic kinesin microtubule-associated protein Eg5 (Kif11) siRNA
caaatcttaacccttaggactct

SEQ ID NO: 4641 - DNA, 23 bp, Artificial Sequence
  mitotic kinesin microtubule-associated protein Eg5 (Kif11) siRNA
aaatcttaacccttaggactctg

SEQ ID NO: 4642 - DNA, 23 bp, Artificial Sequence
  mitotic kinesin microtubule-associated protein Eg5 (Kif11) siRNA
aatcttaacccttaggactctgg

SEQ ID NO: 4643 - DNA, 23 bp, Artificial Sequence
  mitotic kinesin microtubule-associated protein Eg5 (Kif11) siRNA
atcttaacccttaggactctggt

SEQ ID NO: 4644 - DNA, 23 bp, Artificial Sequence
  mitotic kinesin microtubule-associated protein Eg5 (Kif11) siRNA
tcttaacccttaggactctggta

SEQ ID NO: 4645 - DNA, 23 bp, Artificial Sequence
  mitotic kinesin microtubule-associated protein Eg5 (Kif11) siRNA
cttaacccttaggactctggtat

SEQ ID NO: 4646 - DNA, 23 bp, Artificial Sequence
  mitotic kinesin microtubule-associated protein Eg5 (Kif11) siRNA
ttaacccttaggactctggtatt

SEQ ID NO: 4647 - DNA, 23 bp, Artificial Sequence
  mitotic kinesin microtubule-associated protein Eg5 (Kif11) siRNA
taacccttaggactctggtattt

SEQ ID NO: 4648 - DNA, 23 bp, Artificial Sequence
  mitotic kinesin microtubule-associated protein Eg5 (Kif11) siRNA
aacccttaggactctggtatttt

SEQ ID NO: 4649 - DNA, 23 bp, Artificial Sequence
  mitotic kinesin microtubule-associated protein Eg5 (Kif11) siRNA
acccttaggactctggtattttt

SEQ ID NO: 4650 - DNA, 23 bp, Artificial Sequence
  mitotic kinesin microtubule-associated protein Eg5 (Kif11) siRNA
cccttaggactctggtatttttg

SEQ ID NO: 4651 - DNA, 23 bp, Artificial Sequence
  mitotic kinesin microtubule-associated protein Eg5 (Kif11) siRNA
ccttaggactctggtatttttga

SEQ ID NO: 4652 - DNA, 23 bp, Artificial Sequence
  mitotic kinesin microtubule-associated protein Eg5 (Kif11) siRNA
cttaggactctggtatttttgat

SEQ ID NO: 4653 - DNA, 23 bp, Artificial Sequence
  mitotic kinesin microtubule-associated protein Eg5 (Kif11) siRNA
ttaggactctggtatttttgatc

SEQ ID NO: 4654 - DNA, 23 bp, Artificial Sequence
  mitotic kinesin microtubule-associated protein Eg5 (Kif11) siRNA
taggactctggtatttttgatct

SEQ ID NO: 4655 - DNA, 23 bp, Artificial Sequence
  mitotic kinesin microtubule-associated protein Eg5 (Kif11) siRNA
aggactctggtatttttgatctg

SEQ ID NO: 4656 - DNA, 23 bp, Artificial Sequence
  mitotic kinesin microtubule-associated protein Eg5 (Kif11) siRNA
ggactctggtatttttgatctgg

SEQ ID NO: 4657 - DNA, 23 bp, Artificial Sequence
  mitotic kinesin microtubule-associated protein Eg5 (Kif11) siRNA
gactctggtatttttgatctggc

SEQ ID NO: 4658 - DNA, 23 bp, Artificial Sequence
  mitotic kinesin microtubule-associated protein Eg5 (Kif11) siRNA
actctggtatttttgatctggca

SEQ ID NO: 4659 - DNA, 23 bp, Artificial Sequence
  mitotic kinesin microtubule-associated protein Eg5 (Kif11) siRNA
ctctggtatttttgatctggcaa

SEQ ID NO: 4660 - DNA, 23 bp, Artificial Sequence
  mitotic kinesin microtubule-associated protein Eg5 (Kif11) siRNA
tctggtatttttgatctggcaac

SEQ ID NO: 4661 - DNA, 23 bp, Artificial Sequence
  mitotic kinesin microtubule-associated protein Eg5 (Kif11) siRNA
ctggtatttttgatctggcaacc

SEQ ID NO: 4662 - DNA, 23 bp, Artificial Sequence
  mitotic kinesin microtubule-associated protein Eg5 (Kif11) siRNA
tggtatttttgatctggcaacca

SEQ ID NO: 4663 - DNA, 23 bp, Artificial Sequence
  mitotic kinesin microtubule-associated protein Eg5 (Kif11) siRNA
ggtatttttgatctggcaaccat

SEQ ID NO: 4664 - DNA, 23 bp, Artificial Sequence
  mitotic kinesin microtubule-associated protein Eg5 (Kif11) siRNA
gtatttttgatctggcaaccata

SEQ ID NO: 4665 - DNA, 23 bp, Artificial Sequence
  mitotic kinesin microtubule-associated protein Eg5 (Kif11) siRNA
tatttttgatctggcaaccatat

SEQ ID NO: 4666 - DNA, 23 bp, Artificial Sequence
  mitotic kinesin microtubule-associated protein Eg5 (Kif11) siRNA
atttttgatctggcaaccatatt

SEQ ID NO: 4667 - DNA, 23 bp, Artificial Sequence
  mitotic kinesin microtubule-associated protein Eg5 (Kif11) siRNA
tttttgatctggcaaccatattt

SEQ ID NO: 4668 - DNA, 23 bp, Artificial Sequence
  mitotic kinesin microtubule-associated protein Eg5 (Kif11) siRNA
ttttgatctggcaaccatatttc

SEQ ID NO: 4669 - DNA, 23 bp, Artificial Sequence
  mitotic kinesin microtubule-associated protein Eg5 (Kif11) siRNA
tttgatctggcaaccatatttct

SEQ ID NO: 4670 - DNA, 23 bp, Artificial Sequence
  mitotic kinesin microtubule-associated protein Eg5 (Kif11) siRNA
ttgatctggcaaccatatttctg

SEQ ID NO: 4671 - DNA, 23 bp, Artificial Sequence
  mitotic kinesin microtubule-associated protein Eg5 (Kif11) siRNA
tgatctggcaaccatatttctgg

SEQ ID NO: 4672 - DNA, 23 bp, Artificial Sequence
  mitotic kinesin microtubule-associated protein Eg5 (Kif11) siRNA
gatctggcaaccatatttctgga

SEQ ID NO: 4673 - DNA, 23 bp, Artificial Sequence
  mitotic kinesin microtubule-associated protein Eg5 (Kif11) siRNA
atctggcaaccatatttctggaa

SEQ ID NO: 4674 - DNA, 23 bp, Artificial Sequence
  mitotic kinesin microtubule-associated protein Eg5 (Kif11) siRNA
tctggcaaccatatttctggaag

SEQ ID NO: 4675 - DNA, 23 bp, Artificial Sequence
  mitotic kinesin microtubule-associated protein Eg5 (Kif11) siRNA
ctggcaaccatatttctggaagt

SEQ ID NO: 4676 - DNA, 23 bp, Artificial Sequence
  mitotic kinesin microtubule-associated protein Eg5 (Kif11) siRNA
tggcaaccatatttctggaagtt

SEQ ID NO: 4677 - DNA, 23 bp, Artificial Sequence
  mitotic kinesin microtubule-associated protein Eg5 (Kif11) siRNA
ggcaaccatatttctggaagttg

SEQ ID NO: 4678 - DNA, 23 bp, Artificial Sequence
  mitotic kinesin microtubule-associated protein Eg5 (Kif11) siRNA
gcaaccatatttctggaagttga

SEQ ID NO: 4679 - DNA, 23 bp, Artificial Sequence
  mitotic kinesin microtubule-associated protein Eg5 (Kif11) siRNA
caaccatatttctggaagttgag

SEQ ID NO: 4680 - DNA, 23 bp, Artificial Sequence
  mitotic kinesin microtubule-associated protein Eg5 (Kif11) siRNA
aaccatatttctggaagttgaga

SEQ ID NO: 4681 - DNA, 23 bp, Artificial Sequence
  mitotic kinesin microtubule-associated protein Eg5 (Kif11) siRNA
accatatttctggaagttgagat

SEQ ID NO: 4682 - DNA, 23 bp, Artificial Sequence
  mitotic kinesin microtubule-associated protein Eg5 (Kif11) siRNA
ccatatttctggaagttgagatg

SEQ ID NO: 4683 - DNA, 23 bp, Artificial Sequence
  mitotic kinesin microtubule-associated protein Eg5 (Kif11) siRNA
catatttctggaagttgagatgt

SEQ ID NO: 4684 - DNA, 23 bp, Artificial Sequence
  mitotic kinesin microtubule-associated protein Eg5 (Kif11) siRNA
atatttctggaagttgagatgtt

SEQ ID NO: 4685 - DNA, 23 bp, Artificial Sequence
  mitotic kinesin microtubule-associated protein Eg5 (Kif11) siRNA
tatttctggaagttgagatgttt

SEQ ID NO: 4686 - DNA, 23 bp, Artificial Sequence
  mitotic kinesin microtubule-associated protein Eg5 (Kif11) siRNA
atttctggaagttgagatgtttc

SEQ ID NO: 4687 - DNA, 23 bp, Artificial Sequence
  mitotic kinesin microtubule-associated protein Eg5 (Kif11) siRNA
tttctggaagttgagatgtttca

SEQ ID NO: 4688 - DNA, 23 bp, Artificial Sequence
  mitotic kinesin microtubule-associated protein Eg5 (Kif11) siRNA
ttctggaagttgagatgtttcag

SEQ ID NO: 4689 - DNA, 23 bp, Artificial Sequence
  mitotic kinesin microtubule-associated protein Eg5 (Kif11) siRNA
tctggaagttgagatgtttcagc

SEQ ID NO: 4690 - DNA, 23 bp, Artificial Sequence
  mitotic kinesin microtubule-associated protein Eg5 (Kif11) siRNA
ctggaagttgagatgtttcagct

SEQ ID NO: 4691 - DNA, 23 bp, Artificial Sequence
  mitotic kinesin microtubule-associated protein Eg5 (Kif11) siRNA
tggaagttgagatgtttcagctt

SEQ ID NO: 4692 - DNA, 23 bp, Artificial Sequence
  mitotic kinesin microtubule-associated protein Eg5 (Kif11) siRNA
ggaagttgagatgtttcagcttg

SEQ ID NO: 4693 - DNA, 23 bp, Artificial Sequence
  mitotic kinesin microtubule-associated protein Eg5 (Kif11) siRNA
gaagttgagatgtttcagcttga

SEQ ID NO: 4694 - DNA, 23 bp, Artificial Sequence
  mitotic kinesin microtubule-associated protein Eg5 (Kif11) siRNA
aagttgagatgtttcagcttgaa

SEQ ID NO: 4695 - DNA, 23 bp, Artificial Sequence
  mitotic kinesin microtubule-associated protein Eg5 (Kif11) siRNA
agttgagatgtttcagcttgaag

SEQ ID NO: 4696 - DNA, 23 bp, Artificial Sequence
  mitotic kinesin microtubule-associated protein Eg5 (Kif11) siRNA
gttgagatgtttcagcttgaaga

SEQ ID NO: 4697 - DNA, 23 bp, Artificial Sequence
  mitotic kinesin microtubule-associated protein Eg5 (Kif11) siRNA
ttgagatgtttcagcttgaagaa

SEQ ID NO: 4698 - DNA, 23 bp, Artificial Sequence
  mitotic kinesin microtubule-associated protein Eg5 (Kif11) siRNA
tgagatgtttcagcttgaagaac

SEQ ID NO: 4699 - DNA, 23 bp, Artificial Sequence
  mitotic kinesin microtubule-associated protein Eg5 (Kif11) siRNA
gagatgtttcagcttgaagaacc

SEQ ID NO: 4700 - DNA, 23 bp, Artificial Sequence
  mitotic kinesin microtubule-associated protein Eg5 (Kif11) siRNA
agatgtttcagcttgaagaacca

SEQ ID NO: 4701 - DNA, 23 bp, Artificial Sequence
  mitotic kinesin microtubule-associated protein Eg5 (Kif11) siRNA
gatgtttcagcttgaagaaccaa

SEQ ID NO: 4702 - DNA, 23 bp, Artificial Sequence
  mitotic kinesin microtubule-associated protein Eg5 (Kif11) siRNA
atgtttcagcttgaagaaccaaa

SEQ ID NO: 4703 - DNA, 23 bp, Artificial Sequence
  mitotic kinesin microtubule-associated protein Eg5 (Kif11) siRNA
tgtttcagcttgaagaaccaaaa

SEQ ID NO: 4704 - DNA, 23 bp, Artificial Sequence
  mitotic kinesin microtubule-associated protein Eg5 (Kif11) siRNA
gtttcagcttgaagaaccaaaac

SEQ ID NO: 4705 - DNA, 23 bp, Artificial Sequence
  mitotic kinesin microtubule-associated protein Eg5 (Kif11) siRNA
tttcagcttgaagaaccaaaaca

SEQ ID NO: 4706 - DNA, 23 bp, Artificial Sequence
  mitotic kinesin microtubule-associated protein Eg5 (Kif11) siRNA
ttcagcttgaagaaccaaaacag

SEQ ID NO: 4707 - DNA, 23 bp, Artificial Sequence
  mitotic kinesin microtubule-associated protein Eg5 (Kif11) siRNA
tcagcttgaagaaccaaaacaga

SEQ ID NO: 4708 - DNA, 23 bp, Artificial Sequence
  mitotic kinesin microtubule-associated protein Eg5 (Kif11) siRNA
cagcttgaagaaccaaaacagaa

SEQ ID NO: 4709 - DNA, 23 bp, Artificial Sequence
  mitotic kinesin microtubule-associated protein Eg5 (Kif11) siRNA
agcttgaagaaccaaaacagaag

SEQ ID NO: 4710 - DNA, 23 bp, Artificial Sequence
  mitotic kinesin microtubule-associated protein Eg5 (Kif11) siRNA
gcttgaagaaccaaaacagaagg

SEQ ID NO: 4711 - DNA, 23 bp, Artificial Sequence
  mitotic kinesin microtubule-associated protein Eg5 (Kif11) siRNA
cttgaagaaccaaaacagaagga

SEQ ID NO: 4712 - DNA, 23 bp, Artificial Sequence
  mitotic kinesin microtubule-associated protein Eg5 (Kif11) siRNA
ttgaagaaccaaaacagaaggaa

SEQ ID NO: 4713 - DNA, 23 bp, Artificial Sequence
  mitotic kinesin microtubule-associated protein Eg5 (Kif11) siRNA
tgaagaaccaaaacagaaggaat

SEQ ID NO: 4714 - DNA, 23 bp, Artificial Sequence
  mitotic kinesin microtubule-associated protein Eg5 (Kif11) siRNA
gaagaaccaaaacagaaggaata

SEQ ID NO: 4715 - DNA, 23 bp, Artificial Sequence
  mitotic kinesin microtubule-associated protein Eg5 (Kif11) siRNA
aagaaccaaaacagaaggaatat

SEQ ID NO: 4716 - DNA, 23 bp, Artificial Sequence
  mitotic kinesin microtubule-associated protein Eg5 (Kif11) siRNA
agaaccaaaacagaaggaatatg

SEQ ID NO: 4717 - DNA, 23 bp, Artificial Sequence
  mitotic kinesin microtubule-associated protein Eg5 (Kif11) siRNA
gaaccaaaacagaaggaatatgt

SEQ ID NO: 4718 - DNA, 23 bp, Artificial Sequence
  mitotic kinesin microtubule-associated protein Eg5 (Kif11) siRNA
aaccaaaacagaaggaatatgta

SEQ ID NO: 4719 - DNA, 23 bp, Artificial Sequence
  mitotic kinesin microtubule-associated protein Eg5 (Kif11) siRNA
accaaaacagaaggaatatgtac

SEQ ID NO: 4720 - DNA, 23 bp, Artificial Sequence
  mitotic kinesin microtubule-associated protein Eg5 (Kif11) siRNA
ccaaaacagaaggaatatgtaca

SEQ ID NO: 4721 - DNA, 23 bp, Artificial Sequence
  mitotic kinesin microtubule-associated protein Eg5 (Kif11) siRNA
caaaacagaaggaatatgtacaa

SEQ ID NO: 4722 - DNA, 23 bp, Artificial Sequence
  mitotic kinesin microtubule-associated protein Eg5 (Kif11) siRNA
aaaacagaaggaatatgtacaaa

SEQ ID NO: 4723 - DNA, 23 bp, Artificial Sequence
  mitotic kinesin microtubule-associated protein Eg5 (Kif11) siRNA
aaacagaaggaatatgtacaaag

SEQ ID NO: 4724 - DNA, 23 bp, Artificial Sequence
  mitotic kinesin microtubule-associated protein Eg5 (Kif11) siRNA
aacagaaggaatatgtacaaaga

SEQ ID NO: 4725 - DNA, 23 bp, Artificial Sequence
  mitotic kinesin microtubule-associated protein Eg5 (Kif11) siRNA
acagaaggaatatgtacaaagaa

SEQ ID NO: 4726 - DNA, 23 bp, Artificial Sequence
  mitotic kinesin microtubule-associated protein Eg5 (Kif11) siRNA
cagaaggaatatgtacaaagaat

SEQ ID NO: 4727 - DNA, 23 bp, Artificial Sequence
  mitotic kinesin microtubule-associated protein Eg5 (Kif11) siRNA
agaaggaatatgtacaaagaata

SEQ ID NO: 4728 - DNA, 23 bp, Artificial Sequence
  mitotic kinesin microtubule-associated protein Eg5 (Kif11) siRNA
gaaggaatatgtacaaagaataa

SEQ ID NO: 4729 - DNA, 23 bp, Artificial Sequence
  mitotic kinesin microtubule-associated protein Eg5 (Kif11) siRNA
aaggaatatgtacaaagaataaa

SEQ ID NO: 4730 - DNA, 23 bp, Artificial Sequence
  mitotic kinesin microtubule-associated protein Eg5 (Kif11) siRNA
aggaatatgtacaaagaataaat

SEQ ID NO: 4731 - DNA, 23 bp, Artificial Sequence
  mitotic kinesin microtubule-associated protein Eg5 (Kif11) siRNA
ggaatatgtacaaagaataaatt

SEQ ID NO: 4732 - DNA, 23 bp, Artificial Sequence
  mitotic kinesin microtubule-associated protein Eg5 (Kif11) siRNA
gaatatgtacaaagaataaattt

SEQ ID NO: 4733 - DNA, 23 bp, Artificial Sequence
  mitotic kinesin microtubule-associated protein Eg5 (Kif11) siRNA
aatatgtacaaagaataaatttt

SEQ ID NO: 4734 - DNA, 23 bp, Artificial Sequence
  mitotic kinesin microtubule-associated protein Eg5 (Kif11) siRNA
atatgtacaaagaataaattttc

SEQ ID NO: 4735 - DNA, 23 bp, Artificial Sequence
  mitotic kinesin microtubule-associated protein Eg5 (Kif11) siRNA
tatgtacaaagaataaattttct

SEQ ID NO: 4736 - DNA, 23 bp, Artificial Sequence
  mitotic kinesin microtubule-associated protein Eg5 (Kif11) siRNA
atgtacaaagaataaattttctg

SEQ ID NO: 4737 - DNA, 23 bp, Artificial Sequence
  mitotic kinesin microtubule-associated protein Eg5 (Kif11) siRNA
tgtacaaagaataaattttctgc

SEQ ID NO: 4738 - DNA, 23 bp, Artificial Sequence
  mitotic kinesin microtubule-associated protein Eg5 (Kif11) siRNA
gtacaaagaataaattttctgct

SEQ ID NO: 4739 - DNA, 23 bp, Artificial Sequence
  mitotic kinesin microtubule-associated protein Eg5 (Kif11) siRNA
tacaaagaataaattttctgctc

SEQ ID NO: 4740 - DNA, 23 bp, Artificial Sequence
  mitotic kinesin microtubule-associated protein Eg5 (Kif11) siRNA
acaaagaataaattttctgctca

SEQ ID NO: 4741 - DNA, 23 bp, Artificial Sequence
  mitotic kinesin microtubule-associated protein Eg5 (Kif11) siRNA
caaagaataaattttctgctcac

SEQ ID NO: 4742 - DNA, 23 bp, Artificial Sequence
  mitotic kinesin microtubule-associated protein Eg5 (Kif11) siRNA
aaagaataaattttctgctcacg

SEQ ID NO: 4743 - DNA, 23 bp, Artificial Sequence
  mitotic kinesin microtubule-associated protein Eg5 (Kif11) siRNA
aagaataaattttctgctcacga

SEQ ID NO: 4744 - DNA, 23 bp, Artificial Sequence
  mitotic kinesin microtubule-associated protein Eg5 (Kif11) siRNA
agaataaattttctgctcacgat

SEQ ID NO: 4745 - DNA, 23 bp, Artificial Sequence
  mitotic kinesin microtubule-associated protein Eg5 (Kif11) siRNA
gaataaattttctgctcacgatg

SEQ ID NO: 4746 - DNA, 23 bp, Artificial Sequence
  mitotic kinesin microtubule-associated protein Eg5 (Kif11) siRNA
aataaattttctgctcacgatga

SEQ ID NO: 4747 - DNA, 23 bp, Artificial Sequence
  mitotic kinesin microtubule-associated protein Eg5 (Kif11) siRNA
ataaattttctgctcacgatgag

SEQ ID NO: 4748 - DNA, 23 bp, Artificial Sequence
  mitotic kinesin microtubule-associated protein Eg5 (Kif11) siRNA
taaattttctgctcacgatgagt

SEQ ID NO: 4749 - DNA, 23 bp, Artificial Sequence
  mitotic kinesin microtubule-associated protein Eg5 (Kif11) siRNA
aaattttctgctcacgatgagtt

SEQ ID NO: 4750 - DNA, 23 bp, Artificial Sequence
  mitotic kinesin microtubule-associated protein Eg5 (Kif11) siRNA
aattttctgctcacgatgagttt

SEQ ID NO: 4751 - DNA, 23 bp, Artificial Sequence
  mitotic kinesin microtubule-associated protein Eg5 (Kif11) siRNA
attttctgctcacgatgagttta

SEQ ID NO: 4752 - DNA, 23 bp, Artificial Sequence
  mitotic kinesin microtubule-associated protein Eg5 (Kif11) siRNA
ttttctgctcacgatgagtttag

SEQ ID NO: 4753 - DNA, 23 bp, Artificial Sequence
  mitotic kinesin microtubule-associated protein Eg5 (Kif11) siRNA
tttctgctcacgatgagtttagt

SEQ ID NO: 4754 - DNA, 23 bp, Artificial Sequence
  mitotic kinesin microtubule-associated protein Eg5 (Kif11) siRNA
ttctgctcacgatgagtttagtg

SEQ ID NO: 4755 - DNA, 23 bp, Artificial Sequence
  mitotic kinesin microtubule-associated protein Eg5 (Kif11) siRNA
tctgctcacgatgagtttagtgt

SEQ ID NO: 4756 - DNA, 23 bp, Artificial Sequence
  mitotic kinesin microtubule-associated protein Eg5 (Kif11) siRNA
ctgctcacgatgagtttagtgtg

SEQ ID NO: 4757 - DNA, 23 bp, Artificial Sequence
  mitotic kinesin microtubule-associated protein Eg5 (Kif11) siRNA
tgctcacgatgagtttagtgtgt

SEQ ID NO: 4758 - DNA, 23 bp, Artificial Sequence
  mitotic kinesin microtubule-associated protein Eg5 (Kif11) siRNA
gctcacgatgagtttagtgtgta

SEQ ID NO: 4759 - DNA, 23 bp, Artificial Sequence
  mitotic kinesin microtubule-associated protein Eg5 (Kif11) siRNA
ctcacgatgagtttagtgtgtaa

SEQ ID NO: 4760 - DNA, 23 bp, Artificial Sequence
  mitotic kinesin microtubule-associated protein Eg5 (Kif11) siRNA
tcacgatgagtttagtgtgtaaa

SEQ ID NO: 4761 - DNA, 23 bp, Artificial Sequence
  mitotic kinesin microtubule-associated protein Eg5 (Kif11) siRNA
cacgatgagtttagtgtgtaaag

SEQ ID NO: 4762 - DNA, 23 bp, Artificial Sequence
  mitotic kinesin microtubule-associated protein Eg5 (Kif11) siRNA
acgatgagtttagtgtgtaaagt

SEQ ID NO: 4763 - DNA, 23 bp, Artificial Sequence
  mitotic kinesin microtubule-associated protein Eg5 (Kif11) siRNA
cgatgagtttagtgtgtaaagtt

SEQ ID NO: 4764 - DNA, 23 bp, Artificial Sequence
  mitotic kinesin microtubule-associated protein Eg5 (Kif11) siRNA
gatgagtttagtgtgtaaagttt

SEQ ID NO: 4765 - DNA, 23 bp, Artificial Sequence
  mitotic kinesin microtubule-associated protein Eg5 (Kif11) siRNA
atgagtttagtgtgtaaagttta

SEQ ID NO: 4766 - DNA, 23 bp, Artificial Sequence
  mitotic kinesin microtubule-associated protein Eg5 (Kif11) siRNA
tgagtttagtgtgtaaagtttag

SEQ ID NO: 4767 - DNA, 23 bp, Artificial Sequence
  mitotic kinesin microtubule-associated protein Eg5 (Kif11) siRNA
gagtttagtgtgtaaagtttaga

SEQ ID NO: 4768 - DNA, 23 bp, Artificial Sequence
  mitotic kinesin microtubule-associated protein Eg5 (Kif11) siRNA
agtttagtgtgtaaagtttagag

SEQ ID NO: 4769 - DNA, 23 bp, Artificial Sequence
  mitotic kinesin microtubule-associated protein Eg5 (Kif11) siRNA
gtttagtgtgtaaagtttagaga

SEQ ID NO: 4770 - DNA, 23 bp, Artificial Sequence
  mitotic kinesin microtubule-associated protein Eg5 (Kif11) siRNA
tttagtgtgtaaagtttagagac

SEQ ID NO: 4771 - DNA, 23 bp, Artificial Sequence
  mitotic kinesin microtubule-associated protein Eg5 (Kif11) siRNA
ttagtgtgtaaagtttagagaca

SEQ ID NO: 4772 - DNA, 23 bp, Artificial Sequence
  mitotic kinesin microtubule-associated protein Eg5 (Kif11) siRNA
tagtgtgtaaagtttagagacat

SEQ ID NO: 4773 - DNA, 23 bp, Artificial Sequence
  mitotic kinesin microtubule-associated protein Eg5 (Kif11) siRNA
agtgtgtaaagtttagagacatc

SEQ ID NO: 4774 - DNA, 23 bp, Artificial Sequence
  mitotic kinesin microtubule-associated protein Eg5 (Kif11) siRNA
gtgtgtaaagtttagagacatct

SEQ ID NO: 4775 - DNA, 23 bp, Artificial Sequence
  mitotic kinesin microtubule-associated protein Eg5 (Kif11) siRNA
tgtgtaaagtttagagacatctg

SEQ ID NO: 4776 - DNA, 23 bp, Artificial Sequence
  mitotic kinesin microtubule-associated protein Eg5 (Kif11) siRNA
gtgtaaagtttagagacatctga

SEQ ID NO: 4777 - DNA, 23 bp, Artificial Sequence
  mitotic kinesin microtubule-associated protein Eg5 (Kif11) siRNA
tgtaaagtttagagacatctgac

SEQ ID NO: 4778 - DNA, 23 bp, Artificial Sequence
  mitotic kinesin microtubule-associated protein Eg5 (Kif11) siRNA
gtaaagtttagagacatctgact

SEQ ID NO: 4779 - DNA, 23 bp, Artificial Sequence
  mitotic kinesin microtubule-associated protein Eg5 (Kif11) siRNA
taaagtttagagacatctgactt

SEQ ID NO: 4780 - DNA, 23 bp, Artificial Sequence
  mitotic kinesin microtubule-associated protein Eg5 (Kif11) siRNA
aaagtttagagacatctgacttt

SEQ ID NO: 4781 - DNA, 23 bp, Artificial Sequence
  mitotic kinesin microtubule-associated protein Eg5 (Kif11) siRNA
aagtttagagacatctgactttg

SEQ ID NO: 4782 - DNA, 23 bp, Artificial Sequence
  mitotic kinesin microtubule-associated protein Eg5 (Kif11) siRNA
agtttagagacatctgactttga

SEQ ID NO: 4783 - DNA, 23 bp, Artificial Sequence
  mitotic kinesin microtubule-associated protein Eg5 (Kif11) siRNA
gtttagagacatctgactttgat

SEQ ID NO: 4784 - DNA, 23 bp, Artificial Sequence
  mitotic kinesin microtubule-associated protein Eg5 (Kif11) siRNA
tttagagacatctgactttgata

SEQ ID NO: 4785 - DNA, 23 bp, Artificial Sequence
  mitotic kinesin microtubule-associated protein Eg5 (Kif11) siRNA
ttagagacatctgactttgatag

SEQ ID NO: 4786 - DNA, 23 bp, Artificial Sequence
  mitotic kinesin microtubule-associated protein Eg5 (Kif11) siRNA
tagagacatctgactttgatagc

SEQ ID NO: 4787 - DNA, 23 bp, Artificial Sequence
  mitotic kinesin microtubule-associated protein Eg5 (Kif11) siRNA
agagacatctgactttgatagct

SEQ ID NO: 4788 - DNA, 23 bp, Artificial Sequence
  mitotic kinesin microtubule-associated protein Eg5 (Kif11) siRNA
gagacatctgactttgatagcta

SEQ ID NO: 4789 - DNA, 23 bp, Artificial Sequence
  mitotic kinesin microtubule-associated protein Eg5 (Kif11) siRNA
agacatctgactttgatagctaa

SEQ ID NO: 4790 - DNA, 23 bp, Artificial Sequence
  mitotic kinesin microtubule-associated protein Eg5 (Kif11) siRNA
gacatctgactttgatagctaaa

SEQ ID NO: 4791 - DNA, 23 bp, Artificial Sequence
  mitotic kinesin microtubule-associated protein Eg5 (Kif11) siRNA
acatctgactttgatagctaaat

SEQ ID NO: 4792 - DNA, 23 bp, Artificial Sequence
  mitotic kinesin microtubule-associated protein Eg5 (Kif11) siRNA
catctgactttgatagctaaatt

SEQ ID NO: 4793 - DNA, 23 bp, Artificial Sequence
  mitotic kinesin microtubule-associated protein Eg5 (Kif11) siRNA
atctgactttgatagctaaatta

SEQ ID NO: 4794 - DNA, 23 bp, Artificial Sequence
  mitotic kinesin microtubule-associated protein Eg5 (Kif11) siRNA
tctgactttgatagctaaattaa

SEQ ID NO: 4795 - DNA, 23 bp, Artificial Sequence
  mitotic kinesin microtubule-associated protein Eg5 (Kif11) siRNA
ctgactttgatagctaaattaaa

SEQ ID NO: 4796 - DNA, 23 bp, Artificial Sequence
  mitotic kinesin microtubule-associated protein Eg5 (Kif11) siRNA
tgactttgatagctaaattaaac

SEQ ID NO: 4797 - DNA, 23 bp, Artificial Sequence
  mitotic kinesin microtubule-associated protein Eg5 (Kif11) siRNA
gactttgatagctaaattaaacc

SEQ ID NO: 4798 - DNA, 23 bp, Artificial Sequence
  mitotic kinesin microtubule-associated protein Eg5 (Kif11) siRNA
actttgatagctaaattaaacca

SEQ ID NO: 4799 - DNA, 23 bp, Artificial Sequence
  mitotic kinesin microtubule-associated protein Eg5 (Kif11) siRNA
ctttgatagctaaattaaaccaa

SEQ ID NO: 4800 - DNA, 23 bp, Artificial Sequence
  mitotic kinesin microtubule-associated protein Eg5 (Kif11) siRNA
tttgatagctaaattaaaccaaa

SEQ ID NO: 4801 - DNA, 23 bp, Artificial Sequence
  mitotic kinesin microtubule-associated protein Eg5 (Kif11) siRNA
ttgatagctaaattaaaccaaac

SEQ ID NO: 4802 - DNA, 23 bp, Artificial Sequence
  mitotic kinesin microtubule-associated protein Eg5 (Kif11) siRNA
tgatagctaaattaaaccaaacc

SEQ ID NO: 4803 - DNA, 23 bp, Artificial Sequence
  mitotic kinesin microtubule-associated protein Eg5 (Kif11) siRNA
gatagctaaattaaaccaaaccc

SEQ ID NO: 4804 - DNA, 23 bp, Artificial Sequence
  mitotic kinesin microtubule-associated protein Eg5 (Kif11) siRNA
atagctaaattaaaccaaaccct

SEQ ID NO: 4805 - DNA, 23 bp, Artificial Sequence
  mitotic kinesin microtubule-associated protein Eg5 (Kif11) siRNA
tagctaaattaaaccaaacccta

SEQ ID NO: 4806 - DNA, 23 bp, Artificial Sequence
  mitotic kinesin microtubule-associated protein Eg5 (Kif11) siRNA
agctaaattaaaccaaaccctat

SEQ ID NO: 4807 - DNA, 23 bp, Artificial Sequence
  mitotic kinesin microtubule-associated protein Eg5 (Kif11) siRNA
gctaaattaaaccaaaccctatt

SEQ ID NO: 4808 - DNA, 23 bp, Artificial Sequence
  mitotic kinesin microtubule-associated protein Eg5 (Kif11) siRNA
ctaaattaaaccaaaccctattg

SEQ ID NO: 4809 - DNA, 23 bp, Artificial Sequence
  mitotic kinesin microtubule-associated protein Eg5 (Kif11) siRNA
taaattaaaccaaaccctattga

SEQ ID NO: 4810 - DNA, 23 bp, Artificial Sequence
  mitotic kinesin microtubule-associated protein Eg5 (Kif11) siRNA
aaattaaaccaaaccctattgaa

SEQ ID NO: 4811 - DNA, 23 bp, Artificial Sequence
  mitotic kinesin microtubule-associated protein Eg5 (Kif11) siRNA
aattaaaccaaaccctattgaag

SEQ ID NO: 4812 - DNA, 23 bp, Artificial Sequence
  mitotic kinesin microtubule-associated protein Eg5 (Kif11) siRNA
attaaaccaaaccctattgaaga

SEQ ID NO: 4813 - DNA, 23 bp, Artificial Sequence
  mitotic kinesin microtubule-associated protein Eg5 (Kif11) siRNA
ttaaaccaaaccctattgaagaa

SEQ ID NO: 4814 - DNA, 23 bp, Artificial Sequence
  mitotic kinesin microtubule-associated protein Eg5 (Kif11) siRNA
taaaccaaaccctattgaagaat

SEQ ID NO: 4815 - DNA, 23 bp, Artificial Sequence
  mitotic kinesin microtubule-associated protein Eg5 (Kif11) siRNA
aaaccaaaccctattgaagaatt

SEQ ID NO: 4816 - DNA, 23 bp, Artificial Sequence
  mitotic kinesin microtubule-associated protein Eg5 (Kif11) siRNA
aaccaaaccctattgaagaattg

SEQ ID NO: 4817 - DNA, 23 bp, Artificial Sequence
  mitotic kinesin microtubule-associated protein Eg5 (Kif11) siRNA
accaaaccctattgaagaattga

SEQ ID NO: 4818 - DNA, 23 bp, Artificial Sequence
  mitotic kinesin microtubule-associated protein Eg5 (Kif11) siRNA
ccaaaccctattgaagaattgaa

SEQ ID NO: 4819 - DNA, 23 bp, Artificial Sequence
  mitotic kinesin microtubule-associated protein Eg5 (Kif11) siRNA
caaaccctattgaagaattgaat

SEQ ID NO: 4820 - DNA, 23 bp, Artificial Sequence
  mitotic kinesin microtubule-associated protein Eg5 (Kif11) siRNA
aaaccctattgaagaattgaata

SEQ ID NO: 4821 - DNA, 23 bp, Artificial Sequence
  mitotic kinesin microtubule-associated protein Eg5 (Kif11) siRNA
aaccctattgaagaattgaatat

SEQ ID NO: 4822 - DNA, 23 bp, Artificial Sequence
  mitotic kinesin microtubule-associated protein Eg5 (Kif11) siRNA
accctattgaagaattgaatata

SEQ ID NO: 4823 - DNA, 23 bp, Artificial Sequence
  mitotic kinesin microtubule-associated protein Eg5 (Kif11) siRNA
ccctattgaagaattgaatatat

SEQ ID NO: 4824 - DNA, 23 bp, Artificial Sequence
  mitotic kinesin microtubule-associated protein Eg5 (Kif11) siRNA
cctattgaagaattgaatatatg

SEQ ID NO: 4825 - DNA, 23 bp, Artificial Sequence
  mitotic kinesin microtubule-associated protein Eg5 (Kif11) siRNA
ctattgaagaattgaatatatgc

SEQ ID NO: 4826 - DNA, 23 bp, Artificial Sequence
  mitotic kinesin microtubule-associated protein Eg5 (Kif11) siRNA
tattgaagaattgaatatatgct

SEQ ID NO: 4827 - DNA, 23 bp, Artificial Sequence
  mitotic kinesin microtubule-associated protein Eg5 (Kif11) siRNA
attgaagaattgaatatatgcta

SEQ ID NO: 4828 - DNA, 23 bp, Artificial Sequence
  mitotic kinesin microtubule-associated protein Eg5 (Kif11) siRNA
ttgaagaattgaatatatgctac

SEQ ID NO: 4829 - DNA, 23 bp, Artificial Sequence
  mitotic kinesin microtubule-associated protein Eg5 (Kif11) siRNA
tgaagaattgaatatatgctact

SEQ ID NO: 4830 - DNA, 23 bp, Artificial Sequence
  mitotic kinesin microtubule-associated protein Eg5 (Kif11) siRNA
gaagaattgaatatatgctactt

SEQ ID NO: 4831 - DNA, 23 bp, Artificial Sequence
  mitotic kinesin microtubule-associated protein Eg5 (Kif11) siRNA
aagaattgaatatatgctacttc

SEQ ID NO: 4832 - DNA, 23 bp, Artificial Sequence
  mitotic kinesin microtubule-associated protein Eg5 (Kif11) siRNA
agaattgaatatatgctacttca

SEQ ID NO: 4833 - DNA, 23 bp, Artificial Sequence
  mitotic kinesin microtubule-associated protein Eg5 (Kif11) siRNA
gaattgaatatatgctacttcaa

SEQ ID NO: 4834 - DNA, 23 bp, Artificial Sequence
  mitotic kinesin microtubule-associated protein Eg5 (Kif11) siRNA
aattgaatatatgctacttcaag

SEQ ID NO: 4835 - DNA, 23 bp, Artificial Sequence
  mitotic kinesin microtubule-associated protein Eg5 (Kif11) siRNA
attgaatatatgctacttcaaga

SEQ ID NO: 4836 - DNA, 23 bp, Artificial Sequence
  mitotic kinesin microtubule-associated protein Eg5 (Kif11) siRNA
ttgaatatatgctacttcaagaa

SEQ ID NO: 4837 - DNA, 23 bp, Artificial Sequence
  mitotic kinesin microtubule-associated protein Eg5 (Kif11) siRNA
tgaatatatgctacttcaagaaa

SEQ ID NO: 4838 - DNA, 23 bp, Artificial Sequence
  mitotic kinesin microtubule-associated protein Eg5 (Kif11) siRNA
gaatatatgctacttcaagaaac

SEQ ID NO: 4839 - DNA, 23 bp, Artificial Sequence
  mitotic kinesin microtubule-associated protein Eg5 (Kif11) siRNA
aatatatgctacttcaagaaact

SEQ ID NO: 4840 - DNA, 23 bp, Artificial Sequence
  mitotic kinesin microtubule-associated protein Eg5 (Kif11) siRNA
atatatgctacttcaagaaacta

SEQ ID NO: 4841 - DNA, 23 bp, Artificial Sequence
  mitotic kinesin microtubule-associated protein Eg5 (Kif11) siRNA
tatatgctacttcaagaaactaa

SEQ ID NO: 4842 - DNA, 23 bp, Artificial Sequence
  mitotic kinesin microtubule-associated protein Eg5 (Kif11) siRNA
atatgctacttcaagaaactaaa

SEQ ID NO: 4843 - DNA, 23 bp, Artificial Sequence
  mitotic kinesin microtubule-associated protein Eg5 (Kif11) siRNA
tatgctacttcaagaaactaaat

SEQ ID NO: 4844 - DNA, 23 bp, Artificial Sequence
  mitotic kinesin microtubule-associated protein Eg5 (Kif11) siRNA
atgctacttcaagaaactaaatt

SEQ ID NO: 4845 - DNA, 23 bp, Artificial Sequence
  mitotic kinesin microtubule-associated protein Eg5 (Kif11) siRNA
tgctacttcaagaaactaaattg

SEQ ID NO: 4846 - DNA, 23 bp, Artificial Sequence
  mitotic kinesin microtubule-associated protein Eg5 (Kif11) siRNA
gctacttcaagaaactaaattga

SEQ ID NO: 4847 - DNA, 23 bp, Artificial Sequence
  mitotic kinesin microtubule-associated protein Eg5 (Kif11) siRNA
ctacttcaagaaactaaattgat

SEQ ID NO: 4848 - DNA, 23 bp, Artificial Sequence
  mitotic kinesin microtubule-associated protein Eg5 (Kif11) siRNA
tacttcaagaaactaaattgatc

SEQ ID NO: 4849 - DNA, 23 bp, Artificial Sequence
  mitotic kinesin microtubule-associated protein Eg5 (Kif11) siRNA
acttcaagaaactaaattgatct

SEQ ID NO: 4850 - DNA, 23 bp, Artificial Sequence
  mitotic kinesin microtubule-associated protein Eg5 (Kif11) siRNA
cttcaagaaactaaattgatctc

SEQ ID NO: 4851 - DNA, 23 bp, Artificial Sequence
  mitotic kinesin microtubule-associated protein Eg5 (Kif11) siRNA
ttcaagaaactaaattgatctcg

SEQ ID NO: 4852 - DNA, 23 bp, Artificial Sequence
  mitotic kinesin microtubule-associated protein Eg5 (Kif11) siRNA
tcaagaaactaaattgatctcgt

SEQ ID NO: 4853 - DNA, 23 bp, Artificial Sequence
  mitotic kinesin microtubule-associated protein Eg5 (Kif11) siRNA
caagaaactaaattgatctcgta

SEQ ID NO: 4854 - DNA, 23 bp, Artificial Sequence
  mitotic kinesin microtubule-associated protein Eg5 (Kif11) siRNA
aagaaactaaattgatctcgtag

SEQ ID NO: 4855 - DNA, 23 bp, Artificial Sequence
  mitotic kinesin microtubule-associated protein Eg5 (Kif11) siRNA
agaaactaaattgatctcgtaga

SEQ ID NO: 4856 - DNA, 23 bp, Artificial Sequence
  mitotic kinesin microtubule-associated protein Eg5 (Kif11) siRNA
gaaactaaattgatctcgtagaa

SEQ ID NO: 4857 - DNA, 23 bp, Artificial Sequence
  mitotic kinesin microtubule-associated protein Eg5 (Kif11) siRNA
aaactaaattgatctcgtagaat

SEQ ID NO: 4858 - DNA, 23 bp, Artificial Sequence
  mitotic kinesin microtubule-associated protein Eg5 (Kif11) siRNA
aactaaattgatctcgtagaatt

SEQ ID NO: 4859 - DNA, 23 bp, Artificial Sequence
  mitotic kinesin microtubule-associated protein Eg5 (Kif11) siRNA
actaaattgatctcgtagaatta

SEQ ID NO: 4860 - DNA, 23 bp, Artificial Sequence
  mitotic kinesin microtubule-associated protein Eg5 (Kif11) siRNA
ctaaattgatctcgtagaattat

SEQ ID NO: 4861 - DNA, 23 bp, Artificial Sequence
  mitotic kinesin microtubule-associated protein Eg5 (Kif11) siRNA
taaattgatctcgtagaattatc

SEQ ID NO: 4862 - DNA, 23 bp, Artificial Sequence
  mitotic kinesin microtubule-associated protein Eg5 (Kif11) siRNA
aaattgatctcgtagaattatct

SEQ ID NO: 4863 - DNA, 23 bp, Artificial Sequence
  mitotic kinesin microtubule-associated protein Eg5 (Kif11) siRNA
aattgatctcgtagaattatctt

SEQ ID NO: 4864 - DNA, 23 bp, Artificial Sequence
  mitotic kinesin microtubule-associated protein Eg5 (Kif11) siRNA
attgatctcgtagaattatctta

SEQ ID NO: 4865 - DNA, 23 bp, Artificial Sequence
  mitotic kinesin microtubule-associated protein Eg5 (Kif11) siRNA
ttgatctcgtagaattatcttaa

SEQ ID NO: 4866 - DNA, 23 bp, Artificial Sequence
  mitotic kinesin microtubule-associated protein Eg5 (Kif11) siRNA
tgatctcgtagaattatcttaat

SEQ ID NO: 4867 - DNA, 23 bp, Artificial Sequence
  mitotic kinesin microtubule-associated protein Eg5 (Kif11) siRNA
gatctcgtagaattatcttaata

SEQ ID NO: 4868 - DNA, 23 bp, Artificial Sequence
  mitotic kinesin microtubule-associated protein Eg5 (Kif11) siRNA
atctcgtagaattatcttaataa

SEQ ID NO: 4869 - DNA, 23 bp, Artificial Sequence
  mitotic kinesin microtubule-associated protein Eg5 (Kif11) siRNA
tctcgtagaattatcttaataaa

SEQ ID NO: 4870 - DNA, 23 bp, Artificial Sequence
  mitotic kinesin microtubule-associated protein Eg5 (Kif11) siRNA
ctcgtagaattatcttaataaaa

SEQ ID NO: 4871 - DNA, 23 bp, Artificial Sequence
  mitotic kinesin microtubule-associated protein Eg5 (Kif11) siRNA
tcgtagaattatcttaataaaat

SEQ ID NO: 4872 - DNA, 23 bp, Artificial Sequence
  mitotic kinesin microtubule-associated protein Eg5 (Kif11) siRNA
cgtagaattatcttaataaaata

SEQ ID NO: 4873 - DNA, 23 bp, Artificial Sequence
  mitotic kinesin microtubule-associated protein Eg5 (Kif11) siRNA
gtagaattatcttaataaaataa

SEQ ID NO: 4874 - DNA, 23 bp, Artificial Sequence
  mitotic kinesin microtubule-associated protein Eg5 (Kif11) siRNA
tagaattatcttaataaaataat

SEQ ID NO: 4875 - DNA, 23 bp, Artificial Sequence
  mitotic kinesin microtubule-associated protein Eg5 (Kif11) siRNA
agaattatcttaataaaataatg

SEQ ID NO: 4876 - DNA, 23 bp, Artificial Sequence
  mitotic kinesin microtubule-associated protein Eg5 (Kif11) siRNA
gaattatcttaataaaataatgg

SEQ ID NO: 4877 - DNA, 23 bp, Artificial Sequence
  mitotic kinesin microtubule-associated protein Eg5 (Kif11) siRNA
aattatcttaataaaataatggc

SEQ ID NO: 4878 - DNA, 23 bp, Artificial Sequence
  mitotic kinesin microtubule-associated protein Eg5 (Kif11) siRNA
attatcttaataaaataatggct

SEQ ID NO: 4879 - DNA, 23 bp, Artificial Sequence
  mitotic kinesin microtubule-associated protein Eg5 (Kif11) siRNA
ttatcttaataaaataatggcta

SEQ ID NO: 4880 - DNA, 23 bp, Artificial Sequence
  mitotic kinesin microtubule-associated protein Eg5 (Kif11) siRNA
tatcttaataaaataatggctat

SEQ ID NO: 4881 - DNA, 23 bp, Artificial Sequence
  mitotic kinesin microtubule-associated protein Eg5 (Kif11) siRNA
atcttaataaaataatggctata

SEQ ID NO: 4882 - DNA, 23 bp, Artificial Sequence
  mitotic kinesin microtubule-associated protein Eg5 (Kif11) siRNA
tcttaataaaataatggctataa

SEQ ID NO: 4883 - DNA, 23 bp, Artificial Sequence
  mitotic kinesin microtubule-associated protein Eg5 (Kif11) siRNA
cttaataaaataatggctataat

SEQ ID NO: 4884 - DNA, 23 bp, Artificial Sequence
  mitotic kinesin microtubule-associated protein Eg5 (Kif11) siRNA
ttaataaaataatggctataatt

SEQ ID NO: 4885 - DNA, 23 bp, Artificial Sequence
  mitotic kinesin microtubule-associated protein Eg5 (Kif11) siRNA
taataaaataatggctataattt

SEQ ID NO: 4886 - DNA, 23 bp, Artificial Sequence
  mitotic kinesin microtubule-associated protein Eg5 (Kif11) siRNA
aataaaataatggctataatttc

SEQ ID NO: 4887 - DNA, 23 bp, Artificial Sequence
  mitotic kinesin microtubule-associated protein Eg5 (Kif11) siRNA
ataaaataatggctataatttct

SEQ ID NO: 4888 - DNA, 23 bp, Artificial Sequence
  mitotic kinesin microtubule-associated protein Eg5 (Kif11) siRNA
taaaataatggctataatttctc

SEQ ID NO: 4889 - DNA, 23 bp, Artificial Sequence
  mitotic kinesin microtubule-associated protein Eg5 (Kif11) siRNA
aaaataatggctataatttctct

SEQ ID NO: 4890 - DNA, 23 bp, Artificial Sequence
  mitotic kinesin microtubule-associated protein Eg5 (Kif11) siRNA
aaataatggctataatttctctg

SEQ ID NO: 4891 - DNA, 23 bp, Artificial Sequence
  mitotic kinesin microtubule-associated protein Eg5 (Kif11) siRNA
aataatggctataatttctctgc

SEQ ID NO: 4892 - DNA, 23 bp, Artificial Sequence
  mitotic kinesin microtubule-associated protein Eg5 (Kif11) siRNA
ataatggctataatttctctgca

SEQ ID NO: 4893 - DNA, 23 bp, Artificial Sequence
  mitotic kinesin microtubule-associated protein Eg5 (Kif11) siRNA
taatggctataatttctctgcaa

SEQ ID NO: 4894 - DNA, 23 bp, Artificial Sequence
  mitotic kinesin microtubule-associated protein Eg5 (Kif11) siRNA
aatggctataatttctctgcaaa

SEQ ID NO: 4895 - DNA, 23 bp, Artificial Sequence
  mitotic kinesin microtubule-associated protein Eg5 (Kif11) siRNA
atggctataatttctctgcaaaa

SEQ ID NO: 4896 - DNA, 23 bp, Artificial Sequence
  mitotic kinesin microtubule-associated protein Eg5 (Kif11) siRNA
tggctataatttctctgcaaaat

SEQ ID NO: 4897 - DNA, 23 bp, Artificial Sequence
  mitotic kinesin microtubule-associated protein Eg5 (Kif11) siRNA
ggctataatttctctgcaaaatc

SEQ ID NO: 4898 - DNA, 23 bp, Artificial Sequence
  mitotic kinesin microtubule-associated protein Eg5 (Kif11) siRNA
gctataatttctctgcaaaatca

SEQ ID NO: 4899 - DNA, 23 bp, Artificial Sequence
  mitotic kinesin microtubule-associated protein Eg5 (Kif11) siRNA
ctataatttctctgcaaaatcag

SEQ ID NO: 4900 - DNA, 23 bp, Artificial Sequence
  mitotic kinesin microtubule-associated protein Eg5 (Kif11) siRNA
tataatttctctgcaaaatcaga

SEQ ID NO: 4901 - DNA, 23 bp, Artificial Sequence
  mitotic kinesin microtubule-associated protein Eg5 (Kif11) siRNA
ataatttctctgcaaaatcagat

SEQ ID NO: 4902 - DNA, 23 bp, Artificial Sequence
  mitotic kinesin microtubule-associated protein Eg5 (Kif11) siRNA
taatttctctgcaaaatcagatg

SEQ ID NO: 4903 - DNA, 23 bp, Artificial Sequence
  mitotic kinesin microtubule-associated protein Eg5 (Kif11) siRNA
aatttctctgcaaaatcagatgt

SEQ ID NO: 4904 - DNA, 23 bp, Artificial Sequence
  mitotic kinesin microtubule-associated protein Eg5 (Kif11) siRNA
atttctctgcaaaatcagatgtc

SEQ ID NO: 4905 - DNA, 23 bp, Artificial Sequence
  mitotic kinesin microtubule-associated protein Eg5 (Kif11) siRNA
tttctctgcaaaatcagatgtca

SEQ ID NO: 4906 - DNA, 23 bp, Artificial Sequence
  mitotic kinesin microtubule-associated protein Eg5 (Kif11) siRNA
ttctctgcaaaatcagatgtcag

SEQ ID NO: 4907 - DNA, 23 bp, Artificial Sequence
  mitotic kinesin microtubule-associated protein Eg5 (Kif11) siRNA
tctctgcaaaatcagatgtcagc

SEQ ID NO: 4908 - DNA, 23 bp, Artificial Sequence
  mitotic kinesin microtubule-associated protein Eg5 (Kif11) siRNA
ctctgcaaaatcagatgtcagca

SEQ ID NO: 4909 - DNA, 23 bp, Artificial Sequence
  mitotic kinesin microtubule-associated protein Eg5 (Kif11) siRNA
tctgcaaaatcagatgtcagcat

SEQ ID NO: 4910 - DNA, 23 bp, Artificial Sequence
  mitotic kinesin microtubule-associated protein Eg5 (Kif11) siRNA
ctgcaaaatcagatgtcagcata

SEQ ID NO: 4911 - DNA, 23 bp, Artificial Sequence
  mitotic kinesin microtubule-associated protein Eg5 (Kif11) siRNA
tgcaaaatcagatgtcagcataa

SEQ ID NO: 4912 - DNA, 23 bp, Artificial Sequence
  mitotic kinesin microtubule-associated protein Eg5 (Kif11) siRNA
gcaaaatcagatgtcagcataag

SEQ ID NO: 4913 - DNA, 23 bp, Artificial Sequence
  mitotic kinesin microtubule-associated protein Eg5 (Kif11) siRNA
caaaatcagatgtcagcataagc

SEQ ID NO: 4914 - DNA, 23 bp, Artificial Sequence
  mitotic kinesin microtubule-associated protein Eg5 (Kif11) siRNA
aaaatcagatgtcagcataagcg

SEQ ID NO: 4915 - DNA, 23 bp, Artificial Sequence
  mitotic kinesin microtubule-associated protein Eg5 (Kif11) siRNA
aaatcagatgtcagcataagcga

SEQ ID NO: 4916 - DNA, 23 bp, Artificial Sequence
  mitotic kinesin microtubule-associated protein Eg5 (Kif11) siRNA
aatcagatgtcagcataagcgat

SEQ ID NO: 4917 - DNA, 23 bp, Artificial Sequence
  mitotic kinesin microtubule-associated protein Eg5 (Kif11) siRNA
atcagatgtcagcataagcgatg

SEQ ID NO: 4918 - DNA, 23 bp, Artificial Sequence
  mitotic kinesin microtubule-associated protein Eg5 (Kif11) siRNA
tcagatgtcagcataagcgatgg

SEQ ID NO: 4919 - DNA, 23 bp, Artificial Sequence
  mitotic kinesin microtubule-associated protein Eg5 (Kif11) siRNA
cagatgtcagcataagcgatgga

SEQ ID NO: 4920 - DNA, 23 bp, Artificial Sequence
  mitotic kinesin microtubule-associated protein Eg5 (Kif11) siRNA
agatgtcagcataagcgatggat

SEQ ID NO: 4921 - DNA, 23 bp, Artificial Sequence
  mitotic kinesin microtubule-associated protein Eg5 (Kif11) siRNA
gatgtcagcataagcgatggata

SEQ ID NO: 4922 - DNA, 23 bp, Artificial Sequence
  mitotic kinesin microtubule-associated protein Eg5 (Kif11) siRNA
atgtcagcataagcgatggataa

SEQ ID NO: 4923 - DNA, 23 bp, Artificial Sequence
  mitotic kinesin microtubule-associated protein Eg5 (Kif11) siRNA
tgtcagcataagcgatggataat

SEQ ID NO: 4924 - DNA, 23 bp, Artificial Sequence
  mitotic kinesin microtubule-associated protein Eg5 (Kif11) siRNA
gtcagcataagcgatggataata

SEQ ID NO: 4925 - DNA, 23 bp, Artificial Sequence
  mitotic kinesin microtubule-associated protein Eg5 (Kif11) siRNA
tcagcataagcgatggataatac

SEQ ID NO: 4926 - DNA, 23 bp, Artificial Sequence
  mitotic kinesin microtubule-associated protein Eg5 (Kif11) siRNA
cagcataagcgatggataatacc

SEQ ID NO: 4927 - DNA, 23 bp, Artificial Sequence
  mitotic kinesin microtubule-associated protein Eg5 (Kif11) siRNA
agcataagcgatggataatacct

SEQ ID NO: 4928 - DNA, 23 bp, Artificial Sequence
  mitotic kinesin microtubule-associated protein Eg5 (Kif11) siRNA
gcataagcgatggataataccta

SEQ ID NO: 4929 - DNA, 23 bp, Artificial Sequence
  mitotic kinesin microtubule-associated protein Eg5 (Kif11) siRNA
cataagcgatggataatacctaa

SEQ ID NO: 4930 - DNA, 23 bp, Artificial Sequence
  mitotic kinesin microtubule-associated protein Eg5 (Kif11) siRNA
ataagcgatggataatacctaat

SEQ ID NO: 4931 - DNA, 23 bp, Artificial Sequence
  mitotic kinesin microtubule-associated protein Eg5 (Kif11) siRNA
taagcgatggataatacctaata

SEQ ID NO: 4932 - DNA, 23 bp, Artificial Sequence
  mitotic kinesin microtubule-associated protein Eg5 (Kif11) siRNA
aagcgatggataatacctaataa

SEQ ID NO: 4933 - DNA, 23 bp, Artificial Sequence
  mitotic kinesin microtubule-associated protein Eg5 (Kif11) siRNA
agcgatggataatacctaataaa

SEQ ID NO: 4934 - DNA, 23 bp, Artificial Sequence
  mitotic kinesin microtubule-associated protein Eg5 (Kif11) siRNA
gcgatggataatacctaataaac

SEQ ID NO: 4935 - DNA, 23 bp, Artificial Sequence
  mitotic kinesin microtubule-associated protein Eg5 (Kif11) siRNA
cgatggataatacctaataaact

SEQ ID NO: 4936 - DNA, 23 bp, Artificial Sequence
  mitotic kinesin microtubule-associated protein Eg5 (Kif11) siRNA
gatggataatacctaataaactg

SEQ ID NO: 4937 - DNA, 23 bp, Artificial Sequence
  mitotic kinesin microtubule-associated protein Eg5 (Kif11) siRNA
atggataatacctaataaactgc

SEQ ID NO: 4938 - DNA, 23 bp, Artificial Sequence
  mitotic kinesin microtubule-associated protein Eg5 (Kif11) siRNA
tggataatacctaataaactgcc

SEQ ID NO: 4939 - DNA, 23 bp, Artificial Sequence
  mitotic kinesin microtubule-associated protein Eg5 (Kif11) siRNA
ggataatacctaataaactgccc

SEQ ID NO: 4940 - DNA, 23 bp, Artificial Sequence
  mitotic kinesin microtubule-associated protein Eg5 (Kif11) siRNA
gataatacctaataaactgccct

SEQ ID NO: 4941 - DNA, 23 bp, Artificial Sequence
  mitotic kinesin microtubule-associated protein Eg5 (Kif11) siRNA
ataatacctaataaactgccctc

SEQ ID NO: 4942 - DNA, 23 bp, Artificial Sequence
  mitotic kinesin microtubule-associated protein Eg5 (Kif11) siRNA
taatacctaataaactgccctca

SEQ ID NO: 4943 - DNA, 23 bp, Artificial Sequence
  mitotic kinesin microtubule-associated protein Eg5 (Kif11) siRNA
aatacctaataaactgccctcag

SEQ ID NO: 4944 - DNA, 23 bp, Artificial Sequence
  mitotic kinesin microtubule-associated protein Eg5 (Kif11) siRNA
atacctaataaactgccctcagt

SEQ ID NO: 4945 - DNA, 23 bp, Artificial Sequence
  mitotic kinesin microtubule-associated protein Eg5 (Kif11) siRNA
tacctaataaactgccctcagta

SEQ ID NO: 4946 - DNA, 23 bp, Artificial Sequence
  mitotic kinesin microtubule-associated protein Eg5 (Kif11) siRNA
acctaataaactgccctcagtaa

SEQ ID NO: 4947 - DNA, 23 bp, Artificial Sequence
  mitotic kinesin microtubule-associated protein Eg5 (Kif11) siRNA
cctaataaactgccctcagtaaa

SEQ ID NO: 4948 - DNA, 23 bp, Artificial Sequence
  mitotic kinesin microtubule-associated protein Eg5 (Kif11) siRNA
ctaataaactgccctcagtaaat

SEQ ID NO: 4949 - DNA, 23 bp, Artificial Sequence
  mitotic kinesin microtubule-associated protein Eg5 (Kif11) siRNA
taataaactgccctcagtaaatc

SEQ ID NO: 4950 - DNA, 23 bp, Artificial Sequence
  mitotic kinesin microtubule-associated protein Eg5 (Kif11) siRNA
aataaactgccctcagtaaatcc

SEQ ID NO: 4951 - DNA, 23 bp, Artificial Sequence
  mitotic kinesin microtubule-associated protein Eg5 (Kif11) siRNA
ataaactgccctcagtaaatcca

SEQ ID NO: 4952 - DNA, 23 bp, Artificial Sequence
  mitotic kinesin microtubule-associated protein Eg5 (Kif11) siRNA
taaactgccctcagtaaatccat

SEQ ID NO: 4953 - DNA, 23 bp, Artificial Sequence
  mitotic kinesin microtubule-associated protein Eg5 (Kif11) siRNA
aaactgccctcagtaaatccatg

SEQ ID NO: 4954 - DNA, 23 bp, Artificial Sequence
  mitotic kinesin microtubule-associated protein Eg5 (Kif11) siRNA
aactgccctcagtaaatccatgg

SEQ ID NO: 4955 - DNA, 23 bp, Artificial Sequence
  mitotic kinesin microtubule-associated protein Eg5 (Kif11) siRNA
actgccctcagtaaatccatggt

SEQ ID NO: 4956 - DNA, 23 bp, Artificial Sequence
  mitotic kinesin microtubule-associated protein Eg5 (Kif11) siRNA
ctgccctcagtaaatccatggtt

SEQ ID NO: 4957 - DNA, 23 bp, Artificial Sequence
  mitotic kinesin microtubule-associated protein Eg5 (Kif11) siRNA
tgccctcagtaaatccatggtta

SEQ ID NO: 4958 - DNA, 23 bp, Artificial Sequence
  mitotic kinesin microtubule-associated protein Eg5 (Kif11) siRNA
gccctcagtaaatccatggttaa

SEQ ID NO: 4959 - DNA, 23 bp, Artificial Sequence
  mitotic kinesin microtubule-associated protein Eg5 (Kif11) siRNA
ccctcagtaaatccatggttaat

SEQ ID NO: 4960 - DNA, 23 bp, Artificial Sequence
  mitotic kinesin microtubule-associated protein Eg5 (Kif11) siRNA
cctcagtaaatccatggttaata

SEQ ID NO: 4961 - DNA, 23 bp, Artificial Sequence
  mitotic kinesin microtubule-associated protein Eg5 (Kif11) siRNA
ctcagtaaatccatggttaataa

SEQ ID NO: 4962 - DNA, 23 bp, Artificial Sequence
  mitotic kinesin microtubule-associated protein Eg5 (Kif11) siRNA
tcagtaaatccatggttaataaa

SEQ ID NO: 4963 - DNA, 23 bp, Artificial Sequence
  mitotic kinesin microtubule-associated protein Eg5 (Kif11) siRNA
cagtaaatccatggttaataaat

SEQ ID NO: 4964 - DNA, 23 bp, Artificial Sequence
  mitotic kinesin microtubule-associated protein Eg5 (Kif11) siRNA
agtaaatccatggttaataaatg

SEQ ID NO: 4965 - DNA, 23 bp, Artificial Sequence
  mitotic kinesin microtubule-associated protein Eg5 (Kif11) siRNA
gtaaatccatggttaataaatgt

SEQ ID NO: 4966 - DNA, 23 bp, Artificial Sequence
  mitotic kinesin microtubule-associated protein Eg5 (Kif11) siRNA
taaatccatggttaataaatgtg

SEQ ID NO: 4967 - DNA, 23 bp, Artificial Sequence
  mitotic kinesin microtubule-associated protein Eg5 (Kif11) siRNA
aaatccatggttaataaatgtgg

SEQ ID NO: 4968 - DNA, 23 bp, Artificial Sequence
  mitotic kinesin microtubule-associated protein Eg5 (Kif11) siRNA
aatccatggttaataaatgtggt

SEQ ID NO: 4969 - DNA, 23 bp, Artificial Sequence
  mitotic kinesin microtubule-associated protein Eg5 (Kif11) siRNA
atccatggttaataaatgtggtt

SEQ ID NO: 4970 - DNA, 23 bp, Artificial Sequence
  mitotic kinesin microtubule-associated protein Eg5 (Kif11) siRNA
tccatggttaataaatgtggttt

SEQ ID NO: 4971 - DNA, 23 bp, Artificial Sequence
  mitotic kinesin microtubule-associated protein Eg5 (Kif11) siRNA
ccatggttaataaatgtggtttc

SEQ ID NO: 4972 - DNA, 23 bp, Artificial Sequence
  mitotic kinesin microtubule-associated protein Eg5 (Kif11) siRNA
catggttaataaatgtggtttct

SEQ ID NO: 4973 - DNA, 23 bp, Artificial Sequence
  mitotic kinesin microtubule-associated protein Eg5 (Kif11) siRNA
atggttaataaatgtggtttcta

SEQ ID NO: 4974 - DNA, 23 bp, Artificial Sequence
  mitotic kinesin microtubule-associated protein Eg5 (Kif11) siRNA
tggttaataaatgtggtttctac

SEQ ID NO: 4975 - DNA, 23 bp, Artificial Sequence
  mitotic kinesin microtubule-associated protein Eg5 (Kif11) siRNA
ggttaataaatgtggtttctaca

SEQ ID NO: 4976 - DNA, 23 bp, Artificial Sequence
  mitotic kinesin microtubule-associated protein Eg5 (Kif11) siRNA
gttaataaatgtggtttctacat

SEQ ID NO: 4977 - DNA, 23 bp, Artificial Sequence
  mitotic kinesin microtubule-associated protein Eg5 (Kif11) siRNA
ttaataaatgtggtttctacatt

SEQ ID NO: 4978 - DNA, 23 bp, Artificial Sequence
  epidermal growth factor receptor (EGFR), ERBB1 phosphotyrosine kinase siRNA
gcggccgcagcagcctccgcccc

SEQ ID NO: 4979 - DNA, 23 bp, Artificial Sequence
  epidermal growth factor receptor (EGFR), ERBB1 phosphotyrosine kinase siRNA
cggccgcagcagcctccgccccc

SEQ ID NO: 4980 - DNA, 23 bp, Artificial Sequence
  epidermal growth factor receptor (EGFR), ERBB1 phosphotyrosine kinase siRNA
ccccccgcacggtgtgagcgccc

SEQ ID NO: 4981 - DNA, 23 bp, Artificial Sequence
  epidermal growth factor receptor (EGFR), ERBB1 phosphotyrosine kinase siRNA
cccccgcacggtgtgagcgcccg

SEQ ID NO: 4982 - DNA, 23 bp, Artificial Sequence
  epidermal growth factor receptor (EGFR), ERBB1 phosphotyrosine kinase siRNA
ccccgcacggtgtgagcgcccga

SEQ ID NO: 4983 - DNA, 23 bp, Artificial Sequence
  epidermal growth factor receptor (EGFR), ERBB1 phosphotyrosine kinase siRNA
cccgcacggtgtgagcgcccgac

SEQ ID NO: 4984 - DNA, 23 bp, Artificial Sequence
  epidermal growth factor receptor (EGFR), ERBB1 phosphotyrosine kinase siRNA
ccgcacggtgtgagcgcccgacg

SEQ ID NO: 4985 - DNA, 23 bp, Artificial Sequence
  epidermal growth factor receptor (EGFR), ERBB1 phosphotyrosine kinase siRNA
cgcacggtgtgagcgcccgacgc

SEQ ID NO: 4986 - DNA, 23 bp, Artificial Sequence
  epidermal growth factor receptor (EGFR), ERBB1 phosphotyrosine kinase siRNA
gcacggtgtgagcgcccgacgcg

SEQ ID NO: 4987 - DNA, 23 bp, Artificial Sequence
  epidermal growth factor receptor (EGFR), ERBB1 phosphotyrosine kinase siRNA
cacggtgtgagcgcccgacgcgg

SEQ ID NO: 4988 - DNA, 23 bp, Artificial Sequence
  epidermal growth factor receptor (EGFR), ERBB1 phosphotyrosine kinase siRNA
acggtgtgagcgcccgacgcggc

SEQ ID NO: 4989 - DNA, 23 bp, Artificial Sequence
  epidermal growth factor receptor (EGFR), ERBB1 phosphotyrosine kinase siRNA
cggtgtgagcgcccgacgcggcc

SEQ ID NO: 4990 - DNA, 23 bp, Artificial Sequence
  epidermal growth factor receptor (EGFR), ERBB1 phosphotyrosine kinase siRNA
ggtgtgagcgcccgacgcggccg

SEQ ID NO: 4991 - DNA, 23 bp, Artificial Sequence
  epidermal growth factor receptor (EGFR), ERBB1 phosphotyrosine kinase siRNA
gtgtgagcgcccgacgcggccga

SEQ ID NO: 4992 - DNA, 23 bp, Artificial Sequence
  epidermal growth factor receptor (EGFR), ERBB1 phosphotyrosine kinase siRNA
tgtgagcgcccgacgcggccgag

SEQ ID NO: 4993 - DNA, 23 bp, Artificial Sequence
  epidermal growth factor receptor (EGFR), ERBB1 phosphotyrosine kinase siRNA
gtgagcgcccgacgcggccgagg

SEQ ID NO: 4994 - DNA, 23 bp, Artificial Sequence
  epidermal growth factor receptor (EGFR), ERBB1 phosphotyrosine kinase siRNA
tgagcgcccgacgcggccgaggc

SEQ ID NO: 4995 - DNA, 23 bp, Artificial Sequence
  epidermal growth factor receptor (EGFR), ERBB1 phosphotyrosine kinase siRNA
gagcgcccgacgcggccgaggcg

SEQ ID NO: 4996 - DNA, 23 bp, Artificial Sequence
  epidermal growth factor receptor (EGFR), ERBB1 phosphotyrosine kinase siRNA
agcgcccgacgcggccgaggcgg

SEQ ID NO: 4997 - DNA, 23 bp, Artificial Sequence
  epidermal growth factor receptor (EGFR), ERBB1 phosphotyrosine kinase siRNA
gcgcccgacgcggccgaggcggc

SEQ ID NO: 4998 - DNA, 23 bp, Artificial Sequence
  epidermal growth factor receptor (EGFR), ERBB1 phosphotyrosine kinase siRNA
cgcccgacgcggccgaggcggcc

SEQ ID NO: 4999 - DNA, 23 bp, Artificial Sequence
  epidermal growth factor receptor (EGFR), ERBB1 phosphotyrosine kinase siRNA
gcccgacgcggccgaggcggccg

SEQ ID NO: 5000 - DNA, 23 bp, Artificial Sequence
  epidermal growth factor receptor (EGFR), ERBB1 phosphotyrosine kinase siRNA
gcggccggagtcccgagctagcc

SEQ ID NO: 5001 - DNA, 23 bp, Artificial Sequence
  epidermal growth factor receptor (EGFR), ERBB1 phosphotyrosine kinase siRNA
cggccggagtcccgagctagccc

SEQ ID NO: 5002 - DNA, 23 bp, Artificial Sequence
  epidermal growth factor receptor (EGFR), ERBB1 phosphotyrosine kinase siRNA
ggccggagtcccgagctagcccc

SEQ ID NO: 5003 - DNA, 23 bp, Artificial Sequence
  epidermal growth factor receptor (EGFR), ERBB1 phosphotyrosine kinase siRNA
gccggagtcccgagctagccccg

SEQ ID NO: 5004 - DNA, 23 bp, Artificial Sequence
  epidermal growth factor receptor (EGFR), ERBB1 phosphotyrosine kinase siRNA
ccggagtcccgagctagccccgg

SEQ ID NO: 5005 - DNA, 23 bp, Artificial Sequence
  epidermal growth factor receptor (EGFR), ERBB1 phosphotyrosine kinase siRNA
cggagtcccgagctagccccggc

SEQ ID NO: 5006 - DNA, 23 bp, Artificial Sequence
  epidermal growth factor receptor (EGFR), ERBB1 phosphotyrosine kinase siRNA
cgccgcccagaccggacgacagg

SEQ ID NO: 5007 - DNA, 23 bp, Artificial Sequence
  epidermal growth factor receptor (EGFR), ERBB1 phosphotyrosine kinase siRNA
gccgcccagaccggacgacaggc

SEQ ID NO: 5008 - DNA, 23 bp, Artificial Sequence
  epidermal growth factor receptor (EGFR), ERBB1 phosphotyrosine kinase siRNA
ccgcccagaccggacgacaggcc

SEQ ID NO: 5009 - DNA, 23 bp, Artificial Sequence
  epidermal growth factor receptor (EGFR), ERBB1 phosphotyrosine kinase siRNA
cgcccagaccggacgacaggcca

SEQ ID NO: 5010 - DNA, 23 bp, Artificial Sequence
  epidermal growth factor receptor (EGFR), ERBB1 phosphotyrosine kinase siRNA
gcccagaccggacgacaggccac

SEQ ID NO: 5011 - DNA, 23 bp, Artificial Sequence
  epidermal growth factor receptor (EGFR), ERBB1 phosphotyrosine kinase siRNA
cccagaccggacgacaggccacc

SEQ ID NO: 5012 - DNA, 23 bp, Artificial Sequence
  epidermal growth factor receptor (EGFR), ERBB1 phosphotyrosine kinase siRNA
ccagaccggacgacaggccacct

SEQ ID NO: 5013 - DNA, 23 bp, Artificial Sequence
  epidermal growth factor receptor (EGFR), ERBB1 phosphotyrosine kinase siRNA
cagaccggacgacaggccacctc

SEQ ID NO: 5014 - DNA, 23 bp, Artificial Sequence
  epidermal growth factor receptor (EGFR), ERBB1 phosphotyrosine kinase siRNA
agaccggacgacaggccacctcg

SEQ ID NO: 5015 - DNA, 23 bp, Artificial Sequence
  epidermal growth factor receptor (EGFR), ERBB1 phosphotyrosine kinase siRNA
gaccggacgacaggccacctcgt

SEQ ID NO: 5016 - DNA, 23 bp, Artificial Sequence
  epidermal growth factor receptor (EGFR), ERBB1 phosphotyrosine kinase siRNA
accggacgacaggccacctcgtc

SEQ ID NO: 5017 - DNA, 23 bp, Artificial Sequence
  epidermal growth factor receptor (EGFR), ERBB1 phosphotyrosine kinase siRNA
ccggacgacaggccacctcgtcg

SEQ ID NO: 5018 - DNA, 23 bp, Artificial Sequence
  epidermal growth factor receptor (EGFR), ERBB1 phosphotyrosine kinase siRNA
cggacgacaggccacctcgtcgg

SEQ ID NO: 5019 - DNA, 23 bp, Artificial Sequence
  epidermal growth factor receptor (EGFR), ERBB1 phosphotyrosine kinase siRNA
ggacgacaggccacctcgtcggc

SEQ ID NO: 5020 - DNA, 23 bp, Artificial Sequence
  epidermal growth factor receptor (EGFR), ERBB1 phosphotyrosine kinase siRNA
gacgacaggccacctcgtcggcg

SEQ ID NO: 5021 - DNA, 23 bp, Artificial Sequence
  epidermal growth factor receptor (EGFR), ERBB1 phosphotyrosine kinase siRNA
acgacaggccacctcgtcggcgt

SEQ ID NO: 5022 - DNA, 23 bp, Artificial Sequence
  epidermal growth factor receptor (EGFR), ERBB1 phosphotyrosine kinase siRNA
cgacaggccacctcgtcggcgtc

SEQ ID NO: 5023 - DNA, 23 bp, Artificial Sequence
  epidermal growth factor receptor (EGFR), ERBB1 phosphotyrosine kinase siRNA
gacaggccacctcgtcggcgtcc

SEQ ID NO: 5024 - DNA, 23 bp, Artificial Sequence
  epidermal growth factor receptor (EGFR), ERBB1 phosphotyrosine kinase siRNA
acaggccacctcgtcggcgtccg

SEQ ID NO: 5025 - DNA, 23 bp, Artificial Sequence
  epidermal growth factor receptor (EGFR), ERBB1 phosphotyrosine kinase siRNA
caggccacctcgtcggcgtccgc

SEQ ID NO: 5026 - DNA, 23 bp, Artificial Sequence
  epidermal growth factor receptor (EGFR), ERBB1 phosphotyrosine kinase siRNA
aggccacctcgtcggcgtccgcc

SEQ ID NO: 5027 - DNA, 23 bp, Artificial Sequence
  epidermal growth factor receptor (EGFR), ERBB1 phosphotyrosine kinase siRNA
ggccacctcgtcggcgtccgccc

SEQ ID NO: 5028 - DNA, 23 bp, Artificial Sequence
  epidermal growth factor receptor (EGFR), ERBB1 phosphotyrosine kinase siRNA
gccacctcgtcggcgtccgcccg

SEQ ID NO: 5029 - DNA, 23 bp, Artificial Sequence
  epidermal growth factor receptor (EGFR), ERBB1 phosphotyrosine kinase siRNA
ccacctcgtcggcgtccgcccga

SEQ ID NO: 5030 - DNA, 23 bp, Artificial Sequence
  epidermal growth factor receptor (EGFR), ERBB1 phosphotyrosine kinase siRNA
cacctcgtcggcgtccgcccgag

SEQ ID NO: 5031 - DNA, 23 bp, Artificial Sequence
  epidermal growth factor receptor (EGFR), ERBB1 phosphotyrosine kinase siRNA
acctcgtcggcgtccgcccgagt

SEQ ID NO: 5032 - DNA, 23 bp, Artificial Sequence
  epidermal growth factor receptor (EGFR), ERBB1 phosphotyrosine kinase siRNA
cctcgtcggcgtccgcccgagtc

SEQ ID NO: 5033 - DNA, 23 bp, Artificial Sequence
  epidermal growth factor receptor (EGFR), ERBB1 phosphotyrosine kinase siRNA
ctcgtcggcgtccgcccgagtcc

SEQ ID NO: 5034 - DNA, 23 bp, Artificial Sequence
  epidermal growth factor receptor (EGFR), ERBB1 phosphotyrosine kinase siRNA
tcgtcggcgtccgcccgagtccc

SEQ ID NO: 5035 - DNA, 23 bp, Artificial Sequence
  epidermal growth factor receptor (EGFR), ERBB1 phosphotyrosine kinase siRNA
cgtcggcgtccgcccgagtcccc

SEQ ID NO: 5036 - DNA, 23 bp, Artificial Sequence
  epidermal growth factor receptor (EGFR), ERBB1 phosphotyrosine kinase siRNA
gtcggcgtccgcccgagtccccg

SEQ ID NO: 5037 - DNA, 23 bp, Artificial Sequence
  epidermal growth factor receptor (EGFR), ERBB1 phosphotyrosine kinase siRNA
tcggcgtccgcccgagtccccgc

SEQ ID NO: 5038 - DNA, 23 bp, Artificial Sequence
  epidermal growth factor receptor (EGFR), ERBB1 phosphotyrosine kinase siRNA
cggcgtccgcccgagtccccgcc

SEQ ID NO: 5039 - DNA, 23 bp, Artificial Sequence
  epidermal growth factor receptor (EGFR), ERBB1 phosphotyrosine kinase siRNA
ggcgtccgcccgagtccccgcct

SEQ ID NO: 5040 - DNA, 23 bp, Artificial Sequence
  epidermal growth factor receptor (EGFR), ERBB1 phosphotyrosine kinase siRNA
gcgtccgcccgagtccccgcctc

SEQ ID NO: 5041 - DNA, 23 bp, Artificial Sequence
  epidermal growth factor receptor (EGFR), ERBB1 phosphotyrosine kinase siRNA
cgtccgcccgagtccccgcctcg

SEQ ID NO: 5042 - DNA, 23 bp, Artificial Sequence
  epidermal growth factor receptor (EGFR), ERBB1 phosphotyrosine kinase siRNA
gtccgcccgagtccccgcctcgc

SEQ ID NO: 5043 - DNA, 23 bp, Artificial Sequence
  epidermal growth factor receptor (EGFR), ERBB1 phosphotyrosine kinase siRNA
tccgcccgagtccccgcctcgcc

SEQ ID NO: 5044 - DNA, 23 bp, Artificial Sequence
  epidermal growth factor receptor (EGFR), ERBB1 phosphotyrosine kinase siRNA
ccgcccgagtccccgcctcgccg

SEQ ID NO: 5045 - DNA, 23 bp, Artificial Sequence
  epidermal growth factor receptor (EGFR), ERBB1 phosphotyrosine kinase siRNA
cgcccgagtccccgcctcgccgc

SEQ ID NO: 5046 - DNA, 23 bp, Artificial Sequence
  epidermal growth factor receptor (EGFR), ERBB1 phosphotyrosine kinase siRNA
gcccgagtccccgcctcgccgcc

SEQ ID NO: 5047 - DNA, 23 bp, Artificial Sequence
  epidermal growth factor receptor (EGFR), ERBB1 phosphotyrosine kinase siRNA
cccgagtccccgcctcgccgcca

SEQ ID NO: 5048 - DNA, 23 bp, Artificial Sequence
  epidermal growth factor receptor (EGFR), ERBB1 phosphotyrosine kinase siRNA
ccgagtccccgcctcgccgccaa

SEQ ID NO: 5049 - DNA, 23 bp, Artificial Sequence
  epidermal growth factor receptor (EGFR), ERBB1 phosphotyrosine kinase siRNA
cgagtccccgcctcgccgccaac

SEQ ID NO: 5050 - DNA, 23 bp, Artificial Sequence
  epidermal growth factor receptor (EGFR), ERBB1 phosphotyrosine kinase siRNA
gagtccccgcctcgccgccaacg

SEQ ID NO: 5051 - DNA, 23 bp, Artificial Sequence
  epidermal growth factor receptor (EGFR), ERBB1 phosphotyrosine kinase siRNA
agtccccgcctcgccgccaacgc

SEQ ID NO: 5052 - DNA, 23 bp, Artificial Sequence
  epidermal growth factor receptor (EGFR), ERBB1 phosphotyrosine kinase siRNA
gtccccgcctcgccgccaacgcc

SEQ ID NO: 5053 - DNA, 23 bp, Artificial Sequence
  epidermal growth factor receptor (EGFR), ERBB1 phosphotyrosine kinase siRNA
tccccgcctcgccgccaacgcca

SEQ ID NO: 5054 - DNA, 23 bp, Artificial Sequence
  epidermal growth factor receptor (EGFR), ERBB1 phosphotyrosine kinase siRNA
ccccgcctcgccgccaacgccac

SEQ ID NO: 5055 - DNA, 23 bp, Artificial Sequence
  epidermal growth factor receptor (EGFR), ERBB1 phosphotyrosine kinase siRNA
cccgcctcgccgccaacgccaca

SEQ ID NO: 5056 - DNA, 23 bp, Artificial Sequence
  epidermal growth factor receptor (EGFR), ERBB1 phosphotyrosine kinase siRNA
ccgcctcgccgccaacgccacaa

SEQ ID NO: 5057 - DNA, 23 bp, Artificial Sequence
  epidermal growth factor receptor (EGFR), ERBB1 phosphotyrosine kinase siRNA
cgcctcgccgccaacgccacaac

SEQ ID NO: 5058 - DNA, 23 bp, Artificial Sequence
  epidermal growth factor receptor (EGFR), ERBB1 phosphotyrosine kinase siRNA
gcctcgccgccaacgccacaacc

SEQ ID NO: 5059 - DNA, 23 bp, Artificial Sequence
  epidermal growth factor receptor (EGFR), ERBB1 phosphotyrosine kinase siRNA
cctcgccgccaacgccacaacca

SEQ ID NO: 5060 - DNA, 23 bp, Artificial Sequence
  epidermal growth factor receptor (EGFR), ERBB1 phosphotyrosine kinase siRNA
ctcgccgccaacgccacaaccac

SEQ ID NO: 5061 - DNA, 23 bp, Artificial Sequence
  epidermal growth factor receptor (EGFR), ERBB1 phosphotyrosine kinase siRNA
tcgccgccaacgccacaaccacc

SEQ ID NO: 5062 - DNA, 23 bp, Artificial Sequence
  epidermal growth factor receptor (EGFR), ERBB1 phosphotyrosine kinase siRNA
cgccgccaacgccacaaccaccg

SEQ ID NO: 5063 - DNA, 23 bp, Artificial Sequence
  epidermal growth factor receptor (EGFR), ERBB1 phosphotyrosine kinase siRNA
gccgccaacgccacaaccaccgc

SEQ ID NO: 5064 - DNA, 23 bp, Artificial Sequence
  epidermal growth factor receptor (EGFR), ERBB1 phosphotyrosine kinase siRNA
ccgccaacgccacaaccaccgcg

SEQ ID NO: 5065 - DNA, 23 bp, Artificial Sequence
  epidermal growth factor receptor (EGFR), ERBB1 phosphotyrosine kinase siRNA
cgccaacgccacaaccaccgcgc

SEQ ID NO: 5066 - DNA, 23 bp, Artificial Sequence
  epidermal growth factor receptor (EGFR), ERBB1 phosphotyrosine kinase siRNA
gccaacgccacaaccaccgcgca

SEQ ID NO: 5067 - DNA, 23 bp, Artificial Sequence
  epidermal growth factor receptor (EGFR), ERBB1 phosphotyrosine kinase siRNA
ccaacgccacaaccaccgcgcac

SEQ ID NO: 5068 - DNA, 23 bp, Artificial Sequence
  epidermal growth factor receptor (EGFR), ERBB1 phosphotyrosine kinase siRNA
caacgccacaaccaccgcgcacg

SEQ ID NO: 5069 - DNA, 23 bp, Artificial Sequence
  epidermal growth factor receptor (EGFR), ERBB1 phosphotyrosine kinase siRNA
aacgccacaaccaccgcgcacgg

SEQ ID NO: 5070 - DNA, 23 bp, Artificial Sequence
  epidermal growth factor receptor (EGFR), ERBB1 phosphotyrosine kinase siRNA
acgccacaaccaccgcgcacggc

SEQ ID NO: 5071 - DNA, 23 bp, Artificial Sequence
  epidermal growth factor receptor (EGFR), ERBB1 phosphotyrosine kinase siRNA
cgccacaaccaccgcgcacggcc

SEQ ID NO: 5072 - DNA, 23 bp, Artificial Sequence
  epidermal growth factor receptor (EGFR), ERBB1 phosphotyrosine kinase siRNA
gccacaaccaccgcgcacggccc

SEQ ID NO: 5073 - DNA, 23 bp, Artificial Sequence
  epidermal growth factor receptor (EGFR), ERBB1 phosphotyrosine kinase siRNA
ccacaaccaccgcgcacggcccc

SEQ ID NO: 5074 - DNA, 23 bp, Artificial Sequence
  epidermal growth factor receptor (EGFR), ERBB1 phosphotyrosine kinase siRNA
cacaaccaccgcgcacggccccc

SEQ ID NO: 5075 - DNA, 23 bp, Artificial Sequence
  epidermal growth factor receptor (EGFR), ERBB1 phosphotyrosine kinase siRNA
acaaccaccgcgcacggccccct

SEQ ID NO: 5076 - DNA, 23 bp, Artificial Sequence
  epidermal growth factor receptor (EGFR), ERBB1 phosphotyrosine kinase siRNA
caaccaccgcgcacggccccctg

SEQ ID NO: 5077 - DNA, 23 bp, Artificial Sequence
  epidermal growth factor receptor (EGFR), ERBB1 phosphotyrosine kinase siRNA
aaccaccgcgcacggccccctga

SEQ ID NO: 5078 - DNA, 23 bp, Artificial Sequence
  epidermal growth factor receptor (EGFR), ERBB1 phosphotyrosine kinase siRNA
accaccgcgcacggccccctgac

SEQ ID NO: 5079 - DNA, 23 bp, Artificial Sequence
  epidermal growth factor receptor (EGFR), ERBB1 phosphotyrosine kinase siRNA
ccaccgcgcacggccccctgact

SEQ ID NO: 5080 - DNA, 23 bp, Artificial Sequence
  epidermal growth factor receptor (EGFR), ERBB1 phosphotyrosine kinase siRNA
caccgcgcacggccccctgactc

SEQ ID NO: 5081 - DNA, 23 bp, Artificial Sequence
  epidermal growth factor receptor (EGFR), ERBB1 phosphotyrosine kinase siRNA
accgcgcacggccccctgactcc

SEQ ID NO: 5082 - DNA, 23 bp, Artificial Sequence
  epidermal growth factor receptor (EGFR), ERBB1 phosphotyrosine kinase siRNA
ccgcgcacggccccctgactccg

SEQ ID NO: 5083 - DNA, 23 bp, Artificial Sequence
  epidermal growth factor receptor (EGFR), ERBB1 phosphotyrosine kinase siRNA
cgcgcacggccccctgactccgt

SEQ ID NO: 5084 - DNA, 23 bp, Artificial Sequence
  epidermal growth factor receptor (EGFR), ERBB1 phosphotyrosine kinase siRNA
gcgcacggccccctgactccgtc

SEQ ID NO: 5085 - DNA, 23 bp, Artificial Sequence
  epidermal growth factor receptor (EGFR), ERBB1 phosphotyrosine kinase siRNA
cgcacggccccctgactccgtcc

SEQ ID NO: 5086 - DNA, 23 bp, Artificial Sequence
  epidermal growth factor receptor (EGFR), ERBB1 phosphotyrosine kinase siRNA
gcacggccccctgactccgtcca

SEQ ID NO: 5087 - DNA, 23 bp, Artificial Sequence
  epidermal growth factor receptor (EGFR), ERBB1 phosphotyrosine kinase siRNA
cacggccccctgactccgtccag

SEQ ID NO: 5088 - DNA, 23 bp, Artificial Sequence
  epidermal growth factor receptor (EGFR), ERBB1 phosphotyrosine kinase siRNA
acggccccctgactccgtccagt

SEQ ID NO: 5089 - DNA, 23 bp, Artificial Sequence
  epidermal growth factor receptor (EGFR), ERBB1 phosphotyrosine kinase siRNA
cggccccctgactccgtccagta

SEQ ID NO: 5090 - DNA, 23 bp, Artificial Sequence
  epidermal growth factor receptor (EGFR), ERBB1 phosphotyrosine kinase siRNA
ggccccctgactccgtccagtat

SEQ ID NO: 5091 - DNA, 23 bp, Artificial Sequence
  epidermal growth factor receptor (EGFR), ERBB1 phosphotyrosine kinase siRNA
gccccctgactccgtccagtatt

SEQ ID NO: 5092 - DNA, 23 bp, Artificial Sequence
  epidermal growth factor receptor (EGFR), ERBB1 phosphotyrosine kinase siRNA
ccccctgactccgtccagtattg

SEQ ID NO: 5093 - DNA, 23 bp, Artificial Sequence
  epidermal growth factor receptor (EGFR), ERBB1 phosphotyrosine kinase siRNA
cccctgactccgtccagtattga

SEQ ID NO: 5094 - DNA, 23 bp, Artificial Sequence
  epidermal growth factor receptor (EGFR), ERBB1 phosphotyrosine kinase siRNA
ccctgactccgtccagtattgat

SEQ ID NO: 5095 - DNA, 23 bp, Artificial Sequence
  epidermal growth factor receptor (EGFR), ERBB1 phosphotyrosine kinase siRNA
cctgactccgtccagtattgatc

SEQ ID NO: 5096 - DNA, 23 bp, Artificial Sequence
  epidermal growth factor receptor (EGFR), ERBB1 phosphotyrosine kinase siRNA
ctgactccgtccagtattgatcg

SEQ ID NO: 5097 - DNA, 23 bp, Artificial Sequence
  epidermal growth factor receptor (EGFR), ERBB1 phosphotyrosine kinase siRNA
tgactccgtccagtattgatcgg

SEQ ID NO: 5098 - DNA, 23 bp, Artificial Sequence
  epidermal growth factor receptor (EGFR), ERBB1 phosphotyrosine kinase siRNA
gactccgtccagtattgatcggg

SEQ ID NO: 5099 - DNA, 23 bp, Artificial Sequence
  epidermal growth factor receptor (EGFR), ERBB1 phosphotyrosine kinase siRNA
actccgtccagtattgatcggga

SEQ ID NO: 5100 - DNA, 23 bp, Artificial Sequence
  epidermal growth factor receptor (EGFR), ERBB1 phosphotyrosine kinase siRNA
ctccgtccagtattgatcgggag

SEQ ID NO: 5101 - DNA, 23 bp, Artificial Sequence
  epidermal growth factor receptor (EGFR), ERBB1 phosphotyrosine kinase siRNA
tccgtccagtattgatcgggaga

SEQ ID NO: 5102 - DNA, 23 bp, Artificial Sequence
  epidermal growth factor receptor (EGFR), ERBB1 phosphotyrosine kinase siRNA
ccgtccagtattgatcgggagag

SEQ ID NO: 5103 - DNA, 23 bp, Artificial Sequence
  epidermal growth factor receptor (EGFR), ERBB1 phosphotyrosine kinase siRNA
cgtccagtattgatcgggagagc

SEQ ID NO: 5104 - DNA, 23 bp, Artificial Sequence
  epidermal growth factor receptor (EGFR), ERBB1 phosphotyrosine kinase siRNA
gtccagtattgatcgggagagcc

SEQ ID NO: 5105 - DNA, 23 bp, Artificial Sequence
  epidermal growth factor receptor (EGFR), ERBB1 phosphotyrosine kinase siRNA
tccagtattgatcgggagagccg

SEQ ID NO: 5106 - DNA, 23 bp, Artificial Sequence
  epidermal growth factor receptor (EGFR), ERBB1 phosphotyrosine kinase siRNA
ccagtattgatcgggagagccgg

SEQ ID NO: 5107 - DNA, 23 bp, Artificial Sequence
  epidermal growth factor receptor (EGFR), ERBB1 phosphotyrosine kinase siRNA
cagtattgatcgggagagccgga

SEQ ID NO: 5108 - DNA, 23 bp, Artificial Sequence
  epidermal growth factor receptor (EGFR), ERBB1 phosphotyrosine kinase siRNA
agtattgatcgggagagccggag

SEQ ID NO: 5109 - DNA, 23 bp, Artificial Sequence
  epidermal growth factor receptor (EGFR), ERBB1 phosphotyrosine kinase siRNA
gtattgatcgggagagccggagc

SEQ ID NO: 5110 - DNA, 23 bp, Artificial Sequence
  epidermal growth factor receptor (EGFR), ERBB1 phosphotyrosine kinase siRNA
tattgatcgggagagccggagcg

SEQ ID NO: 5111 - DNA, 23 bp, Artificial Sequence
  epidermal growth factor receptor (EGFR), ERBB1 phosphotyrosine kinase siRNA
attgatcgggagagccggagcga

SEQ ID NO: 5112 - DNA, 23 bp, Artificial Sequence
  epidermal growth factor receptor (EGFR), ERBB1 phosphotyrosine kinase siRNA
ttgatcgggagagccggagcgag

SEQ ID NO: 5113 - DNA, 23 bp, Artificial Sequence
  epidermal growth factor receptor (EGFR), ERBB1 phosphotyrosine kinase siRNA
tgatcgggagagccggagcgagc

SEQ ID NO: 5114 - DNA, 23 bp, Artificial Sequence
  epidermal growth factor receptor (EGFR), ERBB1 phosphotyrosine kinase siRNA
gatcgggagagccggagcgagct

SEQ ID NO: 5115 - DNA, 23 bp, Artificial Sequence
  epidermal growth factor receptor (EGFR), ERBB1 phosphotyrosine kinase siRNA
atcgggagagccggagcgagctc

SEQ ID NO: 5116 - DNA, 23 bp, Artificial Sequence
  epidermal growth factor receptor (EGFR), ERBB1 phosphotyrosine kinase siRNA
tcgggagagccggagcgagctct

SEQ ID NO: 5117 - DNA, 23 bp, Artificial Sequence
  epidermal growth factor receptor (EGFR), ERBB1 phosphotyrosine kinase siRNA
cgggagagccggagcgagctctt

SEQ ID NO: 5118 - DNA, 23 bp, Artificial Sequence
  epidermal growth factor receptor (EGFR), ERBB1 phosphotyrosine kinase siRNA
gggagagccggagcgagctcttc

SEQ ID NO: 5119 - DNA, 23 bp, Artificial Sequence
  epidermal growth factor receptor (EGFR), ERBB1 phosphotyrosine kinase siRNA
ggagagccggagcgagctcttcg

SEQ ID NO: 5120 - DNA, 23 bp, Artificial Sequence
  epidermal growth factor receptor (EGFR), ERBB1 phosphotyrosine kinase siRNA
gagagccggagcgagctcttcgg

SEQ ID NO: 5121 - DNA, 23 bp, Artificial Sequence
  epidermal growth factor receptor (EGFR), ERBB1 phosphotyrosine kinase siRNA
agagccggagcgagctcttcggg

SEQ ID NO: 5122 - DNA, 23 bp, Artificial Sequence
  epidermal growth factor receptor (EGFR), ERBB1 phosphotyrosine kinase siRNA
gagccggagcgagctcttcgggg

SEQ ID NO: 5123 - DNA, 23 bp, Artificial Sequence
  epidermal growth factor receptor (EGFR), ERBB1 phosphotyrosine kinase siRNA
agccggagcgagctcttcgggga

SEQ ID NO: 5124 - DNA, 23 bp, Artificial Sequence
  epidermal growth factor receptor (EGFR), ERBB1 phosphotyrosine kinase siRNA
gccggagcgagctcttcggggag

SEQ ID NO: 5125 - DNA, 23 bp, Artificial Sequence
  epidermal growth factor receptor (EGFR), ERBB1 phosphotyrosine kinase siRNA
ccggagcgagctcttcggggagc

SEQ ID NO: 5126 - DNA, 23 bp, Artificial Sequence
  epidermal growth factor receptor (EGFR), ERBB1 phosphotyrosine kinase siRNA
cggagcgagctcttcggggagca

SEQ ID NO: 5127 - DNA, 23 bp, Artificial Sequence
  epidermal growth factor receptor (EGFR), ERBB1 phosphotyrosine kinase siRNA
ggagcgagctcttcggggagcag

SEQ ID NO: 5128 - DNA, 23 bp, Artificial Sequence
  epidermal growth factor receptor (EGFR), ERBB1 phosphotyrosine kinase siRNA
gagcgagctcttcggggagcagc

SEQ ID NO: 5129 - DNA, 23 bp, Artificial Sequence
  epidermal growth factor receptor (EGFR), ERBB1 phosphotyrosine kinase siRNA
atgcgaccctccgggacggccgg

SEQ ID NO: 5130 - DNA, 23 bp, Artificial Sequence
  epidermal growth factor receptor (EGFR), ERBB1 phosphotyrosine kinase siRNA
tgcgaccctccgggacggccggg

SEQ ID NO: 5131 - DNA, 23 bp, Artificial Sequence
  epidermal growth factor receptor (EGFR), ERBB1 phosphotyrosine kinase siRNA
gccggggcagcgctcctggcgct

SEQ ID NO: 5132 - DNA, 23 bp, Artificial Sequence
  epidermal growth factor receptor (EGFR), ERBB1 phosphotyrosine kinase siRNA
ccggggcagcgctcctggcgctg

SEQ ID NO: 5133 - DNA, 23 bp, Artificial Sequence
  epidermal growth factor receptor (EGFR), ERBB1 phosphotyrosine kinase siRNA
cggggcagcgctcctggcgctgc

SEQ ID NO: 5134 - DNA, 23 bp, Artificial Sequence
  epidermal growth factor receptor (EGFR), ERBB1 phosphotyrosine kinase siRNA
ggggcagcgctcctggcgctgct

SEQ ID NO: 5135 - DNA, 23 bp, Artificial Sequence
  epidermal growth factor receptor (EGFR), ERBB1 phosphotyrosine kinase siRNA
gggcagcgctcctggcgctgctg

SEQ ID NO: 5136 - DNA, 23 bp, Artificial Sequence
  epidermal growth factor receptor (EGFR), ERBB1 phosphotyrosine kinase siRNA
ggcagcgctcctggcgctgctgg

SEQ ID NO: 5137 - DNA, 23 bp, Artificial Sequence
  epidermal growth factor receptor (EGFR), ERBB1 phosphotyrosine kinase siRNA
gcagcgctcctggcgctgctggc

SEQ ID NO: 5138 - DNA, 23 bp, Artificial Sequence
  epidermal growth factor receptor (EGFR), ERBB1 phosphotyrosine kinase siRNA
cagcgctcctggcgctgctggct

SEQ ID NO: 5139 - DNA, 23 bp, Artificial Sequence
  epidermal growth factor receptor (EGFR), ERBB1 phosphotyrosine kinase siRNA
agcgctcctggcgctgctggctg

SEQ ID NO: 5140 - DNA, 23 bp, Artificial Sequence
  epidermal growth factor receptor (EGFR), ERBB1 phosphotyrosine kinase siRNA
gcgctcctggcgctgctggctgc

SEQ ID NO: 5141 - DNA, 23 bp, Artificial Sequence
  epidermal growth factor receptor (EGFR), ERBB1 phosphotyrosine kinase siRNA
cgctcctggcgctgctggctgcg

SEQ ID NO: 5142 - DNA, 23 bp, Artificial Sequence
  epidermal growth factor receptor (EGFR), ERBB1 phosphotyrosine kinase siRNA
gctcctggcgctgctggctgcgc

SEQ ID NO: 5143 - DNA, 23 bp, Artificial Sequence
  epidermal growth factor receptor (EGFR), ERBB1 phosphotyrosine kinase siRNA
ctcctggcgctgctggctgcgct

SEQ ID NO: 5144 - DNA, 23 bp, Artificial Sequence
  epidermal growth factor receptor (EGFR), ERBB1 phosphotyrosine kinase siRNA
tcctggcgctgctggctgcgctc

SEQ ID NO: 5145 - DNA, 23 bp, Artificial Sequence
  epidermal growth factor receptor (EGFR), ERBB1 phosphotyrosine kinase siRNA
cctggcgctgctggctgcgctct

SEQ ID NO: 5146 - DNA, 23 bp, Artificial Sequence
  epidermal growth factor receptor (EGFR), ERBB1 phosphotyrosine kinase siRNA
ctggcgctgctggctgcgctctg

SEQ ID NO: 5147 - DNA, 23 bp, Artificial Sequence
  epidermal growth factor receptor (EGFR), ERBB1 phosphotyrosine kinase siRNA
tggcgctgctggctgcgctctgc

SEQ ID NO: 5148 - DNA, 23 bp, Artificial Sequence
  epidermal growth factor receptor (EGFR), ERBB1 phosphotyrosine kinase siRNA
ggcgctgctggctgcgctctgcc

SEQ ID NO: 5149 - DNA, 23 bp, Artificial Sequence
  epidermal growth factor receptor (EGFR), ERBB1 phosphotyrosine kinase siRNA
gcgctgctggctgcgctctgccc

SEQ ID NO: 5150 - DNA, 23 bp, Artificial Sequence
  epidermal growth factor receptor (EGFR), ERBB1 phosphotyrosine kinase siRNA
cgctgctggctgcgctctgcccg

SEQ ID NO: 5151 - DNA, 23 bp, Artificial Sequence
  epidermal growth factor receptor (EGFR), ERBB1 phosphotyrosine kinase siRNA
gctgctggctgcgctctgcccgg

SEQ ID NO: 5152 - DNA, 23 bp, Artificial Sequence
  epidermal growth factor receptor (EGFR), ERBB1 phosphotyrosine kinase siRNA
ctgctggctgcgctctgcccggc

SEQ ID NO: 5153 - DNA, 23 bp, Artificial Sequence
  epidermal growth factor receptor (EGFR), ERBB1 phosphotyrosine kinase siRNA
tgctggctgcgctctgcccggcg

SEQ ID NO: 5154 - DNA, 23 bp, Artificial Sequence
  epidermal growth factor receptor (EGFR), ERBB1 phosphotyrosine kinase siRNA
gctggctgcgctctgcccggcga

SEQ ID NO: 5155 - DNA, 23 bp, Artificial Sequence
  epidermal growth factor receptor (EGFR), ERBB1 phosphotyrosine kinase siRNA
ctggctgcgctctgcccggcgag

SEQ ID NO: 5156 - DNA, 23 bp, Artificial Sequence
  epidermal growth factor receptor (EGFR), ERBB1 phosphotyrosine kinase siRNA
tggctgcgctctgcccggcgagt

SEQ ID NO: 5157 - DNA, 23 bp, Artificial Sequence
  epidermal growth factor receptor (EGFR), ERBB1 phosphotyrosine kinase siRNA
ggctgcgctctgcccggcgagtc

SEQ ID NO: 5158 - DNA, 23 bp, Artificial Sequence
  epidermal growth factor receptor (EGFR), ERBB1 phosphotyrosine kinase siRNA
gctgcgctctgcccggcgagtcg

SEQ ID NO: 5159 - DNA, 23 bp, Artificial Sequence
  epidermal growth factor receptor (EGFR), ERBB1 phosphotyrosine kinase siRNA
ctgcgctctgcccggcgagtcgg

SEQ ID NO: 5160 - DNA, 23 bp, Artificial Sequence
  epidermal growth factor receptor (EGFR), ERBB1 phosphotyrosine kinase siRNA
tgcgctctgcccggcgagtcggg

SEQ ID NO: 5161 - DNA, 23 bp, Artificial Sequence
  epidermal growth factor receptor (EGFR), ERBB1 phosphotyrosine kinase siRNA
gcgctctgcccggcgagtcgggc

SEQ ID NO: 5162 - DNA, 23 bp, Artificial Sequence
  epidermal growth factor receptor (EGFR), ERBB1 phosphotyrosine kinase siRNA
cgctctgcccggcgagtcgggct

SEQ ID NO: 5163 - DNA, 23 bp, Artificial Sequence
  epidermal growth factor receptor (EGFR), ERBB1 phosphotyrosine kinase siRNA
gctctgcccggcgagtcgggctc

SEQ ID NO: 5164 - DNA, 23 bp, Artificial Sequence
  epidermal growth factor receptor (EGFR), ERBB1 phosphotyrosine kinase siRNA
ctctgcccggcgagtcgggctct

SEQ ID NO: 5165 - DNA, 23 bp, Artificial Sequence
  epidermal growth factor receptor (EGFR), ERBB1 phosphotyrosine kinase siRNA
tctgcccggcgagtcgggctctg

SEQ ID NO: 5166 - DNA, 23 bp, Artificial Sequence
  epidermal growth factor receptor (EGFR), ERBB1 phosphotyrosine kinase siRNA
ctgcccggcgagtcgggctctgg

SEQ ID NO: 5167 - DNA, 23 bp, Artificial Sequence
  epidermal growth factor receptor (EGFR), ERBB1 phosphotyrosine kinase siRNA
tgcccggcgagtcgggctctgga

SEQ ID NO: 5168 - DNA, 23 bp, Artificial Sequence
  epidermal growth factor receptor (EGFR), ERBB1 phosphotyrosine kinase siRNA
gcccggcgagtcgggctctggag

SEQ ID NO: 5169 - DNA, 23 bp, Artificial Sequence
  epidermal growth factor receptor (EGFR), ERBB1 phosphotyrosine kinase siRNA
cccggcgagtcgggctctggagg

SEQ ID NO: 5170 - DNA, 23 bp, Artificial Sequence
  epidermal growth factor receptor (EGFR), ERBB1 phosphotyrosine kinase siRNA
ccggcgagtcgggctctggagga

SEQ ID NO: 5171 - DNA, 23 bp, Artificial Sequence
  epidermal growth factor receptor (EGFR), ERBB1 phosphotyrosine kinase siRNA
cggcgagtcgggctctggaggaa

SEQ ID NO: 5172 - DNA, 23 bp, Artificial Sequence
  epidermal growth factor receptor (EGFR), ERBB1 phosphotyrosine kinase siRNA
ggcgagtcgggctctggaggaaa

SEQ ID NO: 5173 - DNA, 23 bp, Artificial Sequence
  epidermal growth factor receptor (EGFR), ERBB1 phosphotyrosine kinase siRNA
gcgagtcgggctctggaggaaaa

SEQ ID NO: 5174 - DNA, 23 bp, Artificial Sequence
  epidermal growth factor receptor (EGFR), ERBB1 phosphotyrosine kinase siRNA
cgagtcgggctctggaggaaaag

SEQ ID NO: 5175 - DNA, 23 bp, Artificial Sequence
  epidermal growth factor receptor (EGFR), ERBB1 phosphotyrosine kinase siRNA
gagtcgggctctggaggaaaaga

SEQ ID NO: 5176 - DNA, 23 bp, Artificial Sequence
  epidermal growth factor receptor (EGFR), ERBB1 phosphotyrosine kinase siRNA
agtcgggctctggaggaaaagaa

SEQ ID NO: 5177 - DNA, 23 bp, Artificial Sequence
  epidermal growth factor receptor (EGFR), ERBB1 phosphotyrosine kinase siRNA
gtcgggctctggaggaaaagaaa

SEQ ID NO: 5178 - DNA, 23 bp, Artificial Sequence
  epidermal growth factor receptor (EGFR), ERBB1 phosphotyrosine kinase siRNA
tcgggctctggaggaaaagaaag

SEQ ID NO: 5179 - DNA, 23 bp, Artificial Sequence
  epidermal growth factor receptor (EGFR), ERBB1 phosphotyrosine kinase siRNA
cgggctctggaggaaaagaaagt

SEQ ID NO: 5180 - DNA, 23 bp, Artificial Sequence
  epidermal growth factor receptor (EGFR), ERBB1 phosphotyrosine kinase siRNA
gggctctggaggaaaagaaagtt

SEQ ID NO: 5181 - DNA, 23 bp, Artificial Sequence
  epidermal growth factor receptor (EGFR), ERBB1 phosphotyrosine kinase siRNA
ggctctggaggaaaagaaagttt

SEQ ID NO: 5182 - DNA, 23 bp, Artificial Sequence
  epidermal growth factor receptor (EGFR), ERBB1 phosphotyrosine kinase siRNA
gctctggaggaaaagaaagtttg

SEQ ID NO: 5183 - DNA, 23 bp, Artificial Sequence
  epidermal growth factor receptor (EGFR), ERBB1 phosphotyrosine kinase siRNA
ctctggaggaaaagaaagtttgc

SEQ ID NO: 5184 - DNA, 23 bp, Artificial Sequence
  epidermal growth factor receptor (EGFR), ERBB1 phosphotyrosine kinase siRNA
tctggaggaaaagaaagtttgcc

SEQ ID NO: 5185 - DNA, 23 bp, Artificial Sequence
  epidermal growth factor receptor (EGFR), ERBB1 phosphotyrosine kinase siRNA
ctggaggaaaagaaagtttgcca

SEQ ID NO: 5186 - DNA, 23 bp, Artificial Sequence
  epidermal growth factor receptor (EGFR), ERBB1 phosphotyrosine kinase siRNA
tggaggaaaagaaagtttgccaa

SEQ ID NO: 5187 - DNA, 23 bp, Artificial Sequence
  epidermal growth factor receptor (EGFR), ERBB1 phosphotyrosine kinase siRNA
ggaggaaaagaaagtttgccaag

SEQ ID NO: 5188 - DNA, 23 bp, Artificial Sequence
  epidermal growth factor receptor (EGFR), ERBB1 phosphotyrosine kinase siRNA
gaggaaaagaaagtttgccaagg

SEQ ID NO: 5189 - DNA, 23 bp, Artificial Sequence
  epidermal growth factor receptor (EGFR), ERBB1 phosphotyrosine kinase siRNA
aggaaaagaaagtttgccaaggc

SEQ ID NO: 5190 - DNA, 23 bp, Artificial Sequence
  epidermal growth factor receptor (EGFR), ERBB1 phosphotyrosine kinase siRNA
ggaaaagaaagtttgccaaggca

SEQ ID NO: 5191 - DNA, 23 bp, Artificial Sequence
  epidermal growth factor receptor (EGFR), ERBB1 phosphotyrosine kinase siRNA
gaaaagaaagtttgccaaggcac

SEQ ID NO: 5192 - DNA, 23 bp, Artificial Sequence
  epidermal growth factor receptor (EGFR), ERBB1 phosphotyrosine kinase siRNA
aaaagaaagtttgccaaggcacg

SEQ ID NO: 5193 - DNA, 23 bp, Artificial Sequence
  epidermal growth factor receptor (EGFR), ERBB1 phosphotyrosine kinase siRNA
aaagaaagtttgccaaggcacga

SEQ ID NO: 5194 - DNA, 23 bp, Artificial Sequence
  epidermal growth factor receptor (EGFR), ERBB1 phosphotyrosine kinase siRNA
aagaaagtttgccaaggcacgag

SEQ ID NO: 5195 - DNA, 23 bp, Artificial Sequence
  epidermal growth factor receptor (EGFR), ERBB1 phosphotyrosine kinase siRNA
agaaagtttgccaaggcacgagt

SEQ ID NO: 5196 - DNA, 23 bp, Artificial Sequence
  epidermal growth factor receptor (EGFR), ERBB1 phosphotyrosine kinase siRNA
gaaagtttgccaaggcacgagta

SEQ ID NO: 5197 - DNA, 23 bp, Artificial Sequence
  epidermal growth factor receptor (EGFR), ERBB1 phosphotyrosine kinase siRNA
aaagtttgccaaggcacgagtaa

SEQ ID NO: 5198 - DNA, 23 bp, Artificial Sequence
  epidermal growth factor receptor (EGFR), ERBB1 phosphotyrosine kinase siRNA
aagtttgccaaggcacgagtaac

SEQ ID NO: 5199 - DNA, 23 bp, Artificial Sequence
  epidermal growth factor receptor (EGFR), ERBB1 phosphotyrosine kinase siRNA
agtttgccaaggcacgagtaaca

SEQ ID NO: 5200 - DNA, 23 bp, Artificial Sequence
  epidermal growth factor receptor (EGFR), ERBB1 phosphotyrosine kinase siRNA
gtttgccaaggcacgagtaacaa

SEQ ID NO: 5201 - DNA, 23 bp, Artificial Sequence
  epidermal growth factor receptor (EGFR), ERBB1 phosphotyrosine kinase siRNA
tttgccaaggcacgagtaacaag

SEQ ID NO: 5202 - DNA, 23 bp, Artificial Sequence
  epidermal growth factor receptor (EGFR), ERBB1 phosphotyrosine kinase siRNA
ttgccaaggcacgagtaacaagc

SEQ ID NO: 5203 - DNA, 23 bp, Artificial Sequence
  epidermal growth factor receptor (EGFR), ERBB1 phosphotyrosine kinase siRNA
tgccaaggcacgagtaacaagct

SEQ ID NO: 5204 - DNA, 23 bp, Artificial Sequence
  epidermal growth factor receptor (EGFR), ERBB1 phosphotyrosine kinase siRNA
gccaaggcacgagtaacaagctc

SEQ ID NO: 5205 - DNA, 23 bp, Artificial Sequence
  epidermal growth factor receptor (EGFR), ERBB1 phosphotyrosine kinase siRNA
ccaaggcacgagtaacaagctca

SEQ ID NO: 5206 - DNA, 23 bp, Artificial Sequence
  epidermal growth factor receptor (EGFR), ERBB1 phosphotyrosine kinase siRNA
caaggcacgagtaacaagctcac

SEQ ID NO: 5207 - DNA, 23 bp, Artificial Sequence
  epidermal growth factor receptor (EGFR), ERBB1 phosphotyrosine kinase siRNA
aaggcacgagtaacaagctcacg

SEQ ID NO: 5208 - DNA, 23 bp, Artificial Sequence
  epidermal growth factor receptor (EGFR), ERBB1 phosphotyrosine kinase siRNA
aggcacgagtaacaagctcacgc

SEQ ID NO: 5209 - DNA, 23 bp, Artificial Sequence
  epidermal growth factor receptor (EGFR), ERBB1 phosphotyrosine kinase siRNA
ggcacgagtaacaagctcacgca

SEQ ID NO: 5210 - DNA, 23 bp, Artificial Sequence
  epidermal growth factor receptor (EGFR), ERBB1 phosphotyrosine kinase siRNA
gcacgagtaacaagctcacgcag

SEQ ID NO: 5211 - DNA, 23 bp, Artificial Sequence
  epidermal growth factor receptor (EGFR), ERBB1 phosphotyrosine kinase siRNA
cacgagtaacaagctcacgcagt

SEQ ID NO: 5212 - DNA, 23 bp, Artificial Sequence
  epidermal growth factor receptor (EGFR), ERBB1 phosphotyrosine kinase siRNA
acgagtaacaagctcacgcagtt

SEQ ID NO: 5213 - DNA, 23 bp, Artificial Sequence
  epidermal growth factor receptor (EGFR), ERBB1 phosphotyrosine kinase siRNA
cgagtaacaagctcacgcagttg

SEQ ID NO: 5214 - DNA, 23 bp, Artificial Sequence
  epidermal growth factor receptor (EGFR), ERBB1 phosphotyrosine kinase siRNA
gagtaacaagctcacgcagttgg

SEQ ID NO: 5215 - DNA, 23 bp, Artificial Sequence
  epidermal growth factor receptor (EGFR), ERBB1 phosphotyrosine kinase siRNA
agtaacaagctcacgcagttggg

SEQ ID NO: 5216 - DNA, 23 bp, Artificial Sequence
  epidermal growth factor receptor (EGFR), ERBB1 phosphotyrosine kinase siRNA
gtaacaagctcacgcagttgggc

SEQ ID NO: 5217 - DNA, 23 bp, Artificial Sequence
  epidermal growth factor receptor (EGFR), ERBB1 phosphotyrosine kinase siRNA
taacaagctcacgcagttgggca

SEQ ID NO: 5218 - DNA, 23 bp, Artificial Sequence
  epidermal growth factor receptor (EGFR), ERBB1 phosphotyrosine kinase siRNA
aacaagctcacgcagttgggcac

SEQ ID NO: 5219 - DNA, 23 bp, Artificial Sequence
  epidermal growth factor receptor (EGFR), ERBB1 phosphotyrosine kinase siRNA
acaagctcacgcagttgggcact

SEQ ID NO: 5220 - DNA, 23 bp, Artificial Sequence
  epidermal growth factor receptor (EGFR), ERBB1 phosphotyrosine kinase siRNA
caagctcacgcagttgggcactt

SEQ ID NO: 5221 - DNA, 23 bp, Artificial Sequence
  epidermal growth factor receptor (EGFR), ERBB1 phosphotyrosine kinase siRNA
aagctcacgcagttgggcacttt

SEQ ID NO: 5222 - DNA, 23 bp, Artificial Sequence
  epidermal growth factor receptor (EGFR), ERBB1 phosphotyrosine kinase siRNA
agctcacgcagttgggcactttt

SEQ ID NO: 5223 - DNA, 23 bp, Artificial Sequence
  epidermal growth factor receptor (EGFR), ERBB1 phosphotyrosine kinase siRNA
gctcacgcagttgggcacttttg

SEQ ID NO: 5224 - DNA, 23 bp, Artificial Sequence
  epidermal growth factor receptor (EGFR), ERBB1 phosphotyrosine kinase siRNA
ctcacgcagttgggcacttttga

SEQ ID NO: 5225 - DNA, 23 bp, Artificial Sequence
  epidermal growth factor receptor (EGFR), ERBB1 phosphotyrosine kinase siRNA
tcacgcagttgggcacttttgaa

SEQ ID NO: 5226 - DNA, 23 bp, Artificial Sequence
  epidermal growth factor receptor (EGFR), ERBB1 phosphotyrosine kinase siRNA
cacgcagttgggcacttttgaag

SEQ ID NO: 5227 - DNA, 23 bp, Artificial Sequence
  epidermal growth factor receptor (EGFR), ERBB1 phosphotyrosine kinase siRNA
acgcagttgggcacttttgaaga

SEQ ID NO: 5228 - DNA, 23 bp, Artificial Sequence
  epidermal growth factor receptor (EGFR), ERBB1 phosphotyrosine kinase siRNA
cgcagttgggcacttttgaagat

SEQ ID NO: 5229 - DNA, 23 bp, Artificial Sequence
  epidermal growth factor receptor (EGFR), ERBB1 phosphotyrosine kinase siRNA
gcagttgggcacttttgaagatc

SEQ ID NO: 5230 - DNA, 23 bp, Artificial Sequence
  epidermal growth factor receptor (EGFR), ERBB1 phosphotyrosine kinase siRNA
cagttgggcacttttgaagatca

SEQ ID NO: 5231 - DNA, 23 bp, Artificial Sequence
  epidermal growth factor receptor (EGFR), ERBB1 phosphotyrosine kinase siRNA
agttgggcacttttgaagatcat

SEQ ID NO: 5232 - DNA, 23 bp, Artificial Sequence
  epidermal growth factor receptor (EGFR), ERBB1 phosphotyrosine kinase siRNA
gttgggcacttttgaagatcatt

SEQ ID NO: 5233 - DNA, 23 bp, Artificial Sequence
  epidermal growth factor receptor (EGFR), ERBB1 phosphotyrosine kinase siRNA
ttgggcacttttgaagatcattt

SEQ ID NO: 5234 - DNA, 23 bp, Artificial Sequence
  epidermal growth factor receptor (EGFR), ERBB1 phosphotyrosine kinase siRNA
tgggcacttttgaagatcatttt

SEQ ID NO: 5235 - DNA, 23 bp, Artificial Sequence
  epidermal growth factor receptor (EGFR), ERBB1 phosphotyrosine kinase siRNA
gggcacttttgaagatcattttc

SEQ ID NO: 5236 - DNA, 23 bp, Artificial Sequence
  epidermal growth factor receptor (EGFR), ERBB1 phosphotyrosine kinase siRNA
ggcacttttgaagatcattttct

SEQ ID NO: 5237 - DNA, 23 bp, Artificial Sequence
  epidermal growth factor receptor (EGFR), ERBB1 phosphotyrosine kinase siRNA
gcacttttgaagatcattttctc

SEQ ID NO: 5238 - DNA, 23 bp, Artificial Sequence
  epidermal growth factor receptor (EGFR), ERBB1 phosphotyrosine kinase siRNA
cacttttgaagatcattttctca

SEQ ID NO: 5239 - DNA, 23 bp, Artificial Sequence
  epidermal growth factor receptor (EGFR), ERBB1 phosphotyrosine kinase siRNA
acttttgaagatcattttctcag

SEQ ID NO: 5240 - DNA, 23 bp, Artificial Sequence
  epidermal growth factor receptor (EGFR), ERBB1 phosphotyrosine kinase siRNA
cttttgaagatcattttctcagc

SEQ ID NO: 5241 - DNA, 23 bp, Artificial Sequence
  epidermal growth factor receptor (EGFR), ERBB1 phosphotyrosine kinase siRNA
ttttgaagatcattttctcagcc

SEQ ID NO: 5242 - DNA, 23 bp, Artificial Sequence
  epidermal growth factor receptor (EGFR), ERBB1 phosphotyrosine kinase siRNA
tttgaagatcattttctcagcct

SEQ ID NO: 5243 - DNA, 23 bp, Artificial Sequence
  epidermal growth factor receptor (EGFR), ERBB1 phosphotyrosine kinase siRNA
ttgaagatcattttctcagcctc

SEQ ID NO: 5244 - DNA, 23 bp, Artificial Sequence
  epidermal growth factor receptor (EGFR), ERBB1 phosphotyrosine kinase siRNA
tgaagatcattttctcagcctcc

SEQ ID NO: 5245 - DNA, 23 bp, Artificial Sequence
  epidermal growth factor receptor (EGFR), ERBB1 phosphotyrosine kinase siRNA
gaagatcattttctcagcctcca

SEQ ID NO: 5246 - DNA, 23 bp, Artificial Sequence
  epidermal growth factor receptor (EGFR), ERBB1 phosphotyrosine kinase siRNA
aagatcattttctcagcctccag

SEQ ID NO: 5247 - DNA, 23 bp, Artificial Sequence
  epidermal growth factor receptor (EGFR), ERBB1 phosphotyrosine kinase siRNA
agatcattttctcagcctccaga

SEQ ID NO: 5248 - DNA, 23 bp, Artificial Sequence
  epidermal growth factor receptor (EGFR), ERBB1 phosphotyrosine kinase siRNA
gatcattttctcagcctccagag

SEQ ID NO: 5249 - DNA, 23 bp, Artificial Sequence
  epidermal growth factor receptor (EGFR), ERBB1 phosphotyrosine kinase siRNA
atcattttctcagcctccagagg

SEQ ID NO: 5250 - DNA, 23 bp, Artificial Sequence
  epidermal growth factor receptor (EGFR), ERBB1 phosphotyrosine kinase siRNA
tcattttctcagcctccagagga

SEQ ID NO: 5251 - DNA, 23 bp, Artificial Sequence
  epidermal growth factor receptor (EGFR), ERBB1 phosphotyrosine kinase siRNA
cattttctcagcctccagaggat

SEQ ID NO: 5252 - DNA, 23 bp, Artificial Sequence
  epidermal growth factor receptor (EGFR), ERBB1 phosphotyrosine kinase siRNA
attttctcagcctccagaggatg

SEQ ID NO: 5253 - DNA, 23 bp, Artificial Sequence
  epidermal growth factor receptor (EGFR), ERBB1 phosphotyrosine kinase siRNA
ttttctcagcctccagaggatgt

SEQ ID NO: 5254 - DNA, 23 bp, Artificial Sequence
  epidermal growth factor receptor (EGFR), ERBB1 phosphotyrosine kinase siRNA
tttctcagcctccagaggatgtt

SEQ ID NO: 5255 - DNA, 23 bp, Artificial Sequence
  epidermal growth factor receptor (EGFR), ERBB1 phosphotyrosine kinase siRNA
ttctcagcctccagaggatgttc

SEQ ID NO: 5256 - DNA, 23 bp, Artificial Sequence
  epidermal growth factor receptor (EGFR), ERBB1 phosphotyrosine kinase siRNA
tctcagcctccagaggatgttca

SEQ ID NO: 5257 - DNA, 23 bp, Artificial Sequence
  epidermal growth factor receptor (EGFR), ERBB1 phosphotyrosine kinase siRNA
ctcagcctccagaggatgttcaa

SEQ ID NO: 5258 - DNA, 23 bp, Artificial Sequence
  epidermal growth factor receptor (EGFR), ERBB1 phosphotyrosine kinase siRNA
tcagcctccagaggatgttcaat

SEQ ID NO: 5259 - DNA, 23 bp, Artificial Sequence
  epidermal growth factor receptor (EGFR), ERBB1 phosphotyrosine kinase siRNA
cagcctccagaggatgttcaata

SEQ ID NO: 5260 - DNA, 23 bp, Artificial Sequence
  epidermal growth factor receptor (EGFR), ERBB1 phosphotyrosine kinase siRNA
agcctccagaggatgttcaataa

SEQ ID NO: 5261 - DNA, 23 bp, Artificial Sequence
  epidermal growth factor receptor (EGFR), ERBB1 phosphotyrosine kinase siRNA
gcctccagaggatgttcaataac

SEQ ID NO: 5262 - DNA, 23 bp, Artificial Sequence
  epidermal growth factor receptor (EGFR), ERBB1 phosphotyrosine kinase siRNA
cctccagaggatgttcaataact

SEQ ID NO: 5263 - DNA, 23 bp, Artificial Sequence
  epidermal growth factor receptor (EGFR), ERBB1 phosphotyrosine kinase siRNA
ctccagaggatgttcaataactg

SEQ ID NO: 5264 - DNA, 23 bp, Artificial Sequence
  epidermal growth factor receptor (EGFR), ERBB1 phosphotyrosine kinase siRNA
tccagaggatgttcaataactgt

SEQ ID NO: 5265 - DNA, 23 bp, Artificial Sequence
  epidermal growth factor receptor (EGFR), ERBB1 phosphotyrosine kinase siRNA
ccagaggatgttcaataactgtg

SEQ ID NO: 5266 - DNA, 23 bp, Artificial Sequence
  epidermal growth factor receptor (EGFR), ERBB1 phosphotyrosine kinase siRNA
cagaggatgttcaataactgtga

SEQ ID NO: 5267 - DNA, 23 bp, Artificial Sequence
  epidermal growth factor receptor (EGFR), ERBB1 phosphotyrosine kinase siRNA
agaggatgttcaataactgtgag

SEQ ID NO: 5268 - DNA, 23 bp, Artificial Sequence
  epidermal growth factor receptor (EGFR), ERBB1 phosphotyrosine kinase siRNA
gaggatgttcaataactgtgagg

SEQ ID NO: 5269 - DNA, 23 bp, Artificial Sequence
  epidermal growth factor receptor (EGFR), ERBB1 phosphotyrosine kinase siRNA
aggatgttcaataactgtgaggt

SEQ ID NO: 5270 - DNA, 23 bp, Artificial Sequence
  epidermal growth factor receptor (EGFR), ERBB1 phosphotyrosine kinase siRNA
ggatgttcaataactgtgaggtg

SEQ ID NO: 5271 - DNA, 23 bp, Artificial Sequence
  epidermal growth factor receptor (EGFR), ERBB1 phosphotyrosine kinase siRNA
gatgttcaataactgtgaggtgg

SEQ ID NO: 5272 - DNA, 23 bp, Artificial Sequence
  epidermal growth factor receptor (EGFR), ERBB1 phosphotyrosine kinase siRNA
atgttcaataactgtgaggtggt

SEQ ID NO: 5273 - DNA, 23 bp, Artificial Sequence
  epidermal growth factor receptor (EGFR), ERBB1 phosphotyrosine kinase siRNA
tgttcaataactgtgaggtggtc

SEQ ID NO: 5274 - DNA, 23 bp, Artificial Sequence
  epidermal growth factor receptor (EGFR), ERBB1 phosphotyrosine kinase siRNA
gttcaataactgtgaggtggtcc

SEQ ID NO: 5275 - DNA, 23 bp, Artificial Sequence
  epidermal growth factor receptor (EGFR), ERBB1 phosphotyrosine kinase siRNA
ttcaataactgtgaggtggtcct

SEQ ID NO: 5276 - DNA, 23 bp, Artificial Sequence
  epidermal growth factor receptor (EGFR), ERBB1 phosphotyrosine kinase siRNA
tcaataactgtgaggtggtcctt

SEQ ID NO: 5277 - DNA, 23 bp, Artificial Sequence
  epidermal growth factor receptor (EGFR), ERBB1 phosphotyrosine kinase siRNA
caataactgtgaggtggtccttg

SEQ ID NO: 5278 - DNA, 23 bp, Artificial Sequence
  epidermal growth factor receptor (EGFR), ERBB1 phosphotyrosine kinase siRNA
aataactgtgaggtggtccttgg

SEQ ID NO: 5279 - DNA, 23 bp, Artificial Sequence
  epidermal growth factor receptor (EGFR), ERBB1 phosphotyrosine kinase siRNA
ataactgtgaggtggtccttggg

SEQ ID NO: 5280 - DNA, 23 bp, Artificial Sequence
  epidermal growth factor receptor (EGFR), ERBB1 phosphotyrosine kinase siRNA
taactgtgaggtggtccttggga

SEQ ID NO: 5281 - DNA, 23 bp, Artificial Sequence
  epidermal growth factor receptor (EGFR), ERBB1 phosphotyrosine kinase siRNA
aactgtgaggtggtccttgggaa

SEQ ID NO: 5282 - DNA, 23 bp, Artificial Sequence
  epidermal growth factor receptor (EGFR), ERBB1 phosphotyrosine kinase siRNA
actgtgaggtggtccttgggaat

SEQ ID NO: 5283 - DNA, 23 bp, Artificial Sequence
  epidermal growth factor receptor (EGFR), ERBB1 phosphotyrosine kinase siRNA
ctgtgaggtggtccttgggaatt

SEQ ID NO: 5284 - DNA, 23 bp, Artificial Sequence
  epidermal growth factor receptor (EGFR), ERBB1 phosphotyrosine kinase siRNA
tgtgaggtggtccttgggaattt

SEQ ID NO: 5285 - DNA, 23 bp, Artificial Sequence
  epidermal growth factor receptor (EGFR), ERBB1 phosphotyrosine kinase siRNA
gtgaggtggtccttgggaatttg

SEQ ID NO: 5286 - DNA, 23 bp, Artificial Sequence
  epidermal growth factor receptor (EGFR), ERBB1 phosphotyrosine kinase siRNA
tgaggtggtccttgggaatttgg

SEQ ID NO: 5287 - DNA, 23 bp, Artificial Sequence
  epidermal growth factor receptor (EGFR), ERBB1 phosphotyrosine kinase siRNA
gaggtggtccttgggaatttgga

SEQ ID NO: 5288 - DNA, 23 bp, Artificial Sequence
  epidermal growth factor receptor (EGFR), ERBB1 phosphotyrosine kinase siRNA
aggtggtccttgggaatttggaa

SEQ ID NO: 5289 - DNA, 23 bp, Artificial Sequence
  epidermal growth factor receptor (EGFR), ERBB1 phosphotyrosine kinase siRNA
ggtggtccttgggaatttggaaa

SEQ ID NO: 5290 - DNA, 23 bp, Artificial Sequence
  epidermal growth factor receptor (EGFR), ERBB1 phosphotyrosine kinase siRNA
gtggtccttgggaatttggaaat

SEQ ID NO: 5291 - DNA, 23 bp, Artificial Sequence
  epidermal growth factor receptor (EGFR), ERBB1 phosphotyrosine kinase siRNA
tggtccttgggaatttggaaatt

SEQ ID NO: 5292 - DNA, 23 bp, Artificial Sequence
  epidermal growth factor receptor (EGFR), ERBB1 phosphotyrosine kinase siRNA
ggtccttgggaatttggaaatta

SEQ ID NO: 5293 - DNA, 23 bp, Artificial Sequence
  epidermal growth factor receptor (EGFR), ERBB1 phosphotyrosine kinase siRNA
gtccttgggaatttggaaattac

SEQ ID NO: 5294 - DNA, 23 bp, Artificial Sequence
  epidermal growth factor receptor (EGFR), ERBB1 phosphotyrosine kinase siRNA
tccttgggaatttggaaattacc

SEQ ID NO: 5295 - DNA, 23 bp, Artificial Sequence
  epidermal growth factor receptor (EGFR), ERBB1 phosphotyrosine kinase siRNA
ccttgggaatttggaaattacct

SEQ ID NO: 5296 - DNA, 23 bp, Artificial Sequence
  epidermal growth factor receptor (EGFR), ERBB1 phosphotyrosine kinase siRNA
cttgggaatttggaaattaccta

SEQ ID NO: 5297 - DNA, 23 bp, Artificial Sequence
  epidermal growth factor receptor (EGFR), ERBB1 phosphotyrosine kinase siRNA
ttgggaatttggaaattacctat

SEQ ID NO: 5298 - DNA, 23 bp, Artificial Sequence
  epidermal growth factor receptor (EGFR), ERBB1 phosphotyrosine kinase siRNA
tgggaatttggaaattacctatg

SEQ ID NO: 5299 - DNA, 23 bp, Artificial Sequence
  epidermal growth factor receptor (EGFR), ERBB1 phosphotyrosine kinase siRNA
gggaatttggaaattacctatgt

SEQ ID NO: 5300 - DNA, 23 bp, Artificial Sequence
  epidermal growth factor receptor (EGFR), ERBB1 phosphotyrosine kinase siRNA
ggaatttggaaattacctatgtg

SEQ ID NO: 5301 - DNA, 23 bp, Artificial Sequence
  epidermal growth factor receptor (EGFR), ERBB1 phosphotyrosine kinase siRNA
gaatttggaaattacctatgtgc

SEQ ID NO: 5302 - DNA, 23 bp, Artificial Sequence
  epidermal growth factor receptor (EGFR), ERBB1 phosphotyrosine kinase siRNA
aatttggaaattacctatgtgca

SEQ ID NO: 5303 - DNA, 23 bp, Artificial Sequence
  epidermal growth factor receptor (EGFR), ERBB1 phosphotyrosine kinase siRNA
atttggaaattacctatgtgcag

SEQ ID NO: 5304 - DNA, 23 bp, Artificial Sequence
  epidermal growth factor receptor (EGFR), ERBB1 phosphotyrosine kinase siRNA
tttggaaattacctatgtgcaga

SEQ ID NO: 5305 - DNA, 23 bp, Artificial Sequence
  epidermal growth factor receptor (EGFR), ERBB1 phosphotyrosine kinase siRNA
ttggaaattacctatgtgcagag

SEQ ID NO: 5306 - DNA, 23 bp, Artificial Sequence
  epidermal growth factor receptor (EGFR), ERBB1 phosphotyrosine kinase siRNA
tggaaattacctatgtgcagagg

SEQ ID NO: 5307 - DNA, 23 bp, Artificial Sequence
  epidermal growth factor receptor (EGFR), ERBB1 phosphotyrosine kinase siRNA
ggaaattacctatgtgcagagga

SEQ ID NO: 5308 - DNA, 23 bp, Artificial Sequence
  epidermal growth factor receptor (EGFR), ERBB1 phosphotyrosine kinase siRNA
gaaattacctatgtgcagaggaa

SEQ ID NO: 5309 - DNA, 23 bp, Artificial Sequence
  epidermal growth factor receptor (EGFR), ERBB1 phosphotyrosine kinase siRNA
aaattacctatgtgcagaggaat

SEQ ID NO: 5310 - DNA, 23 bp, Artificial Sequence
  epidermal growth factor receptor (EGFR), ERBB1 phosphotyrosine kinase siRNA
aattacctatgtgcagaggaatt

SEQ ID NO: 5311 - DNA, 23 bp, Artificial Sequence
  epidermal growth factor receptor (EGFR), ERBB1 phosphotyrosine kinase siRNA
attacctatgtgcagaggaatta

SEQ ID NO: 5312 - DNA, 23 bp, Artificial Sequence
  epidermal growth factor receptor (EGFR), ERBB1 phosphotyrosine kinase siRNA
ttacctatgtgcagaggaattat

SEQ ID NO: 5313 - DNA, 23 bp, Artificial Sequence
  epidermal growth factor receptor (EGFR), ERBB1 phosphotyrosine kinase siRNA
tacctatgtgcagaggaattatg

SEQ ID NO: 5314 - DNA, 23 bp, Artificial Sequence
  epidermal growth factor receptor (EGFR), ERBB1 phosphotyrosine kinase siRNA
acctatgtgcagaggaattatga

SEQ ID NO: 5315 - DNA, 23 bp, Artificial Sequence
  epidermal growth factor receptor (EGFR), ERBB1 phosphotyrosine kinase siRNA
cctatgtgcagaggaattatgat

SEQ ID NO: 5316 - DNA, 23 bp, Artificial Sequence
  epidermal growth factor receptor (EGFR), ERBB1 phosphotyrosine kinase siRNA
ctatgtgcagaggaattatgatc

SEQ ID NO: 5317 - DNA, 23 bp, Artificial Sequence
  epidermal growth factor receptor (EGFR), ERBB1 phosphotyrosine kinase siRNA
tatgtgcagaggaattatgatct

SEQ ID NO: 5318 - DNA, 23 bp, Artificial Sequence
  epidermal growth factor receptor (EGFR), ERBB1 phosphotyrosine kinase siRNA
atgtgcagaggaattatgatctt

SEQ ID NO: 5319 - DNA, 23 bp, Artificial Sequence
  epidermal growth factor receptor (EGFR), ERBB1 phosphotyrosine kinase siRNA
tgtgcagaggaattatgatcttt

SEQ ID NO: 5320 - DNA, 23 bp, Artificial Sequence
  epidermal growth factor receptor (EGFR), ERBB1 phosphotyrosine kinase siRNA
gtgcagaggaattatgatctttc

SEQ ID NO: 5321 - DNA, 23 bp, Artificial Sequence
  epidermal growth factor receptor (EGFR), ERBB1 phosphotyrosine kinase siRNA
tgcagaggaattatgatctttcc

SEQ ID NO: 5322 - DNA, 23 bp, Artificial Sequence
  epidermal growth factor receptor (EGFR), ERBB1 phosphotyrosine kinase siRNA
gcagaggaattatgatctttcct

SEQ ID NO: 5323 - DNA, 23 bp, Artificial Sequence
  epidermal growth factor receptor (EGFR), ERBB1 phosphotyrosine kinase siRNA
cagaggaattatgatctttcctt

SEQ ID NO: 5324 - DNA, 23 bp, Artificial Sequence
  epidermal growth factor receptor (EGFR), ERBB1 phosphotyrosine kinase siRNA
agaggaattatgatctttccttc

SEQ ID NO: 5325 - DNA, 23 bp, Artificial Sequence
  epidermal growth factor receptor (EGFR), ERBB1 phosphotyrosine kinase siRNA
gaggaattatgatctttccttct

SEQ ID NO: 5326 - DNA, 23 bp, Artificial Sequence
  epidermal growth factor receptor (EGFR), ERBB1 phosphotyrosine kinase siRNA
aggaattatgatctttccttctt

SEQ ID NO: 5327 - DNA, 23 bp, Artificial Sequence
  epidermal growth factor receptor (EGFR), ERBB1 phosphotyrosine kinase siRNA
ggaattatgatctttccttctta

SEQ ID NO: 5328 - DNA, 23 bp, Artificial Sequence
  epidermal growth factor receptor (EGFR), ERBB1 phosphotyrosine kinase siRNA
gaattatgatctttccttcttaa

SEQ ID NO: 5329 - DNA, 23 bp, Artificial Sequence
  epidermal growth factor receptor (EGFR), ERBB1 phosphotyrosine kinase siRNA
aattatgatctttccttcttaaa

SEQ ID NO: 5330 - DNA, 23 bp, Artificial Sequence
  epidermal growth factor receptor (EGFR), ERBB1 phosphotyrosine kinase siRNA
attatgatctttccttcttaaag

SEQ ID NO: 5331 - DNA, 23 bp, Artificial Sequence
  epidermal growth factor receptor (EGFR), ERBB1 phosphotyrosine kinase siRNA
ttatgatctttccttcttaaaga

SEQ ID NO: 5332 - DNA, 23 bp, Artificial Sequence
  epidermal growth factor receptor (EGFR), ERBB1 phosphotyrosine kinase siRNA
tatgatctttccttcttaaagac

SEQ ID NO: 5333 - DNA, 23 bp, Artificial Sequence
  epidermal growth factor receptor (EGFR), ERBB1 phosphotyrosine kinase siRNA
atgatctttccttcttaaagacc

SEQ ID NO: 5334 - DNA, 23 bp, Artificial Sequence
  epidermal growth factor receptor (EGFR), ERBB1 phosphotyrosine kinase siRNA
tgatctttccttcttaaagacca

SEQ ID NO: 5335 - DNA, 23 bp, Artificial Sequence
  epidermal growth factor receptor (EGFR), ERBB1 phosphotyrosine kinase siRNA
gatctttccttcttaaagaccat

SEQ ID NO: 5336 - DNA, 23 bp, Artificial Sequence
  epidermal growth factor receptor (EGFR), ERBB1 phosphotyrosine kinase siRNA
atctttccttcttaaagaccatc

SEQ ID NO: 5337 - DNA, 23 bp, Artificial Sequence
  epidermal growth factor receptor (EGFR), ERBB1 phosphotyrosine kinase siRNA
tctttccttcttaaagaccatcc

SEQ ID NO: 5338 - DNA, 23 bp, Artificial Sequence
  epidermal growth factor receptor (EGFR), ERBB1 phosphotyrosine kinase siRNA
ctttccttcttaaagaccatcca

SEQ ID NO: 5339 - DNA, 23 bp, Artificial Sequence
  epidermal growth factor receptor (EGFR), ERBB1 phosphotyrosine kinase siRNA
tttccttcttaaagaccatccag

SEQ ID NO: 5340 - DNA, 23 bp, Artificial Sequence
  epidermal growth factor receptor (EGFR), ERBB1 phosphotyrosine kinase siRNA
ttccttcttaaagaccatccagg

SEQ ID NO: 5341 - DNA, 23 bp, Artificial Sequence
  epidermal growth factor receptor (EGFR), ERBB1 phosphotyrosine kinase siRNA
tccttcttaaagaccatccagga

SEQ ID NO: 5342 - DNA, 23 bp, Artificial Sequence
  epidermal growth factor receptor (EGFR), ERBB1 phosphotyrosine kinase siRNA
ccttcttaaagaccatccaggag

SEQ ID NO: 5343 - DNA, 23 bp, Artificial Sequence
  epidermal growth factor receptor (EGFR), ERBB1 phosphotyrosine kinase siRNA
cttcttaaagaccatccaggagg

SEQ ID NO: 5344 - DNA, 23 bp, Artificial Sequence
  epidermal growth factor receptor (EGFR), ERBB1 phosphotyrosine kinase siRNA
ttcttaaagaccatccaggaggt

SEQ ID NO: 5345 - DNA, 23 bp, Artificial Sequence
  epidermal growth factor receptor (EGFR), ERBB1 phosphotyrosine kinase siRNA
tcttaaagaccatccaggaggtg

SEQ ID NO: 5346 - DNA, 23 bp, Artificial Sequence
  epidermal growth factor receptor (EGFR), ERBB1 phosphotyrosine kinase siRNA
cttaaagaccatccaggaggtgg

SEQ ID NO: 5347 - DNA, 23 bp, Artificial Sequence
  epidermal growth factor receptor (EGFR), ERBB1 phosphotyrosine kinase siRNA
ttaaagaccatccaggaggtggc

SEQ ID NO: 5348 - DNA, 23 bp, Artificial Sequence
  epidermal growth factor receptor (EGFR), ERBB1 phosphotyrosine kinase siRNA
taaagaccatccaggaggtggct

SEQ ID NO: 5349 - DNA, 23 bp, Artificial Sequence
  epidermal growth factor receptor (EGFR), ERBB1 phosphotyrosine kinase siRNA
aaagaccatccaggaggtggctg

SEQ ID NO: 5350 - DNA, 23 bp, Artificial Sequence
  epidermal growth factor receptor (EGFR), ERBB1 phosphotyrosine kinase siRNA
aagaccatccaggaggtggctgg

SEQ ID NO: 5351 - DNA, 23 bp, Artificial Sequence
  epidermal growth factor receptor (EGFR), ERBB1 phosphotyrosine kinase siRNA
agaccatccaggaggtggctggt

SEQ ID NO: 5352 - DNA, 23 bp, Artificial Sequence
  epidermal growth factor receptor (EGFR), ERBB1 phosphotyrosine kinase siRNA
gaccatccaggaggtggctggtt

SEQ ID NO: 5353 - DNA, 23 bp, Artificial Sequence
  epidermal growth factor receptor (EGFR), ERBB1 phosphotyrosine kinase siRNA
accatccaggaggtggctggtta

SEQ ID NO: 5354 - DNA, 23 bp, Artificial Sequence
  epidermal growth factor receptor (EGFR), ERBB1 phosphotyrosine kinase siRNA
ccatccaggaggtggctggttat

SEQ ID NO: 5355 - DNA, 23 bp, Artificial Sequence
  epidermal growth factor receptor (EGFR), ERBB1 phosphotyrosine kinase siRNA
catccaggaggtggctggttatg

SEQ ID NO: 5356 - DNA, 23 bp, Artificial Sequence
  epidermal growth factor receptor (EGFR), ERBB1 phosphotyrosine kinase siRNA
atccaggaggtggctggttatgt

SEQ ID NO: 5357 - DNA, 23 bp, Artificial Sequence
  epidermal growth factor receptor (EGFR), ERBB1 phosphotyrosine kinase siRNA
tccaggaggtggctggttatgtc

SEQ ID NO: 5358 - DNA, 23 bp, Artificial Sequence
  epidermal growth factor receptor (EGFR), ERBB1 phosphotyrosine kinase siRNA
ccaggaggtggctggttatgtcc

SEQ ID NO: 5359 - DNA, 23 bp, Artificial Sequence
  epidermal growth factor receptor (EGFR), ERBB1 phosphotyrosine kinase siRNA
caggaggtggctggttatgtcct

SEQ ID NO: 5360 - DNA, 23 bp, Artificial Sequence
  epidermal growth factor receptor (EGFR), ERBB1 phosphotyrosine kinase siRNA
aggaggtggctggttatgtcctc

SEQ ID NO: 5361 - DNA, 23 bp, Artificial Sequence
  epidermal growth factor receptor (EGFR), ERBB1 phosphotyrosine kinase siRNA
ggaggtggctggttatgtcctca

SEQ ID NO: 5362 - DNA, 23 bp, Artificial Sequence
  epidermal growth factor receptor (EGFR), ERBB1 phosphotyrosine kinase siRNA
gaggtggctggttatgtcctcat

SEQ ID NO: 5363 - DNA, 23 bp, Artificial Sequence
  epidermal growth factor receptor (EGFR), ERBB1 phosphotyrosine kinase siRNA
aggtggctggttatgtcctcatt

SEQ ID NO: 5364 - DNA, 23 bp, Artificial Sequence
  epidermal growth factor receptor (EGFR), ERBB1 phosphotyrosine kinase siRNA
ggtggctggttatgtcctcattg

SEQ ID NO: 5365 - DNA, 23 bp, Artificial Sequence
  epidermal growth factor receptor (EGFR), ERBB1 phosphotyrosine kinase siRNA
gtggctggttatgtcctcattgc

SEQ ID NO: 5366 - DNA, 23 bp, Artificial Sequence
  epidermal growth factor receptor (EGFR), ERBB1 phosphotyrosine kinase siRNA
tggctggttatgtcctcattgcc

SEQ ID NO: 5367 - DNA, 23 bp, Artificial Sequence
  epidermal growth factor receptor (EGFR), ERBB1 phosphotyrosine kinase siRNA
ggctggttatgtcctcattgccc

SEQ ID NO: 5368 - DNA, 23 bp, Artificial Sequence
  epidermal growth factor receptor (EGFR), ERBB1 phosphotyrosine kinase siRNA
gctggttatgtcctcattgccct

SEQ ID NO: 5369 - DNA, 23 bp, Artificial Sequence
  epidermal growth factor receptor (EGFR), ERBB1 phosphotyrosine kinase siRNA
ctggttatgtcctcattgccctc

SEQ ID NO: 5370 - DNA, 23 bp, Artificial Sequence
  epidermal growth factor receptor (EGFR), ERBB1 phosphotyrosine kinase siRNA
tggttatgtcctcattgccctca

SEQ ID NO: 5371 - DNA, 23 bp, Artificial Sequence
  epidermal growth factor receptor (EGFR), ERBB1 phosphotyrosine kinase siRNA
ggttatgtcctcattgccctcaa

SEQ ID NO: 5372 - DNA, 23 bp, Artificial Sequence
  epidermal growth factor receptor (EGFR), ERBB1 phosphotyrosine kinase siRNA
gttatgtcctcattgccctcaac

SEQ ID NO: 5373 - DNA, 23 bp, Artificial Sequence
  epidermal growth factor receptor (EGFR), ERBB1 phosphotyrosine kinase siRNA
ttatgtcctcattgccctcaaca

SEQ ID NO: 5374 - DNA, 23 bp, Artificial Sequence
  epidermal growth factor receptor (EGFR), ERBB1 phosphotyrosine kinase siRNA
tatgtcctcattgccctcaacac

SEQ ID NO: 5375 - DNA, 23 bp, Artificial Sequence
  epidermal growth factor receptor (EGFR), ERBB1 phosphotyrosine kinase siRNA
atgtcctcattgccctcaacaca

SEQ ID NO: 5376 - DNA, 23 bp, Artificial Sequence
  epidermal growth factor receptor (EGFR), ERBB1 phosphotyrosine kinase siRNA
tgtcctcattgccctcaacacag

SEQ ID NO: 5377 - DNA, 23 bp, Artificial Sequence
  epidermal growth factor receptor (EGFR), ERBB1 phosphotyrosine kinase siRNA
gtcctcattgccctcaacacagt

SEQ ID NO: 5378 - DNA, 23 bp, Artificial Sequence
  epidermal growth factor receptor (EGFR), ERBB1 phosphotyrosine kinase siRNA
tcctcattgccctcaacacagtg

SEQ ID NO: 5379 - DNA, 23 bp, Artificial Sequence
  epidermal growth factor receptor (EGFR), ERBB1 phosphotyrosine kinase siRNA
cctcattgccctcaacacagtgg

SEQ ID NO: 5380 - DNA, 23 bp, Artificial Sequence
  epidermal growth factor receptor (EGFR), ERBB1 phosphotyrosine kinase siRNA
ctcattgccctcaacacagtgga

SEQ ID NO: 5381 - DNA, 23 bp, Artificial Sequence
  epidermal growth factor receptor (EGFR), ERBB1 phosphotyrosine kinase siRNA
tcattgccctcaacacagtggag

SEQ ID NO: 5382 - DNA, 23 bp, Artificial Sequence
  epidermal growth factor receptor (EGFR), ERBB1 phosphotyrosine kinase siRNA
cattgccctcaacacagtggagc

SEQ ID NO: 5383 - DNA, 23 bp, Artificial Sequence
  epidermal growth factor receptor (EGFR), ERBB1 phosphotyrosine kinase siRNA
attgccctcaacacagtggagcg

SEQ ID NO: 5384 - DNA, 23 bp, Artificial Sequence
  epidermal growth factor receptor (EGFR), ERBB1 phosphotyrosine kinase siRNA
ttgccctcaacacagtggagcga

SEQ ID NO: 5385 - DNA, 23 bp, Artificial Sequence
  epidermal growth factor receptor (EGFR), ERBB1 phosphotyrosine kinase siRNA
tgccctcaacacagtggagcgaa

SEQ ID NO: 5386 - DNA, 23 bp, Artificial Sequence
  epidermal growth factor receptor (EGFR), ERBB1 phosphotyrosine kinase siRNA
gccctcaacacagtggagcgaat

SEQ ID NO: 5387 - DNA, 23 bp, Artificial Sequence
  epidermal growth factor receptor (EGFR), ERBB1 phosphotyrosine kinase siRNA
ccctcaacacagtggagcgaatt

SEQ ID NO: 5388 - DNA, 23 bp, Artificial Sequence
  epidermal growth factor receptor (EGFR), ERBB1 phosphotyrosine kinase siRNA
cctcaacacagtggagcgaattc

SEQ ID NO: 5389 - DNA, 23 bp, Artificial Sequence
  epidermal growth factor receptor (EGFR), ERBB1 phosphotyrosine kinase siRNA
ctcaacacagtggagcgaattcc

SEQ ID NO: 5390 - DNA, 23 bp, Artificial Sequence
  epidermal growth factor receptor (EGFR), ERBB1 phosphotyrosine kinase siRNA
tcaacacagtggagcgaattcct

SEQ ID NO: 5391 - DNA, 23 bp, Artificial Sequence
  epidermal growth factor receptor (EGFR), ERBB1 phosphotyrosine kinase siRNA
caacacagtggagcgaattcctt

SEQ ID NO: 5392 - DNA, 23 bp, Artificial Sequence
  epidermal growth factor receptor (EGFR), ERBB1 phosphotyrosine kinase siRNA
aacacagtggagcgaattccttt

SEQ ID NO: 5393 - DNA, 23 bp, Artificial Sequence
  epidermal growth factor receptor (EGFR), ERBB1 phosphotyrosine kinase siRNA
acacagtggagcgaattcctttg

SEQ ID NO: 5394 - DNA, 23 bp, Artificial Sequence
  epidermal growth factor receptor (EGFR), ERBB1 phosphotyrosine kinase siRNA
cacagtggagcgaattcctttgg

SEQ ID NO: 5395 - DNA, 23 bp, Artificial Sequence
  epidermal growth factor receptor (EGFR), ERBB1 phosphotyrosine kinase siRNA
acagtggagcgaattcctttgga

SEQ ID NO: 5396 - DNA, 23 bp, Artificial Sequence
  epidermal growth factor receptor (EGFR), ERBB1 phosphotyrosine kinase siRNA
cagtggagcgaattcctttggaa

SEQ ID NO: 5397 - DNA, 23 bp, Artificial Sequence
  epidermal growth factor receptor (EGFR), ERBB1 phosphotyrosine kinase siRNA
agtggagcgaattcctttggaaa

SEQ ID NO: 5398 - DNA, 23 bp, Artificial Sequence
  epidermal growth factor receptor (EGFR), ERBB1 phosphotyrosine kinase siRNA
gtggagcgaattcctttggaaaa

SEQ ID NO: 5399 - DNA, 23 bp, Artificial Sequence
  epidermal growth factor receptor (EGFR), ERBB1 phosphotyrosine kinase siRNA
tggagcgaattcctttggaaaac

SEQ ID NO: 5400 - DNA, 23 bp, Artificial Sequence
  epidermal growth factor receptor (EGFR), ERBB1 phosphotyrosine kinase siRNA
ggagcgaattcctttggaaaacc

SEQ ID NO: 5401 - DNA, 23 bp, Artificial Sequence
  epidermal growth factor receptor (EGFR), ERBB1 phosphotyrosine kinase siRNA
gagcgaattcctttggaaaacct

SEQ ID NO: 5402 - DNA, 23 bp, Artificial Sequence
  epidermal growth factor receptor (EGFR), ERBB1 phosphotyrosine kinase siRNA
agcgaattcctttggaaaacctg

SEQ ID NO: 5403 - DNA, 23 bp, Artificial Sequence
  epidermal growth factor receptor (EGFR), ERBB1 phosphotyrosine kinase siRNA
gcgaattcctttggaaaacctgc

SEQ ID NO: 5404 - DNA, 23 bp, Artificial Sequence
  epidermal growth factor receptor (EGFR), ERBB1 phosphotyrosine kinase siRNA
cgaattcctttggaaaacctgca

SEQ ID NO: 5405 - DNA, 23 bp, Artificial Sequence
  epidermal growth factor receptor (EGFR), ERBB1 phosphotyrosine kinase siRNA
gaattcctttggaaaacctgcag

SEQ ID NO: 5406 - DNA, 23 bp, Artificial Sequence
  epidermal growth factor receptor (EGFR), ERBB1 phosphotyrosine kinase siRNA
aattcctttggaaaacctgcaga

SEQ ID NO: 5407 - DNA, 23 bp, Artificial Sequence
  epidermal growth factor receptor (EGFR), ERBB1 phosphotyrosine kinase siRNA
attcctttggaaaacctgcagat

SEQ ID NO: 5408 - DNA, 23 bp, Artificial Sequence
  epidermal growth factor receptor (EGFR), ERBB1 phosphotyrosine kinase siRNA
ttcctttggaaaacctgcagatc

SEQ ID NO: 5409 - DNA, 23 bp, Artificial Sequence
  epidermal growth factor receptor (EGFR), ERBB1 phosphotyrosine kinase siRNA
tcctttggaaaacctgcagatca

SEQ ID NO: 5410 - DNA, 23 bp, Artificial Sequence
  epidermal growth factor receptor (EGFR), ERBB1 phosphotyrosine kinase siRNA
cctttggaaaacctgcagatcat

SEQ ID NO: 5411 - DNA, 23 bp, Artificial Sequence
  epidermal growth factor receptor (EGFR), ERBB1 phosphotyrosine kinase siRNA
ctttggaaaacctgcagatcatc

SEQ ID NO: 5412 - DNA, 23 bp, Artificial Sequence
  epidermal growth factor receptor (EGFR), ERBB1 phosphotyrosine kinase siRNA
tttggaaaacctgcagatcatca

SEQ ID NO: 5413 - DNA, 23 bp, Artificial Sequence
  epidermal growth factor receptor (EGFR), ERBB1 phosphotyrosine kinase siRNA
ttggaaaacctgcagatcatcag

SEQ ID NO: 5414 - DNA, 23 bp, Artificial Sequence
  epidermal growth factor receptor (EGFR), ERBB1 phosphotyrosine kinase siRNA
tggaaaacctgcagatcatcaga

SEQ ID NO: 5415 - DNA, 23 bp, Artificial Sequence
  epidermal growth factor receptor (EGFR), ERBB1 phosphotyrosine kinase siRNA
ggaaaacctgcagatcatcagag

SEQ ID NO: 5416 - DNA, 23 bp, Artificial Sequence
  epidermal growth factor receptor (EGFR), ERBB1 phosphotyrosine kinase siRNA
gaaaacctgcagatcatcagagg

SEQ ID NO: 5417 - DNA, 23 bp, Artificial Sequence
  epidermal growth factor receptor (EGFR), ERBB1 phosphotyrosine kinase siRNA
aaaacctgcagatcatcagagga

SEQ ID NO: 5418 - DNA, 23 bp, Artificial Sequence
  epidermal growth factor receptor (EGFR), ERBB1 phosphotyrosine kinase siRNA
aaacctgcagatcatcagaggaa

SEQ ID NO: 5419 - DNA, 23 bp, Artificial Sequence
  epidermal growth factor receptor (EGFR), ERBB1 phosphotyrosine kinase siRNA
aacctgcagatcatcagaggaaa

SEQ ID NO: 5420 - DNA, 23 bp, Artificial Sequence
  epidermal growth factor receptor (EGFR), ERBB1 phosphotyrosine kinase siRNA
acctgcagatcatcagaggaaat

SEQ ID NO: 5421 - DNA, 23 bp, Artificial Sequence
  epidermal growth factor receptor (EGFR), ERBB1 phosphotyrosine kinase siRNA
cctgcagatcatcagaggaaata

SEQ ID NO: 5422 - DNA, 23 bp, Artificial Sequence
  epidermal growth factor receptor (EGFR), ERBB1 phosphotyrosine kinase siRNA
ctgcagatcatcagaggaaatat

SEQ ID NO: 5423 - DNA, 23 bp, Artificial Sequence
  epidermal growth factor receptor (EGFR), ERBB1 phosphotyrosine kinase siRNA
tgcagatcatcagaggaaatatg

SEQ ID NO: 5424 - DNA, 23 bp, Artificial Sequence
  epidermal growth factor receptor (EGFR), ERBB1 phosphotyrosine kinase siRNA
gcagatcatcagaggaaatatgt

SEQ ID NO: 5425 - DNA, 23 bp, Artificial Sequence
  epidermal growth factor receptor (EGFR), ERBB1 phosphotyrosine kinase siRNA
cagatcatcagaggaaatatgta

SEQ ID NO: 5426 - DNA, 23 bp, Artificial Sequence
  epidermal growth factor receptor (EGFR), ERBB1 phosphotyrosine kinase siRNA
agatcatcagaggaaatatgtac

SEQ ID NO: 5427 - DNA, 23 bp, Artificial Sequence
  epidermal growth factor receptor (EGFR), ERBB1 phosphotyrosine kinase siRNA
gatcatcagaggaaatatgtact

SEQ ID NO: 5428 - DNA, 23 bp, Artificial Sequence
  epidermal growth factor receptor (EGFR), ERBB1 phosphotyrosine kinase siRNA
atcatcagaggaaatatgtacta

SEQ ID NO: 5429 - DNA, 23 bp, Artificial Sequence
  epidermal growth factor receptor (EGFR), ERBB1 phosphotyrosine kinase siRNA
tcatcagaggaaatatgtactac

SEQ ID NO: 5430 - DNA, 23 bp, Artificial Sequence
  epidermal growth factor receptor (EGFR), ERBB1 phosphotyrosine kinase siRNA
catcagaggaaatatgtactacg

SEQ ID NO: 5431 - DNA, 23 bp, Artificial Sequence
  epidermal growth factor receptor (EGFR), ERBB1 phosphotyrosine kinase siRNA
atcagaggaaatatgtactacga

SEQ ID NO: 5432 - DNA, 23 bp, Artificial Sequence
  epidermal growth factor receptor (EGFR), ERBB1 phosphotyrosine kinase siRNA
tcagaggaaatatgtactacgaa

SEQ ID NO: 5433 - DNA, 23 bp, Artificial Sequence
  epidermal growth factor receptor (EGFR), ERBB1 phosphotyrosine kinase siRNA
cagaggaaatatgtactacgaaa

SEQ ID NO: 5434 - DNA, 23 bp, Artificial Sequence
  epidermal growth factor receptor (EGFR), ERBB1 phosphotyrosine kinase siRNA
agaggaaatatgtactacgaaaa

SEQ ID NO: 5435 - DNA, 23 bp, Artificial Sequence
  epidermal growth factor receptor (EGFR), ERBB1 phosphotyrosine kinase siRNA
gaggaaatatgtactacgaaaat

SEQ ID NO: 5436 - DNA, 23 bp, Artificial Sequence
  epidermal growth factor receptor (EGFR), ERBB1 phosphotyrosine kinase siRNA
aggaaatatgtactacgaaaatt

SEQ ID NO: 5437 - DNA, 23 bp, Artificial Sequence
  epidermal growth factor receptor (EGFR), ERBB1 phosphotyrosine kinase siRNA
ggaaatatgtactacgaaaattc

SEQ ID NO: 5438 - DNA, 23 bp, Artificial Sequence
  epidermal growth factor receptor (EGFR), ERBB1 phosphotyrosine kinase siRNA
gaaatatgtactacgaaaattcc

SEQ ID NO: 5439 - DNA, 23 bp, Artificial Sequence
  epidermal growth factor receptor (EGFR), ERBB1 phosphotyrosine kinase siRNA
aaatatgtactacgaaaattcct

SEQ ID NO: 5440 - DNA, 23 bp, Artificial Sequence
  epidermal growth factor receptor (EGFR), ERBB1 phosphotyrosine kinase siRNA
aatatgtactacgaaaattccta

SEQ ID NO: 5441 - DNA, 23 bp, Artificial Sequence
  epidermal growth factor receptor (EGFR), ERBB1 phosphotyrosine kinase siRNA
atatgtactacgaaaattcctat

SEQ ID NO: 5442 - DNA, 23 bp, Artificial Sequence
  epidermal growth factor receptor (EGFR), ERBB1 phosphotyrosine kinase siRNA
tatgtactacgaaaattcctatg

SEQ ID NO: 5443 - DNA, 23 bp, Artificial Sequence
  epidermal growth factor receptor (EGFR), ERBB1 phosphotyrosine kinase siRNA
atgtactacgaaaattcctatgc

SEQ ID NO: 5444 - DNA, 23 bp, Artificial Sequence
  epidermal growth factor receptor (EGFR), ERBB1 phosphotyrosine kinase siRNA
tgtactacgaaaattcctatgcc

SEQ ID NO: 5445 - DNA, 23 bp, Artificial Sequence
  epidermal growth factor receptor (EGFR), ERBB1 phosphotyrosine kinase siRNA
gtactacgaaaattcctatgcct

SEQ ID NO: 5446 - DNA, 23 bp, Artificial Sequence
  epidermal growth factor receptor (EGFR), ERBB1 phosphotyrosine kinase siRNA
tactacgaaaattcctatgcctt

SEQ ID NO: 5447 - DNA, 23 bp, Artificial Sequence
  epidermal growth factor receptor (EGFR), ERBB1 phosphotyrosine kinase siRNA
actacgaaaattcctatgcctta

SEQ ID NO: 5448 - DNA, 23 bp, Artificial Sequence
  epidermal growth factor receptor (EGFR), ERBB1 phosphotyrosine kinase siRNA
ctacgaaaattcctatgccttag

SEQ ID NO: 5449 - DNA, 23 bp, Artificial Sequence
  epidermal growth factor receptor (EGFR), ERBB1 phosphotyrosine kinase siRNA
tacgaaaattcctatgccttagc

SEQ ID NO: 5450 - DNA, 23 bp, Artificial Sequence
  epidermal growth factor receptor (EGFR), ERBB1 phosphotyrosine kinase siRNA
acgaaaattcctatgccttagca

SEQ ID NO: 5451 - DNA, 23 bp, Artificial Sequence
  epidermal growth factor receptor (EGFR), ERBB1 phosphotyrosine kinase siRNA
cgaaaattcctatgccttagcag

SEQ ID NO: 5452 - DNA, 23 bp, Artificial Sequence
  epidermal growth factor receptor (EGFR), ERBB1 phosphotyrosine kinase siRNA
gaaaattcctatgccttagcagt

SEQ ID NO: 5453 - DNA, 23 bp, Artificial Sequence
  epidermal growth factor receptor (EGFR), ERBB1 phosphotyrosine kinase siRNA
aaaattcctatgccttagcagtc

SEQ ID NO: 5454 - DNA, 23 bp, Artificial Sequence
  epidermal growth factor receptor (EGFR), ERBB1 phosphotyrosine kinase siRNA
aaattcctatgccttagcagtct

SEQ ID NO: 5455 - DNA, 23 bp, Artificial Sequence
  epidermal growth factor receptor (EGFR), ERBB1 phosphotyrosine kinase siRNA
aattcctatgccttagcagtctt

SEQ ID NO: 5456 - DNA, 23 bp, Artificial Sequence
  epidermal growth factor receptor (EGFR), ERBB1 phosphotyrosine kinase siRNA
attcctatgccttagcagtctta

SEQ ID NO: 5457 - DNA, 23 bp, Artificial Sequence
  epidermal growth factor receptor (EGFR), ERBB1 phosphotyrosine kinase siRNA
ttcctatgccttagcagtcttat

SEQ ID NO: 5458 - DNA, 23 bp, Artificial Sequence
  epidermal growth factor receptor (EGFR), ERBB1 phosphotyrosine kinase siRNA
tcctatgccttagcagtcttatc

SEQ ID NO: 5459 - DNA, 23 bp, Artificial Sequence
  epidermal growth factor receptor (EGFR), ERBB1 phosphotyrosine kinase siRNA
cctatgccttagcagtcttatct

SEQ ID NO: 5460 - DNA, 23 bp, Artificial Sequence
  epidermal growth factor receptor (EGFR), ERBB1 phosphotyrosine kinase siRNA
ctatgccttagcagtcttatcta

SEQ ID NO: 5461 - DNA, 23 bp, Artificial Sequence
  epidermal growth factor receptor (EGFR), ERBB1 phosphotyrosine kinase siRNA
tatgccttagcagtcttatctaa

SEQ ID NO: 5462 - DNA, 23 bp, Artificial Sequence
  epidermal growth factor receptor (EGFR), ERBB1 phosphotyrosine kinase siRNA
atgccttagcagtcttatctaac

SEQ ID NO: 5463 - DNA, 23 bp, Artificial Sequence
  epidermal growth factor receptor (EGFR), ERBB1 phosphotyrosine kinase siRNA
tgccttagcagtcttatctaact

SEQ ID NO: 5464 - DNA, 23 bp, Artificial Sequence
  epidermal growth factor receptor (EGFR), ERBB1 phosphotyrosine kinase siRNA
gccttagcagtcttatctaacta

SEQ ID NO: 5465 - DNA, 23 bp, Artificial Sequence
  epidermal growth factor receptor (EGFR), ERBB1 phosphotyrosine kinase siRNA
ccttagcagtcttatctaactat

SEQ ID NO: 5466 - DNA, 23 bp, Artificial Sequence
  epidermal growth factor receptor (EGFR), ERBB1 phosphotyrosine kinase siRNA
cttagcagtcttatctaactatg

SEQ ID NO: 5467 - DNA, 23 bp, Artificial Sequence
  epidermal growth factor receptor (EGFR), ERBB1 phosphotyrosine kinase siRNA
ttagcagtcttatctaactatga

SEQ ID NO: 5468 - DNA, 23 bp, Artificial Sequence
  epidermal growth factor receptor (EGFR), ERBB1 phosphotyrosine kinase siRNA
tagcagtcttatctaactatgat

SEQ ID NO: 5469 - DNA, 23 bp, Artificial Sequence
  epidermal growth factor receptor (EGFR), ERBB1 phosphotyrosine kinase siRNA
agcagtcttatctaactatgatg

SEQ ID NO: 5470 - DNA, 23 bp, Artificial Sequence
  epidermal growth factor receptor (EGFR), ERBB1 phosphotyrosine kinase siRNA
gcagtcttatctaactatgatgc

SEQ ID NO: 5471 - DNA, 23 bp, Artificial Sequence
  epidermal growth factor receptor (EGFR), ERBB1 phosphotyrosine kinase siRNA
cagtcttatctaactatgatgca

SEQ ID NO: 5472 - DNA, 23 bp, Artificial Sequence
  epidermal growth factor receptor (EGFR), ERBB1 phosphotyrosine kinase siRNA
agtcttatctaactatgatgcaa

SEQ ID NO: 5473 - DNA, 23 bp, Artificial Sequence
  epidermal growth factor receptor (EGFR), ERBB1 phosphotyrosine kinase siRNA
gtcttatctaactatgatgcaaa

SEQ ID NO: 5474 - DNA, 23 bp, Artificial Sequence
  epidermal growth factor receptor (EGFR), ERBB1 phosphotyrosine kinase siRNA
tcttatctaactatgatgcaaat

SEQ ID NO: 5475 - DNA, 23 bp, Artificial Sequence
  epidermal growth factor receptor (EGFR), ERBB1 phosphotyrosine kinase siRNA
cttatctaactatgatgcaaata

SEQ ID NO: 5476 - DNA, 23 bp, Artificial Sequence
  epidermal growth factor receptor (EGFR), ERBB1 phosphotyrosine kinase siRNA
ttatctaactatgatgcaaataa

SEQ ID NO: 5477 - DNA, 23 bp, Artificial Sequence
  epidermal growth factor receptor (EGFR), ERBB1 phosphotyrosine kinase siRNA
tatctaactatgatgcaaataaa

SEQ ID NO: 5478 - DNA, 23 bp, Artificial Sequence
  epidermal growth factor receptor (EGFR), ERBB1 phosphotyrosine kinase siRNA
atctaactatgatgcaaataaaa

SEQ ID NO: 5479 - DNA, 23 bp, Artificial Sequence
  epidermal growth factor receptor (EGFR), ERBB1 phosphotyrosine kinase siRNA
tctaactatgatgcaaataaaac

SEQ ID NO: 5480 - DNA, 23 bp, Artificial Sequence
  epidermal growth factor receptor (EGFR), ERBB1 phosphotyrosine kinase siRNA
ctaactatgatgcaaataaaacc

SEQ ID NO: 5481 - DNA, 23 bp, Artificial Sequence
  epidermal growth factor receptor (EGFR), ERBB1 phosphotyrosine kinase siRNA
taactatgatgcaaataaaaccg

SEQ ID NO: 5482 - DNA, 23 bp, Artificial Sequence
  epidermal growth factor receptor (EGFR), ERBB1 phosphotyrosine kinase siRNA
aactatgatgcaaataaaaccgg

SEQ ID NO: 5483 - DNA, 23 bp, Artificial Sequence
  epidermal growth factor receptor (EGFR), ERBB1 phosphotyrosine kinase siRNA
actatgatgcaaataaaaccgga

SEQ ID NO: 5484 - DNA, 23 bp, Artificial Sequence
  epidermal growth factor receptor (EGFR), ERBB1 phosphotyrosine kinase siRNA
ctatgatgcaaataaaaccggac

SEQ ID NO: 5485 - DNA, 23 bp, Artificial Sequence
  epidermal growth factor receptor (EGFR), ERBB1 phosphotyrosine kinase siRNA
tatgatgcaaataaaaccggact

SEQ ID NO: 5486 - DNA, 23 bp, Artificial Sequence
  epidermal growth factor receptor (EGFR), ERBB1 phosphotyrosine kinase siRNA
atgatgcaaataaaaccggactg

SEQ ID NO: 5487 - DNA, 23 bp, Artificial Sequence
  epidermal growth factor receptor (EGFR), ERBB1 phosphotyrosine kinase siRNA
tgatgcaaataaaaccggactga

SEQ ID NO: 5488 - DNA, 23 bp, Artificial Sequence
  epidermal growth factor receptor (EGFR), ERBB1 phosphotyrosine kinase siRNA
gatgcaaataaaaccggactgaa

SEQ ID NO: 5489 - DNA, 23 bp, Artificial Sequence
  epidermal growth factor receptor (EGFR), ERBB1 phosphotyrosine kinase siRNA
atgcaaataaaaccggactgaag

SEQ ID NO: 5490 - DNA, 23 bp, Artificial Sequence
  epidermal growth factor receptor (EGFR), ERBB1 phosphotyrosine kinase siRNA
tgcaaataaaaccggactgaagg

SEQ ID NO: 5491 - DNA, 23 bp, Artificial Sequence
  epidermal growth factor receptor (EGFR), ERBB1 phosphotyrosine kinase siRNA
gcaaataaaaccggactgaagga

SEQ ID NO: 5492 - DNA, 23 bp, Artificial Sequence
  epidermal growth factor receptor (EGFR), ERBB1 phosphotyrosine kinase siRNA
caaataaaaccggactgaaggag

SEQ ID NO: 5493 - DNA, 23 bp, Artificial Sequence
  epidermal growth factor receptor (EGFR), ERBB1 phosphotyrosine kinase siRNA
aaataaaaccggactgaaggagc

SEQ ID NO: 5494 - DNA, 23 bp, Artificial Sequence
  epidermal growth factor receptor (EGFR), ERBB1 phosphotyrosine kinase siRNA
aataaaaccggactgaaggagct

SEQ ID NO: 5495 - DNA, 23 bp, Artificial Sequence
  epidermal growth factor receptor (EGFR), ERBB1 phosphotyrosine kinase siRNA
ataaaaccggactgaaggagctg

SEQ ID NO: 5496 - DNA, 23 bp, Artificial Sequence
  epidermal growth factor receptor (EGFR), ERBB1 phosphotyrosine kinase siRNA
taaaaccggactgaaggagctgc

SEQ ID NO: 5497 - DNA, 23 bp, Artificial Sequence
  epidermal growth factor receptor (EGFR), ERBB1 phosphotyrosine kinase siRNA
aaaaccggactgaaggagctgcc

SEQ ID NO: 5498 - DNA, 23 bp, Artificial Sequence
  epidermal growth factor receptor (EGFR), ERBB1 phosphotyrosine kinase siRNA
aaaccggactgaaggagctgccc

SEQ ID NO: 5499 - DNA, 23 bp, Artificial Sequence
  epidermal growth factor receptor (EGFR), ERBB1 phosphotyrosine kinase siRNA
aaccggactgaaggagctgccca

SEQ ID NO: 5500 - DNA, 23 bp, Artificial Sequence
  epidermal growth factor receptor (EGFR), ERBB1 phosphotyrosine kinase siRNA
accggactgaaggagctgcccat

SEQ ID NO: 5501 - DNA, 23 bp, Artificial Sequence
  epidermal growth factor receptor (EGFR), ERBB1 phosphotyrosine kinase siRNA
ccggactgaaggagctgcccatg

SEQ ID NO: 5502 - DNA, 23 bp, Artificial Sequence
  epidermal growth factor receptor (EGFR), ERBB1 phosphotyrosine kinase siRNA
cggactgaaggagctgcccatga

SEQ ID NO: 5503 - DNA, 23 bp, Artificial Sequence
  epidermal growth factor receptor (EGFR), ERBB1 phosphotyrosine kinase siRNA
ggactgaaggagctgcccatgag

SEQ ID NO: 5504 - DNA, 23 bp, Artificial Sequence
  epidermal growth factor receptor (EGFR), ERBB1 phosphotyrosine kinase siRNA
gactgaaggagctgcccatgaga

SEQ ID NO: 5505 - DNA, 23 bp, Artificial Sequence
  epidermal growth factor receptor (EGFR), ERBB1 phosphotyrosine kinase siRNA
actgaaggagctgcccatgagaa

SEQ ID NO: 5506 - DNA, 23 bp, Artificial Sequence
  epidermal growth factor receptor (EGFR), ERBB1 phosphotyrosine kinase siRNA
ctgaaggagctgcccatgagaaa

SEQ ID NO: 5507 - DNA, 23 bp, Artificial Sequence
  epidermal growth factor receptor (EGFR), ERBB1 phosphotyrosine kinase siRNA
tgaaggagctgcccatgagaaat

SEQ ID NO: 5508 - DNA, 23 bp, Artificial Sequence
  epidermal growth factor receptor (EGFR), ERBB1 phosphotyrosine kinase siRNA
gaaggagctgcccatgagaaatt

SEQ ID NO: 5509 - DNA, 23 bp, Artificial Sequence
  epidermal growth factor receptor (EGFR), ERBB1 phosphotyrosine kinase siRNA
aaggagctgcccatgagaaattt

SEQ ID NO: 5510 - DNA, 23 bp, Artificial Sequence
  epidermal growth factor receptor (EGFR), ERBB1 phosphotyrosine kinase siRNA
aggagctgcccatgagaaattta

SEQ ID NO: 5511 - DNA, 23 bp, Artificial Sequence
  epidermal growth factor receptor (EGFR), ERBB1 phosphotyrosine kinase siRNA
ggagctgcccatgagaaatttac

SEQ ID NO: 5512 - DNA, 23 bp, Artificial Sequence
  epidermal growth factor receptor (EGFR), ERBB1 phosphotyrosine kinase siRNA
gagctgcccatgagaaatttaca

SEQ ID NO: 5513 - DNA, 23 bp, Artificial Sequence
  epidermal growth factor receptor (EGFR), ERBB1 phosphotyrosine kinase siRNA
agctgcccatgagaaatttacag

SEQ ID NO: 5514 - DNA, 23 bp, Artificial Sequence
  epidermal growth factor receptor (EGFR), ERBB1 phosphotyrosine kinase siRNA
gctgcccatgagaaatttacagg

SEQ ID NO: 5515 - DNA, 23 bp, Artificial Sequence
  epidermal growth factor receptor (EGFR), ERBB1 phosphotyrosine kinase siRNA
ctgcccatgagaaatttacagga

SEQ ID NO: 5516 - DNA, 23 bp, Artificial Sequence
  epidermal growth factor receptor (EGFR), ERBB1 phosphotyrosine kinase siRNA
tgcccatgagaaatttacaggaa

SEQ ID NO: 5517 - DNA, 23 bp, Artificial Sequence
  epidermal growth factor receptor (EGFR), ERBB1 phosphotyrosine kinase siRNA
gcccatgagaaatttacaggaaa

SEQ ID NO: 5518 - DNA, 23 bp, Artificial Sequence
  epidermal growth factor receptor (EGFR), ERBB1 phosphotyrosine kinase siRNA
cccatgagaaatttacaggaaat

SEQ ID NO: 5519 - DNA, 23 bp, Artificial Sequence
  epidermal growth factor receptor (EGFR), ERBB1 phosphotyrosine kinase siRNA
ccatgagaaatttacaggaaatc

SEQ ID NO: 5520 - DNA, 23 bp, Artificial Sequence
  epidermal growth factor receptor (EGFR), ERBB1 phosphotyrosine kinase siRNA
catgagaaatttacaggaaatcc

SEQ ID NO: 5521 - DNA, 23 bp, Artificial Sequence
  epidermal growth factor receptor (EGFR), ERBB1 phosphotyrosine kinase siRNA
atgagaaatttacaggaaatcct

SEQ ID NO: 5522 - DNA, 23 bp, Artificial Sequence
  epidermal growth factor receptor (EGFR), ERBB1 phosphotyrosine kinase siRNA
tgagaaatttacaggaaatcctg

SEQ ID NO: 5523 - DNA, 23 bp, Artificial Sequence
  epidermal growth factor receptor (EGFR), ERBB1 phosphotyrosine kinase siRNA
gagaaatttacaggaaatcctgc

SEQ ID NO: 5524 - DNA, 23 bp, Artificial Sequence
  epidermal growth factor receptor (EGFR), ERBB1 phosphotyrosine kinase siRNA
agaaatttacaggaaatcctgca

SEQ ID NO: 5525 - DNA, 23 bp, Artificial Sequence
  epidermal growth factor receptor (EGFR), ERBB1 phosphotyrosine kinase siRNA
gaaatttacaggaaatcctgcat

SEQ ID NO: 5526 - DNA, 23 bp, Artificial Sequence
  epidermal growth factor receptor (EGFR), ERBB1 phosphotyrosine kinase siRNA
aaatttacaggaaatcctgcatg

SEQ ID NO: 5527 - DNA, 23 bp, Artificial Sequence
  epidermal growth factor receptor (EGFR), ERBB1 phosphotyrosine kinase siRNA
aatttacaggaaatcctgcatgg

SEQ ID NO: 5528 - DNA, 23 bp, Artificial Sequence
  epidermal growth factor receptor (EGFR), ERBB1 phosphotyrosine kinase siRNA
atttacaggaaatcctgcatggc

SEQ ID NO: 5529 - DNA, 23 bp, Artificial Sequence
  epidermal growth factor receptor (EGFR), ERBB1 phosphotyrosine kinase siRNA
tttacaggaaatcctgcatggcg

SEQ ID NO: 5530 - DNA, 23 bp, Artificial Sequence
  epidermal growth factor receptor (EGFR), ERBB1 phosphotyrosine kinase siRNA
ttacaggaaatcctgcatggcgc

SEQ ID NO: 5531 - DNA, 23 bp, Artificial Sequence
  epidermal growth factor receptor (EGFR), ERBB1 phosphotyrosine kinase siRNA
tacaggaaatcctgcatggcgcc

SEQ ID NO: 5532 - DNA, 23 bp, Artificial Sequence
  epidermal growth factor receptor (EGFR), ERBB1 phosphotyrosine kinase siRNA
acaggaaatcctgcatggcgccg

SEQ ID NO: 5533 - DNA, 23 bp, Artificial Sequence
  epidermal growth factor receptor (EGFR), ERBB1 phosphotyrosine kinase siRNA
caggaaatcctgcatggcgccgt

SEQ ID NO: 5534 - DNA, 23 bp, Artificial Sequence
  epidermal growth factor receptor (EGFR), ERBB1 phosphotyrosine kinase siRNA
aggaaatcctgcatggcgccgtg

SEQ ID NO: 5535 - DNA, 23 bp, Artificial Sequence
  epidermal growth factor receptor (EGFR), ERBB1 phosphotyrosine kinase siRNA
ggaaatcctgcatggcgccgtgc

SEQ ID NO: 5536 - DNA, 23 bp, Artificial Sequence
  epidermal growth factor receptor (EGFR), ERBB1 phosphotyrosine kinase siRNA
gaaatcctgcatggcgccgtgcg

SEQ ID NO: 5537 - DNA, 23 bp, Artificial Sequence
  epidermal growth factor receptor (EGFR), ERBB1 phosphotyrosine kinase siRNA
aaatcctgcatggcgccgtgcgg

SEQ ID NO: 5538 - DNA, 23 bp, Artificial Sequence
  epidermal growth factor receptor (EGFR), ERBB1 phosphotyrosine kinase siRNA
aatcctgcatggcgccgtgcggt

SEQ ID NO: 5539 - DNA, 23 bp, Artificial Sequence
  epidermal growth factor receptor (EGFR), ERBB1 phosphotyrosine kinase siRNA
atcctgcatggcgccgtgcggtt

SEQ ID NO: 5540 - DNA, 23 bp, Artificial Sequence
  epidermal growth factor receptor (EGFR), ERBB1 phosphotyrosine kinase siRNA
tcctgcatggcgccgtgcggttc

SEQ ID NO: 5541 - DNA, 23 bp, Artificial Sequence
  epidermal growth factor receptor (EGFR), ERBB1 phosphotyrosine kinase siRNA
cctgcatggcgccgtgcggttca

SEQ ID NO: 5542 - DNA, 23 bp, Artificial Sequence
  epidermal growth factor receptor (EGFR), ERBB1 phosphotyrosine kinase siRNA
ctgcatggcgccgtgcggttcag

SEQ ID NO: 5543 - DNA, 23 bp, Artificial Sequence
  epidermal growth factor receptor (EGFR), ERBB1 phosphotyrosine kinase siRNA
tgcatggcgccgtgcggttcagc

SEQ ID NO: 5544 - DNA, 23 bp, Artificial Sequence
  epidermal growth factor receptor (EGFR), ERBB1 phosphotyrosine kinase siRNA
gcatggcgccgtgcggttcagca

SEQ ID NO: 5545 - DNA, 23 bp, Artificial Sequence
  epidermal growth factor receptor (EGFR), ERBB1 phosphotyrosine kinase siRNA
catggcgccgtgcggttcagcaa

SEQ ID NO: 5546 - DNA, 23 bp, Artificial Sequence
  epidermal growth factor receptor (EGFR), ERBB1 phosphotyrosine kinase siRNA
atggcgccgtgcggttcagcaac

SEQ ID NO: 5547 - DNA, 23 bp, Artificial Sequence
  epidermal growth factor receptor (EGFR), ERBB1 phosphotyrosine kinase siRNA
tggcgccgtgcggttcagcaaca

SEQ ID NO: 5548 - DNA, 23 bp, Artificial Sequence
  epidermal growth factor receptor (EGFR), ERBB1 phosphotyrosine kinase siRNA
ggcgccgtgcggttcagcaacaa

SEQ ID NO: 5549 - DNA, 23 bp, Artificial Sequence
  epidermal growth factor receptor (EGFR), ERBB1 phosphotyrosine kinase siRNA
gcgccgtgcggttcagcaacaac

SEQ ID NO: 5550 - DNA, 23 bp, Artificial Sequence
  epidermal growth factor receptor (EGFR), ERBB1 phosphotyrosine kinase siRNA
cgccgtgcggttcagcaacaacc

SEQ ID NO: 5551 - DNA, 23 bp, Artificial Sequence
  epidermal growth factor receptor (EGFR), ERBB1 phosphotyrosine kinase siRNA
gccgtgcggttcagcaacaaccc

SEQ ID NO: 5552 - DNA, 23 bp, Artificial Sequence
  epidermal growth factor receptor (EGFR), ERBB1 phosphotyrosine kinase siRNA
ccgtgcggttcagcaacaaccct

SEQ ID NO: 5553 - DNA, 23 bp, Artificial Sequence
  epidermal growth factor receptor (EGFR), ERBB1 phosphotyrosine kinase siRNA
cgtgcggttcagcaacaaccctg

SEQ ID NO: 5554 - DNA, 23 bp, Artificial Sequence
  epidermal growth factor receptor (EGFR), ERBB1 phosphotyrosine kinase siRNA
gtgcggttcagcaacaaccctgc

SEQ ID NO: 5555 - DNA, 23 bp, Artificial Sequence
  epidermal growth factor receptor (EGFR), ERBB1 phosphotyrosine kinase siRNA
tgcggttcagcaacaaccctgcc

SEQ ID NO: 5556 - DNA, 23 bp, Artificial Sequence
  epidermal growth factor receptor (EGFR), ERBB1 phosphotyrosine kinase siRNA
gcggttcagcaacaaccctgccc

SEQ ID NO: 5557 - DNA, 23 bp, Artificial Sequence
  epidermal growth factor receptor (EGFR), ERBB1 phosphotyrosine kinase siRNA
cggttcagcaacaaccctgccct

SEQ ID NO: 5558 - DNA, 23 bp, Artificial Sequence
  epidermal growth factor receptor (EGFR), ERBB1 phosphotyrosine kinase siRNA
ggttcagcaacaaccctgccctg

SEQ ID NO: 5559 - DNA, 23 bp, Artificial Sequence
  epidermal growth factor receptor (EGFR), ERBB1 phosphotyrosine kinase siRNA
gttcagcaacaaccctgccctgt

SEQ ID NO: 5560 - DNA, 23 bp, Artificial Sequence
  epidermal growth factor receptor (EGFR), ERBB1 phosphotyrosine kinase siRNA
ttcagcaacaaccctgccctgtg

SEQ ID NO: 5561 - DNA, 23 bp, Artificial Sequence
  epidermal growth factor receptor (EGFR), ERBB1 phosphotyrosine kinase siRNA
tcagcaacaaccctgccctgtgc

SEQ ID NO: 5562 - DNA, 23 bp, Artificial Sequence
  epidermal growth factor receptor (EGFR), ERBB1 phosphotyrosine kinase siRNA
cagcaacaaccctgccctgtgca

SEQ ID NO: 5563 - DNA, 23 bp, Artificial Sequence
  epidermal growth factor receptor (EGFR), ERBB1 phosphotyrosine kinase siRNA
agcaacaaccctgccctgtgcaa

SEQ ID NO: 5564 - DNA, 23 bp, Artificial Sequence
  epidermal growth factor receptor (EGFR), ERBB1 phosphotyrosine kinase siRNA
gcaacaaccctgccctgtgcaac

SEQ ID NO: 5565 - DNA, 23 bp, Artificial Sequence
  epidermal growth factor receptor (EGFR), ERBB1 phosphotyrosine kinase siRNA
caacaaccctgccctgtgcaacg

SEQ ID NO: 5566 - DNA, 23 bp, Artificial Sequence
  epidermal growth factor receptor (EGFR), ERBB1 phosphotyrosine kinase siRNA
aacaaccctgccctgtgcaacgt

SEQ ID NO: 5567 - DNA, 23 bp, Artificial Sequence
  epidermal growth factor receptor (EGFR), ERBB1 phosphotyrosine kinase siRNA
acaaccctgccctgtgcaacgtg

SEQ ID NO: 5568 - DNA, 23 bp, Artificial Sequence
  epidermal growth factor receptor (EGFR), ERBB1 phosphotyrosine kinase siRNA
caaccctgccctgtgcaacgtgg

SEQ ID NO: 5569 - DNA, 23 bp, Artificial Sequence
  epidermal growth factor receptor (EGFR), ERBB1 phosphotyrosine kinase siRNA
aaccctgccctgtgcaacgtgga

SEQ ID NO: 5570 - DNA, 23 bp, Artificial Sequence
  epidermal growth factor receptor (EGFR), ERBB1 phosphotyrosine kinase siRNA
accctgccctgtgcaacgtggag

SEQ ID NO: 5571 - DNA, 23 bp, Artificial Sequence
  epidermal growth factor receptor (EGFR), ERBB1 phosphotyrosine kinase siRNA
ccctgccctgtgcaacgtggaga

SEQ ID NO: 5572 - DNA, 23 bp, Artificial Sequence
  epidermal growth factor receptor (EGFR), ERBB1 phosphotyrosine kinase siRNA
cctgccctgtgcaacgtggagag

SEQ ID NO: 5573 - DNA, 23 bp, Artificial Sequence
  epidermal growth factor receptor (EGFR), ERBB1 phosphotyrosine kinase siRNA
ctgccctgtgcaacgtggagagc

SEQ ID NO: 5574 - DNA, 23 bp, Artificial Sequence
  epidermal growth factor receptor (EGFR), ERBB1 phosphotyrosine kinase siRNA
tgccctgtgcaacgtggagagca

SEQ ID NO: 5575 - DNA, 23 bp, Artificial Sequence
  epidermal growth factor receptor (EGFR), ERBB1 phosphotyrosine kinase siRNA
gccctgtgcaacgtggagagcat

SEQ ID NO: 5576 - DNA, 23 bp, Artificial Sequence
  epidermal growth factor receptor (EGFR), ERBB1 phosphotyrosine kinase siRNA
ccctgtgcaacgtggagagcatc

SEQ ID NO: 5577 - DNA, 23 bp, Artificial Sequence
  epidermal growth factor receptor (EGFR), ERBB1 phosphotyrosine kinase siRNA
cctgtgcaacgtggagagcatcc

SEQ ID NO: 5578 - DNA, 23 bp, Artificial Sequence
  epidermal growth factor receptor (EGFR), ERBB1 phosphotyrosine kinase siRNA
ctgtgcaacgtggagagcatcca

SEQ ID NO: 5579 - DNA, 23 bp, Artificial Sequence
  epidermal growth factor receptor (EGFR), ERBB1 phosphotyrosine kinase siRNA
tgtgcaacgtggagagcatccag

SEQ ID NO: 5580 - DNA, 23 bp, Artificial Sequence
  epidermal growth factor receptor (EGFR), ERBB1 phosphotyrosine kinase siRNA
gtgcaacgtggagagcatccagt

SEQ ID NO: 5581 - DNA, 23 bp, Artificial Sequence
  epidermal growth factor receptor (EGFR), ERBB1 phosphotyrosine kinase siRNA
tgcaacgtggagagcatccagtg

SEQ ID NO: 5582 - DNA, 23 bp, Artificial Sequence
  epidermal growth factor receptor (EGFR), ERBB1 phosphotyrosine kinase siRNA
gcaacgtggagagcatccagtgg

SEQ ID NO: 5583 - DNA, 23 bp, Artificial Sequence
  epidermal growth factor receptor (EGFR), ERBB1 phosphotyrosine kinase siRNA
caacgtggagagcatccagtggc

SEQ ID NO: 5584 - DNA, 23 bp, Artificial Sequence
  epidermal growth factor receptor (EGFR), ERBB1 phosphotyrosine kinase siRNA
aacgtggagagcatccagtggcg

SEQ ID NO: 5585 - DNA, 23 bp, Artificial Sequence
  epidermal growth factor receptor (EGFR), ERBB1 phosphotyrosine kinase siRNA
acgtggagagcatccagtggcgg

SEQ ID NO: 5586 - DNA, 23 bp, Artificial Sequence
  epidermal growth factor receptor (EGFR), ERBB1 phosphotyrosine kinase siRNA
cgtggagagcatccagtggcggg

SEQ ID NO: 5587 - DNA, 23 bp, Artificial Sequence
  epidermal growth factor receptor (EGFR), ERBB1 phosphotyrosine kinase siRNA
gtggagagcatccagtggcggga

SEQ ID NO: 5588 - DNA, 23 bp, Artificial Sequence
  epidermal growth factor receptor (EGFR), ERBB1 phosphotyrosine kinase siRNA
tggagagcatccagtggcgggac

SEQ ID NO: 5589 - DNA, 23 bp, Artificial Sequence
  epidermal growth factor receptor (EGFR), ERBB1 phosphotyrosine kinase siRNA
ggagagcatccagtggcgggaca

SEQ ID NO: 5590 - DNA, 23 bp, Artificial Sequence
  epidermal growth factor receptor (EGFR), ERBB1 phosphotyrosine kinase siRNA
gagagcatccagtggcgggacat

SEQ ID NO: 5591 - DNA, 23 bp, Artificial Sequence
  epidermal growth factor receptor (EGFR), ERBB1 phosphotyrosine kinase siRNA
agagcatccagtggcgggacata

SEQ ID NO: 5592 - DNA, 23 bp, Artificial Sequence
  epidermal growth factor receptor (EGFR), ERBB1 phosphotyrosine kinase siRNA
gagcatccagtggcgggacatag

SEQ ID NO: 5593 - DNA, 23 bp, Artificial Sequence
  epidermal growth factor receptor (EGFR), ERBB1 phosphotyrosine kinase siRNA
agcatccagtggcgggacatagt

SEQ ID NO: 5594 - DNA, 23 bp, Artificial Sequence
  epidermal growth factor receptor (EGFR), ERBB1 phosphotyrosine kinase siRNA
gcatccagtggcgggacatagtc

SEQ ID NO: 5595 - DNA, 23 bp, Artificial Sequence
  epidermal growth factor receptor (EGFR), ERBB1 phosphotyrosine kinase siRNA
catccagtggcgggacatagtca

SEQ ID NO: 5596 - DNA, 23 bp, Artificial Sequence
  epidermal growth factor receptor (EGFR), ERBB1 phosphotyrosine kinase siRNA
atccagtggcgggacatagtcag

SEQ ID NO: 5597 - DNA, 23 bp, Artificial Sequence
  epidermal growth factor receptor (EGFR), ERBB1 phosphotyrosine kinase siRNA
tccagtggcgggacatagtcagc

SEQ ID NO: 5598 - DNA, 23 bp, Artificial Sequence
  epidermal growth factor receptor (EGFR), ERBB1 phosphotyrosine kinase siRNA
ccagtggcgggacatagtcagca

SEQ ID NO: 5599 - DNA, 23 bp, Artificial Sequence
  epidermal growth factor receptor (EGFR), ERBB1 phosphotyrosine kinase siRNA
cagtggcgggacatagtcagcag

SEQ ID NO: 5600 - DNA, 23 bp, Artificial Sequence
  epidermal growth factor receptor (EGFR), ERBB1 phosphotyrosine kinase siRNA
agtggcgggacatagtcagcagt

SEQ ID NO: 5601 - DNA, 23 bp, Artificial Sequence
  epidermal growth factor receptor (EGFR), ERBB1 phosphotyrosine kinase siRNA
gtggcgggacatagtcagcagtg

SEQ ID NO: 5602 - DNA, 23 bp, Artificial Sequence
  epidermal growth factor receptor (EGFR), ERBB1 phosphotyrosine kinase siRNA
tggcgggacatagtcagcagtga

SEQ ID NO: 5603 - DNA, 23 bp, Artificial Sequence
  epidermal growth factor receptor (EGFR), ERBB1 phosphotyrosine kinase siRNA
ggcgggacatagtcagcagtgac

SEQ ID NO: 5604 - DNA, 23 bp, Artificial Sequence
  epidermal growth factor receptor (EGFR), ERBB1 phosphotyrosine kinase siRNA
gcgggacatagtcagcagtgact

SEQ ID NO: 5605 - DNA, 23 bp, Artificial Sequence
  epidermal growth factor receptor (EGFR), ERBB1 phosphotyrosine kinase siRNA
cgggacatagtcagcagtgactt

SEQ ID NO: 5606 - DNA, 23 bp, Artificial Sequence
  epidermal growth factor receptor (EGFR), ERBB1 phosphotyrosine kinase siRNA
gggacatagtcagcagtgacttt

SEQ ID NO: 5607 - DNA, 23 bp, Artificial Sequence
  epidermal growth factor receptor (EGFR), ERBB1 phosphotyrosine kinase siRNA
ggacatagtcagcagtgactttc

SEQ ID NO: 5608 - DNA, 23 bp, Artificial Sequence
  epidermal growth factor receptor (EGFR), ERBB1 phosphotyrosine kinase siRNA
gacatagtcagcagtgactttct

SEQ ID NO: 5609 - DNA, 23 bp, Artificial Sequence
  epidermal growth factor receptor (EGFR), ERBB1 phosphotyrosine kinase siRNA
acatagtcagcagtgactttctc

SEQ ID NO: 5610 - DNA, 23 bp, Artificial Sequence
  epidermal growth factor receptor (EGFR), ERBB1 phosphotyrosine kinase siRNA
catagtcagcagtgactttctca

SEQ ID NO: 5611 - DNA, 23 bp, Artificial Sequence
  epidermal growth factor receptor (EGFR), ERBB1 phosphotyrosine kinase siRNA
atagtcagcagtgactttctcag

SEQ ID NO: 5612 - DNA, 23 bp, Artificial Sequence
  epidermal growth factor receptor (EGFR), ERBB1 phosphotyrosine kinase siRNA
tagtcagcagtgactttctcagc

SEQ ID NO: 5613 - DNA, 23 bp, Artificial Sequence
  epidermal growth factor receptor (EGFR), ERBB1 phosphotyrosine kinase siRNA
agtcagcagtgactttctcagca

SEQ ID NO: 5614 - DNA, 23 bp, Artificial Sequence
  epidermal growth factor receptor (EGFR), ERBB1 phosphotyrosine kinase siRNA
gtcagcagtgactttctcagcaa

SEQ ID NO: 5615 - DNA, 23 bp, Artificial Sequence
  epidermal growth factor receptor (EGFR), ERBB1 phosphotyrosine kinase siRNA
tcagcagtgactttctcagcaac

SEQ ID NO: 5616 - DNA, 23 bp, Artificial Sequence
  epidermal growth factor receptor (EGFR), ERBB1 phosphotyrosine kinase siRNA
cagcagtgactttctcagcaaca

SEQ ID NO: 5617 - DNA, 23 bp, Artificial Sequence
  epidermal growth factor receptor (EGFR), ERBB1 phosphotyrosine kinase siRNA
agcagtgactttctcagcaacat

SEQ ID NO: 5618 - DNA, 23 bp, Artificial Sequence
  epidermal growth factor receptor (EGFR), ERBB1 phosphotyrosine kinase siRNA
gcagtgactttctcagcaacatg

SEQ ID NO: 5619 - DNA, 23 bp, Artificial Sequence
  epidermal growth factor receptor (EGFR), ERBB1 phosphotyrosine kinase siRNA
cagtgactttctcagcaacatgt

SEQ ID NO: 5620 - DNA, 23 bp, Artificial Sequence
  epidermal growth factor receptor (EGFR), ERBB1 phosphotyrosine kinase siRNA
agtgactttctcagcaacatgtc

SEQ ID NO: 5621 - DNA, 23 bp, Artificial Sequence
  epidermal growth factor receptor (EGFR), ERBB1 phosphotyrosine kinase siRNA
gtgactttctcagcaacatgtcg

SEQ ID NO: 5622 - DNA, 23 bp, Artificial Sequence
  epidermal growth factor receptor (EGFR), ERBB1 phosphotyrosine kinase siRNA
tgactttctcagcaacatgtcga

SEQ ID NO: 5623 - DNA, 23 bp, Artificial Sequence
  epidermal growth factor receptor (EGFR), ERBB1 phosphotyrosine kinase siRNA
gactttctcagcaacatgtcgat

SEQ ID NO: 5624 - DNA, 23 bp, Artificial Sequence
  epidermal growth factor receptor (EGFR), ERBB1 phosphotyrosine kinase siRNA
actttctcagcaacatgtcgatg

SEQ ID NO: 5625 - DNA, 23 bp, Artificial Sequence
  epidermal growth factor receptor (EGFR), ERBB1 phosphotyrosine kinase siRNA
ctttctcagcaacatgtcgatgg

SEQ ID NO: 5626 - DNA, 23 bp, Artificial Sequence
  epidermal growth factor receptor (EGFR), ERBB1 phosphotyrosine kinase siRNA
tttctcagcaacatgtcgatgga

SEQ ID NO: 5627 - DNA, 23 bp, Artificial Sequence
  epidermal growth factor receptor (EGFR), ERBB1 phosphotyrosine kinase siRNA
ttctcagcaacatgtcgatggac

SEQ ID NO: 5628 - DNA, 23 bp, Artificial Sequence
  epidermal growth factor receptor (EGFR), ERBB1 phosphotyrosine kinase siRNA
tctcagcaacatgtcgatggact

SEQ ID NO: 5629 - DNA, 23 bp, Artificial Sequence
  epidermal growth factor receptor (EGFR), ERBB1 phosphotyrosine kinase siRNA
ctcagcaacatgtcgatggactt

SEQ ID NO: 5630 - DNA, 23 bp, Artificial Sequence
  epidermal growth factor receptor (EGFR), ERBB1 phosphotyrosine kinase siRNA
tcagcaacatgtcgatggacttc

SEQ ID NO: 5631 - DNA, 23 bp, Artificial Sequence
  epidermal growth factor receptor (EGFR), ERBB1 phosphotyrosine kinase siRNA
cagcaacatgtcgatggacttcc

SEQ ID NO: 5632 - DNA, 23 bp, Artificial Sequence
  epidermal growth factor receptor (EGFR), ERBB1 phosphotyrosine kinase siRNA
agcaacatgtcgatggacttcca

SEQ ID NO: 5633 - DNA, 23 bp, Artificial Sequence
  epidermal growth factor receptor (EGFR), ERBB1 phosphotyrosine kinase siRNA
gcaacatgtcgatggacttccag

SEQ ID NO: 5634 - DNA, 23 bp, Artificial Sequence
  epidermal growth factor receptor (EGFR), ERBB1 phosphotyrosine kinase siRNA
caacatgtcgatggacttccaga

SEQ ID NO: 5635 - DNA, 23 bp, Artificial Sequence
  epidermal growth factor receptor (EGFR), ERBB1 phosphotyrosine kinase siRNA
aacatgtcgatggacttccagaa

SEQ ID NO: 5636 - DNA, 23 bp, Artificial Sequence
  epidermal growth factor receptor (EGFR), ERBB1 phosphotyrosine kinase siRNA
acatgtcgatggacttccagaac

SEQ ID NO: 5637 - DNA, 23 bp, Artificial Sequence
  epidermal growth factor receptor (EGFR), ERBB1 phosphotyrosine kinase siRNA
catgtcgatggacttccagaacc

SEQ ID NO: 5638 - DNA, 23 bp, Artificial Sequence
  epidermal growth factor receptor (EGFR), ERBB1 phosphotyrosine kinase siRNA
atgtcgatggacttccagaacca

SEQ ID NO: 5639 - DNA, 23 bp, Artificial Sequence
  epidermal growth factor receptor (EGFR), ERBB1 phosphotyrosine kinase siRNA
tgtcgatggacttccagaaccac

SEQ ID NO: 5640 - DNA, 23 bp, Artificial Sequence
  epidermal growth factor receptor (EGFR), ERBB1 phosphotyrosine kinase siRNA
gtcgatggacttccagaaccacc

SEQ ID NO: 5641 - DNA, 23 bp, Artificial Sequence
  epidermal growth factor receptor (EGFR), ERBB1 phosphotyrosine kinase siRNA
tcgatggacttccagaaccacct

SEQ ID NO: 5642 - DNA, 23 bp, Artificial Sequence
  epidermal growth factor receptor (EGFR), ERBB1 phosphotyrosine kinase siRNA
cgatggacttccagaaccacctg

SEQ ID NO: 5643 - DNA, 23 bp, Artificial Sequence
  epidermal growth factor receptor (EGFR), ERBB1 phosphotyrosine kinase siRNA
gatggacttccagaaccacctgg

SEQ ID NO: 5644 - DNA, 23 bp, Artificial Sequence
  epidermal growth factor receptor (EGFR), ERBB1 phosphotyrosine kinase siRNA
atggacttccagaaccacctggg

SEQ ID NO: 5645 - DNA, 23 bp, Artificial Sequence
  epidermal growth factor receptor (EGFR), ERBB1 phosphotyrosine kinase siRNA
tggacttccagaaccacctgggc

SEQ ID NO: 5646 - DNA, 23 bp, Artificial Sequence
  epidermal growth factor receptor (EGFR), ERBB1 phosphotyrosine kinase siRNA
ggacttccagaaccacctgggca

SEQ ID NO: 5647 - DNA, 23 bp, Artificial Sequence
  epidermal growth factor receptor (EGFR), ERBB1 phosphotyrosine kinase siRNA
gacttccagaaccacctgggcag

SEQ ID NO: 5648 - DNA, 23 bp, Artificial Sequence
  epidermal growth factor receptor (EGFR), ERBB1 phosphotyrosine kinase siRNA
acttccagaaccacctgggcagc

SEQ ID NO: 5649 - DNA, 23 bp, Artificial Sequence
  epidermal growth factor receptor (EGFR), ERBB1 phosphotyrosine kinase siRNA
cttccagaaccacctgggcagct

SEQ ID NO: 5650 - DNA, 23 bp, Artificial Sequence
  epidermal growth factor receptor (EGFR), ERBB1 phosphotyrosine kinase siRNA
ttccagaaccacctgggcagctg

SEQ ID NO: 5651 - DNA, 23 bp, Artificial Sequence
  epidermal growth factor receptor (EGFR), ERBB1 phosphotyrosine kinase siRNA
tccagaaccacctgggcagctgc

SEQ ID NO: 5652 - DNA, 23 bp, Artificial Sequence
  epidermal growth factor receptor (EGFR), ERBB1 phosphotyrosine kinase siRNA
ccagaaccacctgggcagctgcc

SEQ ID NO: 5653 - DNA, 23 bp, Artificial Sequence
  epidermal growth factor receptor (EGFR), ERBB1 phosphotyrosine kinase siRNA
cagaaccacctgggcagctgcca

SEQ ID NO: 5654 - DNA, 23 bp, Artificial Sequence
  epidermal growth factor receptor (EGFR), ERBB1 phosphotyrosine kinase siRNA
agaaccacctgggcagctgccaa

SEQ ID NO: 5655 - DNA, 23 bp, Artificial Sequence
  epidermal growth factor receptor (EGFR), ERBB1 phosphotyrosine kinase siRNA
gaaccacctgggcagctgccaaa

SEQ ID NO: 5656 - DNA, 23 bp, Artificial Sequence
  epidermal growth factor receptor (EGFR), ERBB1 phosphotyrosine kinase siRNA
aaccacctgggcagctgccaaaa

SEQ ID NO: 5657 - DNA, 23 bp, Artificial Sequence
  epidermal growth factor receptor (EGFR), ERBB1 phosphotyrosine kinase siRNA
accacctgggcagctgccaaaag

SEQ ID NO: 5658 - DNA, 23 bp, Artificial Sequence
  epidermal growth factor receptor (EGFR), ERBB1 phosphotyrosine kinase siRNA
ccacctgggcagctgccaaaagt

SEQ ID NO: 5659 - DNA, 23 bp, Artificial Sequence
  epidermal growth factor receptor (EGFR), ERBB1 phosphotyrosine kinase siRNA
cacctgggcagctgccaaaagtg

SEQ ID NO: 5660 - DNA, 23 bp, Artificial Sequence
  epidermal growth factor receptor (EGFR), ERBB1 phosphotyrosine kinase siRNA
acctgggcagctgccaaaagtgt

SEQ ID NO: 5661 - DNA, 23 bp, Artificial Sequence
  epidermal growth factor receptor (EGFR), ERBB1 phosphotyrosine kinase siRNA
cctgggcagctgccaaaagtgtg

SEQ ID NO: 5662 - DNA, 23 bp, Artificial Sequence
  epidermal growth factor receptor (EGFR), ERBB1 phosphotyrosine kinase siRNA
ctgggcagctgccaaaagtgtga

SEQ ID NO: 5663 - DNA, 23 bp, Artificial Sequence
  epidermal growth factor receptor (EGFR), ERBB1 phosphotyrosine kinase siRNA
tgggcagctgccaaaagtgtgat

SEQ ID NO: 5664 - DNA, 23 bp, Artificial Sequence
  epidermal growth factor receptor (EGFR), ERBB1 phosphotyrosine kinase siRNA
gggcagctgccaaaagtgtgatc

SEQ ID NO: 5665 - DNA, 23 bp, Artificial Sequence
  epidermal growth factor receptor (EGFR), ERBB1 phosphotyrosine kinase siRNA
ggcagctgccaaaagtgtgatcc

SEQ ID NO: 5666 - DNA, 23 bp, Artificial Sequence
  epidermal growth factor receptor (EGFR), ERBB1 phosphotyrosine kinase siRNA
gcagctgccaaaagtgtgatcca

SEQ ID NO: 5667 - DNA, 23 bp, Artificial Sequence
  epidermal growth factor receptor (EGFR), ERBB1 phosphotyrosine kinase siRNA
cagctgccaaaagtgtgatccaa

SEQ ID NO: 5668 - DNA, 23 bp, Artificial Sequence
  epidermal growth factor receptor (EGFR), ERBB1 phosphotyrosine kinase siRNA
agctgccaaaagtgtgatccaag

SEQ ID NO: 5669 - DNA, 23 bp, Artificial Sequence
  epidermal growth factor receptor (EGFR), ERBB1 phosphotyrosine kinase siRNA
gctgccaaaagtgtgatccaagc

SEQ ID NO: 5670 - DNA, 23 bp, Artificial Sequence
  epidermal growth factor receptor (EGFR), ERBB1 phosphotyrosine kinase siRNA
ctgccaaaagtgtgatccaagct

SEQ ID NO: 5671 - DNA, 23 bp, Artificial Sequence
  epidermal growth factor receptor (EGFR), ERBB1 phosphotyrosine kinase siRNA
tgccaaaagtgtgatccaagctg

SEQ ID NO: 5672 - DNA, 23 bp, Artificial Sequence
  epidermal growth factor receptor (EGFR), ERBB1 phosphotyrosine kinase siRNA
gccaaaagtgtgatccaagctgt

SEQ ID NO: 5673 - DNA, 23 bp, Artificial Sequence
  epidermal growth factor receptor (EGFR), ERBB1 phosphotyrosine kinase siRNA
ccaaaagtgtgatccaagctgtc

SEQ ID NO: 5674 - DNA, 23 bp, Artificial Sequence
  epidermal growth factor receptor (EGFR), ERBB1 phosphotyrosine kinase siRNA
caaaagtgtgatccaagctgtcc

SEQ ID NO: 5675 - DNA, 23 bp, Artificial Sequence
  epidermal growth factor receptor (EGFR), ERBB1 phosphotyrosine kinase siRNA
aaaagtgtgatccaagctgtccc

SEQ ID NO: 5676 - DNA, 23 bp, Artificial Sequence
  epidermal growth factor receptor (EGFR), ERBB1 phosphotyrosine kinase siRNA
aaagtgtgatccaagctgtccca

SEQ ID NO: 5677 - DNA, 23 bp, Artificial Sequence
  epidermal growth factor receptor (EGFR), ERBB1 phosphotyrosine kinase siRNA
aagtgtgatccaagctgtcccaa

SEQ ID NO: 5678 - DNA, 23 bp, Artificial Sequence
  epidermal growth factor receptor (EGFR), ERBB1 phosphotyrosine kinase siRNA
agtgtgatccaagctgtcccaat

SEQ ID NO: 5679 - DNA, 23 bp, Artificial Sequence
  epidermal growth factor receptor (EGFR), ERBB1 phosphotyrosine kinase siRNA
gtgtgatccaagctgtcccaatg

SEQ ID NO: 5680 - DNA, 23 bp, Artificial Sequence
  epidermal growth factor receptor (EGFR), ERBB1 phosphotyrosine kinase siRNA
tgtgatccaagctgtcccaatgg

SEQ ID NO: 5681 - DNA, 23 bp, Artificial Sequence
  epidermal growth factor receptor (EGFR), ERBB1 phosphotyrosine kinase siRNA
gtgatccaagctgtcccaatggg

SEQ ID NO: 5682 - DNA, 23 bp, Artificial Sequence
  epidermal growth factor receptor (EGFR), ERBB1 phosphotyrosine kinase siRNA
tgatccaagctgtcccaatggga

SEQ ID NO: 5683 - DNA, 23 bp, Artificial Sequence
  epidermal growth factor receptor (EGFR), ERBB1 phosphotyrosine kinase siRNA
gatccaagctgtcccaatgggag

SEQ ID NO: 5684 - DNA, 23 bp, Artificial Sequence
  epidermal growth factor receptor (EGFR), ERBB1 phosphotyrosine kinase siRNA
atccaagctgtcccaatgggagc

SEQ ID NO: 5685 - DNA, 23 bp, Artificial Sequence
  epidermal growth factor receptor (EGFR), ERBB1 phosphotyrosine kinase siRNA
tccaagctgtcccaatgggagct

SEQ ID NO: 5686 - DNA, 23 bp, Artificial Sequence
  epidermal growth factor receptor (EGFR), ERBB1 phosphotyrosine kinase siRNA
ccaagctgtcccaatgggagctg

SEQ ID NO: 5687 - DNA, 23 bp, Artificial Sequence
  epidermal growth factor receptor (EGFR), ERBB1 phosphotyrosine kinase siRNA
caagctgtcccaatgggagctgc

SEQ ID NO: 5688 - DNA, 23 bp, Artificial Sequence
  epidermal growth factor receptor (EGFR), ERBB1 phosphotyrosine kinase siRNA
aagctgtcccaatgggagctgct

SEQ ID NO: 5689 - DNA, 23 bp, Artificial Sequence
  epidermal growth factor receptor (EGFR), ERBB1 phosphotyrosine kinase siRNA
agctgtcccaatgggagctgctg

SEQ ID NO: 5690 - DNA, 23 bp, Artificial Sequence
  epidermal growth factor receptor (EGFR), ERBB1 phosphotyrosine kinase siRNA
gctgtcccaatgggagctgctgg

SEQ ID NO: 5691 - DNA, 23 bp, Artificial Sequence
  epidermal growth factor receptor (EGFR), ERBB1 phosphotyrosine kinase siRNA
ctgtcccaatgggagctgctggg

SEQ ID NO: 5692 - DNA, 23 bp, Artificial Sequence
  epidermal growth factor receptor (EGFR), ERBB1 phosphotyrosine kinase siRNA
tgtcccaatgggagctgctgggg

SEQ ID NO: 5693 - DNA, 23 bp, Artificial Sequence
  epidermal growth factor receptor (EGFR), ERBB1 phosphotyrosine kinase siRNA
gtcccaatgggagctgctggggt

SEQ ID NO: 5694 - DNA, 23 bp, Artificial Sequence
  epidermal growth factor receptor (EGFR), ERBB1 phosphotyrosine kinase siRNA
tcccaatgggagctgctggggtg

SEQ ID NO: 5695 - DNA, 23 bp, Artificial Sequence
  epidermal growth factor receptor (EGFR), ERBB1 phosphotyrosine kinase siRNA
cccaatgggagctgctggggtgc

SEQ ID NO: 5696 - DNA, 23 bp, Artificial Sequence
  epidermal growth factor receptor (EGFR), ERBB1 phosphotyrosine kinase siRNA
ccaatgggagctgctggggtgca

SEQ ID NO: 5697 - DNA, 23 bp, Artificial Sequence
  epidermal growth factor receptor (EGFR), ERBB1 phosphotyrosine kinase siRNA
caatgggagctgctggggtgcag

SEQ ID NO: 5698 - DNA, 23 bp, Artificial Sequence
  epidermal growth factor receptor (EGFR), ERBB1 phosphotyrosine kinase siRNA
aatgggagctgctggggtgcagg

SEQ ID NO: 5699 - DNA, 23 bp, Artificial Sequence
  epidermal growth factor receptor (EGFR), ERBB1 phosphotyrosine kinase siRNA
atgggagctgctggggtgcagga

SEQ ID NO: 5700 - DNA, 23 bp, Artificial Sequence
  epidermal growth factor receptor (EGFR), ERBB1 phosphotyrosine kinase siRNA
tgggagctgctggggtgcaggag

SEQ ID NO: 5701 - DNA, 23 bp, Artificial Sequence
  epidermal growth factor receptor (EGFR), ERBB1 phosphotyrosine kinase siRNA
gggagctgctggggtgcaggaga

SEQ ID NO: 5702 - DNA, 23 bp, Artificial Sequence
  epidermal growth factor receptor (EGFR), ERBB1 phosphotyrosine kinase siRNA
ggagctgctggggtgcaggagag

SEQ ID NO: 5703 - DNA, 23 bp, Artificial Sequence
  epidermal growth factor receptor (EGFR), ERBB1 phosphotyrosine kinase siRNA
gagctgctggggtgcaggagagg

SEQ ID NO: 5704 - DNA, 23 bp, Artificial Sequence
  epidermal growth factor receptor (EGFR), ERBB1 phosphotyrosine kinase siRNA
agctgctggggtgcaggagagga

SEQ ID NO: 5705 - DNA, 23 bp, Artificial Sequence
  epidermal growth factor receptor (EGFR), ERBB1 phosphotyrosine kinase siRNA
gctgctggggtgcaggagaggag

SEQ ID NO: 5706 - DNA, 23 bp, Artificial Sequence
  epidermal growth factor receptor (EGFR), ERBB1 phosphotyrosine kinase siRNA
ctgctggggtgcaggagaggaga

SEQ ID NO: 5707 - DNA, 23 bp, Artificial Sequence
  epidermal growth factor receptor (EGFR), ERBB1 phosphotyrosine kinase siRNA
tgctggggtgcaggagaggagaa

SEQ ID NO: 5708 - DNA, 23 bp, Artificial Sequence
  epidermal growth factor receptor (EGFR), ERBB1 phosphotyrosine kinase siRNA
gctggggtgcaggagaggagaac

SEQ ID NO: 5709 - DNA, 23 bp, Artificial Sequence
  epidermal growth factor receptor (EGFR), ERBB1 phosphotyrosine kinase siRNA
ctggggtgcaggagaggagaact

SEQ ID NO: 5710 - DNA, 23 bp, Artificial Sequence
  epidermal growth factor receptor (EGFR), ERBB1 phosphotyrosine kinase siRNA
tggggtgcaggagaggagaactg

SEQ ID NO: 5711 - DNA, 23 bp, Artificial Sequence
  epidermal growth factor receptor (EGFR), ERBB1 phosphotyrosine kinase siRNA
ggggtgcaggagaggagaactgc

SEQ ID NO: 5712 - DNA, 23 bp, Artificial Sequence
  epidermal growth factor receptor (EGFR), ERBB1 phosphotyrosine kinase siRNA
gggtgcaggagaggagaactgcc

SEQ ID NO: 5713 - DNA, 23 bp, Artificial Sequence
  epidermal growth factor receptor (EGFR), ERBB1 phosphotyrosine kinase siRNA
ggtgcaggagaggagaactgcca

SEQ ID NO: 5714 - DNA, 23 bp, Artificial Sequence
  epidermal growth factor receptor (EGFR), ERBB1 phosphotyrosine kinase siRNA
gtgcaggagaggagaactgccag

SEQ ID NO: 5715 - DNA, 23 bp, Artificial Sequence
  epidermal growth factor receptor (EGFR), ERBB1 phosphotyrosine kinase siRNA
tgcaggagaggagaactgccaga

SEQ ID NO: 5716 - DNA, 23 bp, Artificial Sequence
  epidermal growth factor receptor (EGFR), ERBB1 phosphotyrosine kinase siRNA
gcaggagaggagaactgccagaa

SEQ ID NO: 5717 - DNA, 23 bp, Artificial Sequence
  epidermal growth factor receptor (EGFR), ERBB1 phosphotyrosine kinase siRNA
caggagaggagaactgccagaaa

SEQ ID NO: 5718 - DNA, 23 bp, Artificial Sequence
  epidermal growth factor receptor (EGFR), ERBB1 phosphotyrosine kinase siRNA
aggagaggagaactgccagaaac

SEQ ID NO: 5719 - DNA, 23 bp, Artificial Sequence
  epidermal growth factor receptor (EGFR), ERBB1 phosphotyrosine kinase siRNA
ggagaggagaactgccagaaact

SEQ ID NO: 5720 - DNA, 23 bp, Artificial Sequence
  epidermal growth factor receptor (EGFR), ERBB1 phosphotyrosine kinase siRNA
gagaggagaactgccagaaactg

SEQ ID NO: 5721 - DNA, 23 bp, Artificial Sequence
  epidermal growth factor receptor (EGFR), ERBB1 phosphotyrosine kinase siRNA
agaggagaactgccagaaactga

SEQ ID NO: 5722 - DNA, 23 bp, Artificial Sequence
  epidermal growth factor receptor (EGFR), ERBB1 phosphotyrosine kinase siRNA
gaggagaactgccagaaactgac

SEQ ID NO: 5723 - DNA, 23 bp, Artificial Sequence
  epidermal growth factor receptor (EGFR), ERBB1 phosphotyrosine kinase siRNA
aggagaactgccagaaactgacc

SEQ ID NO: 5724 - DNA, 23 bp, Artificial Sequence
  epidermal growth factor receptor (EGFR), ERBB1 phosphotyrosine kinase siRNA
ggagaactgccagaaactgacca

SEQ ID NO: 5725 - DNA, 23 bp, Artificial Sequence
  epidermal growth factor receptor (EGFR), ERBB1 phosphotyrosine kinase siRNA
gagaactgccagaaactgaccaa

SEQ ID NO: 5726 - DNA, 23 bp, Artificial Sequence
  epidermal growth factor receptor (EGFR), ERBB1 phosphotyrosine kinase siRNA
agaactgccagaaactgaccaaa

SEQ ID NO: 5727 - DNA, 23 bp, Artificial Sequence
  epidermal growth factor receptor (EGFR), ERBB1 phosphotyrosine kinase siRNA
gaactgccagaaactgaccaaaa

SEQ ID NO: 5728 - DNA, 23 bp, Artificial Sequence
  epidermal growth factor receptor (EGFR), ERBB1 phosphotyrosine kinase siRNA
aactgccagaaactgaccaaaat

SEQ ID NO: 5729 - DNA, 23 bp, Artificial Sequence
  epidermal growth factor receptor (EGFR), ERBB1 phosphotyrosine kinase siRNA
actgccagaaactgaccaaaatc

SEQ ID NO: 5730 - DNA, 23 bp, Artificial Sequence
  epidermal growth factor receptor (EGFR), ERBB1 phosphotyrosine kinase siRNA
ctgccagaaactgaccaaaatca

SEQ ID NO: 5731 - DNA, 23 bp, Artificial Sequence
  epidermal growth factor receptor (EGFR), ERBB1 phosphotyrosine kinase siRNA
tgccagaaactgaccaaaatcat

SEQ ID NO: 5732 - DNA, 23 bp, Artificial Sequence
  epidermal growth factor receptor (EGFR), ERBB1 phosphotyrosine kinase siRNA
gccagaaactgaccaaaatcatc

SEQ ID NO: 5733 - DNA, 23 bp, Artificial Sequence
  epidermal growth factor receptor (EGFR), ERBB1 phosphotyrosine kinase siRNA
ccagaaactgaccaaaatcatct

SEQ ID NO: 5734 - DNA, 23 bp, Artificial Sequence
  epidermal growth factor receptor (EGFR), ERBB1 phosphotyrosine kinase siRNA
cagaaactgaccaaaatcatctg

SEQ ID NO: 5735 - DNA, 23 bp, Artificial Sequence
  epidermal growth factor receptor (EGFR), ERBB1 phosphotyrosine kinase siRNA
agaaactgaccaaaatcatctgt

SEQ ID NO: 5736 - DNA, 23 bp, Artificial Sequence
  epidermal growth factor receptor (EGFR), ERBB1 phosphotyrosine kinase siRNA
gaaactgaccaaaatcatctgtg

SEQ ID NO: 5737 - DNA, 23 bp, Artificial Sequence
  epidermal growth factor receptor (EGFR), ERBB1 phosphotyrosine kinase siRNA
aaactgaccaaaatcatctgtgc

SEQ ID NO: 5738 - DNA, 23 bp, Artificial Sequence
  epidermal growth factor receptor (EGFR), ERBB1 phosphotyrosine kinase siRNA
aactgaccaaaatcatctgtgcc

SEQ ID NO: 5739 - DNA, 23 bp, Artificial Sequence
  epidermal growth factor receptor (EGFR), ERBB1 phosphotyrosine kinase siRNA
actgaccaaaatcatctgtgccc

SEQ ID NO: 5740 - DNA, 23 bp, Artificial Sequence
  epidermal growth factor receptor (EGFR), ERBB1 phosphotyrosine kinase siRNA
ctgaccaaaatcatctgtgccca

SEQ ID NO: 5741 - DNA, 23 bp, Artificial Sequence
  epidermal growth factor receptor (EGFR), ERBB1 phosphotyrosine kinase siRNA
tgaccaaaatcatctgtgcccag

SEQ ID NO: 5742 - DNA, 23 bp, Artificial Sequence
  epidermal growth factor receptor (EGFR), ERBB1 phosphotyrosine kinase siRNA
gaccaaaatcatctgtgcccagc

SEQ ID NO: 5743 - DNA, 23 bp, Artificial Sequence
  epidermal growth factor receptor (EGFR), ERBB1 phosphotyrosine kinase siRNA
accaaaatcatctgtgcccagca

SEQ ID NO: 5744 - DNA, 23 bp, Artificial Sequence
  epidermal growth factor receptor (EGFR), ERBB1 phosphotyrosine kinase siRNA
ccaaaatcatctgtgcccagcag

SEQ ID NO: 5745 - DNA, 23 bp, Artificial Sequence
  epidermal growth factor receptor (EGFR), ERBB1 phosphotyrosine kinase siRNA
caaaatcatctgtgcccagcagt

SEQ ID NO: 5746 - DNA, 23 bp, Artificial Sequence
  epidermal growth factor receptor (EGFR), ERBB1 phosphotyrosine kinase siRNA
aaaatcatctgtgcccagcagtg

SEQ ID NO: 5747 - DNA, 23 bp, Artificial Sequence
  epidermal growth factor receptor (EGFR), ERBB1 phosphotyrosine kinase siRNA
aaatcatctgtgcccagcagtgc

SEQ ID NO: 5748 - DNA, 23 bp, Artificial Sequence
  epidermal growth factor receptor (EGFR), ERBB1 phosphotyrosine kinase siRNA
aatcatctgtgcccagcagtgct

SEQ ID NO: 5749 - DNA, 23 bp, Artificial Sequence
  epidermal growth factor receptor (EGFR), ERBB1 phosphotyrosine kinase siRNA
atcatctgtgcccagcagtgctc

SEQ ID NO: 5750 - DNA, 23 bp, Artificial Sequence
  epidermal growth factor receptor (EGFR), ERBB1 phosphotyrosine kinase siRNA
tcatctgtgcccagcagtgctcc

SEQ ID NO: 5751 - DNA, 23 bp, Artificial Sequence
  epidermal growth factor receptor (EGFR), ERBB1 phosphotyrosine kinase siRNA
catctgtgcccagcagtgctccg

SEQ ID NO: 5752 - DNA, 23 bp, Artificial Sequence
  epidermal growth factor receptor (EGFR), ERBB1 phosphotyrosine kinase siRNA
atctgtgcccagcagtgctccgg

SEQ ID NO: 5753 - DNA, 23 bp, Artificial Sequence
  epidermal growth factor receptor (EGFR), ERBB1 phosphotyrosine kinase siRNA
tctgtgcccagcagtgctccggg

SEQ ID NO: 5754 - DNA, 23 bp, Artificial Sequence
  epidermal growth factor receptor (EGFR), ERBB1 phosphotyrosine kinase siRNA
ctgtgcccagcagtgctccgggc

SEQ ID NO: 5755 - DNA, 23 bp, Artificial Sequence
  epidermal growth factor receptor (EGFR), ERBB1 phosphotyrosine kinase siRNA
tgtgcccagcagtgctccgggcg

SEQ ID NO: 5756 - DNA, 23 bp, Artificial Sequence
  epidermal growth factor receptor (EGFR), ERBB1 phosphotyrosine kinase siRNA
gtgcccagcagtgctccgggcgc

SEQ ID NO: 5757 - DNA, 23 bp, Artificial Sequence
  epidermal growth factor receptor (EGFR), ERBB1 phosphotyrosine kinase siRNA
tgcccagcagtgctccgggcgct

SEQ ID NO: 5758 - DNA, 23 bp, Artificial Sequence
  epidermal growth factor receptor (EGFR), ERBB1 phosphotyrosine kinase siRNA
gcccagcagtgctccgggcgctg

SEQ ID NO: 5759 - DNA, 23 bp, Artificial Sequence
  epidermal growth factor receptor (EGFR), ERBB1 phosphotyrosine kinase siRNA
cccagcagtgctccgggcgctgc

SEQ ID NO: 5760 - DNA, 23 bp, Artificial Sequence
  epidermal growth factor receptor (EGFR), ERBB1 phosphotyrosine kinase siRNA
ccagcagtgctccgggcgctgcc

SEQ ID NO: 5761 - DNA, 23 bp, Artificial Sequence
  epidermal growth factor receptor (EGFR), ERBB1 phosphotyrosine kinase siRNA
cagcagtgctccgggcgctgccg

SEQ ID NO: 5762 - DNA, 23 bp, Artificial Sequence
  epidermal growth factor receptor (EGFR), ERBB1 phosphotyrosine kinase siRNA
agcagtgctccgggcgctgccgt

SEQ ID NO: 5763 - DNA, 23 bp, Artificial Sequence
  epidermal growth factor receptor (EGFR), ERBB1 phosphotyrosine kinase siRNA
gcagtgctccgggcgctgccgtg

SEQ ID NO: 5764 - DNA, 23 bp, Artificial Sequence
  epidermal growth factor receptor (EGFR), ERBB1 phosphotyrosine kinase siRNA
cagtgctccgggcgctgccgtgg

SEQ ID NO: 5765 - DNA, 23 bp, Artificial Sequence
  epidermal growth factor receptor (EGFR), ERBB1 phosphotyrosine kinase siRNA
agtgctccgggcgctgccgtggc

SEQ ID NO: 5766 - DNA, 23 bp, Artificial Sequence
  epidermal growth factor receptor (EGFR), ERBB1 phosphotyrosine kinase siRNA
gtgctccgggcgctgccgtggca

SEQ ID NO: 5767 - DNA, 23 bp, Artificial Sequence
  epidermal growth factor receptor (EGFR), ERBB1 phosphotyrosine kinase siRNA
tgctccgggcgctgccgtggcaa

SEQ ID NO: 5768 - DNA, 23 bp, Artificial Sequence
  epidermal growth factor receptor (EGFR), ERBB1 phosphotyrosine kinase siRNA
gctccgggcgctgccgtggcaag

SEQ ID NO: 5769 - DNA, 23 bp, Artificial Sequence
  epidermal growth factor receptor (EGFR), ERBB1 phosphotyrosine kinase siRNA
ctccgggcgctgccgtggcaagt

SEQ ID NO: 5770 - DNA, 23 bp, Artificial Sequence
  epidermal growth factor receptor (EGFR), ERBB1 phosphotyrosine kinase siRNA
tccgggcgctgccgtggcaagtc

SEQ ID NO: 5771 - DNA, 23 bp, Artificial Sequence
  epidermal growth factor receptor (EGFR), ERBB1 phosphotyrosine kinase siRNA
ccgggcgctgccgtggcaagtcc

SEQ ID NO: 5772 - DNA, 23 bp, Artificial Sequence
  epidermal growth factor receptor (EGFR), ERBB1 phosphotyrosine kinase siRNA
cgggcgctgccgtggcaagtccc

SEQ ID NO: 5773 - DNA, 23 bp, Artificial Sequence
  epidermal growth factor receptor (EGFR), ERBB1 phosphotyrosine kinase siRNA
gggcgctgccgtggcaagtcccc

SEQ ID NO: 5774 - DNA, 23 bp, Artificial Sequence
  epidermal growth factor receptor (EGFR), ERBB1 phosphotyrosine kinase siRNA
ggcgctgccgtggcaagtccccc

SEQ ID NO: 5775 - DNA, 23 bp, Artificial Sequence
  epidermal growth factor receptor (EGFR), ERBB1 phosphotyrosine kinase siRNA
gcgctgccgtggcaagtccccca

SEQ ID NO: 5776 - DNA, 23 bp, Artificial Sequence
  epidermal growth factor receptor (EGFR), ERBB1 phosphotyrosine kinase siRNA
cgctgccgtggcaagtcccccag

SEQ ID NO: 5777 - DNA, 23 bp, Artificial Sequence
  epidermal growth factor receptor (EGFR), ERBB1 phosphotyrosine kinase siRNA
gctgccgtggcaagtcccccagt

SEQ ID NO: 5778 - DNA, 23 bp, Artificial Sequence
  epidermal growth factor receptor (EGFR), ERBB1 phosphotyrosine kinase siRNA
ctgccgtggcaagtcccccagtg

SEQ ID NO: 5779 - DNA, 23 bp, Artificial Sequence
  epidermal growth factor receptor (EGFR), ERBB1 phosphotyrosine kinase siRNA
tgccgtggcaagtcccccagtga

SEQ ID NO: 5780 - DNA, 23 bp, Artificial Sequence
  epidermal growth factor receptor (EGFR), ERBB1 phosphotyrosine kinase siRNA
gccgtggcaagtcccccagtgac

SEQ ID NO: 5781 - DNA, 23 bp, Artificial Sequence
  epidermal growth factor receptor (EGFR), ERBB1 phosphotyrosine kinase siRNA
ccgtggcaagtcccccagtgact

SEQ ID NO: 5782 - DNA, 23 bp, Artificial Sequence
  epidermal growth factor receptor (EGFR), ERBB1 phosphotyrosine kinase siRNA
cgtggcaagtcccccagtgactg

SEQ ID NO: 5783 - DNA, 23 bp, Artificial Sequence
  epidermal growth factor receptor (EGFR), ERBB1 phosphotyrosine kinase siRNA
gtggcaagtcccccagtgactgc

SEQ ID NO: 5784 - DNA, 23 bp, Artificial Sequence
  epidermal growth factor receptor (EGFR), ERBB1 phosphotyrosine kinase siRNA
tggcaagtcccccagtgactgct

SEQ ID NO: 5785 - DNA, 23 bp, Artificial Sequence
  epidermal growth factor receptor (EGFR), ERBB1 phosphotyrosine kinase siRNA
ggcaagtcccccagtgactgctg

SEQ ID NO: 5786 - DNA, 23 bp, Artificial Sequence
  epidermal growth factor receptor (EGFR), ERBB1 phosphotyrosine kinase siRNA
gcaagtcccccagtgactgctgc

SEQ ID NO: 5787 - DNA, 23 bp, Artificial Sequence
  epidermal growth factor receptor (EGFR), ERBB1 phosphotyrosine kinase siRNA
caagtcccccagtgactgctgcc

SEQ ID NO: 5788 - DNA, 23 bp, Artificial Sequence
  epidermal growth factor receptor (EGFR), ERBB1 phosphotyrosine kinase siRNA
aagtcccccagtgactgctgcca

SEQ ID NO: 5789 - DNA, 23 bp, Artificial Sequence
  epidermal growth factor receptor (EGFR), ERBB1 phosphotyrosine kinase siRNA
agtcccccagtgactgctgccac

SEQ ID NO: 5790 - DNA, 23 bp, Artificial Sequence
  epidermal growth factor receptor (EGFR), ERBB1 phosphotyrosine kinase siRNA
gtcccccagtgactgctgccaca

SEQ ID NO: 5791 - DNA, 23 bp, Artificial Sequence
  epidermal growth factor receptor (EGFR), ERBB1 phosphotyrosine kinase siRNA
tcccccagtgactgctgccacaa

SEQ ID NO: 5792 - DNA, 23 bp, Artificial Sequence
  epidermal growth factor receptor (EGFR), ERBB1 phosphotyrosine kinase siRNA
cccccagtgactgctgccacaac

SEQ ID NO: 5793 - DNA, 23 bp, Artificial Sequence
  epidermal growth factor receptor (EGFR), ERBB1 phosphotyrosine kinase siRNA
ccccagtgactgctgccacaacc

SEQ ID NO: 5794 - DNA, 23 bp, Artificial Sequence
  epidermal growth factor receptor (EGFR), ERBB1 phosphotyrosine kinase siRNA
cccagtgactgctgccacaacca

SEQ ID NO: 5795 - DNA, 23 bp, Artificial Sequence
  epidermal growth factor receptor (EGFR), ERBB1 phosphotyrosine kinase siRNA
ccagtgactgctgccacaaccag

SEQ ID NO: 5796 - DNA, 23 bp, Artificial Sequence
  epidermal growth factor receptor (EGFR), ERBB1 phosphotyrosine kinase siRNA
cagtgactgctgccacaaccagt

SEQ ID NO: 5797 - DNA, 23 bp, Artificial Sequence
  epidermal growth factor receptor (EGFR), ERBB1 phosphotyrosine kinase siRNA
agtgactgctgccacaaccagtg

SEQ ID NO: 5798 - DNA, 23 bp, Artificial Sequence
  epidermal growth factor receptor (EGFR), ERBB1 phosphotyrosine kinase siRNA
gtgactgctgccacaaccagtgt

SEQ ID NO: 5799 - DNA, 23 bp, Artificial Sequence
  epidermal growth factor receptor (EGFR), ERBB1 phosphotyrosine kinase siRNA
tgactgctgccacaaccagtgtg

SEQ ID NO: 5800 - DNA, 23 bp, Artificial Sequence
  epidermal growth factor receptor (EGFR), ERBB1 phosphotyrosine kinase siRNA
gactgctgccacaaccagtgtgc

SEQ ID NO: 5801 - DNA, 23 bp, Artificial Sequence
  epidermal growth factor receptor (EGFR), ERBB1 phosphotyrosine kinase siRNA
actgctgccacaaccagtgtgct

SEQ ID NO: 5802 - DNA, 23 bp, Artificial Sequence
  epidermal growth factor receptor (EGFR), ERBB1 phosphotyrosine kinase siRNA
ctgctgccacaaccagtgtgctg

SEQ ID NO: 5803 - DNA, 23 bp, Artificial Sequence
  epidermal growth factor receptor (EGFR), ERBB1 phosphotyrosine kinase siRNA
tgctgccacaaccagtgtgctgc

SEQ ID NO: 5804 - DNA, 23 bp, Artificial Sequence
  epidermal growth factor receptor (EGFR), ERBB1 phosphotyrosine kinase siRNA
gctgccacaaccagtgtgctgca

SEQ ID NO: 5805 - DNA, 23 bp, Artificial Sequence
  epidermal growth factor receptor (EGFR), ERBB1 phosphotyrosine kinase siRNA
ctgccacaaccagtgtgctgcag

SEQ ID NO: 5806 - DNA, 23 bp, Artificial Sequence
  epidermal growth factor receptor (EGFR), ERBB1 phosphotyrosine kinase siRNA
tgccacaaccagtgtgctgcagg

SEQ ID NO: 5807 - DNA, 23 bp, Artificial Sequence
  epidermal growth factor receptor (EGFR), ERBB1 phosphotyrosine kinase siRNA
gccacaaccagtgtgctgcaggc

SEQ ID NO: 5808 - DNA, 23 bp, Artificial Sequence
  epidermal growth factor receptor (EGFR), ERBB1 phosphotyrosine kinase siRNA
ccacaaccagtgtgctgcaggct

SEQ ID NO: 5809 - DNA, 23 bp, Artificial Sequence
  epidermal growth factor receptor (EGFR), ERBB1 phosphotyrosine kinase siRNA
cacaaccagtgtgctgcaggctg

SEQ ID NO: 5810 - DNA, 23 bp, Artificial Sequence
  epidermal growth factor receptor (EGFR), ERBB1 phosphotyrosine kinase siRNA
acaaccagtgtgctgcaggctgc

SEQ ID NO: 5811 - DNA, 23 bp, Artificial Sequence
  epidermal growth factor receptor (EGFR), ERBB1 phosphotyrosine kinase siRNA
caaccagtgtgctgcaggctgca

SEQ ID NO: 5812 - DNA, 23 bp, Artificial Sequence
  epidermal growth factor receptor (EGFR), ERBB1 phosphotyrosine kinase siRNA
aaccagtgtgctgcaggctgcac

SEQ ID NO: 5813 - DNA, 23 bp, Artificial Sequence
  epidermal growth factor receptor (EGFR), ERBB1 phosphotyrosine kinase siRNA
accagtgtgctgcaggctgcaca

SEQ ID NO: 5814 - DNA, 23 bp, Artificial Sequence
  epidermal growth factor receptor (EGFR), ERBB1 phosphotyrosine kinase siRNA
ccagtgtgctgcaggctgcacag

SEQ ID NO: 5815 - DNA, 23 bp, Artificial Sequence
  epidermal growth factor receptor (EGFR), ERBB1 phosphotyrosine kinase siRNA
cagtgtgctgcaggctgcacagg

SEQ ID NO: 5816 - DNA, 23 bp, Artificial Sequence
  epidermal growth factor receptor (EGFR), ERBB1 phosphotyrosine kinase siRNA
agtgtgctgcaggctgcacaggc

SEQ ID NO: 5817 - DNA, 23 bp, Artificial Sequence
  epidermal growth factor receptor (EGFR), ERBB1 phosphotyrosine kinase siRNA
gtgtgctgcaggctgcacaggcc

SEQ ID NO: 5818 - DNA, 23 bp, Artificial Sequence
  epidermal growth factor receptor (EGFR), ERBB1 phosphotyrosine kinase siRNA
tgtgctgcaggctgcacaggccc

SEQ ID NO: 5819 - DNA, 23 bp, Artificial Sequence
  epidermal growth factor receptor (EGFR), ERBB1 phosphotyrosine kinase siRNA
gtgctgcaggctgcacaggcccc

SEQ ID NO: 5820 - DNA, 23 bp, Artificial Sequence
  epidermal growth factor receptor (EGFR), ERBB1 phosphotyrosine kinase siRNA
tgctgcaggctgcacaggccccc

SEQ ID NO: 5821 - DNA, 23 bp, Artificial Sequence
  epidermal growth factor receptor (EGFR), ERBB1 phosphotyrosine kinase siRNA
gctgcaggctgcacaggcccccg

SEQ ID NO: 5822 - DNA, 23 bp, Artificial Sequence
  epidermal growth factor receptor (EGFR), ERBB1 phosphotyrosine kinase siRNA
cccccgggagagcgactgcctgg

SEQ ID NO: 5823 - DNA, 23 bp, Artificial Sequence
  epidermal growth factor receptor (EGFR), ERBB1 phosphotyrosine kinase siRNA
ccccgggagagcgactgcctggt

SEQ ID NO: 5824 - DNA, 23 bp, Artificial Sequence
  epidermal growth factor receptor (EGFR), ERBB1 phosphotyrosine kinase siRNA
cccgggagagcgactgcctggtc

SEQ ID NO: 5825 - DNA, 23 bp, Artificial Sequence
  epidermal growth factor receptor (EGFR), ERBB1 phosphotyrosine kinase siRNA
ccgggagagcgactgcctggtct

SEQ ID NO: 5826 - DNA, 23 bp, Artificial Sequence
  epidermal growth factor receptor (EGFR), ERBB1 phosphotyrosine kinase siRNA
cgggagagcgactgcctggtctg

SEQ ID NO: 5827 - DNA, 23 bp, Artificial Sequence
  epidermal growth factor receptor (EGFR), ERBB1 phosphotyrosine kinase siRNA
gggagagcgactgcctggtctgc

SEQ ID NO: 5828 - DNA, 23 bp, Artificial Sequence
  epidermal growth factor receptor (EGFR), ERBB1 phosphotyrosine kinase siRNA
ggagagcgactgcctggtctgcc

SEQ ID NO: 5829 - DNA, 23 bp, Artificial Sequence
  epidermal growth factor receptor (EGFR), ERBB1 phosphotyrosine kinase siRNA
gagagcgactgcctggtctgccg

SEQ ID NO: 5830 - DNA, 23 bp, Artificial Sequence
  epidermal growth factor receptor (EGFR), ERBB1 phosphotyrosine kinase siRNA
agagcgactgcctggtctgccgc

SEQ ID NO: 5831 - DNA, 23 bp, Artificial Sequence
  epidermal growth factor receptor (EGFR), ERBB1 phosphotyrosine kinase siRNA
gagcgactgcctggtctgccgca

SEQ ID NO: 5832 - DNA, 23 bp, Artificial Sequence
  epidermal growth factor receptor (EGFR), ERBB1 phosphotyrosine kinase siRNA
agcgactgcctggtctgccgcaa

SEQ ID NO: 5833 - DNA, 23 bp, Artificial Sequence
  epidermal growth factor receptor (EGFR), ERBB1 phosphotyrosine kinase siRNA
gcgactgcctggtctgccgcaaa

SEQ ID NO: 5834 - DNA, 23 bp, Artificial Sequence
  epidermal growth factor receptor (EGFR), ERBB1 phosphotyrosine kinase siRNA
cgactgcctggtctgccgcaaat

SEQ ID NO: 5835 - DNA, 23 bp, Artificial Sequence
  epidermal growth factor receptor (EGFR), ERBB1 phosphotyrosine kinase siRNA
gactgcctggtctgccgcaaatt

SEQ ID NO: 5836 - DNA, 23 bp, Artificial Sequence
  epidermal growth factor receptor (EGFR), ERBB1 phosphotyrosine kinase siRNA
actgcctggtctgccgcaaattc

SEQ ID NO: 5837 - DNA, 23 bp, Artificial Sequence
  epidermal growth factor receptor (EGFR), ERBB1 phosphotyrosine kinase siRNA
ctgcctggtctgccgcaaattcc

SEQ ID NO: 5838 - DNA, 23 bp, Artificial Sequence
  epidermal growth factor receptor (EGFR), ERBB1 phosphotyrosine kinase siRNA
tgcctggtctgccgcaaattccg

SEQ ID NO: 5839 - DNA, 23 bp, Artificial Sequence
  epidermal growth factor receptor (EGFR), ERBB1 phosphotyrosine kinase siRNA
gcctggtctgccgcaaattccga

SEQ ID NO: 5840 - DNA, 23 bp, Artificial Sequence
  epidermal growth factor receptor (EGFR), ERBB1 phosphotyrosine kinase siRNA
cctggtctgccgcaaattccgag

SEQ ID NO: 5841 - DNA, 23 bp, Artificial Sequence
  epidermal growth factor receptor (EGFR), ERBB1 phosphotyrosine kinase siRNA
ctggtctgccgcaaattccgaga

SEQ ID NO: 5842 - DNA, 23 bp, Artificial Sequence
  epidermal growth factor receptor (EGFR), ERBB1 phosphotyrosine kinase siRNA
tggtctgccgcaaattccgagac

SEQ ID NO: 5843 - DNA, 23 bp, Artificial Sequence
  epidermal growth factor receptor (EGFR), ERBB1 phosphotyrosine kinase siRNA
ggtctgccgcaaattccgagacg

SEQ ID NO: 5844 - DNA, 23 bp, Artificial Sequence
  epidermal growth factor receptor (EGFR), ERBB1 phosphotyrosine kinase siRNA
gtctgccgcaaattccgagacga

SEQ ID NO: 5845 - DNA, 23 bp, Artificial Sequence
  epidermal growth factor receptor (EGFR), ERBB1 phosphotyrosine kinase siRNA
tctgccgcaaattccgagacgaa

SEQ ID NO: 5846 - DNA, 23 bp, Artificial Sequence
  epidermal growth factor receptor (EGFR), ERBB1 phosphotyrosine kinase siRNA
ctgccgcaaattccgagacgaag

SEQ ID NO: 5847 - DNA, 23 bp, Artificial Sequence
  epidermal growth factor receptor (EGFR), ERBB1 phosphotyrosine kinase siRNA
tgccgcaaattccgagacgaagc

SEQ ID NO: 5848 - DNA, 23 bp, Artificial Sequence
  epidermal growth factor receptor (EGFR), ERBB1 phosphotyrosine kinase siRNA
gccgcaaattccgagacgaagcc

SEQ ID NO: 5849 - DNA, 23 bp, Artificial Sequence
  epidermal growth factor receptor (EGFR), ERBB1 phosphotyrosine kinase siRNA
ccgcaaattccgagacgaagcca

SEQ ID NO: 5850 - DNA, 23 bp, Artificial Sequence
  epidermal growth factor receptor (EGFR), ERBB1 phosphotyrosine kinase siRNA
cgcaaattccgagacgaagccac

SEQ ID NO: 5851 - DNA, 23 bp, Artificial Sequence
  epidermal growth factor receptor (EGFR), ERBB1 phosphotyrosine kinase siRNA
gcaaattccgagacgaagccacg

SEQ ID NO: 5852 - DNA, 23 bp, Artificial Sequence
  epidermal growth factor receptor (EGFR), ERBB1 phosphotyrosine kinase siRNA
caaattccgagacgaagccacgt

SEQ ID NO: 5853 - DNA, 23 bp, Artificial Sequence
  epidermal growth factor receptor (EGFR), ERBB1 phosphotyrosine kinase siRNA
aaattccgagacgaagccacgtg

SEQ ID NO: 5854 - DNA, 23 bp, Artificial Sequence
  epidermal growth factor receptor (EGFR), ERBB1 phosphotyrosine kinase siRNA
aattccgagacgaagccacgtgc

SEQ ID NO: 5855 - DNA, 23 bp, Artificial Sequence
  epidermal growth factor receptor (EGFR), ERBB1 phosphotyrosine kinase siRNA
attccgagacgaagccacgtgca

SEQ ID NO: 5856 - DNA, 23 bp, Artificial Sequence
  epidermal growth factor receptor (EGFR), ERBB1 phosphotyrosine kinase siRNA
ttccgagacgaagccacgtgcaa

SEQ ID NO: 5857 - DNA, 23 bp, Artificial Sequence
  epidermal growth factor receptor (EGFR), ERBB1 phosphotyrosine kinase siRNA
tccgagacgaagccacgtgcaag

SEQ ID NO: 5858 - DNA, 23 bp, Artificial Sequence
  epidermal growth factor receptor (EGFR), ERBB1 phosphotyrosine kinase siRNA
ccgagacgaagccacgtgcaagg

SEQ ID NO: 5859 - DNA, 23 bp, Artificial Sequence
  epidermal growth factor receptor (EGFR), ERBB1 phosphotyrosine kinase siRNA
cgagacgaagccacgtgcaagga

SEQ ID NO: 5860 - DNA, 23 bp, Artificial Sequence
  epidermal growth factor receptor (EGFR), ERBB1 phosphotyrosine kinase siRNA
gagacgaagccacgtgcaaggac

SEQ ID NO: 5861 - DNA, 23 bp, Artificial Sequence
  epidermal growth factor receptor (EGFR), ERBB1 phosphotyrosine kinase siRNA
agacgaagccacgtgcaaggaca

SEQ ID NO: 5862 - DNA, 23 bp, Artificial Sequence
  epidermal growth factor receptor (EGFR), ERBB1 phosphotyrosine kinase siRNA
gacgaagccacgtgcaaggacac

SEQ ID NO: 5863 - DNA, 23 bp, Artificial Sequence
  epidermal growth factor receptor (EGFR), ERBB1 phosphotyrosine kinase siRNA
acgaagccacgtgcaaggacacc

SEQ ID NO: 5864 - DNA, 23 bp, Artificial Sequence
  epidermal growth factor receptor (EGFR), ERBB1 phosphotyrosine kinase siRNA
cgaagccacgtgcaaggacacct

SEQ ID NO: 5865 - DNA, 23 bp, Artificial Sequence
  epidermal growth factor receptor (EGFR), ERBB1 phosphotyrosine kinase siRNA
gaagccacgtgcaaggacacctg

SEQ ID NO: 5866 - DNA, 23 bp, Artificial Sequence
  epidermal growth factor receptor (EGFR), ERBB1 phosphotyrosine kinase siRNA
aagccacgtgcaaggacacctgc

SEQ ID NO: 5867 - DNA, 23 bp, Artificial Sequence
  epidermal growth factor receptor (EGFR), ERBB1 phosphotyrosine kinase siRNA
agccacgtgcaaggacacctgcc

SEQ ID NO: 5868 - DNA, 23 bp, Artificial Sequence
  epidermal growth factor receptor (EGFR), ERBB1 phosphotyrosine kinase siRNA
gccacgtgcaaggacacctgccc

SEQ ID NO: 5869 - DNA, 23 bp, Artificial Sequence
  epidermal growth factor receptor (EGFR), ERBB1 phosphotyrosine kinase siRNA
ccacgtgcaaggacacctgcccc

SEQ ID NO: 5870 - DNA, 23 bp, Artificial Sequence
  epidermal growth factor receptor (EGFR), ERBB1 phosphotyrosine kinase siRNA
cacgtgcaaggacacctgccccc

SEQ ID NO: 5871 - DNA, 23 bp, Artificial Sequence
  epidermal growth factor receptor (EGFR), ERBB1 phosphotyrosine kinase siRNA
acgtgcaaggacacctgcccccc

SEQ ID NO: 5872 - DNA, 23 bp, Artificial Sequence
  epidermal growth factor receptor (EGFR), ERBB1 phosphotyrosine kinase siRNA
cgtgcaaggacacctgcccccca

SEQ ID NO: 5873 - DNA, 23 bp, Artificial Sequence
  epidermal growth factor receptor (EGFR), ERBB1 phosphotyrosine kinase siRNA
gtgcaaggacacctgccccccac

SEQ ID NO: 5874 - DNA, 23 bp, Artificial Sequence
  epidermal growth factor receptor (EGFR), ERBB1 phosphotyrosine kinase siRNA
tgcaaggacacctgccccccact

SEQ ID NO: 5875 - DNA, 23 bp, Artificial Sequence
  epidermal growth factor receptor (EGFR), ERBB1 phosphotyrosine kinase siRNA
gcaaggacacctgccccccactc

SEQ ID NO: 5876 - DNA, 23 bp, Artificial Sequence
  epidermal growth factor receptor (EGFR), ERBB1 phosphotyrosine kinase siRNA
caaggacacctgccccccactca

SEQ ID NO: 5877 - DNA, 23 bp, Artificial Sequence
  epidermal growth factor receptor (EGFR), ERBB1 phosphotyrosine kinase siRNA
aaggacacctgccccccactcat

SEQ ID NO: 5878 - DNA, 23 bp, Artificial Sequence
  epidermal growth factor receptor (EGFR), ERBB1 phosphotyrosine kinase siRNA
aggacacctgccccccactcatg

SEQ ID NO: 5879 - DNA, 23 bp, Artificial Sequence
  epidermal growth factor receptor (EGFR), ERBB1 phosphotyrosine kinase siRNA
ggacacctgccccccactcatgc

SEQ ID NO: 5880 - DNA, 23 bp, Artificial Sequence
  epidermal growth factor receptor (EGFR), ERBB1 phosphotyrosine kinase siRNA
gacacctgccccccactcatgct

SEQ ID NO: 5881 - DNA, 23 bp, Artificial Sequence
  epidermal growth factor receptor (EGFR), ERBB1 phosphotyrosine kinase siRNA
acacctgccccccactcatgctc

SEQ ID NO: 5882 - DNA, 23 bp, Artificial Sequence
  epidermal growth factor receptor (EGFR), ERBB1 phosphotyrosine kinase siRNA
cacctgccccccactcatgctct

SEQ ID NO: 5883 - DNA, 23 bp, Artificial Sequence
  epidermal growth factor receptor (EGFR), ERBB1 phosphotyrosine kinase siRNA
acctgccccccactcatgctcta

SEQ ID NO: 5884 - DNA, 23 bp, Artificial Sequence
  epidermal growth factor receptor (EGFR), ERBB1 phosphotyrosine kinase siRNA
cctgccccccactcatgctctac

SEQ ID NO: 5885 - DNA, 23 bp, Artificial Sequence
  epidermal growth factor receptor (EGFR), ERBB1 phosphotyrosine kinase siRNA
ctgccccccactcatgctctaca

SEQ ID NO: 5886 - DNA, 23 bp, Artificial Sequence
  epidermal growth factor receptor (EGFR), ERBB1 phosphotyrosine kinase siRNA
tgccccccactcatgctctacaa

SEQ ID NO: 5887 - DNA, 23 bp, Artificial Sequence
  epidermal growth factor receptor (EGFR), ERBB1 phosphotyrosine kinase siRNA
gccccccactcatgctctacaac

SEQ ID NO: 5888 - DNA, 23 bp, Artificial Sequence
  epidermal growth factor receptor (EGFR), ERBB1 phosphotyrosine kinase siRNA
ccccccactcatgctctacaacc

SEQ ID NO: 5889 - DNA, 23 bp, Artificial Sequence
  epidermal growth factor receptor (EGFR), ERBB1 phosphotyrosine kinase siRNA
cccccactcatgctctacaaccc

SEQ ID NO: 5890 - DNA, 23 bp, Artificial Sequence
  epidermal growth factor receptor (EGFR), ERBB1 phosphotyrosine kinase siRNA
ccccactcatgctctacaacccc

SEQ ID NO: 5891 - DNA, 23 bp, Artificial Sequence
  epidermal growth factor receptor (EGFR), ERBB1 phosphotyrosine kinase siRNA
cccactcatgctctacaacccca

SEQ ID NO: 5892 - DNA, 23 bp, Artificial Sequence
  epidermal growth factor receptor (EGFR), ERBB1 phosphotyrosine kinase siRNA
ccactcatgctctacaaccccac

SEQ ID NO: 5893 - DNA, 23 bp, Artificial Sequence
  epidermal growth factor receptor (EGFR), ERBB1 phosphotyrosine kinase siRNA
cactcatgctctacaaccccacc

SEQ ID NO: 5894 - DNA, 23 bp, Artificial Sequence
  epidermal growth factor receptor (EGFR), ERBB1 phosphotyrosine kinase siRNA
actcatgctctacaaccccacca

SEQ ID NO: 5895 - DNA, 23 bp, Artificial Sequence
  epidermal growth factor receptor (EGFR), ERBB1 phosphotyrosine kinase siRNA
ctcatgctctacaaccccaccac

SEQ ID NO: 5896 - DNA, 23 bp, Artificial Sequence
  epidermal growth factor receptor (EGFR), ERBB1 phosphotyrosine kinase siRNA
tcatgctctacaaccccaccacg

SEQ ID NO: 5897 - DNA, 23 bp, Artificial Sequence
  epidermal growth factor receptor (EGFR), ERBB1 phosphotyrosine kinase siRNA
catgctctacaaccccaccacgt

SEQ ID NO: 5898 - DNA, 23 bp, Artificial Sequence
  epidermal growth factor receptor (EGFR), ERBB1 phosphotyrosine kinase siRNA
atgctctacaaccccaccacgta

SEQ ID NO: 5899 - DNA, 23 bp, Artificial Sequence
  epidermal growth factor receptor (EGFR), ERBB1 phosphotyrosine kinase siRNA
tgctctacaaccccaccacgtac

SEQ ID NO: 5900 - DNA, 23 bp, Artificial Sequence
  epidermal growth factor receptor (EGFR), ERBB1 phosphotyrosine kinase siRNA
gctctacaaccccaccacgtacc

SEQ ID NO: 5901 - DNA, 23 bp, Artificial Sequence
  epidermal growth factor receptor (EGFR), ERBB1 phosphotyrosine kinase siRNA
ctctacaaccccaccacgtacca

SEQ ID NO: 5902 - DNA, 23 bp, Artificial Sequence
  epidermal growth factor receptor (EGFR), ERBB1 phosphotyrosine kinase siRNA
tctacaaccccaccacgtaccag

SEQ ID NO: 5903 - DNA, 23 bp, Artificial Sequence
  epidermal growth factor receptor (EGFR), ERBB1 phosphotyrosine kinase siRNA
ctacaaccccaccacgtaccaga

SEQ ID NO: 5904 - DNA, 23 bp, Artificial Sequence
  epidermal growth factor receptor (EGFR), ERBB1 phosphotyrosine kinase siRNA
tacaaccccaccacgtaccagat

SEQ ID NO: 5905 - DNA, 23 bp, Artificial Sequence
  epidermal growth factor receptor (EGFR), ERBB1 phosphotyrosine kinase siRNA
acaaccccaccacgtaccagatg

SEQ ID NO: 5906 - DNA, 23 bp, Artificial Sequence
  epidermal growth factor receptor (EGFR), ERBB1 phosphotyrosine kinase siRNA
caaccccaccacgtaccagatgg

SEQ ID NO: 5907 - DNA, 23 bp, Artificial Sequence
  epidermal growth factor receptor (EGFR), ERBB1 phosphotyrosine kinase siRNA
aaccccaccacgtaccagatgga

SEQ ID NO: 5908 - DNA, 23 bp, Artificial Sequence
  epidermal growth factor receptor (EGFR), ERBB1 phosphotyrosine kinase siRNA
accccaccacgtaccagatggat

SEQ ID NO: 5909 - DNA, 23 bp, Artificial Sequence
  epidermal growth factor receptor (EGFR), ERBB1 phosphotyrosine kinase siRNA
ccccaccacgtaccagatggatg

SEQ ID NO: 5910 - DNA, 23 bp, Artificial Sequence
  epidermal growth factor receptor (EGFR), ERBB1 phosphotyrosine kinase siRNA
cccaccacgtaccagatggatgt

SEQ ID NO: 5911 - DNA, 23 bp, Artificial Sequence
  epidermal growth factor receptor (EGFR), ERBB1 phosphotyrosine kinase siRNA
ccaccacgtaccagatggatgtg

SEQ ID NO: 5912 - DNA, 23 bp, Artificial Sequence
  epidermal growth factor receptor (EGFR), ERBB1 phosphotyrosine kinase siRNA
caccacgtaccagatggatgtga

SEQ ID NO: 5913 - DNA, 23 bp, Artificial Sequence
  epidermal growth factor receptor (EGFR), ERBB1 phosphotyrosine kinase siRNA
accacgtaccagatggatgtgaa

SEQ ID NO: 5914 - DNA, 23 bp, Artificial Sequence
  epidermal growth factor receptor (EGFR), ERBB1 phosphotyrosine kinase siRNA
ccacgtaccagatggatgtgaac

SEQ ID NO: 5915 - DNA, 23 bp, Artificial Sequence
  epidermal growth factor receptor (EGFR), ERBB1 phosphotyrosine kinase siRNA
cacgtaccagatggatgtgaacc

SEQ ID NO: 5916 - DNA, 23 bp, Artificial Sequence
  epidermal growth factor receptor (EGFR), ERBB1 phosphotyrosine kinase siRNA
acgtaccagatggatgtgaaccc

SEQ ID NO: 5917 - DNA, 23 bp, Artificial Sequence
  epidermal growth factor receptor (EGFR), ERBB1 phosphotyrosine kinase siRNA
cgtaccagatggatgtgaacccc

SEQ ID NO: 5918 - DNA, 23 bp, Artificial Sequence
  epidermal growth factor receptor (EGFR), ERBB1 phosphotyrosine kinase siRNA
gtaccagatggatgtgaaccccg

SEQ ID NO: 5919 - DNA, 23 bp, Artificial Sequence
  epidermal growth factor receptor (EGFR), ERBB1 phosphotyrosine kinase siRNA
taccagatggatgtgaaccccga

SEQ ID NO: 5920 - DNA, 23 bp, Artificial Sequence
  epidermal growth factor receptor (EGFR), ERBB1 phosphotyrosine kinase siRNA
accagatggatgtgaaccccgag

SEQ ID NO: 5921 - DNA, 23 bp, Artificial Sequence
  epidermal growth factor receptor (EGFR), ERBB1 phosphotyrosine kinase siRNA
ccagatggatgtgaaccccgagg

SEQ ID NO: 5922 - DNA, 23 bp, Artificial Sequence
  epidermal growth factor receptor (EGFR), ERBB1 phosphotyrosine kinase siRNA
cagatggatgtgaaccccgaggg

SEQ ID NO: 5923 - DNA, 23 bp, Artificial Sequence
  epidermal growth factor receptor (EGFR), ERBB1 phosphotyrosine kinase siRNA
agatggatgtgaaccccgagggc

SEQ ID NO: 5924 - DNA, 23 bp, Artificial Sequence
  epidermal growth factor receptor (EGFR), ERBB1 phosphotyrosine kinase siRNA
gatggatgtgaaccccgagggca

SEQ ID NO: 5925 - DNA, 23 bp, Artificial Sequence
  epidermal growth factor receptor (EGFR), ERBB1 phosphotyrosine kinase siRNA
atggatgtgaaccccgagggcaa

SEQ ID NO: 5926 - DNA, 23 bp, Artificial Sequence
  epidermal growth factor receptor (EGFR), ERBB1 phosphotyrosine kinase siRNA
tggatgtgaaccccgagggcaaa

SEQ ID NO: 5927 - DNA, 23 bp, Artificial Sequence
  epidermal growth factor receptor (EGFR), ERBB1 phosphotyrosine kinase siRNA
ggatgtgaaccccgagggcaaat

SEQ ID NO: 5928 - DNA, 23 bp, Artificial Sequence
  epidermal growth factor receptor (EGFR), ERBB1 phosphotyrosine kinase siRNA
gatgtgaaccccgagggcaaata

SEQ ID NO: 5929 - DNA, 23 bp, Artificial Sequence
  epidermal growth factor receptor (EGFR), ERBB1 phosphotyrosine kinase siRNA
atgtgaaccccgagggcaaatac

SEQ ID NO: 5930 - DNA, 23 bp, Artificial Sequence
  epidermal growth factor receptor (EGFR), ERBB1 phosphotyrosine kinase siRNA
tgtgaaccccgagggcaaataca

SEQ ID NO: 5931 - DNA, 23 bp, Artificial Sequence
  epidermal growth factor receptor (EGFR), ERBB1 phosphotyrosine kinase siRNA
gtgaaccccgagggcaaatacag

SEQ ID NO: 5932 - DNA, 23 bp, Artificial Sequence
  epidermal growth factor receptor (EGFR), ERBB1 phosphotyrosine kinase siRNA
tgaaccccgagggcaaatacagc

SEQ ID NO: 5933 - DNA, 23 bp, Artificial Sequence
  epidermal growth factor receptor (EGFR), ERBB1 phosphotyrosine kinase siRNA
gaaccccgagggcaaatacagct

SEQ ID NO: 5934 - DNA, 23 bp, Artificial Sequence
  epidermal growth factor receptor (EGFR), ERBB1 phosphotyrosine kinase siRNA
aaccccgagggcaaatacagctt

SEQ ID NO: 5935 - DNA, 23 bp, Artificial Sequence
  epidermal growth factor receptor (EGFR), ERBB1 phosphotyrosine kinase siRNA
accccgagggcaaatacagcttt

SEQ ID NO: 5936 - DNA, 23 bp, Artificial Sequence
  epidermal growth factor receptor (EGFR), ERBB1 phosphotyrosine kinase siRNA
ccccgagggcaaatacagctttg

SEQ ID NO: 5937 - DNA, 23 bp, Artificial Sequence
  epidermal growth factor receptor (EGFR), ERBB1 phosphotyrosine kinase siRNA
cccgagggcaaatacagctttgg

SEQ ID NO: 5938 - DNA, 23 bp, Artificial Sequence
  epidermal growth factor receptor (EGFR), ERBB1 phosphotyrosine kinase siRNA
ccgagggcaaatacagctttggt

SEQ ID NO: 5939 - DNA, 23 bp, Artificial Sequence
  epidermal growth factor receptor (EGFR), ERBB1 phosphotyrosine kinase siRNA
cgagggcaaatacagctttggtg

SEQ ID NO: 5940 - DNA, 23 bp, Artificial Sequence
  epidermal growth factor receptor (EGFR), ERBB1 phosphotyrosine kinase siRNA
gagggcaaatacagctttggtgc

SEQ ID NO: 5941 - DNA, 23 bp, Artificial Sequence
  epidermal growth factor receptor (EGFR), ERBB1 phosphotyrosine kinase siRNA
agggcaaatacagctttggtgcc

SEQ ID NO: 5942 - DNA, 23 bp, Artificial Sequence
  epidermal growth factor receptor (EGFR), ERBB1 phosphotyrosine kinase siRNA
gggcaaatacagctttggtgcca

SEQ ID NO: 5943 - DNA, 23 bp, Artificial Sequence
  epidermal growth factor receptor (EGFR), ERBB1 phosphotyrosine kinase siRNA
ggcaaatacagctttggtgccac

SEQ ID NO: 5944 - DNA, 23 bp, Artificial Sequence
  epidermal growth factor receptor (EGFR), ERBB1 phosphotyrosine kinase siRNA
gcaaatacagctttggtgccacc

SEQ ID NO: 5945 - DNA, 23 bp, Artificial Sequence
  epidermal growth factor receptor (EGFR), ERBB1 phosphotyrosine kinase siRNA
caaatacagctttggtgccacct

SEQ ID NO: 5946 - DNA, 23 bp, Artificial Sequence
  epidermal growth factor receptor (EGFR), ERBB1 phosphotyrosine kinase siRNA
aaatacagctttggtgccacctg

SEQ ID NO: 5947 - DNA, 23 bp, Artificial Sequence
  epidermal growth factor receptor (EGFR), ERBB1 phosphotyrosine kinase siRNA
aatacagctttggtgccacctgc

SEQ ID NO: 5948 - DNA, 23 bp, Artificial Sequence
  epidermal growth factor receptor (EGFR), ERBB1 phosphotyrosine kinase siRNA
atacagctttggtgccacctgcg

SEQ ID NO: 5949 - DNA, 23 bp, Artificial Sequence
  epidermal growth factor receptor (EGFR), ERBB1 phosphotyrosine kinase siRNA
tacagctttggtgccacctgcgt

SEQ ID NO: 5950 - DNA, 23 bp, Artificial Sequence
  epidermal growth factor receptor (EGFR), ERBB1 phosphotyrosine kinase siRNA
acagctttggtgccacctgcgtg

SEQ ID NO: 5951 - DNA, 23 bp, Artificial Sequence
  epidermal growth factor receptor (EGFR), ERBB1 phosphotyrosine kinase siRNA
cagctttggtgccacctgcgtga

SEQ ID NO: 5952 - DNA, 23 bp, Artificial Sequence
  epidermal growth factor receptor (EGFR), ERBB1 phosphotyrosine kinase siRNA
agctttggtgccacctgcgtgaa

SEQ ID NO: 5953 - DNA, 23 bp, Artificial Sequence
  epidermal growth factor receptor (EGFR), ERBB1 phosphotyrosine kinase siRNA
gctttggtgccacctgcgtgaag

SEQ ID NO: 5954 - DNA, 23 bp, Artificial Sequence
  epidermal growth factor receptor (EGFR), ERBB1 phosphotyrosine kinase siRNA
ctttggtgccacctgcgtgaaga

SEQ ID NO: 5955 - DNA, 23 bp, Artificial Sequence
  epidermal growth factor receptor (EGFR), ERBB1 phosphotyrosine kinase siRNA
tttggtgccacctgcgtgaagaa

SEQ ID NO: 5956 - DNA, 23 bp, Artificial Sequence
  epidermal growth factor receptor (EGFR), ERBB1 phosphotyrosine kinase siRNA
ttggtgccacctgcgtgaagaag

SEQ ID NO: 5957 - DNA, 23 bp, Artificial Sequence
  epidermal growth factor receptor (EGFR), ERBB1 phosphotyrosine kinase siRNA
tggtgccacctgcgtgaagaagt

SEQ ID NO: 5958 - DNA, 23 bp, Artificial Sequence
  epidermal growth factor receptor (EGFR), ERBB1 phosphotyrosine kinase siRNA
ggtgccacctgcgtgaagaagtg

SEQ ID NO: 5959 - DNA, 23 bp, Artificial Sequence
  epidermal growth factor receptor (EGFR), ERBB1 phosphotyrosine kinase siRNA
gtgccacctgcgtgaagaagtgt

SEQ ID NO: 5960 - DNA, 23 bp, Artificial Sequence
  epidermal growth factor receptor (EGFR), ERBB1 phosphotyrosine kinase siRNA
tgccacctgcgtgaagaagtgtc

SEQ ID NO: 5961 - DNA, 23 bp, Artificial Sequence
  epidermal growth factor receptor (EGFR), ERBB1 phosphotyrosine kinase siRNA
gccacctgcgtgaagaagtgtcc

SEQ ID NO: 5962 - DNA, 23 bp, Artificial Sequence
  epidermal growth factor receptor (EGFR), ERBB1 phosphotyrosine kinase siRNA
ccacctgcgtgaagaagtgtccc

SEQ ID NO: 5963 - DNA, 23 bp, Artificial Sequence
  epidermal growth factor receptor (EGFR), ERBB1 phosphotyrosine kinase siRNA
cacctgcgtgaagaagtgtcccc

SEQ ID NO: 5964 - DNA, 23 bp, Artificial Sequence
  epidermal growth factor receptor (EGFR), ERBB1 phosphotyrosine kinase siRNA
acctgcgtgaagaagtgtccccg

SEQ ID NO: 5965 - DNA, 23 bp, Artificial Sequence
  epidermal growth factor receptor (EGFR), ERBB1 phosphotyrosine kinase siRNA
cctgcgtgaagaagtgtccccgt

SEQ ID NO: 5966 - DNA, 23 bp, Artificial Sequence
  epidermal growth factor receptor (EGFR), ERBB1 phosphotyrosine kinase siRNA
ctgcgtgaagaagtgtccccgta

SEQ ID NO: 5967 - DNA, 23 bp, Artificial Sequence
  epidermal growth factor receptor (EGFR), ERBB1 phosphotyrosine kinase siRNA
tgcgtgaagaagtgtccccgtaa

SEQ ID NO: 5968 - DNA, 23 bp, Artificial Sequence
  epidermal growth factor receptor (EGFR), ERBB1 phosphotyrosine kinase siRNA
gcgtgaagaagtgtccccgtaat

SEQ ID NO: 5969 - DNA, 23 bp, Artificial Sequence
  epidermal growth factor receptor (EGFR), ERBB1 phosphotyrosine kinase siRNA
cgtgaagaagtgtccccgtaatt

SEQ ID NO: 5970 - DNA, 23 bp, Artificial Sequence
  epidermal growth factor receptor (EGFR), ERBB1 phosphotyrosine kinase siRNA
gtgaagaagtgtccccgtaatta

SEQ ID NO: 5971 - DNA, 23 bp, Artificial Sequence
  epidermal growth factor receptor (EGFR), ERBB1 phosphotyrosine kinase siRNA
tgaagaagtgtccccgtaattat

SEQ ID NO: 5972 - DNA, 23 bp, Artificial Sequence
  epidermal growth factor receptor (EGFR), ERBB1 phosphotyrosine kinase siRNA
gaagaagtgtccccgtaattatg

SEQ ID NO: 5973 - DNA, 23 bp, Artificial Sequence
  epidermal growth factor receptor (EGFR), ERBB1 phosphotyrosine kinase siRNA
aagaagtgtccccgtaattatgt

SEQ ID NO: 5974 - DNA, 23 bp, Artificial Sequence
  epidermal growth factor receptor (EGFR), ERBB1 phosphotyrosine kinase siRNA
agaagtgtccccgtaattatgtg

SEQ ID NO: 5975 - DNA, 23 bp, Artificial Sequence
  epidermal growth factor receptor (EGFR), ERBB1 phosphotyrosine kinase siRNA
gaagtgtccccgtaattatgtgg

SEQ ID NO: 5976 - DNA, 23 bp, Artificial Sequence
  epidermal growth factor receptor (EGFR), ERBB1 phosphotyrosine kinase siRNA
aagtgtccccgtaattatgtggt

SEQ ID NO: 5977 - DNA, 23 bp, Artificial Sequence
  epidermal growth factor receptor (EGFR), ERBB1 phosphotyrosine kinase siRNA
agtgtccccgtaattatgtggtg

SEQ ID NO: 5978 - DNA, 23 bp, Artificial Sequence
  epidermal growth factor receptor (EGFR), ERBB1 phosphotyrosine kinase siRNA
gtgtccccgtaattatgtggtga

SEQ ID NO: 5979 - DNA, 23 bp, Artificial Sequence
  epidermal growth factor receptor (EGFR), ERBB1 phosphotyrosine kinase siRNA
tgtccccgtaattatgtggtgac

SEQ ID NO: 5980 - DNA, 23 bp, Artificial Sequence
  epidermal growth factor receptor (EGFR), ERBB1 phosphotyrosine kinase siRNA
gtccccgtaattatgtggtgaca

SEQ ID NO: 5981 - DNA, 23 bp, Artificial Sequence
  epidermal growth factor receptor (EGFR), ERBB1 phosphotyrosine kinase siRNA
tccccgtaattatgtggtgacag

SEQ ID NO: 5982 - DNA, 23 bp, Artificial Sequence
  epidermal growth factor receptor (EGFR), ERBB1 phosphotyrosine kinase siRNA
ccccgtaattatgtggtgacaga

SEQ ID NO: 5983 - DNA, 23 bp, Artificial Sequence
  epidermal growth factor receptor (EGFR), ERBB1 phosphotyrosine kinase siRNA
cccgtaattatgtggtgacagat

SEQ ID NO: 5984 - DNA, 23 bp, Artificial Sequence
  epidermal growth factor receptor (EGFR), ERBB1 phosphotyrosine kinase siRNA
ccgtaattatgtggtgacagatc

SEQ ID NO: 5985 - DNA, 23 bp, Artificial Sequence
  epidermal growth factor receptor (EGFR), ERBB1 phosphotyrosine kinase siRNA
cgtaattatgtggtgacagatca

SEQ ID NO: 5986 - DNA, 23 bp, Artificial Sequence
  epidermal growth factor receptor (EGFR), ERBB1 phosphotyrosine kinase siRNA
gtaattatgtggtgacagatcac

SEQ ID NO: 5987 - DNA, 23 bp, Artificial Sequence
  epidermal growth factor receptor (EGFR), ERBB1 phosphotyrosine kinase siRNA
taattatgtggtgacagatcacg

SEQ ID NO: 5988 - DNA, 23 bp, Artificial Sequence
  epidermal growth factor receptor (EGFR), ERBB1 phosphotyrosine kinase siRNA
aattatgtggtgacagatcacgg

SEQ ID NO: 5989 - DNA, 23 bp, Artificial Sequence
  epidermal growth factor receptor (EGFR), ERBB1 phosphotyrosine kinase siRNA
attatgtggtgacagatcacggc

SEQ ID NO: 5990 - DNA, 23 bp, Artificial Sequence
  epidermal growth factor receptor (EGFR), ERBB1 phosphotyrosine kinase siRNA
ttatgtggtgacagatcacggct

SEQ ID NO: 5991 - DNA, 23 bp, Artificial Sequence
  epidermal growth factor receptor (EGFR), ERBB1 phosphotyrosine kinase siRNA
tatgtggtgacagatcacggctc

SEQ ID NO: 5992 - DNA, 23 bp, Artificial Sequence
  epidermal growth factor receptor (EGFR), ERBB1 phosphotyrosine kinase siRNA
atgtggtgacagatcacggctcg

SEQ ID NO: 5993 - DNA, 23 bp, Artificial Sequence
  epidermal growth factor receptor (EGFR), ERBB1 phosphotyrosine kinase siRNA
tgtggtgacagatcacggctcgt

SEQ ID NO: 5994 - DNA, 23 bp, Artificial Sequence
  epidermal growth factor receptor (EGFR), ERBB1 phosphotyrosine kinase siRNA
gtggtgacagatcacggctcgtg

SEQ ID NO: 5995 - DNA, 23 bp, Artificial Sequence
  epidermal growth factor receptor (EGFR), ERBB1 phosphotyrosine kinase siRNA
tggtgacagatcacggctcgtgc

SEQ ID NO: 5996 - DNA, 23 bp, Artificial Sequence
  epidermal growth factor receptor (EGFR), ERBB1 phosphotyrosine kinase siRNA
ggtgacagatcacggctcgtgcg

SEQ ID NO: 5997 - DNA, 23 bp, Artificial Sequence
  epidermal growth factor receptor (EGFR), ERBB1 phosphotyrosine kinase siRNA
gtgacagatcacggctcgtgcgt

SEQ ID NO: 5998 - DNA, 23 bp, Artificial Sequence
  epidermal growth factor receptor (EGFR), ERBB1 phosphotyrosine kinase siRNA
tgacagatcacggctcgtgcgtc

SEQ ID NO: 5999 - DNA, 23 bp, Artificial Sequence
  epidermal growth factor receptor (EGFR), ERBB1 phosphotyrosine kinase siRNA
gacagatcacggctcgtgcgtcc

SEQ ID NO: 6000 - DNA, 23 bp, Artificial Sequence
  epidermal growth factor receptor (EGFR), ERBB1 phosphotyrosine kinase siRNA
acagatcacggctcgtgcgtccg

SEQ ID NO: 6001 - DNA, 23 bp, Artificial Sequence
  epidermal growth factor receptor (EGFR), ERBB1 phosphotyrosine kinase siRNA
cagatcacggctcgtgcgtccga

SEQ ID NO: 6002 - DNA, 23 bp, Artificial Sequence
  epidermal growth factor receptor (EGFR), ERBB1 phosphotyrosine kinase siRNA
agatcacggctcgtgcgtccgag

SEQ ID NO: 6003 - DNA, 23 bp, Artificial Sequence
  epidermal growth factor receptor (EGFR), ERBB1 phosphotyrosine kinase siRNA
gatcacggctcgtgcgtccgagc

SEQ ID NO: 6004 - DNA, 23 bp, Artificial Sequence
  epidermal growth factor receptor (EGFR), ERBB1 phosphotyrosine kinase siRNA
atcacggctcgtgcgtccgagcc

SEQ ID NO: 6005 - DNA, 23 bp, Artificial Sequence
  epidermal growth factor receptor (EGFR), ERBB1 phosphotyrosine kinase siRNA
tcacggctcgtgcgtccgagcct

SEQ ID NO: 6006 - DNA, 23 bp, Artificial Sequence
  epidermal growth factor receptor (EGFR), ERBB1 phosphotyrosine kinase siRNA
cacggctcgtgcgtccgagcctg

SEQ ID NO: 6007 - DNA, 23 bp, Artificial Sequence
  epidermal growth factor receptor (EGFR), ERBB1 phosphotyrosine kinase siRNA
acggctcgtgcgtccgagcctgt

SEQ ID NO: 6008 - DNA, 23 bp, Artificial Sequence
  epidermal growth factor receptor (EGFR), ERBB1 phosphotyrosine kinase siRNA
cggctcgtgcgtccgagcctgtg

SEQ ID NO: 6009 - DNA, 23 bp, Artificial Sequence
  epidermal growth factor receptor (EGFR), ERBB1 phosphotyrosine kinase siRNA
ggctcgtgcgtccgagcctgtgg

SEQ ID NO: 6010 - DNA, 23 bp, Artificial Sequence
  epidermal growth factor receptor (EGFR), ERBB1 phosphotyrosine kinase siRNA
gctcgtgcgtccgagcctgtggg

SEQ ID NO: 6011 - DNA, 23 bp, Artificial Sequence
  epidermal growth factor receptor (EGFR), ERBB1 phosphotyrosine kinase siRNA
ctcgtgcgtccgagcctgtgggg

SEQ ID NO: 6012 - DNA, 23 bp, Artificial Sequence
  epidermal growth factor receptor (EGFR), ERBB1 phosphotyrosine kinase siRNA
tcgtgcgtccgagcctgtggggc

SEQ ID NO: 6013 - DNA, 23 bp, Artificial Sequence
  epidermal growth factor receptor (EGFR), ERBB1 phosphotyrosine kinase siRNA
cgtgcgtccgagcctgtggggcc

SEQ ID NO: 6014 - DNA, 23 bp, Artificial Sequence
  epidermal growth factor receptor (EGFR), ERBB1 phosphotyrosine kinase siRNA
gtgcgtccgagcctgtggggccg

SEQ ID NO: 6015 - DNA, 23 bp, Artificial Sequence
  epidermal growth factor receptor (EGFR), ERBB1 phosphotyrosine kinase siRNA
tgcgtccgagcctgtggggccga

SEQ ID NO: 6016 - DNA, 23 bp, Artificial Sequence
  epidermal growth factor receptor (EGFR), ERBB1 phosphotyrosine kinase siRNA
gcgtccgagcctgtggggccgac

SEQ ID NO: 6017 - DNA, 23 bp, Artificial Sequence
  epidermal growth factor receptor (EGFR), ERBB1 phosphotyrosine kinase siRNA
cgtccgagcctgtggggccgaca

SEQ ID NO: 6018 - DNA, 23 bp, Artificial Sequence
  epidermal growth factor receptor (EGFR), ERBB1 phosphotyrosine kinase siRNA
gtccgagcctgtggggccgacag

SEQ ID NO: 6019 - DNA, 23 bp, Artificial Sequence
  epidermal growth factor receptor (EGFR), ERBB1 phosphotyrosine kinase siRNA
tccgagcctgtggggccgacagc

SEQ ID NO: 6020 - DNA, 23 bp, Artificial Sequence
  epidermal growth factor receptor (EGFR), ERBB1 phosphotyrosine kinase siRNA
ccgagcctgtggggccgacagct

SEQ ID NO: 6021 - DNA, 23 bp, Artificial Sequence
  epidermal growth factor receptor (EGFR), ERBB1 phosphotyrosine kinase siRNA
cgagcctgtggggccgacagcta

SEQ ID NO: 6022 - DNA, 23 bp, Artificial Sequence
  epidermal growth factor receptor (EGFR), ERBB1 phosphotyrosine kinase siRNA
gagcctgtggggccgacagctat

SEQ ID NO: 6023 - DNA, 23 bp, Artificial Sequence
  epidermal growth factor receptor (EGFR), ERBB1 phosphotyrosine kinase siRNA
agcctgtggggccgacagctatg

SEQ ID NO: 6024 - DNA, 23 bp, Artificial Sequence
  epidermal growth factor receptor (EGFR), ERBB1 phosphotyrosine kinase siRNA
gcctgtggggccgacagctatga

SEQ ID NO: 6025 - DNA, 23 bp, Artificial Sequence
  epidermal growth factor receptor (EGFR), ERBB1 phosphotyrosine kinase siRNA
cctgtggggccgacagctatgag

SEQ ID NO: 6026 - DNA, 23 bp, Artificial Sequence
  epidermal growth factor receptor (EGFR), ERBB1 phosphotyrosine kinase siRNA
ctgtggggccgacagctatgaga

SEQ ID NO: 6027 - DNA, 23 bp, Artificial Sequence
  epidermal growth factor receptor (EGFR), ERBB1 phosphotyrosine kinase siRNA
tgtggggccgacagctatgagat

SEQ ID NO: 6028 - DNA, 23 bp, Artificial Sequence
  epidermal growth factor receptor (EGFR), ERBB1 phosphotyrosine kinase siRNA
gtggggccgacagctatgagatg

SEQ ID NO: 6029 - DNA, 23 bp, Artificial Sequence
  epidermal growth factor receptor (EGFR), ERBB1 phosphotyrosine kinase siRNA
tggggccgacagctatgagatgg

SEQ ID NO: 6030 - DNA, 23 bp, Artificial Sequence
  epidermal growth factor receptor (EGFR), ERBB1 phosphotyrosine kinase siRNA
ggggccgacagctatgagatgga

SEQ ID NO: 6031 - DNA, 23 bp, Artificial Sequence
  epidermal growth factor receptor (EGFR), ERBB1 phosphotyrosine kinase siRNA
gggccgacagctatgagatggag

SEQ ID NO: 6032 - DNA, 23 bp, Artificial Sequence
  epidermal growth factor receptor (EGFR), ERBB1 phosphotyrosine kinase siRNA
ggccgacagctatgagatggagg

SEQ ID NO: 6033 - DNA, 23 bp, Artificial Sequence
  epidermal growth factor receptor (EGFR), ERBB1 phosphotyrosine kinase siRNA
gccgacagctatgagatggagga

SEQ ID NO: 6034 - DNA, 23 bp, Artificial Sequence
  epidermal growth factor receptor (EGFR), ERBB1 phosphotyrosine kinase siRNA
ccgacagctatgagatggaggaa

SEQ ID NO: 6035 - DNA, 23 bp, Artificial Sequence
  epidermal growth factor receptor (EGFR), ERBB1 phosphotyrosine kinase siRNA
cgacagctatgagatggaggaag

SEQ ID NO: 6036 - DNA, 23 bp, Artificial Sequence
  epidermal growth factor receptor (EGFR), ERBB1 phosphotyrosine kinase siRNA
gacagctatgagatggaggaaga

SEQ ID NO: 6037 - DNA, 23 bp, Artificial Sequence
  epidermal growth factor receptor (EGFR), ERBB1 phosphotyrosine kinase siRNA
acagctatgagatggaggaagac

SEQ ID NO: 6038 - DNA, 23 bp, Artificial Sequence
  epidermal growth factor receptor (EGFR), ERBB1 phosphotyrosine kinase siRNA
cagctatgagatggaggaagacg

SEQ ID NO: 6039 - DNA, 23 bp, Artificial Sequence
  epidermal growth factor receptor (EGFR), ERBB1 phosphotyrosine kinase siRNA
agctatgagatggaggaagacgg

SEQ ID NO: 6040 - DNA, 23 bp, Artificial Sequence
  epidermal growth factor receptor (EGFR), ERBB1 phosphotyrosine kinase siRNA
gctatgagatggaggaagacggc

SEQ ID NO: 6041 - DNA, 23 bp, Artificial Sequence
  epidermal growth factor receptor (EGFR), ERBB1 phosphotyrosine kinase siRNA
ctatgagatggaggaagacggcg

SEQ ID NO: 6042 - DNA, 23 bp, Artificial Sequence
  epidermal growth factor receptor (EGFR), ERBB1 phosphotyrosine kinase siRNA
tatgagatggaggaagacggcgt

SEQ ID NO: 6043 - DNA, 23 bp, Artificial Sequence
  epidermal growth factor receptor (EGFR), ERBB1 phosphotyrosine kinase siRNA
atgagatggaggaagacggcgtc

SEQ ID NO: 6044 - DNA, 23 bp, Artificial Sequence
  epidermal growth factor receptor (EGFR), ERBB1 phosphotyrosine kinase siRNA
tgagatggaggaagacggcgtcc

SEQ ID NO: 6045 - DNA, 23 bp, Artificial Sequence
  epidermal growth factor receptor (EGFR), ERBB1 phosphotyrosine kinase siRNA
gagatggaggaagacggcgtccg

SEQ ID NO: 6046 - DNA, 23 bp, Artificial Sequence
  epidermal growth factor receptor (EGFR), ERBB1 phosphotyrosine kinase siRNA
agatggaggaagacggcgtccgc

SEQ ID NO: 6047 - DNA, 23 bp, Artificial Sequence
  epidermal growth factor receptor (EGFR), ERBB1 phosphotyrosine kinase siRNA
gatggaggaagacggcgtccgca

SEQ ID NO: 6048 - DNA, 23 bp, Artificial Sequence
  epidermal growth factor receptor (EGFR), ERBB1 phosphotyrosine kinase siRNA
atggaggaagacggcgtccgcaa

SEQ ID NO: 6049 - DNA, 23 bp, Artificial Sequence
  epidermal growth factor receptor (EGFR), ERBB1 phosphotyrosine kinase siRNA
tggaggaagacggcgtccgcaag

SEQ ID NO: 6050 - DNA, 23 bp, Artificial Sequence
  epidermal growth factor receptor (EGFR), ERBB1 phosphotyrosine kinase siRNA
ggaggaagacggcgtccgcaagt

SEQ ID NO: 6051 - DNA, 23 bp, Artificial Sequence
  epidermal growth factor receptor (EGFR), ERBB1 phosphotyrosine kinase siRNA
gaggaagacggcgtccgcaagtg

SEQ ID NO: 6052 - DNA, 23 bp, Artificial Sequence
  epidermal growth factor receptor (EGFR), ERBB1 phosphotyrosine kinase siRNA
aggaagacggcgtccgcaagtgt

SEQ ID NO: 6053 - DNA, 23 bp, Artificial Sequence
  epidermal growth factor receptor (EGFR), ERBB1 phosphotyrosine kinase siRNA
ggaagacggcgtccgcaagtgta

SEQ ID NO: 6054 - DNA, 23 bp, Artificial Sequence
  epidermal growth factor receptor (EGFR), ERBB1 phosphotyrosine kinase siRNA
gaagacggcgtccgcaagtgtaa

SEQ ID NO: 6055 - DNA, 23 bp, Artificial Sequence
  epidermal growth factor receptor (EGFR), ERBB1 phosphotyrosine kinase siRNA
aagacggcgtccgcaagtgtaag

SEQ ID NO: 6056 - DNA, 23 bp, Artificial Sequence
  epidermal growth factor receptor (EGFR), ERBB1 phosphotyrosine kinase siRNA
agacggcgtccgcaagtgtaaga

SEQ ID NO: 6057 - DNA, 23 bp, Artificial Sequence
  epidermal growth factor receptor (EGFR), ERBB1 phosphotyrosine kinase siRNA
gacggcgtccgcaagtgtaagaa

SEQ ID NO: 6058 - DNA, 23 bp, Artificial Sequence
  epidermal growth factor receptor (EGFR), ERBB1 phosphotyrosine kinase siRNA
acggcgtccgcaagtgtaagaag

SEQ ID NO: 6059 - DNA, 23 bp, Artificial Sequence
  epidermal growth factor receptor (EGFR), ERBB1 phosphotyrosine kinase siRNA
cggcgtccgcaagtgtaagaagt

SEQ ID NO: 6060 - DNA, 23 bp, Artificial Sequence
  epidermal growth factor receptor (EGFR), ERBB1 phosphotyrosine kinase siRNA
ggcgtccgcaagtgtaagaagtg

SEQ ID NO: 6061 - DNA, 23 bp, Artificial Sequence
  epidermal growth factor receptor (EGFR), ERBB1 phosphotyrosine kinase siRNA
gcgtccgcaagtgtaagaagtgc

SEQ ID NO: 6062 - DNA, 23 bp, Artificial Sequence
  epidermal growth factor receptor (EGFR), ERBB1 phosphotyrosine kinase siRNA
cgtccgcaagtgtaagaagtgcg

SEQ ID NO: 6063 - DNA, 23 bp, Artificial Sequence
  epidermal growth factor receptor (EGFR), ERBB1 phosphotyrosine kinase siRNA
gtccgcaagtgtaagaagtgcga

SEQ ID NO: 6064 - DNA, 23 bp, Artificial Sequence
  epidermal growth factor receptor (EGFR), ERBB1 phosphotyrosine kinase siRNA
tccgcaagtgtaagaagtgcgaa

SEQ ID NO: 6065 - DNA, 23 bp, Artificial Sequence
  epidermal growth factor receptor (EGFR), ERBB1 phosphotyrosine kinase siRNA
ccgcaagtgtaagaagtgcgaag

SEQ ID NO: 6066 - DNA, 23 bp, Artificial Sequence
  epidermal growth factor receptor (EGFR), ERBB1 phosphotyrosine kinase siRNA
cgcaagtgtaagaagtgcgaagg

SEQ ID NO: 6067 - DNA, 23 bp, Artificial Sequence
  epidermal growth factor receptor (EGFR), ERBB1 phosphotyrosine kinase siRNA
gcaagtgtaagaagtgcgaaggg

SEQ ID NO: 6068 - DNA, 23 bp, Artificial Sequence
  epidermal growth factor receptor (EGFR), ERBB1 phosphotyrosine kinase siRNA
caagtgtaagaagtgcgaagggc

SEQ ID NO: 6069 - DNA, 23 bp, Artificial Sequence
  epidermal growth factor receptor (EGFR), ERBB1 phosphotyrosine kinase siRNA
aagtgtaagaagtgcgaagggcc

SEQ ID NO: 6070 - DNA, 23 bp, Artificial Sequence
  epidermal growth factor receptor (EGFR), ERBB1 phosphotyrosine kinase siRNA
agtgtaagaagtgcgaagggcct

SEQ ID NO: 6071 - DNA, 23 bp, Artificial Sequence
  epidermal growth factor receptor (EGFR), ERBB1 phosphotyrosine kinase siRNA
gtgtaagaagtgcgaagggcctt

SEQ ID NO: 6072 - DNA, 23 bp, Artificial Sequence
  epidermal growth factor receptor (EGFR), ERBB1 phosphotyrosine kinase siRNA
tgtaagaagtgcgaagggccttg

SEQ ID NO: 6073 - DNA, 23 bp, Artificial Sequence
  epidermal growth factor receptor (EGFR), ERBB1 phosphotyrosine kinase siRNA
gtaagaagtgcgaagggccttgc

SEQ ID NO: 6074 - DNA, 23 bp, Artificial Sequence
  epidermal growth factor receptor (EGFR), ERBB1 phosphotyrosine kinase siRNA
taagaagtgcgaagggccttgcc

SEQ ID NO: 6075 - DNA, 23 bp, Artificial Sequence
  epidermal growth factor receptor (EGFR), ERBB1 phosphotyrosine kinase siRNA
aagaagtgcgaagggccttgccg

SEQ ID NO: 6076 - DNA, 23 bp, Artificial Sequence
  epidermal growth factor receptor (EGFR), ERBB1 phosphotyrosine kinase siRNA
agaagtgcgaagggccttgccgc

SEQ ID NO: 6077 - DNA, 23 bp, Artificial Sequence
  epidermal growth factor receptor (EGFR), ERBB1 phosphotyrosine kinase siRNA
gaagtgcgaagggccttgccgca

SEQ ID NO: 6078 - DNA, 23 bp, Artificial Sequence
  epidermal growth factor receptor (EGFR), ERBB1 phosphotyrosine kinase siRNA
aagtgcgaagggccttgccgcaa

SEQ ID NO: 6079 - DNA, 23 bp, Artificial Sequence
  epidermal growth factor receptor (EGFR), ERBB1 phosphotyrosine kinase siRNA
agtgcgaagggccttgccgcaaa

SEQ ID NO: 6080 - DNA, 23 bp, Artificial Sequence
  epidermal growth factor receptor (EGFR), ERBB1 phosphotyrosine kinase siRNA
gtgcgaagggccttgccgcaaag

SEQ ID NO: 6081 - DNA, 23 bp, Artificial Sequence
  epidermal growth factor receptor (EGFR), ERBB1 phosphotyrosine kinase siRNA
tgcgaagggccttgccgcaaagt

SEQ ID NO: 6082 - DNA, 23 bp, Artificial Sequence
  epidermal growth factor receptor (EGFR), ERBB1 phosphotyrosine kinase siRNA
gcgaagggccttgccgcaaagtg

SEQ ID NO: 6083 - DNA, 23 bp, Artificial Sequence
  epidermal growth factor receptor (EGFR), ERBB1 phosphotyrosine kinase siRNA
cgaagggccttgccgcaaagtgt

SEQ ID NO: 6084 - DNA, 23 bp, Artificial Sequence
  epidermal growth factor receptor (EGFR), ERBB1 phosphotyrosine kinase siRNA
gaagggccttgccgcaaagtgtg

SEQ ID NO: 6085 - DNA, 23 bp, Artificial Sequence
  epidermal growth factor receptor (EGFR), ERBB1 phosphotyrosine kinase siRNA
aagggccttgccgcaaagtgtgt

SEQ ID NO: 6086 - DNA, 23 bp, Artificial Sequence
  epidermal growth factor receptor (EGFR), ERBB1 phosphotyrosine kinase siRNA
agggccttgccgcaaagtgtgta

SEQ ID NO: 6087 - DNA, 23 bp, Artificial Sequence
  epidermal growth factor receptor (EGFR), ERBB1 phosphotyrosine kinase siRNA
gggccttgccgcaaagtgtgtaa

SEQ ID NO: 6088 - DNA, 23 bp, Artificial Sequence
  epidermal growth factor receptor (EGFR), ERBB1 phosphotyrosine kinase siRNA
ggccttgccgcaaagtgtgtaac

SEQ ID NO: 6089 - DNA, 23 bp, Artificial Sequence
  epidermal growth factor receptor (EGFR), ERBB1 phosphotyrosine kinase siRNA
gccttgccgcaaagtgtgtaacg

SEQ ID NO: 6090 - DNA, 23 bp, Artificial Sequence
  epidermal growth factor receptor (EGFR), ERBB1 phosphotyrosine kinase siRNA
ccttgccgcaaagtgtgtaacgg

SEQ ID NO: 6091 - DNA, 23 bp, Artificial Sequence
  epidermal growth factor receptor (EGFR), ERBB1 phosphotyrosine kinase siRNA
cttgccgcaaagtgtgtaacgga

SEQ ID NO: 6092 - DNA, 23 bp, Artificial Sequence
  epidermal growth factor receptor (EGFR), ERBB1 phosphotyrosine kinase siRNA
ttgccgcaaagtgtgtaacggaa

SEQ ID NO: 6093 - DNA, 23 bp, Artificial Sequence
  epidermal growth factor receptor (EGFR), ERBB1 phosphotyrosine kinase siRNA
tgccgcaaagtgtgtaacggaat

SEQ ID NO: 6094 - DNA, 23 bp, Artificial Sequence
  epidermal growth factor receptor (EGFR), ERBB1 phosphotyrosine kinase siRNA
gccgcaaagtgtgtaacggaata

SEQ ID NO: 6095 - DNA, 23 bp, Artificial Sequence
  epidermal growth factor receptor (EGFR), ERBB1 phosphotyrosine kinase siRNA
ccgcaaagtgtgtaacggaatag

SEQ ID NO: 6096 - DNA, 23 bp, Artificial Sequence
  epidermal growth factor receptor (EGFR), ERBB1 phosphotyrosine kinase siRNA
cgcaaagtgtgtaacggaatagg

SEQ ID NO: 6097 - DNA, 23 bp, Artificial Sequence
  epidermal growth factor receptor (EGFR), ERBB1 phosphotyrosine kinase siRNA
gcaaagtgtgtaacggaataggt

SEQ ID NO: 6098 - DNA, 23 bp, Artificial Sequence
  epidermal growth factor receptor (EGFR), ERBB1 phosphotyrosine kinase siRNA
caaagtgtgtaacggaataggta

SEQ ID NO: 6099 - DNA, 23 bp, Artificial Sequence
  epidermal growth factor receptor (EGFR), ERBB1 phosphotyrosine kinase siRNA
aaagtgtgtaacggaataggtat

SEQ ID NO: 6100 - DNA, 23 bp, Artificial Sequence
  epidermal growth factor receptor (EGFR), ERBB1 phosphotyrosine kinase siRNA
aagtgtgtaacggaataggtatt

SEQ ID NO: 6101 - DNA, 23 bp, Artificial Sequence
  epidermal growth factor receptor (EGFR), ERBB1 phosphotyrosine kinase siRNA
agtgtgtaacggaataggtattg

SEQ ID NO: 6102 - DNA, 23 bp, Artificial Sequence
  epidermal growth factor receptor (EGFR), ERBB1 phosphotyrosine kinase siRNA
gtgtgtaacggaataggtattgg

SEQ ID NO: 6103 - DNA, 23 bp, Artificial Sequence
  epidermal growth factor receptor (EGFR), ERBB1 phosphotyrosine kinase siRNA
tgtgtaacggaataggtattggt

SEQ ID NO: 6104 - DNA, 23 bp, Artificial Sequence
  epidermal growth factor receptor (EGFR), ERBB1 phosphotyrosine kinase siRNA
gtgtaacggaataggtattggtg

SEQ ID NO: 6105 - DNA, 23 bp, Artificial Sequence
  epidermal growth factor receptor (EGFR), ERBB1 phosphotyrosine kinase siRNA
tgtaacggaataggtattggtga

SEQ ID NO: 6106 - DNA, 23 bp, Artificial Sequence
  epidermal growth factor receptor (EGFR), ERBB1 phosphotyrosine kinase siRNA
gtaacggaataggtattggtgaa

SEQ ID NO: 6107 - DNA, 23 bp, Artificial Sequence
  epidermal growth factor receptor (EGFR), ERBB1 phosphotyrosine kinase siRNA
taacggaataggtattggtgaat

SEQ ID NO: 6108 - DNA, 23 bp, Artificial Sequence
  epidermal growth factor receptor (EGFR), ERBB1 phosphotyrosine kinase siRNA
aacggaataggtattggtgaatt

SEQ ID NO: 6109 - DNA, 23 bp, Artificial Sequence
  epidermal growth factor receptor (EGFR), ERBB1 phosphotyrosine kinase siRNA
acggaataggtattggtgaattt

SEQ ID NO: 6110 - DNA, 23 bp, Artificial Sequence
  epidermal growth factor receptor (EGFR), ERBB1 phosphotyrosine kinase siRNA
cggaataggtattggtgaattta

SEQ ID NO: 6111 - DNA, 23 bp, Artificial Sequence
  epidermal growth factor receptor (EGFR), ERBB1 phosphotyrosine kinase siRNA
ggaataggtattggtgaatttaa

SEQ ID NO: 6112 - DNA, 23 bp, Artificial Sequence
  epidermal growth factor receptor (EGFR), ERBB1 phosphotyrosine kinase siRNA
gaataggtattggtgaatttaaa

SEQ ID NO: 6113 - DNA, 23 bp, Artificial Sequence
  epidermal growth factor receptor (EGFR), ERBB1 phosphotyrosine kinase siRNA
aataggtattggtgaatttaaag

SEQ ID NO: 6114 - DNA, 23 bp, Artificial Sequence
  epidermal growth factor receptor (EGFR), ERBB1 phosphotyrosine kinase siRNA
ataggtattggtgaatttaaaga

SEQ ID NO: 6115 - DNA, 23 bp, Artificial Sequence
  epidermal growth factor receptor (EGFR), ERBB1 phosphotyrosine kinase siRNA
taggtattggtgaatttaaagac

SEQ ID NO: 6116 - DNA, 23 bp, Artificial Sequence
  epidermal growth factor receptor (EGFR), ERBB1 phosphotyrosine kinase siRNA
aggtattggtgaatttaaagact

SEQ ID NO: 6117 - DNA, 23 bp, Artificial Sequence
  epidermal growth factor receptor (EGFR), ERBB1 phosphotyrosine kinase siRNA
ggtattggtgaatttaaagactc

SEQ ID NO: 6118 - DNA, 23 bp, Artificial Sequence
  epidermal growth factor receptor (EGFR), ERBB1 phosphotyrosine kinase siRNA
gtattggtgaatttaaagactca

SEQ ID NO: 6119 - DNA, 23 bp, Artificial Sequence
  epidermal growth factor receptor (EGFR), ERBB1 phosphotyrosine kinase siRNA
tattggtgaatttaaagactcac

SEQ ID NO: 6120 - DNA, 23 bp, Artificial Sequence
  epidermal growth factor receptor (EGFR), ERBB1 phosphotyrosine kinase siRNA
attggtgaatttaaagactcact

SEQ ID NO: 6121 - DNA, 23 bp, Artificial Sequence
  epidermal growth factor receptor (EGFR), ERBB1 phosphotyrosine kinase siRNA
ttggtgaatttaaagactcactc

SEQ ID NO: 6122 - DNA, 23 bp, Artificial Sequence
  epidermal growth factor receptor (EGFR), ERBB1 phosphotyrosine kinase siRNA
tggtgaatttaaagactcactct

SEQ ID NO: 6123 - DNA, 23 bp, Artificial Sequence
  epidermal growth factor receptor (EGFR), ERBB1 phosphotyrosine kinase siRNA
ggtgaatttaaagactcactctc

SEQ ID NO: 6124 - DNA, 23 bp, Artificial Sequence
  epidermal growth factor receptor (EGFR), ERBB1 phosphotyrosine kinase siRNA
gtgaatttaaagactcactctcc

SEQ ID NO: 6125 - DNA, 23 bp, Artificial Sequence
  epidermal growth factor receptor (EGFR), ERBB1 phosphotyrosine kinase siRNA
tgaatttaaagactcactctcca

SEQ ID NO: 6126 - DNA, 23 bp, Artificial Sequence
  epidermal growth factor receptor (EGFR), ERBB1 phosphotyrosine kinase siRNA
gaatttaaagactcactctccat

SEQ ID NO: 6127 - DNA, 23 bp, Artificial Sequence
  epidermal growth factor receptor (EGFR), ERBB1 phosphotyrosine kinase siRNA
aatttaaagactcactctccata

SEQ ID NO: 6128 - DNA, 23 bp, Artificial Sequence
  epidermal growth factor receptor (EGFR), ERBB1 phosphotyrosine kinase siRNA
atttaaagactcactctccataa

SEQ ID NO: 6129 - DNA, 23 bp, Artificial Sequence
  epidermal growth factor receptor (EGFR), ERBB1 phosphotyrosine kinase siRNA
tttaaagactcactctccataaa

SEQ ID NO: 6130 - DNA, 23 bp, Artificial Sequence
  epidermal growth factor receptor (EGFR), ERBB1 phosphotyrosine kinase siRNA
ttaaagactcactctccataaat

SEQ ID NO: 6131 - DNA, 23 bp, Artificial Sequence
  epidermal growth factor receptor (EGFR), ERBB1 phosphotyrosine kinase siRNA
taaagactcactctccataaatg

SEQ ID NO: 6132 - DNA, 23 bp, Artificial Sequence
  epidermal growth factor receptor (EGFR), ERBB1 phosphotyrosine kinase siRNA
aaagactcactctccataaatgc

SEQ ID NO: 6133 - DNA, 23 bp, Artificial Sequence
  epidermal growth factor receptor (EGFR), ERBB1 phosphotyrosine kinase siRNA
aagactcactctccataaatgct

SEQ ID NO: 6134 - DNA, 23 bp, Artificial Sequence
  epidermal growth factor receptor (EGFR), ERBB1 phosphotyrosine kinase siRNA
agactcactctccataaatgcta

SEQ ID NO: 6135 - DNA, 23 bp, Artificial Sequence
  epidermal growth factor receptor (EGFR), ERBB1 phosphotyrosine kinase siRNA
gactcactctccataaatgctac

SEQ ID NO: 6136 - DNA, 23 bp, Artificial Sequence
  epidermal growth factor receptor (EGFR), ERBB1 phosphotyrosine kinase siRNA
actcactctccataaatgctacg

SEQ ID NO: 6137 - DNA, 23 bp, Artificial Sequence
  epidermal growth factor receptor (EGFR), ERBB1 phosphotyrosine kinase siRNA
ctcactctccataaatgctacga

SEQ ID NO: 6138 - DNA, 23 bp, Artificial Sequence
  epidermal growth factor receptor (EGFR), ERBB1 phosphotyrosine kinase siRNA
tcactctccataaatgctacgaa

SEQ ID NO: 6139 - DNA, 23 bp, Artificial Sequence
  epidermal growth factor receptor (EGFR), ERBB1 phosphotyrosine kinase siRNA
cactctccataaatgctacgaat

SEQ ID NO: 6140 - DNA, 23 bp, Artificial Sequence
  epidermal growth factor receptor (EGFR), ERBB1 phosphotyrosine kinase siRNA
actctccataaatgctacgaata

SEQ ID NO: 6141 - DNA, 23 bp, Artificial Sequence
  epidermal growth factor receptor (EGFR), ERBB1 phosphotyrosine kinase siRNA
ctctccataaatgctacgaatat

SEQ ID NO: 6142 - DNA, 23 bp, Artificial Sequence
  epidermal growth factor receptor (EGFR), ERBB1 phosphotyrosine kinase siRNA
tctccataaatgctacgaatatt

SEQ ID NO: 6143 - DNA, 23 bp, Artificial Sequence
  epidermal growth factor receptor (EGFR), ERBB1 phosphotyrosine kinase siRNA
ctccataaatgctacgaatatta

SEQ ID NO: 6144 - DNA, 23 bp, Artificial Sequence
  epidermal growth factor receptor (EGFR), ERBB1 phosphotyrosine kinase siRNA
tccataaatgctacgaatattaa

SEQ ID NO: 6145 - DNA, 23 bp, Artificial Sequence
  epidermal growth factor receptor (EGFR), ERBB1 phosphotyrosine kinase siRNA
ccataaatgctacgaatattaaa

SEQ ID NO: 6146 - DNA, 23 bp, Artificial Sequence
  epidermal growth factor receptor (EGFR), ERBB1 phosphotyrosine kinase siRNA
cataaatgctacgaatattaaac

SEQ ID NO: 6147 - DNA, 23 bp, Artificial Sequence
  epidermal growth factor receptor (EGFR), ERBB1 phosphotyrosine kinase siRNA
ataaatgctacgaatattaaaca

SEQ ID NO: 6148 - DNA, 23 bp, Artificial Sequence
  epidermal growth factor receptor (EGFR), ERBB1 phosphotyrosine kinase siRNA
taaatgctacgaatattaaacac

SEQ ID NO: 6149 - DNA, 23 bp, Artificial Sequence
  epidermal growth factor receptor (EGFR), ERBB1 phosphotyrosine kinase siRNA
aaatgctacgaatattaaacact

SEQ ID NO: 6150 - DNA, 23 bp, Artificial Sequence
  epidermal growth factor receptor (EGFR), ERBB1 phosphotyrosine kinase siRNA
aatgctacgaatattaaacactt

SEQ ID NO: 6151 - DNA, 23 bp, Artificial Sequence
  epidermal growth factor receptor (EGFR), ERBB1 phosphotyrosine kinase siRNA
atgctacgaatattaaacacttc

SEQ ID NO: 6152 - DNA, 23 bp, Artificial Sequence
  epidermal growth factor receptor (EGFR), ERBB1 phosphotyrosine kinase siRNA
tgctacgaatattaaacacttca

SEQ ID NO: 6153 - DNA, 23 bp, Artificial Sequence
  epidermal growth factor receptor (EGFR), ERBB1 phosphotyrosine kinase siRNA
gctacgaatattaaacacttcaa

SEQ ID NO: 6154 - DNA, 23 bp, Artificial Sequence
  epidermal growth factor receptor (EGFR), ERBB1 phosphotyrosine kinase siRNA
ctacgaatattaaacacttcaaa

SEQ ID NO: 6155 - DNA, 23 bp, Artificial Sequence
  epidermal growth factor receptor (EGFR), ERBB1 phosphotyrosine kinase siRNA
tacgaatattaaacacttcaaaa

SEQ ID NO: 6156 - DNA, 23 bp, Artificial Sequence
  epidermal growth factor receptor (EGFR), ERBB1 phosphotyrosine kinase siRNA
acgaatattaaacacttcaaaaa

SEQ ID NO: 6157 - DNA, 23 bp, Artificial Sequence
  epidermal growth factor receptor (EGFR), ERBB1 phosphotyrosine kinase siRNA
cgaatattaaacacttcaaaaac

SEQ ID NO: 6158 - DNA, 23 bp, Artificial Sequence
  epidermal growth factor receptor (EGFR), ERBB1 phosphotyrosine kinase siRNA
gaatattaaacacttcaaaaact

SEQ ID NO: 6159 - DNA, 23 bp, Artificial Sequence
  epidermal growth factor receptor (EGFR), ERBB1 phosphotyrosine kinase siRNA
aatattaaacacttcaaaaactg

SEQ ID NO: 6160 - DNA, 23 bp, Artificial Sequence
  epidermal growth factor receptor (EGFR), ERBB1 phosphotyrosine kinase siRNA
atattaaacacttcaaaaactgc

SEQ ID NO: 6161 - DNA, 23 bp, Artificial Sequence
  epidermal growth factor receptor (EGFR), ERBB1 phosphotyrosine kinase siRNA
tattaaacacttcaaaaactgca

SEQ ID NO: 6162 - DNA, 23 bp, Artificial Sequence
  epidermal growth factor receptor (EGFR), ERBB1 phosphotyrosine kinase siRNA
attaaacacttcaaaaactgcac

SEQ ID NO: 6163 - DNA, 23 bp, Artificial Sequence
  epidermal growth factor receptor (EGFR), ERBB1 phosphotyrosine kinase siRNA
ttaaacacttcaaaaactgcacc

SEQ ID NO: 6164 - DNA, 23 bp, Artificial Sequence
  epidermal growth factor receptor (EGFR), ERBB1 phosphotyrosine kinase siRNA
taaacacttcaaaaactgcacct

SEQ ID NO: 6165 - DNA, 23 bp, Artificial Sequence
  epidermal growth factor receptor (EGFR), ERBB1 phosphotyrosine kinase siRNA
aaacacttcaaaaactgcacctc

SEQ ID NO: 6166 - DNA, 23 bp, Artificial Sequence
  epidermal growth factor receptor (EGFR), ERBB1 phosphotyrosine kinase siRNA
aacacttcaaaaactgcacctcc

SEQ ID NO: 6167 - DNA, 23 bp, Artificial Sequence
  epidermal growth factor receptor (EGFR), ERBB1 phosphotyrosine kinase siRNA
acacttcaaaaactgcacctcca

SEQ ID NO: 6168 - DNA, 23 bp, Artificial Sequence
  epidermal growth factor receptor (EGFR), ERBB1 phosphotyrosine kinase siRNA
cacttcaaaaactgcacctccat

SEQ ID NO: 6169 - DNA, 23 bp, Artificial Sequence
  epidermal growth factor receptor (EGFR), ERBB1 phosphotyrosine kinase siRNA
acttcaaaaactgcacctccatc

SEQ ID NO: 6170 - DNA, 23 bp, Artificial Sequence
  epidermal growth factor receptor (EGFR), ERBB1 phosphotyrosine kinase siRNA
cttcaaaaactgcacctccatca

SEQ ID NO: 6171 - DNA, 23 bp, Artificial Sequence
  epidermal growth factor receptor (EGFR), ERBB1 phosphotyrosine kinase siRNA
ttcaaaaactgcacctccatcag

SEQ ID NO: 6172 - DNA, 23 bp, Artificial Sequence
  epidermal growth factor receptor (EGFR), ERBB1 phosphotyrosine kinase siRNA
tcaaaaactgcacctccatcagt

SEQ ID NO: 6173 - DNA, 23 bp, Artificial Sequence
  epidermal growth factor receptor (EGFR), ERBB1 phosphotyrosine kinase siRNA
caaaaactgcacctccatcagtg

SEQ ID NO: 6174 - DNA, 23 bp, Artificial Sequence
  epidermal growth factor receptor (EGFR), ERBB1 phosphotyrosine kinase siRNA
aaaaactgcacctccatcagtgg

SEQ ID NO: 6175 - DNA, 23 bp, Artificial Sequence
  epidermal growth factor receptor (EGFR), ERBB1 phosphotyrosine kinase siRNA
aaaactgcacctccatcagtggc

SEQ ID NO: 6176 - DNA, 23 bp, Artificial Sequence
  epidermal growth factor receptor (EGFR), ERBB1 phosphotyrosine kinase siRNA
aaactgcacctccatcagtggcg

SEQ ID NO: 6177 - DNA, 23 bp, Artificial Sequence
  epidermal growth factor receptor (EGFR), ERBB1 phosphotyrosine kinase siRNA
aactgcacctccatcagtggcga

SEQ ID NO: 6178 - DNA, 23 bp, Artificial Sequence
  epidermal growth factor receptor (EGFR), ERBB1 phosphotyrosine kinase siRNA
actgcacctccatcagtggcgat

SEQ ID NO: 6179 - DNA, 23 bp, Artificial Sequence
  epidermal growth factor receptor (EGFR), ERBB1 phosphotyrosine kinase siRNA
ctgcacctccatcagtggcgatc

SEQ ID NO: 6180 - DNA, 23 bp, Artificial Sequence
  epidermal growth factor receptor (EGFR), ERBB1 phosphotyrosine kinase siRNA
tgcacctccatcagtggcgatct

SEQ ID NO: 6181 - DNA, 23 bp, Artificial Sequence
  epidermal growth factor receptor (EGFR), ERBB1 phosphotyrosine kinase siRNA
gcacctccatcagtggcgatctc

SEQ ID NO: 6182 - DNA, 23 bp, Artificial Sequence
  epidermal growth factor receptor (EGFR), ERBB1 phosphotyrosine kinase siRNA
cacctccatcagtggcgatctcc

SEQ ID NO: 6183 - DNA, 23 bp, Artificial Sequence
  epidermal growth factor receptor (EGFR), ERBB1 phosphotyrosine kinase siRNA
acctccatcagtggcgatctcca

SEQ ID NO: 6184 - DNA, 23 bp, Artificial Sequence
  epidermal growth factor receptor (EGFR), ERBB1 phosphotyrosine kinase siRNA
cctccatcagtggcgatctccac

SEQ ID NO: 6185 - DNA, 23 bp, Artificial Sequence
  epidermal growth factor receptor (EGFR), ERBB1 phosphotyrosine kinase siRNA
ctccatcagtggcgatctccaca

SEQ ID NO: 6186 - DNA, 23 bp, Artificial Sequence
  epidermal growth factor receptor (EGFR), ERBB1 phosphotyrosine kinase siRNA
tccatcagtggcgatctccacat

SEQ ID NO: 6187 - DNA, 23 bp, Artificial Sequence
  epidermal growth factor receptor (EGFR), ERBB1 phosphotyrosine kinase siRNA
ccatcagtggcgatctccacatc

SEQ ID NO: 6188 - DNA, 23 bp, Artificial Sequence
  epidermal growth factor receptor (EGFR), ERBB1 phosphotyrosine kinase siRNA
catcagtggcgatctccacatcc

SEQ ID NO: 6189 - DNA, 23 bp, Artificial Sequence
  epidermal growth factor receptor (EGFR), ERBB1 phosphotyrosine kinase siRNA
atcagtggcgatctccacatcct

SEQ ID NO: 6190 - DNA, 23 bp, Artificial Sequence
  epidermal growth factor receptor (EGFR), ERBB1 phosphotyrosine kinase siRNA
tcagtggcgatctccacatcctg

SEQ ID NO: 6191 - DNA, 23 bp, Artificial Sequence
  epidermal growth factor receptor (EGFR), ERBB1 phosphotyrosine kinase siRNA
cagtggcgatctccacatcctgc

SEQ ID NO: 6192 - DNA, 23 bp, Artificial Sequence
  epidermal growth factor receptor (EGFR), ERBB1 phosphotyrosine kinase siRNA
agtggcgatctccacatcctgcc

SEQ ID NO: 6193 - DNA, 23 bp, Artificial Sequence
  epidermal growth factor receptor (EGFR), ERBB1 phosphotyrosine kinase siRNA
gtggcgatctccacatcctgccg

SEQ ID NO: 6194 - DNA, 23 bp, Artificial Sequence
  epidermal growth factor receptor (EGFR), ERBB1 phosphotyrosine kinase siRNA
tggcgatctccacatcctgccgg

SEQ ID NO: 6195 - DNA, 23 bp, Artificial Sequence
  epidermal growth factor receptor (EGFR), ERBB1 phosphotyrosine kinase siRNA
ggcgatctccacatcctgccggt

SEQ ID NO: 6196 - DNA, 23 bp, Artificial Sequence
  epidermal growth factor receptor (EGFR), ERBB1 phosphotyrosine kinase siRNA
gcgatctccacatcctgccggtg

SEQ ID NO: 6197 - DNA, 23 bp, Artificial Sequence
  epidermal growth factor receptor (EGFR), ERBB1 phosphotyrosine kinase siRNA
cgatctccacatcctgccggtgg

SEQ ID NO: 6198 - DNA, 23 bp, Artificial Sequence
  epidermal growth factor receptor (EGFR), ERBB1 phosphotyrosine kinase siRNA
gatctccacatcctgccggtggc

SEQ ID NO: 6199 - DNA, 23 bp, Artificial Sequence
  epidermal growth factor receptor (EGFR), ERBB1 phosphotyrosine kinase siRNA
atctccacatcctgccggtggca

SEQ ID NO: 6200 - DNA, 23 bp, Artificial Sequence
  epidermal growth factor receptor (EGFR), ERBB1 phosphotyrosine kinase siRNA
tctccacatcctgccggtggcat

SEQ ID NO: 6201 - DNA, 23 bp, Artificial Sequence
  epidermal growth factor receptor (EGFR), ERBB1 phosphotyrosine kinase siRNA
ctccacatcctgccggtggcatt

SEQ ID NO: 6202 - DNA, 23 bp, Artificial Sequence
  epidermal growth factor receptor (EGFR), ERBB1 phosphotyrosine kinase siRNA
tccacatcctgccggtggcattt

SEQ ID NO: 6203 - DNA, 23 bp, Artificial Sequence
  epidermal growth factor receptor (EGFR), ERBB1 phosphotyrosine kinase siRNA
ccacatcctgccggtggcattta

SEQ ID NO: 6204 - DNA, 23 bp, Artificial Sequence
  epidermal growth factor receptor (EGFR), ERBB1 phosphotyrosine kinase siRNA
cacatcctgccggtggcatttag

SEQ ID NO: 6205 - DNA, 23 bp, Artificial Sequence
  epidermal growth factor receptor (EGFR), ERBB1 phosphotyrosine kinase siRNA
acatcctgccggtggcatttagg

SEQ ID NO: 6206 - DNA, 23 bp, Artificial Sequence
  epidermal growth factor receptor (EGFR), ERBB1 phosphotyrosine kinase siRNA
catcctgccggtggcatttaggg

SEQ ID NO: 6207 - DNA, 23 bp, Artificial Sequence
  epidermal growth factor receptor (EGFR), ERBB1 phosphotyrosine kinase siRNA
atcctgccggtggcatttagggg

SEQ ID NO: 6208 - DNA, 23 bp, Artificial Sequence
  epidermal growth factor receptor (EGFR), ERBB1 phosphotyrosine kinase siRNA
tcctgccggtggcatttaggggt

SEQ ID NO: 6209 - DNA, 23 bp, Artificial Sequence
  epidermal growth factor receptor (EGFR), ERBB1 phosphotyrosine kinase siRNA
cctgccggtggcatttaggggtg

SEQ ID NO: 6210 - DNA, 23 bp, Artificial Sequence
  epidermal growth factor receptor (EGFR), ERBB1 phosphotyrosine kinase siRNA
ctgccggtggcatttaggggtga

SEQ ID NO: 6211 - DNA, 23 bp, Artificial Sequence
  epidermal growth factor receptor (EGFR), ERBB1 phosphotyrosine kinase siRNA
tgccggtggcatttaggggtgac

SEQ ID NO: 6212 - DNA, 23 bp, Artificial Sequence
  epidermal growth factor receptor (EGFR), ERBB1 phosphotyrosine kinase siRNA
gccggtggcatttaggggtgact

SEQ ID NO: 6213 - DNA, 23 bp, Artificial Sequence
  epidermal growth factor receptor (EGFR), ERBB1 phosphotyrosine kinase siRNA
ccggtggcatttaggggtgactc

SEQ ID NO: 6214 - DNA, 23 bp, Artificial Sequence
  epidermal growth factor receptor (EGFR), ERBB1 phosphotyrosine kinase siRNA
cggtggcatttaggggtgactcc

SEQ ID NO: 6215 - DNA, 23 bp, Artificial Sequence
  epidermal growth factor receptor (EGFR), ERBB1 phosphotyrosine kinase siRNA
ggtggcatttaggggtgactcct

SEQ ID NO: 6216 - DNA, 23 bp, Artificial Sequence
  epidermal growth factor receptor (EGFR), ERBB1 phosphotyrosine kinase siRNA
gtggcatttaggggtgactcctt

SEQ ID NO: 6217 - DNA, 23 bp, Artificial Sequence
  epidermal growth factor receptor (EGFR), ERBB1 phosphotyrosine kinase siRNA
tggcatttaggggtgactccttc

SEQ ID NO: 6218 - DNA, 23 bp, Artificial Sequence
  epidermal growth factor receptor (EGFR), ERBB1 phosphotyrosine kinase siRNA
ggcatttaggggtgactccttca

SEQ ID NO: 6219 - DNA, 23 bp, Artificial Sequence
  epidermal growth factor receptor (EGFR), ERBB1 phosphotyrosine kinase siRNA
gcatttaggggtgactccttcac

SEQ ID NO: 6220 - DNA, 23 bp, Artificial Sequence
  epidermal growth factor receptor (EGFR), ERBB1 phosphotyrosine kinase siRNA
catttaggggtgactccttcaca

SEQ ID NO: 6221 - DNA, 23 bp, Artificial Sequence
  epidermal growth factor receptor (EGFR), ERBB1 phosphotyrosine kinase siRNA
atttaggggtgactccttcacac

SEQ ID NO: 6222 - DNA, 23 bp, Artificial Sequence
  epidermal growth factor receptor (EGFR), ERBB1 phosphotyrosine kinase siRNA
tttaggggtgactccttcacaca

SEQ ID NO: 6223 - DNA, 23 bp, Artificial Sequence
  epidermal growth factor receptor (EGFR), ERBB1 phosphotyrosine kinase siRNA
ttaggggtgactccttcacacat

SEQ ID NO: 6224 - DNA, 23 bp, Artificial Sequence
  epidermal growth factor receptor (EGFR), ERBB1 phosphotyrosine kinase siRNA
taggggtgactccttcacacata

SEQ ID NO: 6225 - DNA, 23 bp, Artificial Sequence
  epidermal growth factor receptor (EGFR), ERBB1 phosphotyrosine kinase siRNA
aggggtgactccttcacacatac

SEQ ID NO: 6226 - DNA, 23 bp, Artificial Sequence
  epidermal growth factor receptor (EGFR), ERBB1 phosphotyrosine kinase siRNA
ggggtgactccttcacacatact

SEQ ID NO: 6227 - DNA, 23 bp, Artificial Sequence
  epidermal growth factor receptor (EGFR), ERBB1 phosphotyrosine kinase siRNA
gggtgactccttcacacatactc

SEQ ID NO: 6228 - DNA, 23 bp, Artificial Sequence
  epidermal growth factor receptor (EGFR), ERBB1 phosphotyrosine kinase siRNA
ggtgactccttcacacatactcc

SEQ ID NO: 6229 - DNA, 23 bp, Artificial Sequence
  epidermal growth factor receptor (EGFR), ERBB1 phosphotyrosine kinase siRNA
gtgactccttcacacatactcct

SEQ ID NO: 6230 - DNA, 23 bp, Artificial Sequence
  epidermal growth factor receptor (EGFR), ERBB1 phosphotyrosine kinase siRNA
tgactccttcacacatactcctc

SEQ ID NO: 6231 - DNA, 23 bp, Artificial Sequence
  epidermal growth factor receptor (EGFR), ERBB1 phosphotyrosine kinase siRNA
gactccttcacacatactcctcc

SEQ ID NO: 6232 - DNA, 23 bp, Artificial Sequence
  epidermal growth factor receptor (EGFR), ERBB1 phosphotyrosine kinase siRNA
actccttcacacatactcctcct

SEQ ID NO: 6233 - DNA, 23 bp, Artificial Sequence
  epidermal growth factor receptor (EGFR), ERBB1 phosphotyrosine kinase siRNA
ctccttcacacatactcctcctc

SEQ ID NO: 6234 - DNA, 23 bp, Artificial Sequence
  epidermal growth factor receptor (EGFR), ERBB1 phosphotyrosine kinase siRNA
tccttcacacatactcctcctct

SEQ ID NO: 6235 - DNA, 23 bp, Artificial Sequence
  epidermal growth factor receptor (EGFR), ERBB1 phosphotyrosine kinase siRNA
ccttcacacatactcctcctctg

SEQ ID NO: 6236 - DNA, 23 bp, Artificial Sequence
  epidermal growth factor receptor (EGFR), ERBB1 phosphotyrosine kinase siRNA
cttcacacatactcctcctctgg

SEQ ID NO: 6237 - DNA, 23 bp, Artificial Sequence
  epidermal growth factor receptor (EGFR), ERBB1 phosphotyrosine kinase siRNA
ttcacacatactcctcctctgga

SEQ ID NO: 6238 - DNA, 23 bp, Artificial Sequence
  epidermal growth factor receptor (EGFR), ERBB1 phosphotyrosine kinase siRNA
tcacacatactcctcctctggat

SEQ ID NO: 6239 - DNA, 23 bp, Artificial Sequence
  epidermal growth factor receptor (EGFR), ERBB1 phosphotyrosine kinase siRNA
cacacatactcctcctctggatc

SEQ ID NO: 6240 - DNA, 23 bp, Artificial Sequence
  epidermal growth factor receptor (EGFR), ERBB1 phosphotyrosine kinase siRNA
acacatactcctcctctggatcc

SEQ ID NO: 6241 - DNA, 23 bp, Artificial Sequence
  epidermal growth factor receptor (EGFR), ERBB1 phosphotyrosine kinase siRNA
cacatactcctcctctggatcca

SEQ ID NO: 6242 - DNA, 23 bp, Artificial Sequence
  epidermal growth factor receptor (EGFR), ERBB1 phosphotyrosine kinase siRNA
acatactcctcctctggatccac

SEQ ID NO: 6243 - DNA, 23 bp, Artificial Sequence
  epidermal growth factor receptor (EGFR), ERBB1 phosphotyrosine kinase siRNA
catactcctcctctggatccaca

SEQ ID NO: 6244 - DNA, 23 bp, Artificial Sequence
  epidermal growth factor receptor (EGFR), ERBB1 phosphotyrosine kinase siRNA
atactcctcctctggatccacag

SEQ ID NO: 6245 - DNA, 23 bp, Artificial Sequence
  epidermal growth factor receptor (EGFR), ERBB1 phosphotyrosine kinase siRNA
tactcctcctctggatccacagg

SEQ ID NO: 6246 - DNA, 23 bp, Artificial Sequence
  epidermal growth factor receptor (EGFR), ERBB1 phosphotyrosine kinase siRNA
actcctcctctggatccacagga

SEQ ID NO: 6247 - DNA, 23 bp, Artificial Sequence
  epidermal growth factor receptor (EGFR), ERBB1 phosphotyrosine kinase siRNA
ctcctcctctggatccacaggaa

SEQ ID NO: 6248 - DNA, 23 bp, Artificial Sequence
  epidermal growth factor receptor (EGFR), ERBB1 phosphotyrosine kinase siRNA
tcctcctctggatccacaggaac

SEQ ID NO: 6249 - DNA, 23 bp, Artificial Sequence
  epidermal growth factor receptor (EGFR), ERBB1 phosphotyrosine kinase siRNA
cctcctctggatccacaggaact

SEQ ID NO: 6250 - DNA, 23 bp, Artificial Sequence
  epidermal growth factor receptor (EGFR), ERBB1 phosphotyrosine kinase siRNA
ctcctctggatccacaggaactg

SEQ ID NO: 6251 - DNA, 23 bp, Artificial Sequence
  epidermal growth factor receptor (EGFR), ERBB1 phosphotyrosine kinase siRNA
tcctctggatccacaggaactgg

SEQ ID NO: 6252 - DNA, 23 bp, Artificial Sequence
  epidermal growth factor receptor (EGFR), ERBB1 phosphotyrosine kinase siRNA
cctctggatccacaggaactgga

SEQ ID NO: 6253 - DNA, 23 bp, Artificial Sequence
  epidermal growth factor receptor (EGFR), ERBB1 phosphotyrosine kinase siRNA
ctctggatccacaggaactggat

SEQ ID NO: 6254 - DNA, 23 bp, Artificial Sequence
  epidermal growth factor receptor (EGFR), ERBB1 phosphotyrosine kinase siRNA
tctggatccacaggaactggata

SEQ ID NO: 6255 - DNA, 23 bp, Artificial Sequence
  epidermal growth factor receptor (EGFR), ERBB1 phosphotyrosine kinase siRNA
ctggatccacaggaactggatat

SEQ ID NO: 6256 - DNA, 23 bp, Artificial Sequence
  epidermal growth factor receptor (EGFR), ERBB1 phosphotyrosine kinase siRNA
tggatccacaggaactggatatt

SEQ ID NO: 6257 - DNA, 23 bp, Artificial Sequence
  epidermal growth factor receptor (EGFR), ERBB1 phosphotyrosine kinase siRNA
ggatccacaggaactggatattc

SEQ ID NO: 6258 - DNA, 23 bp, Artificial Sequence
  epidermal growth factor receptor (EGFR), ERBB1 phosphotyrosine kinase siRNA
gatccacaggaactggatattct

SEQ ID NO: 6259 - DNA, 23 bp, Artificial Sequence
  epidermal growth factor receptor (EGFR), ERBB1 phosphotyrosine kinase siRNA
atccacaggaactggatattctg

SEQ ID NO: 6260 - DNA, 23 bp, Artificial Sequence
  epidermal growth factor receptor (EGFR), ERBB1 phosphotyrosine kinase siRNA
tccacaggaactggatattctga

SEQ ID NO: 6261 - DNA, 23 bp, Artificial Sequence
  epidermal growth factor receptor (EGFR), ERBB1 phosphotyrosine kinase siRNA
ccacaggaactggatattctgaa

SEQ ID NO: 6262 - DNA, 23 bp, Artificial Sequence
  epidermal growth factor receptor (EGFR), ERBB1 phosphotyrosine kinase siRNA
cacaggaactggatattctgaaa

SEQ ID NO: 6263 - DNA, 23 bp, Artificial Sequence
  epidermal growth factor receptor (EGFR), ERBB1 phosphotyrosine kinase siRNA
acaggaactggatattctgaaaa

SEQ ID NO: 6264 - DNA, 23 bp, Artificial Sequence
  epidermal growth factor receptor (EGFR), ERBB1 phosphotyrosine kinase siRNA
caggaactggatattctgaaaac

SEQ ID NO: 6265 - DNA, 23 bp, Artificial Sequence
  epidermal growth factor receptor (EGFR), ERBB1 phosphotyrosine kinase siRNA
aggaactggatattctgaaaacc

SEQ ID NO: 6266 - DNA, 23 bp, Artificial Sequence
  epidermal growth factor receptor (EGFR), ERBB1 phosphotyrosine kinase siRNA
ggaactggatattctgaaaaccg

SEQ ID NO: 6267 - DNA, 23 bp, Artificial Sequence
  epidermal growth factor receptor (EGFR), ERBB1 phosphotyrosine kinase siRNA
gaactggatattctgaaaaccgt

SEQ ID NO: 6268 - DNA, 23 bp, Artificial Sequence
  epidermal growth factor receptor (EGFR), ERBB1 phosphotyrosine kinase siRNA
aactggatattctgaaaaccgta

SEQ ID NO: 6269 - DNA, 23 bp, Artificial Sequence
  epidermal growth factor receptor (EGFR), ERBB1 phosphotyrosine kinase siRNA
actggatattctgaaaaccgtaa

SEQ ID NO: 6270 - DNA, 23 bp, Artificial Sequence
  epidermal growth factor receptor (EGFR), ERBB1 phosphotyrosine kinase siRNA
ctggatattctgaaaaccgtaaa

SEQ ID NO: 6271 - DNA, 23 bp, Artificial Sequence
  epidermal growth factor receptor (EGFR), ERBB1 phosphotyrosine kinase siRNA
tggatattctgaaaaccgtaaag

SEQ ID NO: 6272 - DNA, 23 bp, Artificial Sequence
  epidermal growth factor receptor (EGFR), ERBB1 phosphotyrosine kinase siRNA
ggatattctgaaaaccgtaaagg

SEQ ID NO: 6273 - DNA, 23 bp, Artificial Sequence
  epidermal growth factor receptor (EGFR), ERBB1 phosphotyrosine kinase siRNA
gatattctgaaaaccgtaaagga

SEQ ID NO: 6274 - DNA, 23 bp, Artificial Sequence
  epidermal growth factor receptor (EGFR), ERBB1 phosphotyrosine kinase siRNA
atattctgaaaaccgtaaaggaa

SEQ ID NO: 6275 - DNA, 23 bp, Artificial Sequence
  epidermal growth factor receptor (EGFR), ERBB1 phosphotyrosine kinase siRNA
tattctgaaaaccgtaaaggaaa

SEQ ID NO: 6276 - DNA, 23 bp, Artificial Sequence
  epidermal growth factor receptor (EGFR), ERBB1 phosphotyrosine kinase siRNA
attctgaaaaccgtaaaggaaat

SEQ ID NO: 6277 - DNA, 23 bp, Artificial Sequence
  epidermal growth factor receptor (EGFR), ERBB1 phosphotyrosine kinase siRNA
ttctgaaaaccgtaaaggaaatc

SEQ ID NO: 6278 - DNA, 23 bp, Artificial Sequence
  epidermal growth factor receptor (EGFR), ERBB1 phosphotyrosine kinase siRNA
tctgaaaaccgtaaaggaaatca

SEQ ID NO: 6279 - DNA, 23 bp, Artificial Sequence
  epidermal growth factor receptor (EGFR), ERBB1 phosphotyrosine kinase siRNA
ctgaaaaccgtaaaggaaatcac

SEQ ID NO: 6280 - DNA, 23 bp, Artificial Sequence
  epidermal growth factor receptor (EGFR), ERBB1 phosphotyrosine kinase siRNA
tgaaaaccgtaaaggaaatcaca

SEQ ID NO: 6281 - DNA, 23 bp, Artificial Sequence
  epidermal growth factor receptor (EGFR), ERBB1 phosphotyrosine kinase siRNA
gaaaaccgtaaaggaaatcacag

SEQ ID NO: 6282 - DNA, 23 bp, Artificial Sequence
  epidermal growth factor receptor (EGFR), ERBB1 phosphotyrosine kinase siRNA
aaaaccgtaaaggaaatcacagg

SEQ ID NO: 6283 - DNA, 23 bp, Artificial Sequence
  epidermal growth factor receptor (EGFR), ERBB1 phosphotyrosine kinase siRNA
aaaccgtaaaggaaatcacaggg

SEQ ID NO: 6284 - DNA, 23 bp, Artificial Sequence
  epidermal growth factor receptor (EGFR), ERBB1 phosphotyrosine kinase siRNA
aaccgtaaaggaaatcacagggt

SEQ ID NO: 6285 - DNA, 23 bp, Artificial Sequence
  epidermal growth factor receptor (EGFR), ERBB1 phosphotyrosine kinase siRNA
accgtaaaggaaatcacagggtt

SEQ ID NO: 6286 - DNA, 23 bp, Artificial Sequence
  epidermal growth factor receptor (EGFR), ERBB1 phosphotyrosine kinase siRNA
ccgtaaaggaaatcacagggttt

SEQ ID NO: 6287 - DNA, 23 bp, Artificial Sequence
  epidermal growth factor receptor (EGFR), ERBB1 phosphotyrosine kinase siRNA
cgtaaaggaaatcacagggtttt

SEQ ID NO: 6288 - DNA, 23 bp, Artificial Sequence
  epidermal growth factor receptor (EGFR), ERBB1 phosphotyrosine kinase siRNA
gtaaaggaaatcacagggttttt

SEQ ID NO: 6289 - DNA, 23 bp, Artificial Sequence
  epidermal growth factor receptor (EGFR), ERBB1 phosphotyrosine kinase siRNA
taaaggaaatcacagggtttttg

SEQ ID NO: 6290 - DNA, 23 bp, Artificial Sequence
  epidermal growth factor receptor (EGFR), ERBB1 phosphotyrosine kinase siRNA
aaaggaaatcacagggtttttgc

SEQ ID NO: 6291 - DNA, 23 bp, Artificial Sequence
  epidermal growth factor receptor (EGFR), ERBB1 phosphotyrosine kinase siRNA
aaggaaatcacagggtttttgct

SEQ ID NO: 6292 - DNA, 23 bp, Artificial Sequence
  epidermal growth factor receptor (EGFR), ERBB1 phosphotyrosine kinase siRNA
aggaaatcacagggtttttgctg

SEQ ID NO: 6293 - DNA, 23 bp, Artificial Sequence
  epidermal growth factor receptor (EGFR), ERBB1 phosphotyrosine kinase siRNA
ggaaatcacagggtttttgctga

SEQ ID NO: 6294 - DNA, 23 bp, Artificial Sequence
  epidermal growth factor receptor (EGFR), ERBB1 phosphotyrosine kinase siRNA
gaaatcacagggtttttgctgat

SEQ ID NO: 6295 - DNA, 23 bp, Artificial Sequence
  epidermal growth factor receptor (EGFR), ERBB1 phosphotyrosine kinase siRNA
aaatcacagggtttttgctgatt

SEQ ID NO: 6296 - DNA, 23 bp, Artificial Sequence
  epidermal growth factor receptor (EGFR), ERBB1 phosphotyrosine kinase siRNA
aatcacagggtttttgctgattc

SEQ ID NO: 6297 - DNA, 23 bp, Artificial Sequence
  epidermal growth factor receptor (EGFR), ERBB1 phosphotyrosine kinase siRNA
atcacagggtttttgctgattca

SEQ ID NO: 6298 - DNA, 23 bp, Artificial Sequence
  epidermal growth factor receptor (EGFR), ERBB1 phosphotyrosine kinase siRNA
tcacagggtttttgctgattcag

SEQ ID NO: 6299 - DNA, 23 bp, Artificial Sequence
  epidermal growth factor receptor (EGFR), ERBB1 phosphotyrosine kinase siRNA
cacagggtttttgctgattcagg

SEQ ID NO: 6300 - DNA, 23 bp, Artificial Sequence
  epidermal growth factor receptor (EGFR), ERBB1 phosphotyrosine kinase siRNA
acagggtttttgctgattcaggc

SEQ ID NO: 6301 - DNA, 23 bp, Artificial Sequence
  epidermal growth factor receptor (EGFR), ERBB1 phosphotyrosine kinase siRNA
cagggtttttgctgattcaggct

SEQ ID NO: 6302 - DNA, 23 bp, Artificial Sequence
  epidermal growth factor receptor (EGFR), ERBB1 phosphotyrosine kinase siRNA
agggtttttgctgattcaggctt

SEQ ID NO: 6303 - DNA, 23 bp, Artificial Sequence
  epidermal growth factor receptor (EGFR), ERBB1 phosphotyrosine kinase siRNA
gggtttttgctgattcaggcttg

SEQ ID NO: 6304 - DNA, 23 bp, Artificial Sequence
  epidermal growth factor receptor (EGFR), ERBB1 phosphotyrosine kinase siRNA
ggtttttgctgattcaggcttgg

SEQ ID NO: 6305 - DNA, 23 bp, Artificial Sequence
  epidermal growth factor receptor (EGFR), ERBB1 phosphotyrosine kinase siRNA
gtttttgctgattcaggcttggc

SEQ ID NO: 6306 - DNA, 23 bp, Artificial Sequence
  epidermal growth factor receptor (EGFR), ERBB1 phosphotyrosine kinase siRNA
tttttgctgattcaggcttggcc

SEQ ID NO: 6307 - DNA, 23 bp, Artificial Sequence
  epidermal growth factor receptor (EGFR), ERBB1 phosphotyrosine kinase siRNA
ttttgctgattcaggcttggcct

SEQ ID NO: 6308 - DNA, 23 bp, Artificial Sequence
  epidermal growth factor receptor (EGFR), ERBB1 phosphotyrosine kinase siRNA
tttgctgattcaggcttggcctg

SEQ ID NO: 6309 - DNA, 23 bp, Artificial Sequence
  epidermal growth factor receptor (EGFR), ERBB1 phosphotyrosine kinase siRNA
ttgctgattcaggcttggcctga

SEQ ID NO: 6310 - DNA, 23 bp, Artificial Sequence
  epidermal growth factor receptor (EGFR), ERBB1 phosphotyrosine kinase siRNA
tgctgattcaggcttggcctgaa

SEQ ID NO: 6311 - DNA, 23 bp, Artificial Sequence
  epidermal growth factor receptor (EGFR), ERBB1 phosphotyrosine kinase siRNA
gctgattcaggcttggcctgaaa

SEQ ID NO: 6312 - DNA, 23 bp, Artificial Sequence
  epidermal growth factor receptor (EGFR), ERBB1 phosphotyrosine kinase siRNA
ctgattcaggcttggcctgaaaa

SEQ ID NO: 6313 - DNA, 23 bp, Artificial Sequence
  epidermal growth factor receptor (EGFR), ERBB1 phosphotyrosine kinase siRNA
tgattcaggcttggcctgaaaac

SEQ ID NO: 6314 - DNA, 23 bp, Artificial Sequence
  epidermal growth factor receptor (EGFR), ERBB1 phosphotyrosine kinase siRNA
gattcaggcttggcctgaaaaca

SEQ ID NO: 6315 - DNA, 23 bp, Artificial Sequence
  epidermal growth factor receptor (EGFR), ERBB1 phosphotyrosine kinase siRNA
attcaggcttggcctgaaaacag

SEQ ID NO: 6316 - DNA, 23 bp, Artificial Sequence
  epidermal growth factor receptor (EGFR), ERBB1 phosphotyrosine kinase siRNA
ttcaggcttggcctgaaaacagg

SEQ ID NO: 6317 - DNA, 23 bp, Artificial Sequence
  epidermal growth factor receptor (EGFR), ERBB1 phosphotyrosine kinase siRNA
tcaggcttggcctgaaaacagga

SEQ ID NO: 6318 - DNA, 23 bp, Artificial Sequence
  epidermal growth factor receptor (EGFR), ERBB1 phosphotyrosine kinase siRNA
caggcttggcctgaaaacaggac

SEQ ID NO: 6319 - DNA, 23 bp, Artificial Sequence
  epidermal growth factor receptor (EGFR), ERBB1 phosphotyrosine kinase siRNA
aggcttggcctgaaaacaggacg

SEQ ID NO: 6320 - DNA, 23 bp, Artificial Sequence
  epidermal growth factor receptor (EGFR), ERBB1 phosphotyrosine kinase siRNA
ggcttggcctgaaaacaggacgg

SEQ ID NO: 6321 - DNA, 23 bp, Artificial Sequence
  epidermal growth factor receptor (EGFR), ERBB1 phosphotyrosine kinase siRNA
gcttggcctgaaaacaggacgga

SEQ ID NO: 6322 - DNA, 23 bp, Artificial Sequence
  epidermal growth factor receptor (EGFR), ERBB1 phosphotyrosine kinase siRNA
cttggcctgaaaacaggacggac

SEQ ID NO: 6323 - DNA, 23 bp, Artificial Sequence
  epidermal growth factor receptor (EGFR), ERBB1 phosphotyrosine kinase siRNA
ttggcctgaaaacaggacggacc

SEQ ID NO: 6324 - DNA, 23 bp, Artificial Sequence
  epidermal growth factor receptor (EGFR), ERBB1 phosphotyrosine kinase siRNA
tggcctgaaaacaggacggacct

SEQ ID NO: 6325 - DNA, 23 bp, Artificial Sequence
  epidermal growth factor receptor (EGFR), ERBB1 phosphotyrosine kinase siRNA
ggcctgaaaacaggacggacctc

SEQ ID NO: 6326 - DNA, 23 bp, Artificial Sequence
  epidermal growth factor receptor (EGFR), ERBB1 phosphotyrosine kinase siRNA
gcctgaaaacaggacggacctcc

SEQ ID NO: 6327 - DNA, 23 bp, Artificial Sequence
  epidermal growth factor receptor (EGFR), ERBB1 phosphotyrosine kinase siRNA
cctgaaaacaggacggacctcca

SEQ ID NO: 6328 - DNA, 23 bp, Artificial Sequence
  epidermal growth factor receptor (EGFR), ERBB1 phosphotyrosine kinase siRNA
ctgaaaacaggacggacctccat

SEQ ID NO: 6329 - DNA, 23 bp, Artificial Sequence
  epidermal growth factor receptor (EGFR), ERBB1 phosphotyrosine kinase siRNA
tgaaaacaggacggacctccatg

SEQ ID NO: 6330 - DNA, 23 bp, Artificial Sequence
  epidermal growth factor receptor (EGFR), ERBB1 phosphotyrosine kinase siRNA
gaaaacaggacggacctccatgc

SEQ ID NO: 6331 - DNA, 23 bp, Artificial Sequence
  epidermal growth factor receptor (EGFR), ERBB1 phosphotyrosine kinase siRNA
aaaacaggacggacctccatgcc

SEQ ID NO: 6332 - DNA, 23 bp, Artificial Sequence
  epidermal growth factor receptor (EGFR), ERBB1 phosphotyrosine kinase siRNA
aaacaggacggacctccatgcct

SEQ ID NO: 6333 - DNA, 23 bp, Artificial Sequence
  epidermal growth factor receptor (EGFR), ERBB1 phosphotyrosine kinase siRNA
aacaggacggacctccatgcctt

SEQ ID NO: 6334 - DNA, 23 bp, Artificial Sequence
  epidermal growth factor receptor (EGFR), ERBB1 phosphotyrosine kinase siRNA
acaggacggacctccatgccttt

SEQ ID NO: 6335 - DNA, 23 bp, Artificial Sequence
  epidermal growth factor receptor (EGFR), ERBB1 phosphotyrosine kinase siRNA
caggacggacctccatgcctttg

SEQ ID NO: 6336 - DNA, 23 bp, Artificial Sequence
  epidermal growth factor receptor (EGFR), ERBB1 phosphotyrosine kinase siRNA
aggacggacctccatgcctttga

SEQ ID NO: 6337 - DNA, 23 bp, Artificial Sequence
  epidermal growth factor receptor (EGFR), ERBB1 phosphotyrosine kinase siRNA
ggacggacctccatgcctttgag

SEQ ID NO: 6338 - DNA, 23 bp, Artificial Sequence
  epidermal growth factor receptor (EGFR), ERBB1 phosphotyrosine kinase siRNA
gacggacctccatgcctttgaga

SEQ ID NO: 6339 - DNA, 23 bp, Artificial Sequence
  epidermal growth factor receptor (EGFR), ERBB1 phosphotyrosine kinase siRNA
acggacctccatgcctttgagaa

SEQ ID NO: 6340 - DNA, 23 bp, Artificial Sequence
  epidermal growth factor receptor (EGFR), ERBB1 phosphotyrosine kinase siRNA
cggacctccatgcctttgagaac

SEQ ID NO: 6341 - DNA, 23 bp, Artificial Sequence
  epidermal growth factor receptor (EGFR), ERBB1 phosphotyrosine kinase siRNA
ggacctccatgcctttgagaacc

SEQ ID NO: 6342 - DNA, 23 bp, Artificial Sequence
  epidermal growth factor receptor (EGFR), ERBB1 phosphotyrosine kinase siRNA
gacctccatgcctttgagaacct

SEQ ID NO: 6343 - DNA, 23 bp, Artificial Sequence
  epidermal growth factor receptor (EGFR), ERBB1 phosphotyrosine kinase siRNA
acctccatgcctttgagaaccta

SEQ ID NO: 6344 - DNA, 23 bp, Artificial Sequence
  epidermal growth factor receptor (EGFR), ERBB1 phosphotyrosine kinase siRNA
cctccatgcctttgagaacctag

SEQ ID NO: 6345 - DNA, 23 bp, Artificial Sequence
  epidermal growth factor receptor (EGFR), ERBB1 phosphotyrosine kinase siRNA
ctccatgcctttgagaacctaga

SEQ ID NO: 6346 - DNA, 23 bp, Artificial Sequence
  epidermal growth factor receptor (EGFR), ERBB1 phosphotyrosine kinase siRNA
tccatgcctttgagaacctagaa

SEQ ID NO: 6347 - DNA, 23 bp, Artificial Sequence
  epidermal growth factor receptor (EGFR), ERBB1 phosphotyrosine kinase siRNA
ccatgcctttgagaacctagaaa

SEQ ID NO: 6348 - DNA, 23 bp, Artificial Sequence
  epidermal growth factor receptor (EGFR), ERBB1 phosphotyrosine kinase siRNA
catgcctttgagaacctagaaat

SEQ ID NO: 6349 - DNA, 23 bp, Artificial Sequence
  epidermal growth factor receptor (EGFR), ERBB1 phosphotyrosine kinase siRNA
atgcctttgagaacctagaaatc

SEQ ID NO: 6350 - DNA, 23 bp, Artificial Sequence
  epidermal growth factor receptor (EGFR), ERBB1 phosphotyrosine kinase siRNA
tgcctttgagaacctagaaatca

SEQ ID NO: 6351 - DNA, 23 bp, Artificial Sequence
  epidermal growth factor receptor (EGFR), ERBB1 phosphotyrosine kinase siRNA
gcctttgagaacctagaaatcat

SEQ ID NO: 6352 - DNA, 23 bp, Artificial Sequence
  epidermal growth factor receptor (EGFR), ERBB1 phosphotyrosine kinase siRNA
cctttgagaacctagaaatcata

SEQ ID NO: 6353 - DNA, 23 bp, Artificial Sequence
  epidermal growth factor receptor (EGFR), ERBB1 phosphotyrosine kinase siRNA
ctttgagaacctagaaatcatac

SEQ ID NO: 6354 - DNA, 23 bp, Artificial Sequence
  epidermal growth factor receptor (EGFR), ERBB1 phosphotyrosine kinase siRNA
tttgagaacctagaaatcatacg

SEQ ID NO: 6355 - DNA, 23 bp, Artificial Sequence
  epidermal growth factor receptor (EGFR), ERBB1 phosphotyrosine kinase siRNA
ttgagaacctagaaatcatacgc

SEQ ID NO: 6356 - DNA, 23 bp, Artificial Sequence
  epidermal growth factor receptor (EGFR), ERBB1 phosphotyrosine kinase siRNA
tgagaacctagaaatcatacgcg

SEQ ID NO: 6357 - DNA, 23 bp, Artificial Sequence
  epidermal growth factor receptor (EGFR), ERBB1 phosphotyrosine kinase siRNA
gagaacctagaaatcatacgcgg

SEQ ID NO: 6358 - DNA, 23 bp, Artificial Sequence
  epidermal growth factor receptor (EGFR), ERBB1 phosphotyrosine kinase siRNA
agaacctagaaatcatacgcggc

SEQ ID NO: 6359 - DNA, 23 bp, Artificial Sequence
  epidermal growth factor receptor (EGFR), ERBB1 phosphotyrosine kinase siRNA
gaacctagaaatcatacgcggca

SEQ ID NO: 6360 - DNA, 23 bp, Artificial Sequence
  epidermal growth factor receptor (EGFR), ERBB1 phosphotyrosine kinase siRNA
aacctagaaatcatacgcggcag

SEQ ID NO: 6361 - DNA, 23 bp, Artificial Sequence
  epidermal growth factor receptor (EGFR), ERBB1 phosphotyrosine kinase siRNA
acctagaaatcatacgcggcagg

SEQ ID NO: 6362 - DNA, 23 bp, Artificial Sequence
  epidermal growth factor receptor (EGFR), ERBB1 phosphotyrosine kinase siRNA
cctagaaatcatacgcggcagga

SEQ ID NO: 6363 - DNA, 23 bp, Artificial Sequence
  epidermal growth factor receptor (EGFR), ERBB1 phosphotyrosine kinase siRNA
ctagaaatcatacgcggcaggac

SEQ ID NO: 6364 - DNA, 23 bp, Artificial Sequence
  epidermal growth factor receptor (EGFR), ERBB1 phosphotyrosine kinase siRNA
tagaaatcatacgcggcaggacc

SEQ ID NO: 6365 - DNA, 23 bp, Artificial Sequence
  epidermal growth factor receptor (EGFR), ERBB1 phosphotyrosine kinase siRNA
agaaatcatacgcggcaggacca

SEQ ID NO: 6366 - DNA, 23 bp, Artificial Sequence
  epidermal growth factor receptor (EGFR), ERBB1 phosphotyrosine kinase siRNA
gaaatcatacgcggcaggaccaa

SEQ ID NO: 6367 - DNA, 23 bp, Artificial Sequence
  epidermal growth factor receptor (EGFR), ERBB1 phosphotyrosine kinase siRNA
aaatcatacgcggcaggaccaag

SEQ ID NO: 6368 - DNA, 23 bp, Artificial Sequence
  epidermal growth factor receptor (EGFR), ERBB1 phosphotyrosine kinase siRNA
aatcatacgcggcaggaccaagc

SEQ ID NO: 6369 - DNA, 23 bp, Artificial Sequence
  epidermal growth factor receptor (EGFR), ERBB1 phosphotyrosine kinase siRNA
atcatacgcggcaggaccaagca

SEQ ID NO: 6370 - DNA, 23 bp, Artificial Sequence
  epidermal growth factor receptor (EGFR), ERBB1 phosphotyrosine kinase siRNA
tcatacgcggcaggaccaagcaa

SEQ ID NO: 6371 - DNA, 23 bp, Artificial Sequence
  epidermal growth factor receptor (EGFR), ERBB1 phosphotyrosine kinase siRNA
catacgcggcaggaccaagcaac

SEQ ID NO: 6372 - DNA, 23 bp, Artificial Sequence
  epidermal growth factor receptor (EGFR), ERBB1 phosphotyrosine kinase siRNA
atacgcggcaggaccaagcaaca

SEQ ID NO: 6373 - DNA, 23 bp, Artificial Sequence
  epidermal growth factor receptor (EGFR), ERBB1 phosphotyrosine kinase siRNA
tacgcggcaggaccaagcaacat

SEQ ID NO: 6374 - DNA, 23 bp, Artificial Sequence
  epidermal growth factor receptor (EGFR), ERBB1 phosphotyrosine kinase siRNA
acgcggcaggaccaagcaacatg

SEQ ID NO: 6375 - DNA, 23 bp, Artificial Sequence
  epidermal growth factor receptor (EGFR), ERBB1 phosphotyrosine kinase siRNA
cgcggcaggaccaagcaacatgg

SEQ ID NO: 6376 - DNA, 23 bp, Artificial Sequence
  epidermal growth factor receptor (EGFR), ERBB1 phosphotyrosine kinase siRNA
gcggcaggaccaagcaacatggt

SEQ ID NO: 6377 - DNA, 23 bp, Artificial Sequence
  epidermal growth factor receptor (EGFR), ERBB1 phosphotyrosine kinase siRNA
cggcaggaccaagcaacatggtc

SEQ ID NO: 6378 - DNA, 23 bp, Artificial Sequence
  epidermal growth factor receptor (EGFR), ERBB1 phosphotyrosine kinase siRNA
ggcaggaccaagcaacatggtca

SEQ ID NO: 6379 - DNA, 23 bp, Artificial Sequence
  epidermal growth factor receptor (EGFR), ERBB1 phosphotyrosine kinase siRNA
gcaggaccaagcaacatggtcag

SEQ ID NO: 6380 - DNA, 23 bp, Artificial Sequence
  epidermal growth factor receptor (EGFR), ERBB1 phosphotyrosine kinase siRNA
caggaccaagcaacatggtcagt

SEQ ID NO: 6381 - DNA, 23 bp, Artificial Sequence
  epidermal growth factor receptor (EGFR), ERBB1 phosphotyrosine kinase siRNA
aggaccaagcaacatggtcagtt

SEQ ID NO: 6382 - DNA, 23 bp, Artificial Sequence
  epidermal growth factor receptor (EGFR), ERBB1 phosphotyrosine kinase siRNA
ggaccaagcaacatggtcagttt

SEQ ID NO: 6383 - DNA, 23 bp, Artificial Sequence
  epidermal growth factor receptor (EGFR), ERBB1 phosphotyrosine kinase siRNA
gaccaagcaacatggtcagtttt

SEQ ID NO: 6384 - DNA, 23 bp, Artificial Sequence
  epidermal growth factor receptor (EGFR), ERBB1 phosphotyrosine kinase siRNA
accaagcaacatggtcagttttc

SEQ ID NO: 6385 - DNA, 23 bp, Artificial Sequence
  epidermal growth factor receptor (EGFR), ERBB1 phosphotyrosine kinase siRNA
ccaagcaacatggtcagttttct

SEQ ID NO: 6386 - DNA, 23 bp, Artificial Sequence
  epidermal growth factor receptor (EGFR), ERBB1 phosphotyrosine kinase siRNA
caagcaacatggtcagttttctc

SEQ ID NO: 6387 - DNA, 23 bp, Artificial Sequence
  epidermal growth factor receptor (EGFR), ERBB1 phosphotyrosine kinase siRNA
aagcaacatggtcagttttctct

SEQ ID NO: 6388 - DNA, 23 bp, Artificial Sequence
  epidermal growth factor receptor (EGFR), ERBB1 phosphotyrosine kinase siRNA
agcaacatggtcagttttctctt

SEQ ID NO: 6389 - DNA, 23 bp, Artificial Sequence
  epidermal growth factor receptor (EGFR), ERBB1 phosphotyrosine kinase siRNA
gcaacatggtcagttttctcttg

SEQ ID NO: 6390 - DNA, 23 bp, Artificial Sequence
  epidermal growth factor receptor (EGFR), ERBB1 phosphotyrosine kinase siRNA
caacatggtcagttttctcttgc

SEQ ID NO: 6391 - DNA, 23 bp, Artificial Sequence
  epidermal growth factor receptor (EGFR), ERBB1 phosphotyrosine kinase siRNA
aacatggtcagttttctcttgca

SEQ ID NO: 6392 - DNA, 23 bp, Artificial Sequence
  epidermal growth factor receptor (EGFR), ERBB1 phosphotyrosine kinase siRNA
acatggtcagttttctcttgcag

SEQ ID NO: 6393 - DNA, 23 bp, Artificial Sequence
  epidermal growth factor receptor (EGFR), ERBB1 phosphotyrosine kinase siRNA
catggtcagttttctcttgcagt

SEQ ID NO: 6394 - DNA, 23 bp, Artificial Sequence
  epidermal growth factor receptor (EGFR), ERBB1 phosphotyrosine kinase siRNA
atggtcagttttctcttgcagtc

SEQ ID NO: 6395 - DNA, 23 bp, Artificial Sequence
  epidermal growth factor receptor (EGFR), ERBB1 phosphotyrosine kinase siRNA
tggtcagttttctcttgcagtcg

SEQ ID NO: 6396 - DNA, 23 bp, Artificial Sequence
  epidermal growth factor receptor (EGFR), ERBB1 phosphotyrosine kinase siRNA
ggtcagttttctcttgcagtcgt

SEQ ID NO: 6397 - DNA, 23 bp, Artificial Sequence
  epidermal growth factor receptor (EGFR), ERBB1 phosphotyrosine kinase siRNA
gtcagttttctcttgcagtcgtc

SEQ ID NO: 6398 - DNA, 23 bp, Artificial Sequence
  epidermal growth factor receptor (EGFR), ERBB1 phosphotyrosine kinase siRNA
tcagttttctcttgcagtcgtca

SEQ ID NO: 6399 - DNA, 23 bp, Artificial Sequence
  epidermal growth factor receptor (EGFR), ERBB1 phosphotyrosine kinase siRNA
cagttttctcttgcagtcgtcag

SEQ ID NO: 6400 - DNA, 23 bp, Artificial Sequence
  epidermal growth factor receptor (EGFR), ERBB1 phosphotyrosine kinase siRNA
agttttctcttgcagtcgtcagc

SEQ ID NO: 6401 - DNA, 23 bp, Artificial Sequence
  epidermal growth factor receptor (EGFR), ERBB1 phosphotyrosine kinase siRNA
gttttctcttgcagtcgtcagcc

SEQ ID NO: 6402 - DNA, 23 bp, Artificial Sequence
  epidermal growth factor receptor (EGFR), ERBB1 phosphotyrosine kinase siRNA
ttttctcttgcagtcgtcagcct

SEQ ID NO: 6403 - DNA, 23 bp, Artificial Sequence
  epidermal growth factor receptor (EGFR), ERBB1 phosphotyrosine kinase siRNA
tttctcttgcagtcgtcagcctg

SEQ ID NO: 6404 - DNA, 23 bp, Artificial Sequence
  epidermal growth factor receptor (EGFR), ERBB1 phosphotyrosine kinase siRNA
ttctcttgcagtcgtcagcctga

SEQ ID NO: 6405 - DNA, 23 bp, Artificial Sequence
  epidermal growth factor receptor (EGFR), ERBB1 phosphotyrosine kinase siRNA
tctcttgcagtcgtcagcctgaa

SEQ ID NO: 6406 - DNA, 23 bp, Artificial Sequence
  epidermal growth factor receptor (EGFR), ERBB1 phosphotyrosine kinase siRNA
ctcttgcagtcgtcagcctgaac

SEQ ID NO: 6407 - DNA, 23 bp, Artificial Sequence
  epidermal growth factor receptor (EGFR), ERBB1 phosphotyrosine kinase siRNA
tcttgcagtcgtcagcctgaaca

SEQ ID NO: 6408 - DNA, 23 bp, Artificial Sequence
  epidermal growth factor receptor (EGFR), ERBB1 phosphotyrosine kinase siRNA
cttgcagtcgtcagcctgaacat

SEQ ID NO: 6409 - DNA, 23 bp, Artificial Sequence
  epidermal growth factor receptor (EGFR), ERBB1 phosphotyrosine kinase siRNA
ttgcagtcgtcagcctgaacata

SEQ ID NO: 6410 - DNA, 23 bp, Artificial Sequence
  epidermal growth factor receptor (EGFR), ERBB1 phosphotyrosine kinase siRNA
tgcagtcgtcagcctgaacataa

SEQ ID NO: 6411 - DNA, 23 bp, Artificial Sequence
  epidermal growth factor receptor (EGFR), ERBB1 phosphotyrosine kinase siRNA
gcagtcgtcagcctgaacataac

SEQ ID NO: 6412 - DNA, 23 bp, Artificial Sequence
  epidermal growth factor receptor (EGFR), ERBB1 phosphotyrosine kinase siRNA
cagtcgtcagcctgaacataaca

SEQ ID NO: 6413 - DNA, 23 bp, Artificial Sequence
  epidermal growth factor receptor (EGFR), ERBB1 phosphotyrosine kinase siRNA
agtcgtcagcctgaacataacat

SEQ ID NO: 6414 - DNA, 23 bp, Artificial Sequence
  epidermal growth factor receptor (EGFR), ERBB1 phosphotyrosine kinase siRNA
gtcgtcagcctgaacataacatc

SEQ ID NO: 6415 - DNA, 23 bp, Artificial Sequence
  epidermal growth factor receptor (EGFR), ERBB1 phosphotyrosine kinase siRNA
tcgtcagcctgaacataacatcc

SEQ ID NO: 6416 - DNA, 23 bp, Artificial Sequence
  epidermal growth factor receptor (EGFR), ERBB1 phosphotyrosine kinase siRNA
cgtcagcctgaacataacatcct

SEQ ID NO: 6417 - DNA, 23 bp, Artificial Sequence
  epidermal growth factor receptor (EGFR), ERBB1 phosphotyrosine kinase siRNA
gtcagcctgaacataacatcctt

SEQ ID NO: 6418 - DNA, 23 bp, Artificial Sequence
  epidermal growth factor receptor (EGFR), ERBB1 phosphotyrosine kinase siRNA
tcagcctgaacataacatccttg

SEQ ID NO: 6419 - DNA, 23 bp, Artificial Sequence
  epidermal growth factor receptor (EGFR), ERBB1 phosphotyrosine kinase siRNA
cagcctgaacataacatccttgg

SEQ ID NO: 6420 - DNA, 23 bp, Artificial Sequence
  epidermal growth factor receptor (EGFR), ERBB1 phosphotyrosine kinase siRNA
agcctgaacataacatccttggg

SEQ ID NO: 6421 - DNA, 23 bp, Artificial Sequence
  epidermal growth factor receptor (EGFR), ERBB1 phosphotyrosine kinase siRNA
gcctgaacataacatccttggga

SEQ ID NO: 6422 - DNA, 23 bp, Artificial Sequence
  epidermal growth factor receptor (EGFR), ERBB1 phosphotyrosine kinase siRNA
cctgaacataacatccttgggat

SEQ ID NO: 6423 - DNA, 23 bp, Artificial Sequence
  epidermal growth factor receptor (EGFR), ERBB1 phosphotyrosine kinase siRNA
ctgaacataacatccttgggatt

SEQ ID NO: 6424 - DNA, 23 bp, Artificial Sequence
  epidermal growth factor receptor (EGFR), ERBB1 phosphotyrosine kinase siRNA
tgaacataacatccttgggatta

SEQ ID NO: 6425 - DNA, 23 bp, Artificial Sequence
  epidermal growth factor receptor (EGFR), ERBB1 phosphotyrosine kinase siRNA
gaacataacatccttgggattac

SEQ ID NO: 6426 - DNA, 23 bp, Artificial Sequence
  epidermal growth factor receptor (EGFR), ERBB1 phosphotyrosine kinase siRNA
aacataacatccttgggattacg

SEQ ID NO: 6427 - DNA, 23 bp, Artificial Sequence
  epidermal growth factor receptor (EGFR), ERBB1 phosphotyrosine kinase siRNA
acataacatccttgggattacgc

SEQ ID NO: 6428 - DNA, 23 bp, Artificial Sequence
  epidermal growth factor receptor (EGFR), ERBB1 phosphotyrosine kinase siRNA
cataacatccttgggattacgct

SEQ ID NO: 6429 - DNA, 23 bp, Artificial Sequence
  epidermal growth factor receptor (EGFR), ERBB1 phosphotyrosine kinase siRNA
ataacatccttgggattacgctc

SEQ ID NO: 6430 - DNA, 23 bp, Artificial Sequence
  epidermal growth factor receptor (EGFR), ERBB1 phosphotyrosine kinase siRNA
taacatccttgggattacgctcc

SEQ ID NO: 6431 - DNA, 23 bp, Artificial Sequence
  epidermal growth factor receptor (EGFR), ERBB1 phosphotyrosine kinase siRNA
aacatccttgggattacgctccc

SEQ ID NO: 6432 - DNA, 23 bp, Artificial Sequence
  epidermal growth factor receptor (EGFR), ERBB1 phosphotyrosine kinase siRNA
acatccttgggattacgctccct

SEQ ID NO: 6433 - DNA, 23 bp, Artificial Sequence
  epidermal growth factor receptor (EGFR), ERBB1 phosphotyrosine kinase siRNA
catccttgggattacgctccctc

SEQ ID NO: 6434 - DNA, 23 bp, Artificial Sequence
  epidermal growth factor receptor (EGFR), ERBB1 phosphotyrosine kinase siRNA
atccttgggattacgctccctca

SEQ ID NO: 6435 - DNA, 23 bp, Artificial Sequence
  epidermal growth factor receptor (EGFR), ERBB1 phosphotyrosine kinase siRNA
tccttgggattacgctccctcaa

SEQ ID NO: 6436 - DNA, 23 bp, Artificial Sequence
  epidermal growth factor receptor (EGFR), ERBB1 phosphotyrosine kinase siRNA
ccttgggattacgctccctcaag

SEQ ID NO: 6437 - DNA, 23 bp, Artificial Sequence
  epidermal growth factor receptor (EGFR), ERBB1 phosphotyrosine kinase siRNA
cttgggattacgctccctcaagg

SEQ ID NO: 6438 - DNA, 23 bp, Artificial Sequence
  epidermal growth factor receptor (EGFR), ERBB1 phosphotyrosine kinase siRNA
ttgggattacgctccctcaagga

SEQ ID NO: 6439 - DNA, 23 bp, Artificial Sequence
  epidermal growth factor receptor (EGFR), ERBB1 phosphotyrosine kinase siRNA
tgggattacgctccctcaaggag

SEQ ID NO: 6440 - DNA, 23 bp, Artificial Sequence
  epidermal growth factor receptor (EGFR), ERBB1 phosphotyrosine kinase siRNA
gggattacgctccctcaaggaga

SEQ ID NO: 6441 - DNA, 23 bp, Artificial Sequence
  epidermal growth factor receptor (EGFR), ERBB1 phosphotyrosine kinase siRNA
ggattacgctccctcaaggagat

SEQ ID NO: 6442 - DNA, 23 bp, Artificial Sequence
  epidermal growth factor receptor (EGFR), ERBB1 phosphotyrosine kinase siRNA
gattacgctccctcaaggagata

SEQ ID NO: 6443 - DNA, 23 bp, Artificial Sequence
  epidermal growth factor receptor (EGFR), ERBB1 phosphotyrosine kinase siRNA
attacgctccctcaaggagataa

SEQ ID NO: 6444 - DNA, 23 bp, Artificial Sequence
  epidermal growth factor receptor (EGFR), ERBB1 phosphotyrosine kinase siRNA
ttacgctccctcaaggagataag

SEQ ID NO: 6445 - DNA, 23 bp, Artificial Sequence
  epidermal growth factor receptor (EGFR), ERBB1 phosphotyrosine kinase siRNA
tacgctccctcaaggagataagt

SEQ ID NO: 6446 - DNA, 23 bp, Artificial Sequence
  epidermal growth factor receptor (EGFR), ERBB1 phosphotyrosine kinase siRNA
acgctccctcaaggagataagtg

SEQ ID NO: 6447 - DNA, 23 bp, Artificial Sequence
  epidermal growth factor receptor (EGFR), ERBB1 phosphotyrosine kinase siRNA
cgctccctcaaggagataagtga

SEQ ID NO: 6448 - DNA, 23 bp, Artificial Sequence
  epidermal growth factor receptor (EGFR), ERBB1 phosphotyrosine kinase siRNA
gctccctcaaggagataagtgat

SEQ ID NO: 6449 - DNA, 23 bp, Artificial Sequence
  epidermal growth factor receptor (EGFR), ERBB1 phosphotyrosine kinase siRNA
ctccctcaaggagataagtgatg

SEQ ID NO: 6450 - DNA, 23 bp, Artificial Sequence
  epidermal growth factor receptor (EGFR), ERBB1 phosphotyrosine kinase siRNA
tccctcaaggagataagtgatgg

SEQ ID NO: 6451 - DNA, 23 bp, Artificial Sequence
  epidermal growth factor receptor (EGFR), ERBB1 phosphotyrosine kinase siRNA
ccctcaaggagataagtgatgga

SEQ ID NO: 6452 - DNA, 23 bp, Artificial Sequence
  epidermal growth factor receptor (EGFR), ERBB1 phosphotyrosine kinase siRNA
cctcaaggagataagtgatggag

SEQ ID NO: 6453 - DNA, 23 bp, Artificial Sequence
  epidermal growth factor receptor (EGFR), ERBB1 phosphotyrosine kinase siRNA
ctcaaggagataagtgatggaga

SEQ ID NO: 6454 - DNA, 23 bp, Artificial Sequence
  epidermal growth factor receptor (EGFR), ERBB1 phosphotyrosine kinase siRNA
tcaaggagataagtgatggagat

SEQ ID NO: 6455 - DNA, 23 bp, Artificial Sequence
  epidermal growth factor receptor (EGFR), ERBB1 phosphotyrosine kinase siRNA
caaggagataagtgatggagatg

SEQ ID NO: 6456 - DNA, 23 bp, Artificial Sequence
  epidermal growth factor receptor (EGFR), ERBB1 phosphotyrosine kinase siRNA
aaggagataagtgatggagatgt

SEQ ID NO: 6457 - DNA, 23 bp, Artificial Sequence
  epidermal growth factor receptor (EGFR), ERBB1 phosphotyrosine kinase siRNA
aggagataagtgatggagatgtg

SEQ ID NO: 6458 - DNA, 23 bp, Artificial Sequence
  epidermal growth factor receptor (EGFR), ERBB1 phosphotyrosine kinase siRNA
ggagataagtgatggagatgtga

SEQ ID NO: 6459 - DNA, 23 bp, Artificial Sequence
  epidermal growth factor receptor (EGFR), ERBB1 phosphotyrosine kinase siRNA
gagataagtgatggagatgtgat

SEQ ID NO: 6460 - DNA, 23 bp, Artificial Sequence
  epidermal growth factor receptor (EGFR), ERBB1 phosphotyrosine kinase siRNA
agataagtgatggagatgtgata

SEQ ID NO: 6461 - DNA, 23 bp, Artificial Sequence
  epidermal growth factor receptor (EGFR), ERBB1 phosphotyrosine kinase siRNA
gataagtgatggagatgtgataa

SEQ ID NO: 6462 - DNA, 23 bp, Artificial Sequence
  epidermal growth factor receptor (EGFR), ERBB1 phosphotyrosine kinase siRNA
ataagtgatggagatgtgataat

SEQ ID NO: 6463 - DNA, 23 bp, Artificial Sequence
  epidermal growth factor receptor (EGFR), ERBB1 phosphotyrosine kinase siRNA
taagtgatggagatgtgataatt

SEQ ID NO: 6464 - DNA, 23 bp, Artificial Sequence
  epidermal growth factor receptor (EGFR), ERBB1 phosphotyrosine kinase siRNA
aagtgatggagatgtgataattt

SEQ ID NO: 6465 - DNA, 23 bp, Artificial Sequence
  epidermal growth factor receptor (EGFR), ERBB1 phosphotyrosine kinase siRNA
agtgatggagatgtgataatttc

SEQ ID NO: 6466 - DNA, 23 bp, Artificial Sequence
  epidermal growth factor receptor (EGFR), ERBB1 phosphotyrosine kinase siRNA
gtgatggagatgtgataatttca

SEQ ID NO: 6467 - DNA, 23 bp, Artificial Sequence
  epidermal growth factor receptor (EGFR), ERBB1 phosphotyrosine kinase siRNA
tgatggagatgtgataatttcag

SEQ ID NO: 6468 - DNA, 23 bp, Artificial Sequence
  epidermal growth factor receptor (EGFR), ERBB1 phosphotyrosine kinase siRNA
gatggagatgtgataatttcagg

SEQ ID NO: 6469 - DNA, 23 bp, Artificial Sequence
  epidermal growth factor receptor (EGFR), ERBB1 phosphotyrosine kinase siRNA
atggagatgtgataatttcagga

SEQ ID NO: 6470 - DNA, 23 bp, Artificial Sequence
  epidermal growth factor receptor (EGFR), ERBB1 phosphotyrosine kinase siRNA
tggagatgtgataatttcaggaa

SEQ ID NO: 6471 - DNA, 23 bp, Artificial Sequence
  epidermal growth factor receptor (EGFR), ERBB1 phosphotyrosine kinase siRNA
ggagatgtgataatttcaggaaa

SEQ ID NO: 6472 - DNA, 23 bp, Artificial Sequence
  epidermal growth factor receptor (EGFR), ERBB1 phosphotyrosine kinase siRNA
gagatgtgataatttcaggaaac

SEQ ID NO: 6473 - DNA, 23 bp, Artificial Sequence
  epidermal growth factor receptor (EGFR), ERBB1 phosphotyrosine kinase siRNA
agatgtgataatttcaggaaaca

SEQ ID NO: 6474 - DNA, 23 bp, Artificial Sequence
  epidermal growth factor receptor (EGFR), ERBB1 phosphotyrosine kinase siRNA
gatgtgataatttcaggaaacaa

SEQ ID NO: 6475 - DNA, 23 bp, Artificial Sequence
  epidermal growth factor receptor (EGFR), ERBB1 phosphotyrosine kinase siRNA
atgtgataatttcaggaaacaaa

SEQ ID NO: 6476 - DNA, 23 bp, Artificial Sequence
  epidermal growth factor receptor (EGFR), ERBB1 phosphotyrosine kinase siRNA
tgtgataatttcaggaaacaaaa

SEQ ID NO: 6477 - DNA, 23 bp, Artificial Sequence
  epidermal growth factor receptor (EGFR), ERBB1 phosphotyrosine kinase siRNA
gtgataatttcaggaaacaaaaa

SEQ ID NO: 6478 - DNA, 23 bp, Artificial Sequence
  epidermal growth factor receptor (EGFR), ERBB1 phosphotyrosine kinase siRNA
tgataatttcaggaaacaaaaat

SEQ ID NO: 6479 - DNA, 23 bp, Artificial Sequence
  epidermal growth factor receptor (EGFR), ERBB1 phosphotyrosine kinase siRNA
gataatttcaggaaacaaaaatt

SEQ ID NO: 6480 - DNA, 23 bp, Artificial Sequence
  epidermal growth factor receptor (EGFR), ERBB1 phosphotyrosine kinase siRNA
ataatttcaggaaacaaaaattt

SEQ ID NO: 6481 - DNA, 23 bp, Artificial Sequence
  epidermal growth factor receptor (EGFR), ERBB1 phosphotyrosine kinase siRNA
taatttcaggaaacaaaaatttg

SEQ ID NO: 6482 - DNA, 23 bp, Artificial Sequence
  epidermal growth factor receptor (EGFR), ERBB1 phosphotyrosine kinase siRNA
aatttcaggaaacaaaaatttgt

SEQ ID NO: 6483 - DNA, 23 bp, Artificial Sequence
  epidermal growth factor receptor (EGFR), ERBB1 phosphotyrosine kinase siRNA
atttcaggaaacaaaaatttgtg

SEQ ID NO: 6484 - DNA, 23 bp, Artificial Sequence
  epidermal growth factor receptor (EGFR), ERBB1 phosphotyrosine kinase siRNA
tttcaggaaacaaaaatttgtgc

SEQ ID NO: 6485 - DNA, 23 bp, Artificial Sequence
  epidermal growth factor receptor (EGFR), ERBB1 phosphotyrosine kinase siRNA
ttcaggaaacaaaaatttgtgct

SEQ ID NO: 6486 - DNA, 23 bp, Artificial Sequence
  epidermal growth factor receptor (EGFR), ERBB1 phosphotyrosine kinase siRNA
tcaggaaacaaaaatttgtgcta

SEQ ID NO: 6487 - DNA, 23 bp, Artificial Sequence
  epidermal growth factor receptor (EGFR), ERBB1 phosphotyrosine kinase siRNA
caggaaacaaaaatttgtgctat

SEQ ID NO: 6488 - DNA, 23 bp, Artificial Sequence
  epidermal growth factor receptor (EGFR), ERBB1 phosphotyrosine kinase siRNA
aggaaacaaaaatttgtgctatg

SEQ ID NO: 6489 - DNA, 23 bp, Artificial Sequence
  epidermal growth factor receptor (EGFR), ERBB1 phosphotyrosine kinase siRNA
ggaaacaaaaatttgtgctatgc

SEQ ID NO: 6490 - DNA, 23 bp, Artificial Sequence
  epidermal growth factor receptor (EGFR), ERBB1 phosphotyrosine kinase siRNA
gaaacaaaaatttgtgctatgca

SEQ ID NO: 6491 - DNA, 23 bp, Artificial Sequence
  epidermal growth factor receptor (EGFR), ERBB1 phosphotyrosine kinase siRNA
aaacaaaaatttgtgctatgcaa

SEQ ID NO: 6492 - DNA, 23 bp, Artificial Sequence
  epidermal growth factor receptor (EGFR), ERBB1 phosphotyrosine kinase siRNA
aacaaaaatttgtgctatgcaaa

SEQ ID NO: 6493 - DNA, 23 bp, Artificial Sequence
  epidermal growth factor receptor (EGFR), ERBB1 phosphotyrosine kinase siRNA
acaaaaatttgtgctatgcaaat

SEQ ID NO: 6494 - DNA, 23 bp, Artificial Sequence
  epidermal growth factor receptor (EGFR), ERBB1 phosphotyrosine kinase siRNA
caaaaatttgtgctatgcaaata

SEQ ID NO: 6495 - DNA, 23 bp, Artificial Sequence
  epidermal growth factor receptor (EGFR), ERBB1 phosphotyrosine kinase siRNA
aaaaatttgtgctatgcaaatac

SEQ ID NO: 6496 - DNA, 23 bp, Artificial Sequence
  epidermal growth factor receptor (EGFR), ERBB1 phosphotyrosine kinase siRNA
aaaatttgtgctatgcaaataca

SEQ ID NO: 6497 - DNA, 23 bp, Artificial Sequence
  epidermal growth factor receptor (EGFR), ERBB1 phosphotyrosine kinase siRNA
aaatttgtgctatgcaaatacaa

SEQ ID NO: 6498 - DNA, 23 bp, Artificial Sequence
  epidermal growth factor receptor (EGFR), ERBB1 phosphotyrosine kinase siRNA
aatttgtgctatgcaaatacaat

SEQ ID NO: 6499 - DNA, 23 bp, Artificial Sequence
  epidermal growth factor receptor (EGFR), ERBB1 phosphotyrosine kinase siRNA
atttgtgctatgcaaatacaata

SEQ ID NO: 6500 - DNA, 23 bp, Artificial Sequence
  epidermal growth factor receptor (EGFR), ERBB1 phosphotyrosine kinase siRNA
tttgtgctatgcaaatacaataa

SEQ ID NO: 6501 - DNA, 23 bp, Artificial Sequence
  epidermal growth factor receptor (EGFR), ERBB1 phosphotyrosine kinase siRNA
ttgtgctatgcaaatacaataaa

SEQ ID NO: 6502 - DNA, 23 bp, Artificial Sequence
  epidermal growth factor receptor (EGFR), ERBB1 phosphotyrosine kinase siRNA
tgtgctatgcaaatacaataaac

SEQ ID NO: 6503 - DNA, 23 bp, Artificial Sequence
  epidermal growth factor receptor (EGFR), ERBB1 phosphotyrosine kinase siRNA
gtgctatgcaaatacaataaact

SEQ ID NO: 6504 - DNA, 23 bp, Artificial Sequence
  epidermal growth factor receptor (EGFR), ERBB1 phosphotyrosine kinase siRNA
tgctatgcaaatacaataaactg

SEQ ID NO: 6505 - DNA, 23 bp, Artificial Sequence
  epidermal growth factor receptor (EGFR), ERBB1 phosphotyrosine kinase siRNA
gctatgcaaatacaataaactgg

SEQ ID NO: 6506 - DNA, 23 bp, Artificial Sequence
  epidermal growth factor receptor (EGFR), ERBB1 phosphotyrosine kinase siRNA
ctatgcaaatacaataaactgga

SEQ ID NO: 6507 - DNA, 23 bp, Artificial Sequence
  epidermal growth factor receptor (EGFR), ERBB1 phosphotyrosine kinase siRNA
tatgcaaatacaataaactggaa

SEQ ID NO: 6508 - DNA, 23 bp, Artificial Sequence
  epidermal growth factor receptor (EGFR), ERBB1 phosphotyrosine kinase siRNA
atgcaaatacaataaactggaaa

SEQ ID NO: 6509 - DNA, 23 bp, Artificial Sequence
  epidermal growth factor receptor (EGFR), ERBB1 phosphotyrosine kinase siRNA
tgcaaatacaataaactggaaaa

SEQ ID NO: 6510 - DNA, 23 bp, Artificial Sequence
  epidermal growth factor receptor (EGFR), ERBB1 phosphotyrosine kinase siRNA
gcaaatacaataaactggaaaaa

SEQ ID NO: 6511 - DNA, 23 bp, Artificial Sequence
  epidermal growth factor receptor (EGFR), ERBB1 phosphotyrosine kinase siRNA
caaatacaataaactggaaaaaa

SEQ ID NO: 6512 - DNA, 23 bp, Artificial Sequence
  epidermal growth factor receptor (EGFR), ERBB1 phosphotyrosine kinase siRNA
aaatacaataaactggaaaaaac

SEQ ID NO: 6513 - DNA, 23 bp, Artificial Sequence
  epidermal growth factor receptor (EGFR), ERBB1 phosphotyrosine kinase siRNA
aatacaataaactggaaaaaact

SEQ ID NO: 6514 - DNA, 23 bp, Artificial Sequence
  epidermal growth factor receptor (EGFR), ERBB1 phosphotyrosine kinase siRNA
atacaataaactggaaaaaactg

SEQ ID NO: 6515 - DNA, 23 bp, Artificial Sequence
  epidermal growth factor receptor (EGFR), ERBB1 phosphotyrosine kinase siRNA
tacaataaactggaaaaaactgt

SEQ ID NO: 6516 - DNA, 23 bp, Artificial Sequence
  epidermal growth factor receptor (EGFR), ERBB1 phosphotyrosine kinase siRNA
acaataaactggaaaaaactgtt

SEQ ID NO: 6517 - DNA, 23 bp, Artificial Sequence
  epidermal growth factor receptor (EGFR), ERBB1 phosphotyrosine kinase siRNA
caataaactggaaaaaactgttt

SEQ ID NO: 6518 - DNA, 23 bp, Artificial Sequence
  epidermal growth factor receptor (EGFR), ERBB1 phosphotyrosine kinase siRNA
aataaactggaaaaaactgtttg

SEQ ID NO: 6519 - DNA, 23 bp, Artificial Sequence
  epidermal growth factor receptor (EGFR), ERBB1 phosphotyrosine kinase siRNA
ataaactggaaaaaactgtttgg

SEQ ID NO: 6520 - DNA, 23 bp, Artificial Sequence
  epidermal growth factor receptor (EGFR), ERBB1 phosphotyrosine kinase siRNA
taaactggaaaaaactgtttggg

SEQ ID NO: 6521 - DNA, 23 bp, Artificial Sequence
  epidermal growth factor receptor (EGFR), ERBB1 phosphotyrosine kinase siRNA
aaactggaaaaaactgtttggga

SEQ ID NO: 6522 - DNA, 23 bp, Artificial Sequence
  epidermal growth factor receptor (EGFR), ERBB1 phosphotyrosine kinase siRNA
aactggaaaaaactgtttgggac

SEQ ID NO: 6523 - DNA, 23 bp, Artificial Sequence
  epidermal growth factor receptor (EGFR), ERBB1 phosphotyrosine kinase siRNA
actggaaaaaactgtttgggacc

SEQ ID NO: 6524 - DNA, 23 bp, Artificial Sequence
  epidermal growth factor receptor (EGFR), ERBB1 phosphotyrosine kinase siRNA
ctggaaaaaactgtttgggacct

SEQ ID NO: 6525 - DNA, 23 bp, Artificial Sequence
  epidermal growth factor receptor (EGFR), ERBB1 phosphotyrosine kinase siRNA
tggaaaaaactgtttgggacctc

SEQ ID NO: 6526 - DNA, 23 bp, Artificial Sequence
  epidermal growth factor receptor (EGFR), ERBB1 phosphotyrosine kinase siRNA
ggaaaaaactgtttgggacctcc

SEQ ID NO: 6527 - DNA, 23 bp, Artificial Sequence
  epidermal growth factor receptor (EGFR), ERBB1 phosphotyrosine kinase siRNA
gaaaaaactgtttgggacctccg

SEQ ID NO: 6528 - DNA, 23 bp, Artificial Sequence
  epidermal growth factor receptor (EGFR), ERBB1 phosphotyrosine kinase siRNA
aaaaaactgtttgggacctccgg

SEQ ID NO: 6529 - DNA, 23 bp, Artificial Sequence
  epidermal growth factor receptor (EGFR), ERBB1 phosphotyrosine kinase siRNA
aaaaactgtttgggacctccggt

SEQ ID NO: 6530 - DNA, 23 bp, Artificial Sequence
  epidermal growth factor receptor (EGFR), ERBB1 phosphotyrosine kinase siRNA
aaaactgtttgggacctccggtc

SEQ ID NO: 6531 - DNA, 23 bp, Artificial Sequence
  epidermal growth factor receptor (EGFR), ERBB1 phosphotyrosine kinase siRNA
aaactgtttgggacctccggtca

SEQ ID NO: 6532 - DNA, 23 bp, Artificial Sequence
  epidermal growth factor receptor (EGFR), ERBB1 phosphotyrosine kinase siRNA
aactgtttgggacctccggtcag

SEQ ID NO: 6533 - DNA, 23 bp, Artificial Sequence
  epidermal growth factor receptor (EGFR), ERBB1 phosphotyrosine kinase siRNA
actgtttgggacctccggtcaga

SEQ ID NO: 6534 - DNA, 23 bp, Artificial Sequence
  epidermal growth factor receptor (EGFR), ERBB1 phosphotyrosine kinase siRNA
ctgtttgggacctccggtcagaa

SEQ ID NO: 6535 - DNA, 23 bp, Artificial Sequence
  epidermal growth factor receptor (EGFR), ERBB1 phosphotyrosine kinase siRNA
tgtttgggacctccggtcagaaa

SEQ ID NO: 6536 - DNA, 23 bp, Artificial Sequence
  epidermal growth factor receptor (EGFR), ERBB1 phosphotyrosine kinase siRNA
gtttgggacctccggtcagaaaa

SEQ ID NO: 6537 - DNA, 23 bp, Artificial Sequence
  epidermal growth factor receptor (EGFR), ERBB1 phosphotyrosine kinase siRNA
tttgggacctccggtcagaaaac

SEQ ID NO: 6538 - DNA, 23 bp, Artificial Sequence
  epidermal growth factor receptor (EGFR), ERBB1 phosphotyrosine kinase siRNA
ttgggacctccggtcagaaaacc

SEQ ID NO: 6539 - DNA, 23 bp, Artificial Sequence
  epidermal growth factor receptor (EGFR), ERBB1 phosphotyrosine kinase siRNA
tgggacctccggtcagaaaacca

SEQ ID NO: 6540 - DNA, 23 bp, Artificial Sequence
  epidermal growth factor receptor (EGFR), ERBB1 phosphotyrosine kinase siRNA
gggacctccggtcagaaaaccaa

SEQ ID NO: 6541 - DNA, 23 bp, Artificial Sequence
  epidermal growth factor receptor (EGFR), ERBB1 phosphotyrosine kinase siRNA
ggacctccggtcagaaaaccaaa

SEQ ID NO: 6542 - DNA, 23 bp, Artificial Sequence
  epidermal growth factor receptor (EGFR), ERBB1 phosphotyrosine kinase siRNA
gacctccggtcagaaaaccaaaa

SEQ ID NO: 6543 - DNA, 23 bp, Artificial Sequence
  epidermal growth factor receptor (EGFR), ERBB1 phosphotyrosine kinase siRNA
acctccggtcagaaaaccaaaat

SEQ ID NO: 6544 - DNA, 23 bp, Artificial Sequence
  epidermal growth factor receptor (EGFR), ERBB1 phosphotyrosine kinase siRNA
cctccggtcagaaaaccaaaatt

SEQ ID NO: 6545 - DNA, 23 bp, Artificial Sequence
  epidermal growth factor receptor (EGFR), ERBB1 phosphotyrosine kinase siRNA
ctccggtcagaaaaccaaaatta

SEQ ID NO: 6546 - DNA, 23 bp, Artificial Sequence
  epidermal growth factor receptor (EGFR), ERBB1 phosphotyrosine kinase siRNA
tccggtcagaaaaccaaaattat

SEQ ID NO: 6547 - DNA, 23 bp, Artificial Sequence
  epidermal growth factor receptor (EGFR), ERBB1 phosphotyrosine kinase siRNA
ccggtcagaaaaccaaaattata

SEQ ID NO: 6548 - DNA, 23 bp, Artificial Sequence
  epidermal growth factor receptor (EGFR), ERBB1 phosphotyrosine kinase siRNA
cggtcagaaaaccaaaattataa

SEQ ID NO: 6549 - DNA, 23 bp, Artificial Sequence
  epidermal growth factor receptor (EGFR), ERBB1 phosphotyrosine kinase siRNA
ggtcagaaaaccaaaattataag

SEQ ID NO: 6550 - DNA, 23 bp, Artificial Sequence
  epidermal growth factor receptor (EGFR), ERBB1 phosphotyrosine kinase siRNA
gtcagaaaaccaaaattataagc

SEQ ID NO: 6551 - DNA, 23 bp, Artificial Sequence
  epidermal growth factor receptor (EGFR), ERBB1 phosphotyrosine kinase siRNA
tcagaaaaccaaaattataagca

SEQ ID NO: 6552 - DNA, 23 bp, Artificial Sequence
  epidermal growth factor receptor (EGFR), ERBB1 phosphotyrosine kinase siRNA
cagaaaaccaaaattataagcaa

SEQ ID NO: 6553 - DNA, 23 bp, Artificial Sequence
  epidermal growth factor receptor (EGFR), ERBB1 phosphotyrosine kinase siRNA
agaaaaccaaaattataagcaac

SEQ ID NO: 6554 - DNA, 23 bp, Artificial Sequence
  epidermal growth factor receptor (EGFR), ERBB1 phosphotyrosine kinase siRNA
gaaaaccaaaattataagcaaca

SEQ ID NO: 6555 - DNA, 23 bp, Artificial Sequence
  epidermal growth factor receptor (EGFR), ERBB1 phosphotyrosine kinase siRNA
aaaaccaaaattataagcaacag

SEQ ID NO: 6556 - DNA, 23 bp, Artificial Sequence
  epidermal growth factor receptor (EGFR), ERBB1 phosphotyrosine kinase siRNA
aaaccaaaattataagcaacaga

SEQ ID NO: 6557 - DNA, 23 bp, Artificial Sequence
  epidermal growth factor receptor (EGFR), ERBB1 phosphotyrosine kinase siRNA
aaccaaaattataagcaacagag

SEQ ID NO: 6558 - DNA, 23 bp, Artificial Sequence
  epidermal growth factor receptor (EGFR), ERBB1 phosphotyrosine kinase siRNA
accaaaattataagcaacagagg

SEQ ID NO: 6559 - DNA, 23 bp, Artificial Sequence
  epidermal growth factor receptor (EGFR), ERBB1 phosphotyrosine kinase siRNA
ccaaaattataagcaacagaggt

SEQ ID NO: 6560 - DNA, 23 bp, Artificial Sequence
  epidermal growth factor receptor (EGFR), ERBB1 phosphotyrosine kinase siRNA
caaaattataagcaacagaggtg

SEQ ID NO: 6561 - DNA, 23 bp, Artificial Sequence
  epidermal growth factor receptor (EGFR), ERBB1 phosphotyrosine kinase siRNA
aaaattataagcaacagaggtga

SEQ ID NO: 6562 - DNA, 23 bp, Artificial Sequence
  epidermal growth factor receptor (EGFR), ERBB1 phosphotyrosine kinase siRNA
aaattataagcaacagaggtgaa

SEQ ID NO: 6563 - DNA, 23 bp, Artificial Sequence
  epidermal growth factor receptor (EGFR), ERBB1 phosphotyrosine kinase siRNA
aattataagcaacagaggtgaaa

SEQ ID NO: 6564 - DNA, 23 bp, Artificial Sequence
  epidermal growth factor receptor (EGFR), ERBB1 phosphotyrosine kinase siRNA
attataagcaacagaggtgaaaa

SEQ ID NO: 6565 - DNA, 23 bp, Artificial Sequence
  epidermal growth factor receptor (EGFR), ERBB1 phosphotyrosine kinase siRNA
ttataagcaacagaggtgaaaac

SEQ ID NO: 6566 - DNA, 23 bp, Artificial Sequence
  epidermal growth factor receptor (EGFR), ERBB1 phosphotyrosine kinase siRNA
tataagcaacagaggtgaaaaca

SEQ ID NO: 6567 - DNA, 23 bp, Artificial Sequence
  epidermal growth factor receptor (EGFR), ERBB1 phosphotyrosine kinase siRNA
ataagcaacagaggtgaaaacag

SEQ ID NO: 6568 - DNA, 23 bp, Artificial Sequence
  epidermal growth factor receptor (EGFR), ERBB1 phosphotyrosine kinase siRNA
taagcaacagaggtgaaaacagc

SEQ ID NO: 6569 - DNA, 23 bp, Artificial Sequence
  epidermal growth factor receptor (EGFR), ERBB1 phosphotyrosine kinase siRNA
aagcaacagaggtgaaaacagct

SEQ ID NO: 6570 - DNA, 23 bp, Artificial Sequence
  epidermal growth factor receptor (EGFR), ERBB1 phosphotyrosine kinase siRNA
agcaacagaggtgaaaacagctg

SEQ ID NO: 6571 - DNA, 23 bp, Artificial Sequence
  epidermal growth factor receptor (EGFR), ERBB1 phosphotyrosine kinase siRNA
gcaacagaggtgaaaacagctgc

SEQ ID NO: 6572 - DNA, 23 bp, Artificial Sequence
  epidermal growth factor receptor (EGFR), ERBB1 phosphotyrosine kinase siRNA
caacagaggtgaaaacagctgca

SEQ ID NO: 6573 - DNA, 23 bp, Artificial Sequence
  epidermal growth factor receptor (EGFR), ERBB1 phosphotyrosine kinase siRNA
aacagaggtgaaaacagctgcaa

SEQ ID NO: 6574 - DNA, 23 bp, Artificial Sequence
  epidermal growth factor receptor (EGFR), ERBB1 phosphotyrosine kinase siRNA
acagaggtgaaaacagctgcaag

SEQ ID NO: 6575 - DNA, 23 bp, Artificial Sequence
  epidermal growth factor receptor (EGFR), ERBB1 phosphotyrosine kinase siRNA
cagaggtgaaaacagctgcaagg

SEQ ID NO: 6576 - DNA, 23 bp, Artificial Sequence
  epidermal growth factor receptor (EGFR), ERBB1 phosphotyrosine kinase siRNA
agaggtgaaaacagctgcaaggc

SEQ ID NO: 6577 - DNA, 23 bp, Artificial Sequence
  epidermal growth factor receptor (EGFR), ERBB1 phosphotyrosine kinase siRNA
gaggtgaaaacagctgcaaggcc

SEQ ID NO: 6578 - DNA, 23 bp, Artificial Sequence
  epidermal growth factor receptor (EGFR), ERBB1 phosphotyrosine kinase siRNA
aggtgaaaacagctgcaaggcca

SEQ ID NO: 6579 - DNA, 23 bp, Artificial Sequence
  epidermal growth factor receptor (EGFR), ERBB1 phosphotyrosine kinase siRNA
ggtgaaaacagctgcaaggccac

SEQ ID NO: 6580 - DNA, 23 bp, Artificial Sequence
  epidermal growth factor receptor (EGFR), ERBB1 phosphotyrosine kinase siRNA
gtgaaaacagctgcaaggccaca

SEQ ID NO: 6581 - DNA, 23 bp, Artificial Sequence
  epidermal growth factor receptor (EGFR), ERBB1 phosphotyrosine kinase siRNA
tgaaaacagctgcaaggccacag

SEQ ID NO: 6582 - DNA, 23 bp, Artificial Sequence
  epidermal growth factor receptor (EGFR), ERBB1 phosphotyrosine kinase siRNA
gaaaacagctgcaaggccacagg

SEQ ID NO: 6583 - DNA, 23 bp, Artificial Sequence
  epidermal growth factor receptor (EGFR), ERBB1 phosphotyrosine kinase siRNA
aaaacagctgcaaggccacaggc

SEQ ID NO: 6584 - DNA, 23 bp, Artificial Sequence
  epidermal growth factor receptor (EGFR), ERBB1 phosphotyrosine kinase siRNA
aaacagctgcaaggccacaggcc

SEQ ID NO: 6585 - DNA, 23 bp, Artificial Sequence
  epidermal growth factor receptor (EGFR), ERBB1 phosphotyrosine kinase siRNA
aacagctgcaaggccacaggcca

SEQ ID NO: 6586 - DNA, 23 bp, Artificial Sequence
  epidermal growth factor receptor (EGFR), ERBB1 phosphotyrosine kinase siRNA
acagctgcaaggccacaggccag

SEQ ID NO: 6587 - DNA, 23 bp, Artificial Sequence
  epidermal growth factor receptor (EGFR), ERBB1 phosphotyrosine kinase siRNA
cagctgcaaggccacaggccagg

SEQ ID NO: 6588 - DNA, 23 bp, Artificial Sequence
  epidermal growth factor receptor (EGFR), ERBB1 phosphotyrosine kinase siRNA
agctgcaaggccacaggccaggt

SEQ ID NO: 6589 - DNA, 23 bp, Artificial Sequence
  epidermal growth factor receptor (EGFR), ERBB1 phosphotyrosine kinase siRNA
gctgcaaggccacaggccaggtc

SEQ ID NO: 6590 - DNA, 23 bp, Artificial Sequence
  epidermal growth factor receptor (EGFR), ERBB1 phosphotyrosine kinase siRNA
ctgcaaggccacaggccaggtct

SEQ ID NO: 6591 - DNA, 23 bp, Artificial Sequence
  epidermal growth factor receptor (EGFR), ERBB1 phosphotyrosine kinase siRNA
tgcaaggccacaggccaggtctg

SEQ ID NO: 6592 - DNA, 23 bp, Artificial Sequence
  epidermal growth factor receptor (EGFR), ERBB1 phosphotyrosine kinase siRNA
gcaaggccacaggccaggtctgc

SEQ ID NO: 6593 - DNA, 23 bp, Artificial Sequence
  epidermal growth factor receptor (EGFR), ERBB1 phosphotyrosine kinase siRNA
caaggccacaggccaggtctgcc

SEQ ID NO: 6594 - DNA, 23 bp, Artificial Sequence
  epidermal growth factor receptor (EGFR), ERBB1 phosphotyrosine kinase siRNA
aaggccacaggccaggtctgcca

SEQ ID NO: 6595 - DNA, 23 bp, Artificial Sequence
  epidermal growth factor receptor (EGFR), ERBB1 phosphotyrosine kinase siRNA
aggccacaggccaggtctgccat

SEQ ID NO: 6596 - DNA, 23 bp, Artificial Sequence
  epidermal growth factor receptor (EGFR), ERBB1 phosphotyrosine kinase siRNA
ggccacaggccaggtctgccatg

SEQ ID NO: 6597 - DNA, 23 bp, Artificial Sequence
  epidermal growth factor receptor (EGFR), ERBB1 phosphotyrosine kinase siRNA
gccacaggccaggtctgccatgc

SEQ ID NO: 6598 - DNA, 23 bp, Artificial Sequence
  epidermal growth factor receptor (EGFR), ERBB1 phosphotyrosine kinase siRNA
ccacaggccaggtctgccatgcc

SEQ ID NO: 6599 - DNA, 23 bp, Artificial Sequence
  epidermal growth factor receptor (EGFR), ERBB1 phosphotyrosine kinase siRNA
cacaggccaggtctgccatgcct

SEQ ID NO: 6600 - DNA, 23 bp, Artificial Sequence
  epidermal growth factor receptor (EGFR), ERBB1 phosphotyrosine kinase siRNA
acaggccaggtctgccatgcctt

SEQ ID NO: 6601 - DNA, 23 bp, Artificial Sequence
  epidermal growth factor receptor (EGFR), ERBB1 phosphotyrosine kinase siRNA
caggccaggtctgccatgccttg

SEQ ID NO: 6602 - DNA, 23 bp, Artificial Sequence
  epidermal growth factor receptor (EGFR), ERBB1 phosphotyrosine kinase siRNA
aggccaggtctgccatgccttgt

SEQ ID NO: 6603 - DNA, 23 bp, Artificial Sequence
  epidermal growth factor receptor (EGFR), ERBB1 phosphotyrosine kinase siRNA
ggccaggtctgccatgccttgtg

SEQ ID NO: 6604 - DNA, 23 bp, Artificial Sequence
  epidermal growth factor receptor (EGFR), ERBB1 phosphotyrosine kinase siRNA
gccaggtctgccatgccttgtgc

SEQ ID NO: 6605 - DNA, 23 bp, Artificial Sequence
  epidermal growth factor receptor (EGFR), ERBB1 phosphotyrosine kinase siRNA
ccaggtctgccatgccttgtgct

SEQ ID NO: 6606 - DNA, 23 bp, Artificial Sequence
  epidermal growth factor receptor (EGFR), ERBB1 phosphotyrosine kinase siRNA
caggtctgccatgccttgtgctc

SEQ ID NO: 6607 - DNA, 23 bp, Artificial Sequence
  epidermal growth factor receptor (EGFR), ERBB1 phosphotyrosine kinase siRNA
aggtctgccatgccttgtgctcc

SEQ ID NO: 6608 - DNA, 23 bp, Artificial Sequence
  epidermal growth factor receptor (EGFR), ERBB1 phosphotyrosine kinase siRNA
ggtctgccatgccttgtgctccc

SEQ ID NO: 6609 - DNA, 23 bp, Artificial Sequence
  epidermal growth factor receptor (EGFR), ERBB1 phosphotyrosine kinase siRNA
gtctgccatgccttgtgctcccc

SEQ ID NO: 6610 - DNA, 23 bp, Artificial Sequence
  epidermal growth factor receptor (EGFR), ERBB1 phosphotyrosine kinase siRNA
tctgccatgccttgtgctccccc

SEQ ID NO: 6611 - DNA, 23 bp, Artificial Sequence
  epidermal growth factor receptor (EGFR), ERBB1 phosphotyrosine kinase siRNA
ctgccatgccttgtgctcccccg

SEQ ID NO: 6612 - DNA, 23 bp, Artificial Sequence
  epidermal growth factor receptor (EGFR), ERBB1 phosphotyrosine kinase siRNA
tgccatgccttgtgctcccccga

SEQ ID NO: 6613 - DNA, 23 bp, Artificial Sequence
  epidermal growth factor receptor (EGFR), ERBB1 phosphotyrosine kinase siRNA
gccatgccttgtgctcccccgag

SEQ ID NO: 6614 - DNA, 23 bp, Artificial Sequence
  epidermal growth factor receptor (EGFR), ERBB1 phosphotyrosine kinase siRNA
ccatgccttgtgctcccccgagg

SEQ ID NO: 6615 - DNA, 23 bp, Artificial Sequence
  epidermal growth factor receptor (EGFR), ERBB1 phosphotyrosine kinase siRNA
catgccttgtgctcccccgaggg

SEQ ID NO: 6616 - DNA, 23 bp, Artificial Sequence
  epidermal growth factor receptor (EGFR), ERBB1 phosphotyrosine kinase siRNA
atgccttgtgctcccccgagggc

SEQ ID NO: 6617 - DNA, 23 bp, Artificial Sequence
  epidermal growth factor receptor (EGFR), ERBB1 phosphotyrosine kinase siRNA
tgccttgtgctcccccgagggct

SEQ ID NO: 6618 - DNA, 23 bp, Artificial Sequence
  epidermal growth factor receptor (EGFR), ERBB1 phosphotyrosine kinase siRNA
gccttgtgctcccccgagggctg

SEQ ID NO: 6619 - DNA, 23 bp, Artificial Sequence
  epidermal growth factor receptor (EGFR), ERBB1 phosphotyrosine kinase siRNA
ccttgtgctcccccgagggctgc

SEQ ID NO: 6620 - DNA, 23 bp, Artificial Sequence
  epidermal growth factor receptor (EGFR), ERBB1 phosphotyrosine kinase siRNA
cttgtgctcccccgagggctgct

SEQ ID NO: 6621 - DNA, 23 bp, Artificial Sequence
  epidermal growth factor receptor (EGFR), ERBB1 phosphotyrosine kinase siRNA
ttgtgctcccccgagggctgctg

SEQ ID NO: 6622 - DNA, 23 bp, Artificial Sequence
  epidermal growth factor receptor (EGFR), ERBB1 phosphotyrosine kinase siRNA
tgtgctcccccgagggctgctgg

SEQ ID NO: 6623 - DNA, 23 bp, Artificial Sequence
  epidermal growth factor receptor (EGFR), ERBB1 phosphotyrosine kinase siRNA
gtgctcccccgagggctgctggg

SEQ ID NO: 6624 - DNA, 23 bp, Artificial Sequence
  epidermal growth factor receptor (EGFR), ERBB1 phosphotyrosine kinase siRNA
tgctcccccgagggctgctgggg

SEQ ID NO: 6625 - DNA, 23 bp, Artificial Sequence
  epidermal growth factor receptor (EGFR), ERBB1 phosphotyrosine kinase siRNA
gctcccccgagggctgctggggc

SEQ ID NO: 6626 - DNA, 23 bp, Artificial Sequence
  epidermal growth factor receptor (EGFR), ERBB1 phosphotyrosine kinase siRNA
ctcccccgagggctgctggggcc

SEQ ID NO: 6627 - DNA, 23 bp, Artificial Sequence
  epidermal growth factor receptor (EGFR), ERBB1 phosphotyrosine kinase siRNA
tcccccgagggctgctggggccc

SEQ ID NO: 6628 - DNA, 23 bp, Artificial Sequence
  epidermal growth factor receptor (EGFR), ERBB1 phosphotyrosine kinase siRNA
cccccgagggctgctggggcccg

SEQ ID NO: 6629 - DNA, 23 bp, Artificial Sequence
  epidermal growth factor receptor (EGFR), ERBB1 phosphotyrosine kinase siRNA
gggcccggagcccagggactgcg

SEQ ID NO: 6630 - DNA, 23 bp, Artificial Sequence
  epidermal growth factor receptor (EGFR), ERBB1 phosphotyrosine kinase siRNA
ggcccggagcccagggactgcgt

SEQ ID NO: 6631 - DNA, 23 bp, Artificial Sequence
  epidermal growth factor receptor (EGFR), ERBB1 phosphotyrosine kinase siRNA
gcccggagcccagggactgcgtc

SEQ ID NO: 6632 - DNA, 23 bp, Artificial Sequence
  epidermal growth factor receptor (EGFR), ERBB1 phosphotyrosine kinase siRNA
cccggagcccagggactgcgtct

SEQ ID NO: 6633 - DNA, 23 bp, Artificial Sequence
  epidermal growth factor receptor (EGFR), ERBB1 phosphotyrosine kinase siRNA
ccggagcccagggactgcgtctc

SEQ ID NO: 6634 - DNA, 23 bp, Artificial Sequence
  epidermal growth factor receptor (EGFR), ERBB1 phosphotyrosine kinase siRNA
cggagcccagggactgcgtctct

SEQ ID NO: 6635 - DNA, 23 bp, Artificial Sequence
  epidermal growth factor receptor (EGFR), ERBB1 phosphotyrosine kinase siRNA
ggagcccagggactgcgtctctt

SEQ ID NO: 6636 - DNA, 23 bp, Artificial Sequence
  epidermal growth factor receptor (EGFR), ERBB1 phosphotyrosine kinase siRNA
gagcccagggactgcgtctcttg

SEQ ID NO: 6637 - DNA, 23 bp, Artificial Sequence
  epidermal growth factor receptor (EGFR), ERBB1 phosphotyrosine kinase siRNA
agcccagggactgcgtctcttgc

SEQ ID NO: 6638 - DNA, 23 bp, Artificial Sequence
  epidermal growth factor receptor (EGFR), ERBB1 phosphotyrosine kinase siRNA
gcccagggactgcgtctcttgcc

SEQ ID NO: 6639 - DNA, 23 bp, Artificial Sequence
  epidermal growth factor receptor (EGFR), ERBB1 phosphotyrosine kinase siRNA
cccagggactgcgtctcttgccg

SEQ ID NO: 6640 - DNA, 23 bp, Artificial Sequence
  epidermal growth factor receptor (EGFR), ERBB1 phosphotyrosine kinase siRNA
ccagggactgcgtctcttgccgg

SEQ ID NO: 6641 - DNA, 23 bp, Artificial Sequence
  epidermal growth factor receptor (EGFR), ERBB1 phosphotyrosine kinase siRNA
cagggactgcgtctcttgccgga

SEQ ID NO: 6642 - DNA, 23 bp, Artificial Sequence
  epidermal growth factor receptor (EGFR), ERBB1 phosphotyrosine kinase siRNA
agggactgcgtctcttgccggaa

SEQ ID NO: 6643 - DNA, 23 bp, Artificial Sequence
  epidermal growth factor receptor (EGFR), ERBB1 phosphotyrosine kinase siRNA
gggactgcgtctcttgccggaat

SEQ ID NO: 6644 - DNA, 23 bp, Artificial Sequence
  epidermal growth factor receptor (EGFR), ERBB1 phosphotyrosine kinase siRNA
ggactgcgtctcttgccggaatg

SEQ ID NO: 6645 - DNA, 23 bp, Artificial Sequence
  epidermal growth factor receptor (EGFR), ERBB1 phosphotyrosine kinase siRNA
gactgcgtctcttgccggaatgt

SEQ ID NO: 6646 - DNA, 23 bp, Artificial Sequence
  epidermal growth factor receptor (EGFR), ERBB1 phosphotyrosine kinase siRNA
actgcgtctcttgccggaatgtc

SEQ ID NO: 6647 - DNA, 23 bp, Artificial Sequence
  epidermal growth factor receptor (EGFR), ERBB1 phosphotyrosine kinase siRNA
ctgcgtctcttgccggaatgtca

SEQ ID NO: 6648 - DNA, 23 bp, Artificial Sequence
  epidermal growth factor receptor (EGFR), ERBB1 phosphotyrosine kinase siRNA
tgcgtctcttgccggaatgtcag

SEQ ID NO: 6649 - DNA, 23 bp, Artificial Sequence
  epidermal growth factor receptor (EGFR), ERBB1 phosphotyrosine kinase siRNA
gcgtctcttgccggaatgtcagc

SEQ ID NO: 6650 - DNA, 23 bp, Artificial Sequence
  epidermal growth factor receptor (EGFR), ERBB1 phosphotyrosine kinase siRNA
cgtctcttgccggaatgtcagcc

SEQ ID NO: 6651 - DNA, 23 bp, Artificial Sequence
  epidermal growth factor receptor (EGFR), ERBB1 phosphotyrosine kinase siRNA
gtctcttgccggaatgtcagccg

SEQ ID NO: 6652 - DNA, 23 bp, Artificial Sequence
  epidermal growth factor receptor (EGFR), ERBB1 phosphotyrosine kinase siRNA
tctcttgccggaatgtcagccga

SEQ ID NO: 6653 - DNA, 23 bp, Artificial Sequence
  epidermal growth factor receptor (EGFR), ERBB1 phosphotyrosine kinase siRNA
ctcttgccggaatgtcagccgag

SEQ ID NO: 6654 - DNA, 23 bp, Artificial Sequence
  epidermal growth factor receptor (EGFR), ERBB1 phosphotyrosine kinase siRNA
tcttgccggaatgtcagccgagg

SEQ ID NO: 6655 - DNA, 23 bp, Artificial Sequence
  epidermal growth factor receptor (EGFR), ERBB1 phosphotyrosine kinase siRNA
cttgccggaatgtcagccgaggc

SEQ ID NO: 6656 - DNA, 23 bp, Artificial Sequence
  epidermal growth factor receptor (EGFR), ERBB1 phosphotyrosine kinase siRNA
ttgccggaatgtcagccgaggca

SEQ ID NO: 6657 - DNA, 23 bp, Artificial Sequence
  epidermal growth factor receptor (EGFR), ERBB1 phosphotyrosine kinase siRNA
tgccggaatgtcagccgaggcag

SEQ ID NO: 6658 - DNA, 23 bp, Artificial Sequence
  epidermal growth factor receptor (EGFR), ERBB1 phosphotyrosine kinase siRNA
gccggaatgtcagccgaggcagg

SEQ ID NO: 6659 - DNA, 23 bp, Artificial Sequence
  epidermal growth factor receptor (EGFR), ERBB1 phosphotyrosine kinase siRNA
ccggaatgtcagccgaggcaggg

SEQ ID NO: 6660 - DNA, 23 bp, Artificial Sequence
  epidermal growth factor receptor (EGFR), ERBB1 phosphotyrosine kinase siRNA
cggaatgtcagccgaggcaggga

SEQ ID NO: 6661 - DNA, 23 bp, Artificial Sequence
  epidermal growth factor receptor (EGFR), ERBB1 phosphotyrosine kinase siRNA
ggaatgtcagccgaggcagggaa

SEQ ID NO: 6662 - DNA, 23 bp, Artificial Sequence
  epidermal growth factor receptor (EGFR), ERBB1 phosphotyrosine kinase siRNA
gaatgtcagccgaggcagggaat

SEQ ID NO: 6663 - DNA, 23 bp, Artificial Sequence
  epidermal growth factor receptor (EGFR), ERBB1 phosphotyrosine kinase siRNA
aatgtcagccgaggcagggaatg

SEQ ID NO: 6664 - DNA, 23 bp, Artificial Sequence
  epidermal growth factor receptor (EGFR), ERBB1 phosphotyrosine kinase siRNA
atgtcagccgaggcagggaatgc

SEQ ID NO: 6665 - DNA, 23 bp, Artificial Sequence
  epidermal growth factor receptor (EGFR), ERBB1 phosphotyrosine kinase siRNA
tgtcagccgaggcagggaatgcg

SEQ ID NO: 6666 - DNA, 23 bp, Artificial Sequence
  epidermal growth factor receptor (EGFR), ERBB1 phosphotyrosine kinase siRNA
gtcagccgaggcagggaatgcgt

SEQ ID NO: 6667 - DNA, 23 bp, Artificial Sequence
  epidermal growth factor receptor (EGFR), ERBB1 phosphotyrosine kinase siRNA
tcagccgaggcagggaatgcgtg

SEQ ID NO: 6668 - DNA, 23 bp, Artificial Sequence
  epidermal growth factor receptor (EGFR), ERBB1 phosphotyrosine kinase siRNA
cagccgaggcagggaatgcgtgg

SEQ ID NO: 6669 - DNA, 23 bp, Artificial Sequence
  epidermal growth factor receptor (EGFR), ERBB1 phosphotyrosine kinase siRNA
agccgaggcagggaatgcgtgga

SEQ ID NO: 6670 - DNA, 23 bp, Artificial Sequence
  epidermal growth factor receptor (EGFR), ERBB1 phosphotyrosine kinase siRNA
gccgaggcagggaatgcgtggac

SEQ ID NO: 6671 - DNA, 23 bp, Artificial Sequence
  epidermal growth factor receptor (EGFR), ERBB1 phosphotyrosine kinase siRNA
ccgaggcagggaatgcgtggaca

SEQ ID NO: 6672 - DNA, 23 bp, Artificial Sequence
  epidermal growth factor receptor (EGFR), ERBB1 phosphotyrosine kinase siRNA
cgaggcagggaatgcgtggacaa

SEQ ID NO: 6673 - DNA, 23 bp, Artificial Sequence
  epidermal growth factor receptor (EGFR), ERBB1 phosphotyrosine kinase siRNA
gaggcagggaatgcgtggacaag

SEQ ID NO: 6674 - DNA, 23 bp, Artificial Sequence
  epidermal growth factor receptor (EGFR), ERBB1 phosphotyrosine kinase siRNA
aggcagggaatgcgtggacaagt

SEQ ID NO: 6675 - DNA, 23 bp, Artificial Sequence
  epidermal growth factor receptor (EGFR), ERBB1 phosphotyrosine kinase siRNA
ggcagggaatgcgtggacaagtg

SEQ ID NO: 6676 - DNA, 23 bp, Artificial Sequence
  epidermal growth factor receptor (EGFR), ERBB1 phosphotyrosine kinase siRNA
gcagggaatgcgtggacaagtgc

SEQ ID NO: 6677 - DNA, 23 bp, Artificial Sequence
  epidermal growth factor receptor (EGFR), ERBB1 phosphotyrosine kinase siRNA
cagggaatgcgtggacaagtgca

SEQ ID NO: 6678 - DNA, 23 bp, Artificial Sequence
  epidermal growth factor receptor (EGFR), ERBB1 phosphotyrosine kinase siRNA
agggaatgcgtggacaagtgcaa

SEQ ID NO: 6679 - DNA, 23 bp, Artificial Sequence
  epidermal growth factor receptor (EGFR), ERBB1 phosphotyrosine kinase siRNA
gggaatgcgtggacaagtgcaac

SEQ ID NO: 6680 - DNA, 23 bp, Artificial Sequence
  epidermal growth factor receptor (EGFR), ERBB1 phosphotyrosine kinase siRNA
ggaatgcgtggacaagtgcaacc

SEQ ID NO: 6681 - DNA, 23 bp, Artificial Sequence
  epidermal growth factor receptor (EGFR), ERBB1 phosphotyrosine kinase siRNA
gaatgcgtggacaagtgcaacct

SEQ ID NO: 6682 - DNA, 23 bp, Artificial Sequence
  epidermal growth factor receptor (EGFR), ERBB1 phosphotyrosine kinase siRNA
aatgcgtggacaagtgcaacctt

SEQ ID NO: 6683 - DNA, 23 bp, Artificial Sequence
  epidermal growth factor receptor (EGFR), ERBB1 phosphotyrosine kinase siRNA
atgcgtggacaagtgcaaccttc

SEQ ID NO: 6684 - DNA, 23 bp, Artificial Sequence
  epidermal growth factor receptor (EGFR), ERBB1 phosphotyrosine kinase siRNA
tgcgtggacaagtgcaaccttct

SEQ ID NO: 6685 - DNA, 23 bp, Artificial Sequence
  epidermal growth factor receptor (EGFR), ERBB1 phosphotyrosine kinase siRNA
gcgtggacaagtgcaaccttctg

SEQ ID NO: 6686 - DNA, 23 bp, Artificial Sequence
  epidermal growth factor receptor (EGFR), ERBB1 phosphotyrosine kinase siRNA
cgtggacaagtgcaaccttctgg

SEQ ID NO: 6687 - DNA, 23 bp, Artificial Sequence
  epidermal growth factor receptor (EGFR), ERBB1 phosphotyrosine kinase siRNA
gtggacaagtgcaaccttctgga

SEQ ID NO: 6688 - DNA, 23 bp, Artificial Sequence
  epidermal growth factor receptor (EGFR), ERBB1 phosphotyrosine kinase siRNA
tggacaagtgcaaccttctggag

SEQ ID NO: 6689 - DNA, 23 bp, Artificial Sequence
  epidermal growth factor receptor (EGFR), ERBB1 phosphotyrosine kinase siRNA
ggacaagtgcaaccttctggagg

SEQ ID NO: 6690 - DNA, 23 bp, Artificial Sequence
  epidermal growth factor receptor (EGFR), ERBB1 phosphotyrosine kinase siRNA
gacaagtgcaaccttctggaggg

SEQ ID NO: 6691 - DNA, 23 bp, Artificial Sequence
  epidermal growth factor receptor (EGFR), ERBB1 phosphotyrosine kinase siRNA
acaagtgcaaccttctggagggt

SEQ ID NO: 6692 - DNA, 23 bp, Artificial Sequence
  epidermal growth factor receptor (EGFR), ERBB1 phosphotyrosine kinase siRNA
caagtgcaaccttctggagggtg

SEQ ID NO: 6693 - DNA, 23 bp, Artificial Sequence
  epidermal growth factor receptor (EGFR), ERBB1 phosphotyrosine kinase siRNA
aagtgcaaccttctggagggtga

SEQ ID NO: 6694 - DNA, 23 bp, Artificial Sequence
  epidermal growth factor receptor (EGFR), ERBB1 phosphotyrosine kinase siRNA
agtgcaaccttctggagggtgag

SEQ ID NO: 6695 - DNA, 23 bp, Artificial Sequence
  epidermal growth factor receptor (EGFR), ERBB1 phosphotyrosine kinase siRNA
gtgcaaccttctggagggtgagc

SEQ ID NO: 6696 - DNA, 23 bp, Artificial Sequence
  epidermal growth factor receptor (EGFR), ERBB1 phosphotyrosine kinase siRNA
tgcaaccttctggagggtgagcc

SEQ ID NO: 6697 - DNA, 23 bp, Artificial Sequence
  epidermal growth factor receptor (EGFR), ERBB1 phosphotyrosine kinase siRNA
gcaaccttctggagggtgagcca

SEQ ID NO: 6698 - DNA, 23 bp, Artificial Sequence
  epidermal growth factor receptor (EGFR), ERBB1 phosphotyrosine kinase siRNA
caaccttctggagggtgagccaa

SEQ ID NO: 6699 - DNA, 23 bp, Artificial Sequence
  epidermal growth factor receptor (EGFR), ERBB1 phosphotyrosine kinase siRNA
aaccttctggagggtgagccaag

SEQ ID NO: 6700 - DNA, 23 bp, Artificial Sequence
  epidermal growth factor receptor (EGFR), ERBB1 phosphotyrosine kinase siRNA
accttctggagggtgagccaagg

SEQ ID NO: 6701 - DNA, 23 bp, Artificial Sequence
  epidermal growth factor receptor (EGFR), ERBB1 phosphotyrosine kinase siRNA
ccttctggagggtgagccaaggg

SEQ ID NO: 6702 - DNA, 23 bp, Artificial Sequence
  epidermal growth factor receptor (EGFR), ERBB1 phosphotyrosine kinase siRNA
cttctggagggtgagccaaggga

SEQ ID NO: 6703 - DNA, 23 bp, Artificial Sequence
  epidermal growth factor receptor (EGFR), ERBB1 phosphotyrosine kinase siRNA
ttctggagggtgagccaagggag

SEQ ID NO: 6704 - DNA, 23 bp, Artificial Sequence
  epidermal growth factor receptor (EGFR), ERBB1 phosphotyrosine kinase siRNA
tctggagggtgagccaagggagt

SEQ ID NO: 6705 - DNA, 23 bp, Artificial Sequence
  epidermal growth factor receptor (EGFR), ERBB1 phosphotyrosine kinase siRNA
ctggagggtgagccaagggagtt

SEQ ID NO: 6706 - DNA, 23 bp, Artificial Sequence
  epidermal growth factor receptor (EGFR), ERBB1 phosphotyrosine kinase siRNA
tggagggtgagccaagggagttt

SEQ ID NO: 6707 - DNA, 23 bp, Artificial Sequence
  epidermal growth factor receptor (EGFR), ERBB1 phosphotyrosine kinase siRNA
ggagggtgagccaagggagtttg

SEQ ID NO: 6708 - DNA, 23 bp, Artificial Sequence
  epidermal growth factor receptor (EGFR), ERBB1 phosphotyrosine kinase siRNA
gagggtgagccaagggagtttgt

SEQ ID NO: 6709 - DNA, 23 bp, Artificial Sequence
  epidermal growth factor receptor (EGFR), ERBB1 phosphotyrosine kinase siRNA
agggtgagccaagggagtttgtg

SEQ ID NO: 6710 - DNA, 23 bp, Artificial Sequence
  epidermal growth factor receptor (EGFR), ERBB1 phosphotyrosine kinase siRNA
gggtgagccaagggagtttgtgg

SEQ ID NO: 6711 - DNA, 23 bp, Artificial Sequence
  epidermal growth factor receptor (EGFR), ERBB1 phosphotyrosine kinase siRNA
ggtgagccaagggagtttgtgga

SEQ ID NO: 6712 - DNA, 23 bp, Artificial Sequence
  epidermal growth factor receptor (EGFR), ERBB1 phosphotyrosine kinase siRNA
gtgagccaagggagtttgtggag

SEQ ID NO: 6713 - DNA, 23 bp, Artificial Sequence
  epidermal growth factor receptor (EGFR), ERBB1 phosphotyrosine kinase siRNA
tgagccaagggagtttgtggaga

SEQ ID NO: 6714 - DNA, 23 bp, Artificial Sequence
  epidermal growth factor receptor (EGFR), ERBB1 phosphotyrosine kinase siRNA
gagccaagggagtttgtggagaa

SEQ ID NO: 6715 - DNA, 23 bp, Artificial Sequence
  epidermal growth factor receptor (EGFR), ERBB1 phosphotyrosine kinase siRNA
agccaagggagtttgtggagaac

SEQ ID NO: 6716 - DNA, 23 bp, Artificial Sequence
  epidermal growth factor receptor (EGFR), ERBB1 phosphotyrosine kinase siRNA
gccaagggagtttgtggagaact

SEQ ID NO: 6717 - DNA, 23 bp, Artificial Sequence
  epidermal growth factor receptor (EGFR), ERBB1 phosphotyrosine kinase siRNA
ccaagggagtttgtggagaactc

SEQ ID NO: 6718 - DNA, 23 bp, Artificial Sequence
  epidermal growth factor receptor (EGFR), ERBB1 phosphotyrosine kinase siRNA
caagggagtttgtggagaactct

SEQ ID NO: 6719 - DNA, 23 bp, Artificial Sequence
  epidermal growth factor receptor (EGFR), ERBB1 phosphotyrosine kinase siRNA
aagggagtttgtggagaactctg

SEQ ID NO: 6720 - DNA, 23 bp, Artificial Sequence
  epidermal growth factor receptor (EGFR), ERBB1 phosphotyrosine kinase siRNA
agggagtttgtggagaactctga

SEQ ID NO: 6721 - DNA, 23 bp, Artificial Sequence
  epidermal growth factor receptor (EGFR), ERBB1 phosphotyrosine kinase siRNA
gggagtttgtggagaactctgag

SEQ ID NO: 6722 - DNA, 23 bp, Artificial Sequence
  epidermal growth factor receptor (EGFR), ERBB1 phosphotyrosine kinase siRNA
ggagtttgtggagaactctgagt

SEQ ID NO: 6723 - DNA, 23 bp, Artificial Sequence
  epidermal growth factor receptor (EGFR), ERBB1 phosphotyrosine kinase siRNA
gagtttgtggagaactctgagtg

SEQ ID NO: 6724 - DNA, 23 bp, Artificial Sequence
  epidermal growth factor receptor (EGFR), ERBB1 phosphotyrosine kinase siRNA
agtttgtggagaactctgagtgc

SEQ ID NO: 6725 - DNA, 23 bp, Artificial Sequence
  epidermal growth factor receptor (EGFR), ERBB1 phosphotyrosine kinase siRNA
gtttgtggagaactctgagtgca

SEQ ID NO: 6726 - DNA, 23 bp, Artificial Sequence
  epidermal growth factor receptor (EGFR), ERBB1 phosphotyrosine kinase siRNA
tttgtggagaactctgagtgcat

SEQ ID NO: 6727 - DNA, 23 bp, Artificial Sequence
  epidermal growth factor receptor (EGFR), ERBB1 phosphotyrosine kinase siRNA
ttgtggagaactctgagtgcata

SEQ ID NO: 6728 - DNA, 23 bp, Artificial Sequence
  epidermal growth factor receptor (EGFR), ERBB1 phosphotyrosine kinase siRNA
tgtggagaactctgagtgcatac

SEQ ID NO: 6729 - DNA, 23 bp, Artificial Sequence
  epidermal growth factor receptor (EGFR), ERBB1 phosphotyrosine kinase siRNA
gtggagaactctgagtgcataca

SEQ ID NO: 6730 - DNA, 23 bp, Artificial Sequence
  epidermal growth factor receptor (EGFR), ERBB1 phosphotyrosine kinase siRNA
tggagaactctgagtgcatacag

SEQ ID NO: 6731 - DNA, 23 bp, Artificial Sequence
  epidermal growth factor receptor (EGFR), ERBB1 phosphotyrosine kinase siRNA
ggagaactctgagtgcatacagt

SEQ ID NO: 6732 - DNA, 23 bp, Artificial Sequence
  epidermal growth factor receptor (EGFR), ERBB1 phosphotyrosine kinase siRNA
gagaactctgagtgcatacagtg

SEQ ID NO: 6733 - DNA, 23 bp, Artificial Sequence
  epidermal growth factor receptor (EGFR), ERBB1 phosphotyrosine kinase siRNA
agaactctgagtgcatacagtgc

SEQ ID NO: 6734 - DNA, 23 bp, Artificial Sequence
  epidermal growth factor receptor (EGFR), ERBB1 phosphotyrosine kinase siRNA
gaactctgagtgcatacagtgcc

SEQ ID NO: 6735 - DNA, 23 bp, Artificial Sequence
  epidermal growth factor receptor (EGFR), ERBB1 phosphotyrosine kinase siRNA
aactctgagtgcatacagtgcca

SEQ ID NO: 6736 - DNA, 23 bp, Artificial Sequence
  epidermal growth factor receptor (EGFR), ERBB1 phosphotyrosine kinase siRNA
actctgagtgcatacagtgccac

SEQ ID NO: 6737 - DNA, 23 bp, Artificial Sequence
  epidermal growth factor receptor (EGFR), ERBB1 phosphotyrosine kinase siRNA
ctctgagtgcatacagtgccacc

SEQ ID NO: 6738 - DNA, 23 bp, Artificial Sequence
  epidermal growth factor receptor (EGFR), ERBB1 phosphotyrosine kinase siRNA
tctgagtgcatacagtgccaccc

SEQ ID NO: 6739 - DNA, 23 bp, Artificial Sequence
  epidermal growth factor receptor (EGFR), ERBB1 phosphotyrosine kinase siRNA
ctgagtgcatacagtgccaccca

SEQ ID NO: 6740 - DNA, 23 bp, Artificial Sequence
  epidermal growth factor receptor (EGFR), ERBB1 phosphotyrosine kinase siRNA
tgagtgcatacagtgccacccag

SEQ ID NO: 6741 - DNA, 23 bp, Artificial Sequence
  epidermal growth factor receptor (EGFR), ERBB1 phosphotyrosine kinase siRNA
gagtgcatacagtgccacccaga

SEQ ID NO: 6742 - DNA, 23 bp, Artificial Sequence
  epidermal growth factor receptor (EGFR), ERBB1 phosphotyrosine kinase siRNA
agtgcatacagtgccacccagag

SEQ ID NO: 6743 - DNA, 23 bp, Artificial Sequence
  epidermal growth factor receptor (EGFR), ERBB1 phosphotyrosine kinase siRNA
gtgcatacagtgccacccagagt

SEQ ID NO: 6744 - DNA, 23 bp, Artificial Sequence
  epidermal growth factor receptor (EGFR), ERBB1 phosphotyrosine kinase siRNA
tgcatacagtgccacccagagtg

SEQ ID NO: 6745 - DNA, 23 bp, Artificial Sequence
  epidermal growth factor receptor (EGFR), ERBB1 phosphotyrosine kinase siRNA
gcatacagtgccacccagagtgc

SEQ ID NO: 6746 - DNA, 23 bp, Artificial Sequence
  epidermal growth factor receptor (EGFR), ERBB1 phosphotyrosine kinase siRNA
catacagtgccacccagagtgcc

SEQ ID NO: 6747 - DNA, 23 bp, Artificial Sequence
  epidermal growth factor receptor (EGFR), ERBB1 phosphotyrosine kinase siRNA
atacagtgccacccagagtgcct

SEQ ID NO: 6748 - DNA, 23 bp, Artificial Sequence
  epidermal growth factor receptor (EGFR), ERBB1 phosphotyrosine kinase siRNA
tacagtgccacccagagtgcctg

SEQ ID NO: 6749 - DNA, 23 bp, Artificial Sequence
  epidermal growth factor receptor (EGFR), ERBB1 phosphotyrosine kinase siRNA
acagtgccacccagagtgcctgc

SEQ ID NO: 6750 - DNA, 23 bp, Artificial Sequence
  epidermal growth factor receptor (EGFR), ERBB1 phosphotyrosine kinase siRNA
cagtgccacccagagtgcctgcc

SEQ ID NO: 6751 - DNA, 23 bp, Artificial Sequence
  epidermal growth factor receptor (EGFR), ERBB1 phosphotyrosine kinase siRNA
agtgccacccagagtgcctgcct

SEQ ID NO: 6752 - DNA, 23 bp, Artificial Sequence
  epidermal growth factor receptor (EGFR), ERBB1 phosphotyrosine kinase siRNA
gtgccacccagagtgcctgcctc

SEQ ID NO: 6753 - DNA, 23 bp, Artificial Sequence
  epidermal growth factor receptor (EGFR), ERBB1 phosphotyrosine kinase siRNA
tgccacccagagtgcctgcctca

SEQ ID NO: 6754 - DNA, 23 bp, Artificial Sequence
  epidermal growth factor receptor (EGFR), ERBB1 phosphotyrosine kinase siRNA
gccacccagagtgcctgcctcag

SEQ ID NO: 6755 - DNA, 23 bp, Artificial Sequence
  epidermal growth factor receptor (EGFR), ERBB1 phosphotyrosine kinase siRNA
ccacccagagtgcctgcctcagg

SEQ ID NO: 6756 - DNA, 23 bp, Artificial Sequence
  epidermal growth factor receptor (EGFR), ERBB1 phosphotyrosine kinase siRNA
cacccagagtgcctgcctcaggc

SEQ ID NO: 6757 - DNA, 23 bp, Artificial Sequence
  epidermal growth factor receptor (EGFR), ERBB1 phosphotyrosine kinase siRNA
acccagagtgcctgcctcaggcc

SEQ ID NO: 6758 - DNA, 23 bp, Artificial Sequence
  epidermal growth factor receptor (EGFR), ERBB1 phosphotyrosine kinase siRNA
cccagagtgcctgcctcaggcca

SEQ ID NO: 6759 - DNA, 23 bp, Artificial Sequence
  epidermal growth factor receptor (EGFR), ERBB1 phosphotyrosine kinase siRNA
ccagagtgcctgcctcaggccat

SEQ ID NO: 6760 - DNA, 23 bp, Artificial Sequence
  epidermal growth factor receptor (EGFR), ERBB1 phosphotyrosine kinase siRNA
cagagtgcctgcctcaggccatg

SEQ ID NO: 6761 - DNA, 23 bp, Artificial Sequence
  epidermal growth factor receptor (EGFR), ERBB1 phosphotyrosine kinase siRNA
agagtgcctgcctcaggccatga

SEQ ID NO: 6762 - DNA, 23 bp, Artificial Sequence
  epidermal growth factor receptor (EGFR), ERBB1 phosphotyrosine kinase siRNA
gagtgcctgcctcaggccatgaa

SEQ ID NO: 6763 - DNA, 23 bp, Artificial Sequence
  epidermal growth factor receptor (EGFR), ERBB1 phosphotyrosine kinase siRNA
agtgcctgcctcaggccatgaac

SEQ ID NO: 6764 - DNA, 23 bp, Artificial Sequence
  epidermal growth factor receptor (EGFR), ERBB1 phosphotyrosine kinase siRNA
gtgcctgcctcaggccatgaaca

SEQ ID NO: 6765 - DNA, 23 bp, Artificial Sequence
  epidermal growth factor receptor (EGFR), ERBB1 phosphotyrosine kinase siRNA
tgcctgcctcaggccatgaacat

SEQ ID NO: 6766 - DNA, 23 bp, Artificial Sequence
  epidermal growth factor receptor (EGFR), ERBB1 phosphotyrosine kinase siRNA
gcctgcctcaggccatgaacatc

SEQ ID NO: 6767 - DNA, 23 bp, Artificial Sequence
  epidermal growth factor receptor (EGFR), ERBB1 phosphotyrosine kinase siRNA
cctgcctcaggccatgaacatca

SEQ ID NO: 6768 - DNA, 23 bp, Artificial Sequence
  epidermal growth factor receptor (EGFR), ERBB1 phosphotyrosine kinase siRNA
ctgcctcaggccatgaacatcac

SEQ ID NO: 6769 - DNA, 23 bp, Artificial Sequence
  epidermal growth factor receptor (EGFR), ERBB1 phosphotyrosine kinase siRNA
tgcctcaggccatgaacatcacc

SEQ ID NO: 6770 - DNA, 23 bp, Artificial Sequence
  epidermal growth factor receptor (EGFR), ERBB1 phosphotyrosine kinase siRNA
gcctcaggccatgaacatcacct

SEQ ID NO: 6771 - DNA, 23 bp, Artificial Sequence
  epidermal growth factor receptor (EGFR), ERBB1 phosphotyrosine kinase siRNA
cctcaggccatgaacatcacctg

SEQ ID NO: 6772 - DNA, 23 bp, Artificial Sequence
  epidermal growth factor receptor (EGFR), ERBB1 phosphotyrosine kinase siRNA
ctcaggccatgaacatcacctgc

SEQ ID NO: 6773 - DNA, 23 bp, Artificial Sequence
  epidermal growth factor receptor (EGFR), ERBB1 phosphotyrosine kinase siRNA
tcaggccatgaacatcacctgca

SEQ ID NO: 6774 - DNA, 23 bp, Artificial Sequence
  epidermal growth factor receptor (EGFR), ERBB1 phosphotyrosine kinase siRNA
caggccatgaacatcacctgcac

SEQ ID NO: 6775 - DNA, 23 bp, Artificial Sequence
  epidermal growth factor receptor (EGFR), ERBB1 phosphotyrosine kinase siRNA
aggccatgaacatcacctgcaca

SEQ ID NO: 6776 - DNA, 23 bp, Artificial Sequence
  epidermal growth factor receptor (EGFR), ERBB1 phosphotyrosine kinase siRNA
ggccatgaacatcacctgcacag

SEQ ID NO: 6777 - DNA, 23 bp, Artificial Sequence
  epidermal growth factor receptor (EGFR), ERBB1 phosphotyrosine kinase siRNA
gccatgaacatcacctgcacagg

SEQ ID NO: 6778 - DNA, 23 bp, Artificial Sequence
  epidermal growth factor receptor (EGFR), ERBB1 phosphotyrosine kinase siRNA
ccatgaacatcacctgcacagga

SEQ ID NO: 6779 - DNA, 23 bp, Artificial Sequence
  epidermal growth factor receptor (EGFR), ERBB1 phosphotyrosine kinase siRNA
catgaacatcacctgcacaggac

SEQ ID NO: 6780 - DNA, 23 bp, Artificial Sequence
  epidermal growth factor receptor (EGFR), ERBB1 phosphotyrosine kinase siRNA
atgaacatcacctgcacaggacg

SEQ ID NO: 6781 - DNA, 23 bp, Artificial Sequence
  epidermal growth factor receptor (EGFR), ERBB1 phosphotyrosine kinase siRNA
tgaacatcacctgcacaggacgg

SEQ ID NO: 6782 - DNA, 23 bp, Artificial Sequence
  epidermal growth factor receptor (EGFR), ERBB1 phosphotyrosine kinase siRNA
gaacatcacctgcacaggacggg

SEQ ID NO: 6783 - DNA, 23 bp, Artificial Sequence
  epidermal growth factor receptor (EGFR), ERBB1 phosphotyrosine kinase siRNA
aacatcacctgcacaggacgggg

SEQ ID NO: 6784 - DNA, 23 bp, Artificial Sequence
  epidermal growth factor receptor (EGFR), ERBB1 phosphotyrosine kinase siRNA
acatcacctgcacaggacgggga

SEQ ID NO: 6785 - DNA, 23 bp, Artificial Sequence
  epidermal growth factor receptor (EGFR), ERBB1 phosphotyrosine kinase siRNA
catcacctgcacaggacggggac

SEQ ID NO: 6786 - DNA, 23 bp, Artificial Sequence
  epidermal growth factor receptor (EGFR), ERBB1 phosphotyrosine kinase siRNA
atcacctgcacaggacggggacc

SEQ ID NO: 6787 - DNA, 23 bp, Artificial Sequence
  epidermal growth factor receptor (EGFR), ERBB1 phosphotyrosine kinase siRNA
tcacctgcacaggacggggacca

SEQ ID NO: 6788 - DNA, 23 bp, Artificial Sequence
  epidermal growth factor receptor (EGFR), ERBB1 phosphotyrosine kinase siRNA
cacctgcacaggacggggaccag

SEQ ID NO: 6789 - DNA, 23 bp, Artificial Sequence
  epidermal growth factor receptor (EGFR), ERBB1 phosphotyrosine kinase siRNA
acctgcacaggacggggaccaga

SEQ ID NO: 6790 - DNA, 23 bp, Artificial Sequence
  epidermal growth factor receptor (EGFR), ERBB1 phosphotyrosine kinase siRNA
cctgcacaggacggggaccagac

SEQ ID NO: 6791 - DNA, 23 bp, Artificial Sequence
  epidermal growth factor receptor (EGFR), ERBB1 phosphotyrosine kinase siRNA
ctgcacaggacggggaccagaca

SEQ ID NO: 6792 - DNA, 23 bp, Artificial Sequence
  epidermal growth factor receptor (EGFR), ERBB1 phosphotyrosine kinase siRNA
tgcacaggacggggaccagacaa

SEQ ID NO: 6793 - DNA, 23 bp, Artificial Sequence
  epidermal growth factor receptor (EGFR), ERBB1 phosphotyrosine kinase siRNA
gcacaggacggggaccagacaac

SEQ ID NO: 6794 - DNA, 23 bp, Artificial Sequence
  epidermal growth factor receptor (EGFR), ERBB1 phosphotyrosine kinase siRNA
cacaggacggggaccagacaact

SEQ ID NO: 6795 - DNA, 23 bp, Artificial Sequence
  epidermal growth factor receptor (EGFR), ERBB1 phosphotyrosine kinase siRNA
acaggacggggaccagacaactg

SEQ ID NO: 6796 - DNA, 23 bp, Artificial Sequence
  epidermal growth factor receptor (EGFR), ERBB1 phosphotyrosine kinase siRNA
caggacggggaccagacaactgt

SEQ ID NO: 6797 - DNA, 23 bp, Artificial Sequence
  epidermal growth factor receptor (EGFR), ERBB1 phosphotyrosine kinase siRNA
aggacggggaccagacaactgta

SEQ ID NO: 6798 - DNA, 23 bp, Artificial Sequence
  epidermal growth factor receptor (EGFR), ERBB1 phosphotyrosine kinase siRNA
ggacggggaccagacaactgtat

SEQ ID NO: 6799 - DNA, 23 bp, Artificial Sequence
  epidermal growth factor receptor (EGFR), ERBB1 phosphotyrosine kinase siRNA
gacggggaccagacaactgtatc

SEQ ID NO: 6800 - DNA, 23 bp, Artificial Sequence
  epidermal growth factor receptor (EGFR), ERBB1 phosphotyrosine kinase siRNA
acggggaccagacaactgtatcc

SEQ ID NO: 6801 - DNA, 23 bp, Artificial Sequence
  epidermal growth factor receptor (EGFR), ERBB1 phosphotyrosine kinase siRNA
cggggaccagacaactgtatcca

SEQ ID NO: 6802 - DNA, 23 bp, Artificial Sequence
  epidermal growth factor receptor (EGFR), ERBB1 phosphotyrosine kinase siRNA
ggggaccagacaactgtatccag

SEQ ID NO: 6803 - DNA, 23 bp, Artificial Sequence
  epidermal growth factor receptor (EGFR), ERBB1 phosphotyrosine kinase siRNA
gggaccagacaactgtatccagt

SEQ ID NO: 6804 - DNA, 23 bp, Artificial Sequence
  epidermal growth factor receptor (EGFR), ERBB1 phosphotyrosine kinase siRNA
ggaccagacaactgtatccagtg

SEQ ID NO: 6805 - DNA, 23 bp, Artificial Sequence
  epidermal growth factor receptor (EGFR), ERBB1 phosphotyrosine kinase siRNA
gaccagacaactgtatccagtgt

SEQ ID NO: 6806 - DNA, 23 bp, Artificial Sequence
  epidermal growth factor receptor (EGFR), ERBB1 phosphotyrosine kinase siRNA
accagacaactgtatccagtgtg

SEQ ID NO: 6807 - DNA, 23 bp, Artificial Sequence
  epidermal growth factor receptor (EGFR), ERBB1 phosphotyrosine kinase siRNA
ccagacaactgtatccagtgtgc

SEQ ID NO: 6808 - DNA, 23 bp, Artificial Sequence
  epidermal growth factor receptor (EGFR), ERBB1 phosphotyrosine kinase siRNA
cagacaactgtatccagtgtgcc

SEQ ID NO: 6809 - DNA, 23 bp, Artificial Sequence
  epidermal growth factor receptor (EGFR), ERBB1 phosphotyrosine kinase siRNA
agacaactgtatccagtgtgccc

SEQ ID NO: 6810 - DNA, 23 bp, Artificial Sequence
  epidermal growth factor receptor (EGFR), ERBB1 phosphotyrosine kinase siRNA
gacaactgtatccagtgtgccca

SEQ ID NO: 6811 - DNA, 23 bp, Artificial Sequence
  epidermal growth factor receptor (EGFR), ERBB1 phosphotyrosine kinase siRNA
acaactgtatccagtgtgcccac

SEQ ID NO: 6812 - DNA, 23 bp, Artificial Sequence
  epidermal growth factor receptor (EGFR), ERBB1 phosphotyrosine kinase siRNA
caactgtatccagtgtgcccact

SEQ ID NO: 6813 - DNA, 23 bp, Artificial Sequence
  epidermal growth factor receptor (EGFR), ERBB1 phosphotyrosine kinase siRNA
aactgtatccagtgtgcccacta

SEQ ID NO: 6814 - DNA, 23 bp, Artificial Sequence
  epidermal growth factor receptor (EGFR), ERBB1 phosphotyrosine kinase siRNA
actgtatccagtgtgcccactac

SEQ ID NO: 6815 - DNA, 23 bp, Artificial Sequence
  epidermal growth factor receptor (EGFR), ERBB1 phosphotyrosine kinase siRNA
ctgtatccagtgtgcccactaca

SEQ ID NO: 6816 - DNA, 23 bp, Artificial Sequence
  epidermal growth factor receptor (EGFR), ERBB1 phosphotyrosine kinase siRNA
tgtatccagtgtgcccactacat

SEQ ID NO: 6817 - DNA, 23 bp, Artificial Sequence
  epidermal growth factor receptor (EGFR), ERBB1 phosphotyrosine kinase siRNA
gtatccagtgtgcccactacatt

SEQ ID NO: 6818 - DNA, 23 bp, Artificial Sequence
  epidermal growth factor receptor (EGFR), ERBB1 phosphotyrosine kinase siRNA
tatccagtgtgcccactacattg

SEQ ID NO: 6819 - DNA, 23 bp, Artificial Sequence
  epidermal growth factor receptor (EGFR), ERBB1 phosphotyrosine kinase siRNA
atccagtgtgcccactacattga

SEQ ID NO: 6820 - DNA, 23 bp, Artificial Sequence
  epidermal growth factor receptor (EGFR), ERBB1 phosphotyrosine kinase siRNA
tccagtgtgcccactacattgac

SEQ ID NO: 6821 - DNA, 23 bp, Artificial Sequence
  epidermal growth factor receptor (EGFR), ERBB1 phosphotyrosine kinase siRNA
ccagtgtgcccactacattgacg

SEQ ID NO: 6822 - DNA, 23 bp, Artificial Sequence
  epidermal growth factor receptor (EGFR), ERBB1 phosphotyrosine kinase siRNA
cagtgtgcccactacattgacgg

SEQ ID NO: 6823 - DNA, 23 bp, Artificial Sequence
  epidermal growth factor receptor (EGFR), ERBB1 phosphotyrosine kinase siRNA
agtgtgcccactacattgacggc

SEQ ID NO: 6824 - DNA, 23 bp, Artificial Sequence
  epidermal growth factor receptor (EGFR), ERBB1 phosphotyrosine kinase siRNA
gtgtgcccactacattgacggcc

SEQ ID NO: 6825 - DNA, 23 bp, Artificial Sequence
  epidermal growth factor receptor (EGFR), ERBB1 phosphotyrosine kinase siRNA
tgtgcccactacattgacggccc

SEQ ID NO: 6826 - DNA, 23 bp, Artificial Sequence
  epidermal growth factor receptor (EGFR), ERBB1 phosphotyrosine kinase siRNA
gtgcccactacattgacggcccc

SEQ ID NO: 6827 - DNA, 23 bp, Artificial Sequence
  epidermal growth factor receptor (EGFR), ERBB1 phosphotyrosine kinase siRNA
tgcccactacattgacggccccc

SEQ ID NO: 6828 - DNA, 23 bp, Artificial Sequence
  epidermal growth factor receptor (EGFR), ERBB1 phosphotyrosine kinase siRNA
gcccactacattgacggccccca

SEQ ID NO: 6829 - DNA, 23 bp, Artificial Sequence
  epidermal growth factor receptor (EGFR), ERBB1 phosphotyrosine kinase siRNA
cccactacattgacggcccccac

SEQ ID NO: 6830 - DNA, 23 bp, Artificial Sequence
  epidermal growth factor receptor (EGFR), ERBB1 phosphotyrosine kinase siRNA
ccactacattgacggcccccact

SEQ ID NO: 6831 - DNA, 23 bp, Artificial Sequence
  epidermal growth factor receptor (EGFR), ERBB1 phosphotyrosine kinase siRNA
cactacattgacggcccccactg

SEQ ID NO: 6832 - DNA, 23 bp, Artificial Sequence
  epidermal growth factor receptor (EGFR), ERBB1 phosphotyrosine kinase siRNA
actacattgacggcccccactgc

SEQ ID NO: 6833 - DNA, 23 bp, Artificial Sequence
  epidermal growth factor receptor (EGFR), ERBB1 phosphotyrosine kinase siRNA
ctacattgacggcccccactgcg

SEQ ID NO: 6834 - DNA, 23 bp, Artificial Sequence
  epidermal growth factor receptor (EGFR), ERBB1 phosphotyrosine kinase siRNA
tacattgacggcccccactgcgt

SEQ ID NO: 6835 - DNA, 23 bp, Artificial Sequence
  epidermal growth factor receptor (EGFR), ERBB1 phosphotyrosine kinase siRNA
acattgacggcccccactgcgtc

SEQ ID NO: 6836 - DNA, 23 bp, Artificial Sequence
  epidermal growth factor receptor (EGFR), ERBB1 phosphotyrosine kinase siRNA
cattgacggcccccactgcgtca

SEQ ID NO: 6837 - DNA, 23 bp, Artificial Sequence
  epidermal growth factor receptor (EGFR), ERBB1 phosphotyrosine kinase siRNA
attgacggcccccactgcgtcaa

SEQ ID NO: 6838 - DNA, 23 bp, Artificial Sequence
  epidermal growth factor receptor (EGFR), ERBB1 phosphotyrosine kinase siRNA
ttgacggcccccactgcgtcaag

SEQ ID NO: 6839 - DNA, 23 bp, Artificial Sequence
  epidermal growth factor receptor (EGFR), ERBB1 phosphotyrosine kinase siRNA
tgacggcccccactgcgtcaaga

SEQ ID NO: 6840 - DNA, 23 bp, Artificial Sequence
  epidermal growth factor receptor (EGFR), ERBB1 phosphotyrosine kinase siRNA
gacggcccccactgcgtcaagac

SEQ ID NO: 6841 - DNA, 23 bp, Artificial Sequence
  epidermal growth factor receptor (EGFR), ERBB1 phosphotyrosine kinase siRNA
acggcccccactgcgtcaagacc

SEQ ID NO: 6842 - DNA, 23 bp, Artificial Sequence
  epidermal growth factor receptor (EGFR), ERBB1 phosphotyrosine kinase siRNA
cggcccccactgcgtcaagacct

SEQ ID NO: 6843 - DNA, 23 bp, Artificial Sequence
  epidermal growth factor receptor (EGFR), ERBB1 phosphotyrosine kinase siRNA
ggcccccactgcgtcaagacctg

SEQ ID NO: 6844 - DNA, 23 bp, Artificial Sequence
  epidermal growth factor receptor (EGFR), ERBB1 phosphotyrosine kinase siRNA
gcccccactgcgtcaagacctgc

SEQ ID NO: 6845 - DNA, 23 bp, Artificial Sequence
  epidermal growth factor receptor (EGFR), ERBB1 phosphotyrosine kinase siRNA
cccccactgcgtcaagacctgcc

SEQ ID NO: 6846 - DNA, 23 bp, Artificial Sequence
  epidermal growth factor receptor (EGFR), ERBB1 phosphotyrosine kinase siRNA
ccccactgcgtcaagacctgccc

SEQ ID NO: 6847 - DNA, 23 bp, Artificial Sequence
  epidermal growth factor receptor (EGFR), ERBB1 phosphotyrosine kinase siRNA
cccactgcgtcaagacctgcccg

SEQ ID NO: 6848 - DNA, 23 bp, Artificial Sequence
  epidermal growth factor receptor (EGFR), ERBB1 phosphotyrosine kinase siRNA
ccactgcgtcaagacctgcccgg

SEQ ID NO: 6849 - DNA, 23 bp, Artificial Sequence
  epidermal growth factor receptor (EGFR), ERBB1 phosphotyrosine kinase siRNA
cactgcgtcaagacctgcccggc

SEQ ID NO: 6850 - DNA, 23 bp, Artificial Sequence
  epidermal growth factor receptor (EGFR), ERBB1 phosphotyrosine kinase siRNA
actgcgtcaagacctgcccggca

SEQ ID NO: 6851 - DNA, 23 bp, Artificial Sequence
  epidermal growth factor receptor (EGFR), ERBB1 phosphotyrosine kinase siRNA
ctgcgtcaagacctgcccggcag

SEQ ID NO: 6852 - DNA, 23 bp, Artificial Sequence
  epidermal growth factor receptor (EGFR), ERBB1 phosphotyrosine kinase siRNA
tgcgtcaagacctgcccggcagg

SEQ ID NO: 6853 - DNA, 23 bp, Artificial Sequence
  epidermal growth factor receptor (EGFR), ERBB1 phosphotyrosine kinase siRNA
gcgtcaagacctgcccggcagga

SEQ ID NO: 6854 - DNA, 23 bp, Artificial Sequence
  epidermal growth factor receptor (EGFR), ERBB1 phosphotyrosine kinase siRNA
cgtcaagacctgcccggcaggag

SEQ ID NO: 6855 - DNA, 23 bp, Artificial Sequence
  epidermal growth factor receptor (EGFR), ERBB1 phosphotyrosine kinase siRNA
gtcaagacctgcccggcaggagt

SEQ ID NO: 6856 - DNA, 23 bp, Artificial Sequence
  epidermal growth factor receptor (EGFR), ERBB1 phosphotyrosine kinase siRNA
tcaagacctgcccggcaggagtc

SEQ ID NO: 6857 - DNA, 23 bp, Artificial Sequence
  epidermal growth factor receptor (EGFR), ERBB1 phosphotyrosine kinase siRNA
caagacctgcccggcaggagtca

SEQ ID NO: 6858 - DNA, 23 bp, Artificial Sequence
  epidermal growth factor receptor (EGFR), ERBB1 phosphotyrosine kinase siRNA
aagacctgcccggcaggagtcat

SEQ ID NO: 6859 - DNA, 23 bp, Artificial Sequence
  epidermal growth factor receptor (EGFR), ERBB1 phosphotyrosine kinase siRNA
agacctgcccggcaggagtcatg

SEQ ID NO: 6860 - DNA, 23 bp, Artificial Sequence
  epidermal growth factor receptor (EGFR), ERBB1 phosphotyrosine kinase siRNA
gacctgcccggcaggagtcatgg

SEQ ID NO: 6861 - DNA, 23 bp, Artificial Sequence
  epidermal growth factor receptor (EGFR), ERBB1 phosphotyrosine kinase siRNA
acctgcccggcaggagtcatggg

SEQ ID NO: 6862 - DNA, 23 bp, Artificial Sequence
  epidermal growth factor receptor (EGFR), ERBB1 phosphotyrosine kinase siRNA
cctgcccggcaggagtcatggga

SEQ ID NO: 6863 - DNA, 23 bp, Artificial Sequence
  epidermal growth factor receptor (EGFR), ERBB1 phosphotyrosine kinase siRNA
ctgcccggcaggagtcatgggag

SEQ ID NO: 6864 - DNA, 23 bp, Artificial Sequence
  epidermal growth factor receptor (EGFR), ERBB1 phosphotyrosine kinase siRNA
tgcccggcaggagtcatgggaga

SEQ ID NO: 6865 - DNA, 23 bp, Artificial Sequence
  epidermal growth factor receptor (EGFR), ERBB1 phosphotyrosine kinase siRNA
gcccggcaggagtcatgggagaa

SEQ ID NO: 6866 - DNA, 23 bp, Artificial Sequence
  epidermal growth factor receptor (EGFR), ERBB1 phosphotyrosine kinase siRNA
cccggcaggagtcatgggagaaa

SEQ ID NO: 6867 - DNA, 23 bp, Artificial Sequence
  epidermal growth factor receptor (EGFR), ERBB1 phosphotyrosine kinase siRNA
ccggcaggagtcatgggagaaaa

SEQ ID NO: 6868 - DNA, 23 bp, Artificial Sequence
  epidermal growth factor receptor (EGFR), ERBB1 phosphotyrosine kinase siRNA
cggcaggagtcatgggagaaaac

SEQ ID NO: 6869 - DNA, 23 bp, Artificial Sequence
  epidermal growth factor receptor (EGFR), ERBB1 phosphotyrosine kinase siRNA
ggcaggagtcatgggagaaaaca

SEQ ID NO: 6870 - DNA, 23 bp, Artificial Sequence
  epidermal growth factor receptor (EGFR), ERBB1 phosphotyrosine kinase siRNA
gcaggagtcatgggagaaaacaa

SEQ ID NO: 6871 - DNA, 23 bp, Artificial Sequence
  epidermal growth factor receptor (EGFR), ERBB1 phosphotyrosine kinase siRNA
caggagtcatgggagaaaacaac

SEQ ID NO: 6872 - DNA, 23 bp, Artificial Sequence
  epidermal growth factor receptor (EGFR), ERBB1 phosphotyrosine kinase siRNA
aggagtcatgggagaaaacaaca

SEQ ID NO: 6873 - DNA, 23 bp, Artificial Sequence
  epidermal growth factor receptor (EGFR), ERBB1 phosphotyrosine kinase siRNA
ggagtcatgggagaaaacaacac

SEQ ID NO: 6874 - DNA, 23 bp, Artificial Sequence
  epidermal growth factor receptor (EGFR), ERBB1 phosphotyrosine kinase siRNA
gagtcatgggagaaaacaacacc

SEQ ID NO: 6875 - DNA, 23 bp, Artificial Sequence
  epidermal growth factor receptor (EGFR), ERBB1 phosphotyrosine kinase siRNA
agtcatgggagaaaacaacaccc

SEQ ID NO: 6876 - DNA, 23 bp, Artificial Sequence
  epidermal growth factor receptor (EGFR), ERBB1 phosphotyrosine kinase siRNA
gtcatgggagaaaacaacaccct

SEQ ID NO: 6877 - DNA, 23 bp, Artificial Sequence
  epidermal growth factor receptor (EGFR), ERBB1 phosphotyrosine kinase siRNA
tcatgggagaaaacaacaccctg

SEQ ID NO: 6878 - DNA, 23 bp, Artificial Sequence
  epidermal growth factor receptor (EGFR), ERBB1 phosphotyrosine kinase siRNA
catgggagaaaacaacaccctgg

SEQ ID NO: 6879 - DNA, 23 bp, Artificial Sequence
  epidermal growth factor receptor (EGFR), ERBB1 phosphotyrosine kinase siRNA
atgggagaaaacaacaccctggt

SEQ ID NO: 6880 - DNA, 23 bp, Artificial Sequence
  epidermal growth factor receptor (EGFR), ERBB1 phosphotyrosine kinase siRNA
tgggagaaaacaacaccctggtc

SEQ ID NO: 6881 - DNA, 23 bp, Artificial Sequence
  epidermal growth factor receptor (EGFR), ERBB1 phosphotyrosine kinase siRNA
gggagaaaacaacaccctggtct

SEQ ID NO: 6882 - DNA, 23 bp, Artificial Sequence
  epidermal growth factor receptor (EGFR), ERBB1 phosphotyrosine kinase siRNA
ggagaaaacaacaccctggtctg

SEQ ID NO: 6883 - DNA, 23 bp, Artificial Sequence
  epidermal growth factor receptor (EGFR), ERBB1 phosphotyrosine kinase siRNA
gagaaaacaacaccctggtctgg

SEQ ID NO: 6884 - DNA, 23 bp, Artificial Sequence
  epidermal growth factor receptor (EGFR), ERBB1 phosphotyrosine kinase siRNA
agaaaacaacaccctggtctgga

SEQ ID NO: 6885 - DNA, 23 bp, Artificial Sequence
  epidermal growth factor receptor (EGFR), ERBB1 phosphotyrosine kinase siRNA
gaaaacaacaccctggtctggaa

SEQ ID NO: 6886 - DNA, 23 bp, Artificial Sequence
  epidermal growth factor receptor (EGFR), ERBB1 phosphotyrosine kinase siRNA
aaaacaacaccctggtctggaag

SEQ ID NO: 6887 - DNA, 23 bp, Artificial Sequence
  epidermal growth factor receptor (EGFR), ERBB1 phosphotyrosine kinase siRNA
aaacaacaccctggtctggaagt

SEQ ID NO: 6888 - DNA, 23 bp, Artificial Sequence
  epidermal growth factor receptor (EGFR), ERBB1 phosphotyrosine kinase siRNA
aacaacaccctggtctggaagta

SEQ ID NO: 6889 - DNA, 23 bp, Artificial Sequence
  epidermal growth factor receptor (EGFR), ERBB1 phosphotyrosine kinase siRNA
acaacaccctggtctggaagtac

SEQ ID NO: 6890 - DNA, 23 bp, Artificial Sequence
  epidermal growth factor receptor (EGFR), ERBB1 phosphotyrosine kinase siRNA
caacaccctggtctggaagtacg

SEQ ID NO: 6891 - DNA, 23 bp, Artificial Sequence
  epidermal growth factor receptor (EGFR), ERBB1 phosphotyrosine kinase siRNA
aacaccctggtctggaagtacgc

SEQ ID NO: 6892 - DNA, 23 bp, Artificial Sequence
  epidermal growth factor receptor (EGFR), ERBB1 phosphotyrosine kinase siRNA
acaccctggtctggaagtacgca

SEQ ID NO: 6893 - DNA, 23 bp, Artificial Sequence
  epidermal growth factor receptor (EGFR), ERBB1 phosphotyrosine kinase siRNA
caccctggtctggaagtacgcag

SEQ ID NO: 6894 - DNA, 23 bp, Artificial Sequence
  epidermal growth factor receptor (EGFR), ERBB1 phosphotyrosine kinase siRNA
accctggtctggaagtacgcaga

SEQ ID NO: 6895 - DNA, 23 bp, Artificial Sequence
  epidermal growth factor receptor (EGFR), ERBB1 phosphotyrosine kinase siRNA
ccctggtctggaagtacgcagac

SEQ ID NO: 6896 - DNA, 23 bp, Artificial Sequence
  epidermal growth factor receptor (EGFR), ERBB1 phosphotyrosine kinase siRNA
cctggtctggaagtacgcagacg

SEQ ID NO: 6897 - DNA, 23 bp, Artificial Sequence
  epidermal growth factor receptor (EGFR), ERBB1 phosphotyrosine kinase siRNA
ctggtctggaagtacgcagacgc

SEQ ID NO: 6898 - DNA, 23 bp, Artificial Sequence
  epidermal growth factor receptor (EGFR), ERBB1 phosphotyrosine kinase siRNA
tggtctggaagtacgcagacgcc

SEQ ID NO: 6899 - DNA, 23 bp, Artificial Sequence
  epidermal growth factor receptor (EGFR), ERBB1 phosphotyrosine kinase siRNA
ggtctggaagtacgcagacgccg

SEQ ID NO: 6900 - DNA, 23 bp, Artificial Sequence
  epidermal growth factor receptor (EGFR), ERBB1 phosphotyrosine kinase siRNA
gtctggaagtacgcagacgccgg

SEQ ID NO: 6901 - DNA, 23 bp, Artificial Sequence
  epidermal growth factor receptor (EGFR), ERBB1 phosphotyrosine kinase siRNA
tctggaagtacgcagacgccggc

SEQ ID NO: 6902 - DNA, 23 bp, Artificial Sequence
  epidermal growth factor receptor (EGFR), ERBB1 phosphotyrosine kinase siRNA
ctggaagtacgcagacgccggcc

SEQ ID NO: 6903 - DNA, 23 bp, Artificial Sequence
  epidermal growth factor receptor (EGFR), ERBB1 phosphotyrosine kinase siRNA
tggaagtacgcagacgccggcca

SEQ ID NO: 6904 - DNA, 23 bp, Artificial Sequence
  epidermal growth factor receptor (EGFR), ERBB1 phosphotyrosine kinase siRNA
ggaagtacgcagacgccggccat

SEQ ID NO: 6905 - DNA, 23 bp, Artificial Sequence
  epidermal growth factor receptor (EGFR), ERBB1 phosphotyrosine kinase siRNA
gaagtacgcagacgccggccatg

SEQ ID NO: 6906 - DNA, 23 bp, Artificial Sequence
  epidermal growth factor receptor (EGFR), ERBB1 phosphotyrosine kinase siRNA
aagtacgcagacgccggccatgt

SEQ ID NO: 6907 - DNA, 23 bp, Artificial Sequence
  epidermal growth factor receptor (EGFR), ERBB1 phosphotyrosine kinase siRNA
agtacgcagacgccggccatgtg

SEQ ID NO: 6908 - DNA, 23 bp, Artificial Sequence
  epidermal growth factor receptor (EGFR), ERBB1 phosphotyrosine kinase siRNA
gtacgcagacgccggccatgtgt

SEQ ID NO: 6909 - DNA, 23 bp, Artificial Sequence
  epidermal growth factor receptor (EGFR), ERBB1 phosphotyrosine kinase siRNA
tacgcagacgccggccatgtgtg

SEQ ID NO: 6910 - DNA, 23 bp, Artificial Sequence
  epidermal growth factor receptor (EGFR), ERBB1 phosphotyrosine kinase siRNA
acgcagacgccggccatgtgtgc

SEQ ID NO: 6911 - DNA, 23 bp, Artificial Sequence
  epidermal growth factor receptor (EGFR), ERBB1 phosphotyrosine kinase siRNA
cgcagacgccggccatgtgtgcc

SEQ ID NO: 6912 - DNA, 23 bp, Artificial Sequence
  epidermal growth factor receptor (EGFR), ERBB1 phosphotyrosine kinase siRNA
gcagacgccggccatgtgtgcca

SEQ ID NO: 6913 - DNA, 23 bp, Artificial Sequence
  epidermal growth factor receptor (EGFR), ERBB1 phosphotyrosine kinase siRNA
cagacgccggccatgtgtgccac

SEQ ID NO: 6914 - DNA, 23 bp, Artificial Sequence
  epidermal growth factor receptor (EGFR), ERBB1 phosphotyrosine kinase siRNA
agacgccggccatgtgtgccacc

SEQ ID NO: 6915 - DNA, 23 bp, Artificial Sequence
  epidermal growth factor receptor (EGFR), ERBB1 phosphotyrosine kinase siRNA
gacgccggccatgtgtgccacct

SEQ ID NO: 6916 - DNA, 23 bp, Artificial Sequence
  epidermal growth factor receptor (EGFR), ERBB1 phosphotyrosine kinase siRNA
acgccggccatgtgtgccacctg

SEQ ID NO: 6917 - DNA, 23 bp, Artificial Sequence
  epidermal growth factor receptor (EGFR), ERBB1 phosphotyrosine kinase siRNA
cgccggccatgtgtgccacctgt

SEQ ID NO: 6918 - DNA, 23 bp, Artificial Sequence
  epidermal growth factor receptor (EGFR), ERBB1 phosphotyrosine kinase siRNA
gccggccatgtgtgccacctgtg

SEQ ID NO: 6919 - DNA, 23 bp, Artificial Sequence
  epidermal growth factor receptor (EGFR), ERBB1 phosphotyrosine kinase siRNA
ccggccatgtgtgccacctgtgc

SEQ ID NO: 6920 - DNA, 23 bp, Artificial Sequence
  epidermal growth factor receptor (EGFR), ERBB1 phosphotyrosine kinase siRNA
cggccatgtgtgccacctgtgcc

SEQ ID NO: 6921 - DNA, 23 bp, Artificial Sequence
  epidermal growth factor receptor (EGFR), ERBB1 phosphotyrosine kinase siRNA
ggccatgtgtgccacctgtgcca

SEQ ID NO: 6922 - DNA, 23 bp, Artificial Sequence
  epidermal growth factor receptor (EGFR), ERBB1 phosphotyrosine kinase siRNA
gccatgtgtgccacctgtgccat

SEQ ID NO: 6923 - DNA, 23 bp, Artificial Sequence
  epidermal growth factor receptor (EGFR), ERBB1 phosphotyrosine kinase siRNA
ccatgtgtgccacctgtgccatc

SEQ ID NO: 6924 - DNA, 23 bp, Artificial Sequence
  epidermal growth factor receptor (EGFR), ERBB1 phosphotyrosine kinase siRNA
catgtgtgccacctgtgccatcc

SEQ ID NO: 6925 - DNA, 23 bp, Artificial Sequence
  epidermal growth factor receptor (EGFR), ERBB1 phosphotyrosine kinase siRNA
atgtgtgccacctgtgccatcca

SEQ ID NO: 6926 - DNA, 23 bp, Artificial Sequence
  epidermal growth factor receptor (EGFR), ERBB1 phosphotyrosine kinase siRNA
tgtgtgccacctgtgccatccaa

SEQ ID NO: 6927 - DNA, 23 bp, Artificial Sequence
  epidermal growth factor receptor (EGFR), ERBB1 phosphotyrosine kinase siRNA
gtgtgccacctgtgccatccaaa

SEQ ID NO: 6928 - DNA, 23 bp, Artificial Sequence
  epidermal growth factor receptor (EGFR), ERBB1 phosphotyrosine kinase siRNA
tgtgccacctgtgccatccaaac

SEQ ID NO: 6929 - DNA, 23 bp, Artificial Sequence
  epidermal growth factor receptor (EGFR), ERBB1 phosphotyrosine kinase siRNA
gtgccacctgtgccatccaaact

SEQ ID NO: 6930 - DNA, 23 bp, Artificial Sequence
  epidermal growth factor receptor (EGFR), ERBB1 phosphotyrosine kinase siRNA
tgccacctgtgccatccaaactg

SEQ ID NO: 6931 - DNA, 23 bp, Artificial Sequence
  epidermal growth factor receptor (EGFR), ERBB1 phosphotyrosine kinase siRNA
gccacctgtgccatccaaactgc

SEQ ID NO: 6932 - DNA, 23 bp, Artificial Sequence
  epidermal growth factor receptor (EGFR), ERBB1 phosphotyrosine kinase siRNA
ccacctgtgccatccaaactgca

SEQ ID NO: 6933 - DNA, 23 bp, Artificial Sequence
  epidermal growth factor receptor (EGFR), ERBB1 phosphotyrosine kinase siRNA
cacctgtgccatccaaactgcac

SEQ ID NO: 6934 - DNA, 23 bp, Artificial Sequence
  epidermal growth factor receptor (EGFR), ERBB1 phosphotyrosine kinase siRNA
acctgtgccatccaaactgcacc

SEQ ID NO: 6935 - DNA, 23 bp, Artificial Sequence
  epidermal growth factor receptor (EGFR), ERBB1 phosphotyrosine kinase siRNA
cctgtgccatccaaactgcacct

SEQ ID NO: 6936 - DNA, 23 bp, Artificial Sequence
  epidermal growth factor receptor (EGFR), ERBB1 phosphotyrosine kinase siRNA
ctgtgccatccaaactgcaccta

SEQ ID NO: 6937 - DNA, 23 bp, Artificial Sequence
  epidermal growth factor receptor (EGFR), ERBB1 phosphotyrosine kinase siRNA
tgtgccatccaaactgcacctac

SEQ ID NO: 6938 - DNA, 23 bp, Artificial Sequence
  epidermal growth factor receptor (EGFR), ERBB1 phosphotyrosine kinase siRNA
gtgccatccaaactgcacctacg

SEQ ID NO: 6939 - DNA, 23 bp, Artificial Sequence
  epidermal growth factor receptor (EGFR), ERBB1 phosphotyrosine kinase siRNA
tgccatccaaactgcacctacgg

SEQ ID NO: 6940 - DNA, 23 bp, Artificial Sequence
  epidermal growth factor receptor (EGFR), ERBB1 phosphotyrosine kinase siRNA
gccatccaaactgcacctacgga

SEQ ID NO: 6941 - DNA, 23 bp, Artificial Sequence
  epidermal growth factor receptor (EGFR), ERBB1 phosphotyrosine kinase siRNA
ccatccaaactgcacctacggat

SEQ ID NO: 6942 - DNA, 23 bp, Artificial Sequence
  epidermal growth factor receptor (EGFR), ERBB1 phosphotyrosine kinase siRNA
catccaaactgcacctacggatg

SEQ ID NO: 6943 - DNA, 23 bp, Artificial Sequence
  epidermal growth factor receptor (EGFR), ERBB1 phosphotyrosine kinase siRNA
atccaaactgcacctacggatgc

SEQ ID NO: 6944 - DNA, 23 bp, Artificial Sequence
  epidermal growth factor receptor (EGFR), ERBB1 phosphotyrosine kinase siRNA
tccaaactgcacctacggatgca

SEQ ID NO: 6945 - DNA, 23 bp, Artificial Sequence
  epidermal growth factor receptor (EGFR), ERBB1 phosphotyrosine kinase siRNA
ccaaactgcacctacggatgcac

SEQ ID NO: 6946 - DNA, 23 bp, Artificial Sequence
  epidermal growth factor receptor (EGFR), ERBB1 phosphotyrosine kinase siRNA
caaactgcacctacggatgcact

SEQ ID NO: 6947 - DNA, 23 bp, Artificial Sequence
  epidermal growth factor receptor (EGFR), ERBB1 phosphotyrosine kinase siRNA
aaactgcacctacggatgcactg

SEQ ID NO: 6948 - DNA, 23 bp, Artificial Sequence
  epidermal growth factor receptor (EGFR), ERBB1 phosphotyrosine kinase siRNA
aactgcacctacggatgcactgg

SEQ ID NO: 6949 - DNA, 23 bp, Artificial Sequence
  epidermal growth factor receptor (EGFR), ERBB1 phosphotyrosine kinase siRNA
actgcacctacggatgcactggg

SEQ ID NO: 6950 - DNA, 23 bp, Artificial Sequence
  epidermal growth factor receptor (EGFR), ERBB1 phosphotyrosine kinase siRNA
ctgcacctacggatgcactgggc

SEQ ID NO: 6951 - DNA, 23 bp, Artificial Sequence
  epidermal growth factor receptor (EGFR), ERBB1 phosphotyrosine kinase siRNA
tgcacctacggatgcactgggcc

SEQ ID NO: 6952 - DNA, 23 bp, Artificial Sequence
  epidermal growth factor receptor (EGFR), ERBB1 phosphotyrosine kinase siRNA
gcacctacggatgcactgggcca

SEQ ID NO: 6953 - DNA, 23 bp, Artificial Sequence
  epidermal growth factor receptor (EGFR), ERBB1 phosphotyrosine kinase siRNA
cacctacggatgcactgggccag

SEQ ID NO: 6954 - DNA, 23 bp, Artificial Sequence
  epidermal growth factor receptor (EGFR), ERBB1 phosphotyrosine kinase siRNA
acctacggatgcactgggccagg

SEQ ID NO: 6955 - DNA, 23 bp, Artificial Sequence
  epidermal growth factor receptor (EGFR), ERBB1 phosphotyrosine kinase siRNA
cctacggatgcactgggccaggt

SEQ ID NO: 6956 - DNA, 23 bp, Artificial Sequence
  epidermal growth factor receptor (EGFR), ERBB1 phosphotyrosine kinase siRNA
ctacggatgcactgggccaggtc

SEQ ID NO: 6957 - DNA, 23 bp, Artificial Sequence
  epidermal growth factor receptor (EGFR), ERBB1 phosphotyrosine kinase siRNA
tacggatgcactgggccaggtct

SEQ ID NO: 6958 - DNA, 23 bp, Artificial Sequence
  epidermal growth factor receptor (EGFR), ERBB1 phosphotyrosine kinase siRNA
acggatgcactgggccaggtctt

SEQ ID NO: 6959 - DNA, 23 bp, Artificial Sequence
  epidermal growth factor receptor (EGFR), ERBB1 phosphotyrosine kinase siRNA
cggatgcactgggccaggtcttg

SEQ ID NO: 6960 - DNA, 23 bp, Artificial Sequence
  epidermal growth factor receptor (EGFR), ERBB1 phosphotyrosine kinase siRNA
ggatgcactgggccaggtcttga

SEQ ID NO: 6961 - DNA, 23 bp, Artificial Sequence
  epidermal growth factor receptor (EGFR), ERBB1 phosphotyrosine kinase siRNA
gatgcactgggccaggtcttgaa

SEQ ID NO: 6962 - DNA, 23 bp, Artificial Sequence
  epidermal growth factor receptor (EGFR), ERBB1 phosphotyrosine kinase siRNA
atgcactgggccaggtcttgaag

SEQ ID NO: 6963 - DNA, 23 bp, Artificial Sequence
  epidermal growth factor receptor (EGFR), ERBB1 phosphotyrosine kinase siRNA
tgcactgggccaggtcttgaagg

SEQ ID NO: 6964 - DNA, 23 bp, Artificial Sequence
  epidermal growth factor receptor (EGFR), ERBB1 phosphotyrosine kinase siRNA
gcactgggccaggtcttgaaggc

SEQ ID NO: 6965 - DNA, 23 bp, Artificial Sequence
  epidermal growth factor receptor (EGFR), ERBB1 phosphotyrosine kinase siRNA
cactgggccaggtcttgaaggct

SEQ ID NO: 6966 - DNA, 23 bp, Artificial Sequence
  epidermal growth factor receptor (EGFR), ERBB1 phosphotyrosine kinase siRNA
actgggccaggtcttgaaggctg

SEQ ID NO: 6967 - DNA, 23 bp, Artificial Sequence
  epidermal growth factor receptor (EGFR), ERBB1 phosphotyrosine kinase siRNA
ctgggccaggtcttgaaggctgt

SEQ ID NO: 6968 - DNA, 23 bp, Artificial Sequence
  epidermal growth factor receptor (EGFR), ERBB1 phosphotyrosine kinase siRNA
tgggccaggtcttgaaggctgtc

SEQ ID NO: 6969 - DNA, 23 bp, Artificial Sequence
  epidermal growth factor receptor (EGFR), ERBB1 phosphotyrosine kinase siRNA
gggccaggtcttgaaggctgtcc

SEQ ID NO: 6970 - DNA, 23 bp, Artificial Sequence
  epidermal growth factor receptor (EGFR), ERBB1 phosphotyrosine kinase siRNA
ggccaggtcttgaaggctgtcca

SEQ ID NO: 6971 - DNA, 23 bp, Artificial Sequence
  epidermal growth factor receptor (EGFR), ERBB1 phosphotyrosine kinase siRNA
gccaggtcttgaaggctgtccaa

SEQ ID NO: 6972 - DNA, 23 bp, Artificial Sequence
  epidermal growth factor receptor (EGFR), ERBB1 phosphotyrosine kinase siRNA
ccaggtcttgaaggctgtccaac

SEQ ID NO: 6973 - DNA, 23 bp, Artificial Sequence
  epidermal growth factor receptor (EGFR), ERBB1 phosphotyrosine kinase siRNA
caggtcttgaaggctgtccaacg

SEQ ID NO: 6974 - DNA, 23 bp, Artificial Sequence
  epidermal growth factor receptor (EGFR), ERBB1 phosphotyrosine kinase siRNA
aggtcttgaaggctgtccaacga

SEQ ID NO: 6975 - DNA, 23 bp, Artificial Sequence
  epidermal growth factor receptor (EGFR), ERBB1 phosphotyrosine kinase siRNA
ggtcttgaaggctgtccaacgaa

SEQ ID NO: 6976 - DNA, 23 bp, Artificial Sequence
  epidermal growth factor receptor (EGFR), ERBB1 phosphotyrosine kinase siRNA
gtcttgaaggctgtccaacgaat

SEQ ID NO: 6977 - DNA, 23 bp, Artificial Sequence
  epidermal growth factor receptor (EGFR), ERBB1 phosphotyrosine kinase siRNA
tcttgaaggctgtccaacgaatg

SEQ ID NO: 6978 - DNA, 23 bp, Artificial Sequence
  epidermal growth factor receptor (EGFR), ERBB1 phosphotyrosine kinase siRNA
cttgaaggctgtccaacgaatgg

SEQ ID NO: 6979 - DNA, 23 bp, Artificial Sequence
  epidermal growth factor receptor (EGFR), ERBB1 phosphotyrosine kinase siRNA
ttgaaggctgtccaacgaatggg

SEQ ID NO: 6980 - DNA, 23 bp, Artificial Sequence
  epidermal growth factor receptor (EGFR), ERBB1 phosphotyrosine kinase siRNA
tgaaggctgtccaacgaatgggc

SEQ ID NO: 6981 - DNA, 23 bp, Artificial Sequence
  epidermal growth factor receptor (EGFR), ERBB1 phosphotyrosine kinase siRNA
gaaggctgtccaacgaatgggcc

SEQ ID NO: 6982 - DNA, 23 bp, Artificial Sequence
  epidermal growth factor receptor (EGFR), ERBB1 phosphotyrosine kinase siRNA
aaggctgtccaacgaatgggcct

SEQ ID NO: 6983 - DNA, 23 bp, Artificial Sequence
  epidermal growth factor receptor (EGFR), ERBB1 phosphotyrosine kinase siRNA
aggctgtccaacgaatgggccta

SEQ ID NO: 6984 - DNA, 23 bp, Artificial Sequence
  epidermal growth factor receptor (EGFR), ERBB1 phosphotyrosine kinase siRNA
ggctgtccaacgaatgggcctaa

SEQ ID NO: 6985 - DNA, 23 bp, Artificial Sequence
  epidermal growth factor receptor (EGFR), ERBB1 phosphotyrosine kinase siRNA
gctgtccaacgaatgggcctaag

SEQ ID NO: 6986 - DNA, 23 bp, Artificial Sequence
  epidermal growth factor receptor (EGFR), ERBB1 phosphotyrosine kinase siRNA
ctgtccaacgaatgggcctaaga

SEQ ID NO: 6987 - DNA, 23 bp, Artificial Sequence
  epidermal growth factor receptor (EGFR), ERBB1 phosphotyrosine kinase siRNA
tgtccaacgaatgggcctaagat

SEQ ID NO: 6988 - DNA, 23 bp, Artificial Sequence
  epidermal growth factor receptor (EGFR), ERBB1 phosphotyrosine kinase siRNA
gtccaacgaatgggcctaagatc

SEQ ID NO: 6989 - DNA, 23 bp, Artificial Sequence
  epidermal growth factor receptor (EGFR), ERBB1 phosphotyrosine kinase siRNA
tccaacgaatgggcctaagatcc

SEQ ID NO: 6990 - DNA, 23 bp, Artificial Sequence
  epidermal growth factor receptor (EGFR), ERBB1 phosphotyrosine kinase siRNA
ccaacgaatgggcctaagatccc

SEQ ID NO: 6991 - DNA, 23 bp, Artificial Sequence
  epidermal growth factor receptor (EGFR), ERBB1 phosphotyrosine kinase siRNA
caacgaatgggcctaagatcccg

SEQ ID NO: 6992 - DNA, 23 bp, Artificial Sequence
  epidermal growth factor receptor (EGFR), ERBB1 phosphotyrosine kinase siRNA
aacgaatgggcctaagatcccgt

SEQ ID NO: 6993 - DNA, 23 bp, Artificial Sequence
  epidermal growth factor receptor (EGFR), ERBB1 phosphotyrosine kinase siRNA
acgaatgggcctaagatcccgtc

SEQ ID NO: 6994 - DNA, 23 bp, Artificial Sequence
  epidermal growth factor receptor (EGFR), ERBB1 phosphotyrosine kinase siRNA
cgaatgggcctaagatcccgtcc

SEQ ID NO: 6995 - DNA, 23 bp, Artificial Sequence
  epidermal growth factor receptor (EGFR), ERBB1 phosphotyrosine kinase siRNA
gaatgggcctaagatcccgtcca

SEQ ID NO: 6996 - DNA, 23 bp, Artificial Sequence
  epidermal growth factor receptor (EGFR), ERBB1 phosphotyrosine kinase siRNA
aatgggcctaagatcccgtccat

SEQ ID NO: 6997 - DNA, 23 bp, Artificial Sequence
  epidermal growth factor receptor (EGFR), ERBB1 phosphotyrosine kinase siRNA
atgggcctaagatcccgtccatc

SEQ ID NO: 6998 - DNA, 23 bp, Artificial Sequence
  epidermal growth factor receptor (EGFR), ERBB1 phosphotyrosine kinase siRNA
tgggcctaagatcccgtccatcg

SEQ ID NO: 6999 - DNA, 23 bp, Artificial Sequence
  epidermal growth factor receptor (EGFR), ERBB1 phosphotyrosine kinase siRNA
gggcctaagatcccgtccatcgc

SEQ ID NO: 7000 - DNA, 23 bp, Artificial Sequence
  epidermal growth factor receptor (EGFR), ERBB1 phosphotyrosine kinase siRNA
ggcctaagatcccgtccatcgcc

SEQ ID NO: 7001 - DNA, 23 bp, Artificial Sequence
  epidermal growth factor receptor (EGFR), ERBB1 phosphotyrosine kinase siRNA
gcctaagatcccgtccatcgcca

SEQ ID NO: 7002 - DNA, 23 bp, Artificial Sequence
  epidermal growth factor receptor (EGFR), ERBB1 phosphotyrosine kinase siRNA
cctaagatcccgtccatcgccac

SEQ ID NO: 7003 - DNA, 23 bp, Artificial Sequence
  epidermal growth factor receptor (EGFR), ERBB1 phosphotyrosine kinase siRNA
ctaagatcccgtccatcgccact

SEQ ID NO: 7004 - DNA, 23 bp, Artificial Sequence
  epidermal growth factor receptor (EGFR), ERBB1 phosphotyrosine kinase siRNA
taagatcccgtccatcgccactg

SEQ ID NO: 7005 - DNA, 23 bp, Artificial Sequence
  epidermal growth factor receptor (EGFR), ERBB1 phosphotyrosine kinase siRNA
aagatcccgtccatcgccactgg

SEQ ID NO: 7006 - DNA, 23 bp, Artificial Sequence
  epidermal growth factor receptor (EGFR), ERBB1 phosphotyrosine kinase siRNA
agatcccgtccatcgccactggg

SEQ ID NO: 7007 - DNA, 23 bp, Artificial Sequence
  epidermal growth factor receptor (EGFR), ERBB1 phosphotyrosine kinase siRNA
gatcccgtccatcgccactggga

SEQ ID NO: 7008 - DNA, 23 bp, Artificial Sequence
  epidermal growth factor receptor (EGFR), ERBB1 phosphotyrosine kinase siRNA
atcccgtccatcgccactgggat

SEQ ID NO: 7009 - DNA, 23 bp, Artificial Sequence
  epidermal growth factor receptor (EGFR), ERBB1 phosphotyrosine kinase siRNA
tcccgtccatcgccactgggatg

SEQ ID NO: 7010 - DNA, 23 bp, Artificial Sequence
  epidermal growth factor receptor (EGFR), ERBB1 phosphotyrosine kinase siRNA
cccgtccatcgccactgggatgg

SEQ ID NO: 7011 - DNA, 23 bp, Artificial Sequence
  epidermal growth factor receptor (EGFR), ERBB1 phosphotyrosine kinase siRNA
ccgtccatcgccactgggatggt

SEQ ID NO: 7012 - DNA, 23 bp, Artificial Sequence
  epidermal growth factor receptor (EGFR), ERBB1 phosphotyrosine kinase siRNA
cgtccatcgccactgggatggtg

SEQ ID NO: 7013 - DNA, 23 bp, Artificial Sequence
  epidermal growth factor receptor (EGFR), ERBB1 phosphotyrosine kinase siRNA
gtccatcgccactgggatggtgg

SEQ ID NO: 7014 - DNA, 23 bp, Artificial Sequence
  epidermal growth factor receptor (EGFR), ERBB1 phosphotyrosine kinase siRNA
tccatcgccactgggatggtggg

SEQ ID NO: 7015 - DNA, 23 bp, Artificial Sequence
  epidermal growth factor receptor (EGFR), ERBB1 phosphotyrosine kinase siRNA
ccatcgccactgggatggtgggg

SEQ ID NO: 7016 - DNA, 23 bp, Artificial Sequence
  epidermal growth factor receptor (EGFR), ERBB1 phosphotyrosine kinase siRNA
catcgccactgggatggtggggg

SEQ ID NO: 7017 - DNA, 23 bp, Artificial Sequence
  epidermal growth factor receptor (EGFR), ERBB1 phosphotyrosine kinase siRNA
atcgccactgggatggtgggggc

SEQ ID NO: 7018 - DNA, 23 bp, Artificial Sequence
  epidermal growth factor receptor (EGFR), ERBB1 phosphotyrosine kinase siRNA
tcgccactgggatggtgggggcc

SEQ ID NO: 7019 - DNA, 23 bp, Artificial Sequence
  epidermal growth factor receptor (EGFR), ERBB1 phosphotyrosine kinase siRNA
cgccactgggatggtgggggccc

SEQ ID NO: 7020 - DNA, 23 bp, Artificial Sequence
  epidermal growth factor receptor (EGFR), ERBB1 phosphotyrosine kinase siRNA
gccactgggatggtgggggccct

SEQ ID NO: 7021 - DNA, 23 bp, Artificial Sequence
  epidermal growth factor receptor (EGFR), ERBB1 phosphotyrosine kinase siRNA
ccactgggatggtgggggccctc

SEQ ID NO: 7022 - DNA, 23 bp, Artificial Sequence
  epidermal growth factor receptor (EGFR), ERBB1 phosphotyrosine kinase siRNA
cactgggatggtgggggccctcc

SEQ ID NO: 7023 - DNA, 23 bp, Artificial Sequence
  epidermal growth factor receptor (EGFR), ERBB1 phosphotyrosine kinase siRNA
actgggatggtgggggccctcct

SEQ ID NO: 7024 - DNA, 23 bp, Artificial Sequence
  epidermal growth factor receptor (EGFR), ERBB1 phosphotyrosine kinase siRNA
ctgggatggtgggggccctcctc

SEQ ID NO: 7025 - DNA, 23 bp, Artificial Sequence
  epidermal growth factor receptor (EGFR), ERBB1 phosphotyrosine kinase siRNA
tgggatggtgggggccctcctct

SEQ ID NO: 7026 - DNA, 23 bp, Artificial Sequence
  epidermal growth factor receptor (EGFR), ERBB1 phosphotyrosine kinase siRNA
gggatggtgggggccctcctctt

SEQ ID NO: 7027 - DNA, 23 bp, Artificial Sequence
  epidermal growth factor receptor (EGFR), ERBB1 phosphotyrosine kinase siRNA
ggatggtgggggccctcctcttg

SEQ ID NO: 7028 - DNA, 23 bp, Artificial Sequence
  epidermal growth factor receptor (EGFR), ERBB1 phosphotyrosine kinase siRNA
gatggtgggggccctcctcttgc

SEQ ID NO: 7029 - DNA, 23 bp, Artificial Sequence
  epidermal growth factor receptor (EGFR), ERBB1 phosphotyrosine kinase siRNA
atggtgggggccctcctcttgct

SEQ ID NO: 7030 - DNA, 23 bp, Artificial Sequence
  epidermal growth factor receptor (EGFR), ERBB1 phosphotyrosine kinase siRNA
tggtgggggccctcctcttgctg

SEQ ID NO: 7031 - DNA, 23 bp, Artificial Sequence
  epidermal growth factor receptor (EGFR), ERBB1 phosphotyrosine kinase siRNA
ggtgggggccctcctcttgctgc

SEQ ID NO: 7032 - DNA, 23 bp, Artificial Sequence
  epidermal growth factor receptor (EGFR), ERBB1 phosphotyrosine kinase siRNA
gtgggggccctcctcttgctgct

SEQ ID NO: 7033 - DNA, 23 bp, Artificial Sequence
  epidermal growth factor receptor (EGFR), ERBB1 phosphotyrosine kinase siRNA
tgggggccctcctcttgctgctg

SEQ ID NO: 7034 - DNA, 23 bp, Artificial Sequence
  epidermal growth factor receptor (EGFR), ERBB1 phosphotyrosine kinase siRNA
gggggccctcctcttgctgctgg

SEQ ID NO: 7035 - DNA, 23 bp, Artificial Sequence
  epidermal growth factor receptor (EGFR), ERBB1 phosphotyrosine kinase siRNA
ggggccctcctcttgctgctggt

SEQ ID NO: 7036 - DNA, 23 bp, Artificial Sequence
  epidermal growth factor receptor (EGFR), ERBB1 phosphotyrosine kinase siRNA
gggccctcctcttgctgctggtg

SEQ ID NO: 7037 - DNA, 23 bp, Artificial Sequence
  epidermal growth factor receptor (EGFR), ERBB1 phosphotyrosine kinase siRNA
ggccctcctcttgctgctggtgg

SEQ ID NO: 7038 - DNA, 23 bp, Artificial Sequence
  epidermal growth factor receptor (EGFR), ERBB1 phosphotyrosine kinase siRNA
gccctcctcttgctgctggtggt

SEQ ID NO: 7039 - DNA, 23 bp, Artificial Sequence
  epidermal growth factor receptor (EGFR), ERBB1 phosphotyrosine kinase siRNA
ccctcctcttgctgctggtggtg

SEQ ID NO: 7040 - DNA, 23 bp, Artificial Sequence
  epidermal growth factor receptor (EGFR), ERBB1 phosphotyrosine kinase siRNA
cctcctcttgctgctggtggtgg

SEQ ID NO: 7041 - DNA, 23 bp, Artificial Sequence
  epidermal growth factor receptor (EGFR), ERBB1 phosphotyrosine kinase siRNA
ctcctcttgctgctggtggtggc

SEQ ID NO: 7042 - DNA, 23 bp, Artificial Sequence
  epidermal growth factor receptor (EGFR), ERBB1 phosphotyrosine kinase siRNA
tcctcttgctgctggtggtggcc

SEQ ID NO: 7043 - DNA, 23 bp, Artificial Sequence
  epidermal growth factor receptor (EGFR), ERBB1 phosphotyrosine kinase siRNA
cctcttgctgctggtggtggccc

SEQ ID NO: 7044 - DNA, 23 bp, Artificial Sequence
  epidermal growth factor receptor (EGFR), ERBB1 phosphotyrosine kinase siRNA
ctcttgctgctggtggtggccct

SEQ ID NO: 7045 - DNA, 23 bp, Artificial Sequence
  epidermal growth factor receptor (EGFR), ERBB1 phosphotyrosine kinase siRNA
tcttgctgctggtggtggccctg

SEQ ID NO: 7046 - DNA, 23 bp, Artificial Sequence
  epidermal growth factor receptor (EGFR), ERBB1 phosphotyrosine kinase siRNA
cttgctgctggtggtggccctgg

SEQ ID NO: 7047 - DNA, 23 bp, Artificial Sequence
  epidermal growth factor receptor (EGFR), ERBB1 phosphotyrosine kinase siRNA
ttgctgctggtggtggccctggg

SEQ ID NO: 7048 - DNA, 23 bp, Artificial Sequence
  epidermal growth factor receptor (EGFR), ERBB1 phosphotyrosine kinase siRNA
tgctgctggtggtggccctgggg

SEQ ID NO: 7049 - DNA, 23 bp, Artificial Sequence
  epidermal growth factor receptor (EGFR), ERBB1 phosphotyrosine kinase siRNA
gctgctggtggtggccctgggga

SEQ ID NO: 7050 - DNA, 23 bp, Artificial Sequence
  epidermal growth factor receptor (EGFR), ERBB1 phosphotyrosine kinase siRNA
ctgctggtggtggccctggggat

SEQ ID NO: 7051 - DNA, 23 bp, Artificial Sequence
  epidermal growth factor receptor (EGFR), ERBB1 phosphotyrosine kinase siRNA
tgctggtggtggccctggggatc

SEQ ID NO: 7052 - DNA, 23 bp, Artificial Sequence
  epidermal growth factor receptor (EGFR), ERBB1 phosphotyrosine kinase siRNA
gctggtggtggccctggggatcg

SEQ ID NO: 7053 - DNA, 23 bp, Artificial Sequence
  epidermal growth factor receptor (EGFR), ERBB1 phosphotyrosine kinase siRNA
ctggtggtggccctggggatcgg

SEQ ID NO: 7054 - DNA, 23 bp, Artificial Sequence
  epidermal growth factor receptor (EGFR), ERBB1 phosphotyrosine kinase siRNA
tggtggtggccctggggatcggc

SEQ ID NO: 7055 - DNA, 23 bp, Artificial Sequence
  epidermal growth factor receptor (EGFR), ERBB1 phosphotyrosine kinase siRNA
ggtggtggccctggggatcggcc

SEQ ID NO: 7056 - DNA, 23 bp, Artificial Sequence
  epidermal growth factor receptor (EGFR), ERBB1 phosphotyrosine kinase siRNA
gtggtggccctggggatcggcct

SEQ ID NO: 7057 - DNA, 23 bp, Artificial Sequence
  epidermal growth factor receptor (EGFR), ERBB1 phosphotyrosine kinase siRNA
tggtggccctggggatcggcctc

SEQ ID NO: 7058 - DNA, 23 bp, Artificial Sequence
  epidermal growth factor receptor (EGFR), ERBB1 phosphotyrosine kinase siRNA
ggtggccctggggatcggcctct

SEQ ID NO: 7059 - DNA, 23 bp, Artificial Sequence
  epidermal growth factor receptor (EGFR), ERBB1 phosphotyrosine kinase siRNA
gtggccctggggatcggcctctt

SEQ ID NO: 7060 - DNA, 23 bp, Artificial Sequence
  epidermal growth factor receptor (EGFR), ERBB1 phosphotyrosine kinase siRNA
tggccctggggatcggcctcttc

SEQ ID NO: 7061 - DNA, 23 bp, Artificial Sequence
  epidermal growth factor receptor (EGFR), ERBB1 phosphotyrosine kinase siRNA
ggccctggggatcggcctcttca

SEQ ID NO: 7062 - DNA, 23 bp, Artificial Sequence
  epidermal growth factor receptor (EGFR), ERBB1 phosphotyrosine kinase siRNA
gccctggggatcggcctcttcat

SEQ ID NO: 7063 - DNA, 23 bp, Artificial Sequence
  epidermal growth factor receptor (EGFR), ERBB1 phosphotyrosine kinase siRNA
ccctggggatcggcctcttcatg

SEQ ID NO: 7064 - DNA, 23 bp, Artificial Sequence
  epidermal growth factor receptor (EGFR), ERBB1 phosphotyrosine kinase siRNA
cctggggatcggcctcttcatgc

SEQ ID NO: 7065 - DNA, 23 bp, Artificial Sequence
  epidermal growth factor receptor (EGFR), ERBB1 phosphotyrosine kinase siRNA
ctggggatcggcctcttcatgcg

SEQ ID NO: 7066 - DNA, 23 bp, Artificial Sequence
  epidermal growth factor receptor (EGFR), ERBB1 phosphotyrosine kinase siRNA
tggggatcggcctcttcatgcga

SEQ ID NO: 7067 - DNA, 23 bp, Artificial Sequence
  epidermal growth factor receptor (EGFR), ERBB1 phosphotyrosine kinase siRNA
ggggatcggcctcttcatgcgaa

SEQ ID NO: 7068 - DNA, 23 bp, Artificial Sequence
  epidermal growth factor receptor (EGFR), ERBB1 phosphotyrosine kinase siRNA
gggatcggcctcttcatgcgaag

SEQ ID NO: 7069 - DNA, 23 bp, Artificial Sequence
  epidermal growth factor receptor (EGFR), ERBB1 phosphotyrosine kinase siRNA
ggatcggcctcttcatgcgaagg

SEQ ID NO: 7070 - DNA, 23 bp, Artificial Sequence
  epidermal growth factor receptor (EGFR), ERBB1 phosphotyrosine kinase siRNA
gatcggcctcttcatgcgaaggc

SEQ ID NO: 7071 - DNA, 23 bp, Artificial Sequence
  epidermal growth factor receptor (EGFR), ERBB1 phosphotyrosine kinase siRNA
atcggcctcttcatgcgaaggcg

SEQ ID NO: 7072 - DNA, 23 bp, Artificial Sequence
  epidermal growth factor receptor (EGFR), ERBB1 phosphotyrosine kinase siRNA
tcggcctcttcatgcgaaggcgc

SEQ ID NO: 7073 - DNA, 23 bp, Artificial Sequence
  epidermal growth factor receptor (EGFR), ERBB1 phosphotyrosine kinase siRNA
cggcctcttcatgcgaaggcgcc

SEQ ID NO: 7074 - DNA, 23 bp, Artificial Sequence
  epidermal growth factor receptor (EGFR), ERBB1 phosphotyrosine kinase siRNA
ggcctcttcatgcgaaggcgcca

SEQ ID NO: 7075 - DNA, 23 bp, Artificial Sequence
  epidermal growth factor receptor (EGFR), ERBB1 phosphotyrosine kinase siRNA
gcctcttcatgcgaaggcgccac

SEQ ID NO: 7076 - DNA, 23 bp, Artificial Sequence
  epidermal growth factor receptor (EGFR), ERBB1 phosphotyrosine kinase siRNA
cctcttcatgcgaaggcgccaca

SEQ ID NO: 7077 - DNA, 23 bp, Artificial Sequence
  epidermal growth factor receptor (EGFR), ERBB1 phosphotyrosine kinase siRNA
ctcttcatgcgaaggcgccacat

SEQ ID NO: 7078 - DNA, 23 bp, Artificial Sequence
  epidermal growth factor receptor (EGFR), ERBB1 phosphotyrosine kinase siRNA
tcttcatgcgaaggcgccacatc

SEQ ID NO: 7079 - DNA, 23 bp, Artificial Sequence
  epidermal growth factor receptor (EGFR), ERBB1 phosphotyrosine kinase siRNA
cttcatgcgaaggcgccacatcg

SEQ ID NO: 7080 - DNA, 23 bp, Artificial Sequence
  epidermal growth factor receptor (EGFR), ERBB1 phosphotyrosine kinase siRNA
ttcatgcgaaggcgccacatcgt

SEQ ID NO: 7081 - DNA, 23 bp, Artificial Sequence
  epidermal growth factor receptor (EGFR), ERBB1 phosphotyrosine kinase siRNA
tcatgcgaaggcgccacatcgtt

SEQ ID NO: 7082 - DNA, 23 bp, Artificial Sequence
  epidermal growth factor receptor (EGFR), ERBB1 phosphotyrosine kinase siRNA
catgcgaaggcgccacatcgttc

SEQ ID NO: 7083 - DNA, 23 bp, Artificial Sequence
  epidermal growth factor receptor (EGFR), ERBB1 phosphotyrosine kinase siRNA
atgcgaaggcgccacatcgttcg

SEQ ID NO: 7084 - DNA, 23 bp, Artificial Sequence
  epidermal growth factor receptor (EGFR), ERBB1 phosphotyrosine kinase siRNA
tgcgaaggcgccacatcgttcgg

SEQ ID NO: 7085 - DNA, 23 bp, Artificial Sequence
  epidermal growth factor receptor (EGFR), ERBB1 phosphotyrosine kinase siRNA
gcgaaggcgccacatcgttcgga

SEQ ID NO: 7086 - DNA, 23 bp, Artificial Sequence
  epidermal growth factor receptor (EGFR), ERBB1 phosphotyrosine kinase siRNA
cgaaggcgccacatcgttcggaa

SEQ ID NO: 7087 - DNA, 23 bp, Artificial Sequence
  epidermal growth factor receptor (EGFR), ERBB1 phosphotyrosine kinase siRNA
gaaggcgccacatcgttcggaag

SEQ ID NO: 7088 - DNA, 23 bp, Artificial Sequence
  epidermal growth factor receptor (EGFR), ERBB1 phosphotyrosine kinase siRNA
aaggcgccacatcgttcggaagc

SEQ ID NO: 7089 - DNA, 23 bp, Artificial Sequence
  epidermal growth factor receptor (EGFR), ERBB1 phosphotyrosine kinase siRNA
aggcgccacatcgttcggaagcg

SEQ ID NO: 7090 - DNA, 23 bp, Artificial Sequence
  epidermal growth factor receptor (EGFR), ERBB1 phosphotyrosine kinase siRNA
ggcgccacatcgttcggaagcgc

SEQ ID NO: 7091 - DNA, 23 bp, Artificial Sequence
  epidermal growth factor receptor (EGFR), ERBB1 phosphotyrosine kinase siRNA
gcgccacatcgttcggaagcgca

SEQ ID NO: 7092 - DNA, 23 bp, Artificial Sequence
  epidermal growth factor receptor (EGFR), ERBB1 phosphotyrosine kinase siRNA
cgccacatcgttcggaagcgcac

SEQ ID NO: 7093 - DNA, 23 bp, Artificial Sequence
  epidermal growth factor receptor (EGFR), ERBB1 phosphotyrosine kinase siRNA
gccacatcgttcggaagcgcacg

SEQ ID NO: 7094 - DNA, 23 bp, Artificial Sequence
  epidermal growth factor receptor (EGFR), ERBB1 phosphotyrosine kinase siRNA
ccacatcgttcggaagcgcacgc

SEQ ID NO: 7095 - DNA, 23 bp, Artificial Sequence
  epidermal growth factor receptor (EGFR), ERBB1 phosphotyrosine kinase siRNA
cacatcgttcggaagcgcacgct

SEQ ID NO: 7096 - DNA, 23 bp, Artificial Sequence
  epidermal growth factor receptor (EGFR), ERBB1 phosphotyrosine kinase siRNA
acatcgttcggaagcgcacgctg

SEQ ID NO: 7097 - DNA, 23 bp, Artificial Sequence
  epidermal growth factor receptor (EGFR), ERBB1 phosphotyrosine kinase siRNA
catcgttcggaagcgcacgctgc

SEQ ID NO: 7098 - DNA, 23 bp, Artificial Sequence
  epidermal growth factor receptor (EGFR), ERBB1 phosphotyrosine kinase siRNA
atcgttcggaagcgcacgctgcg

SEQ ID NO: 7099 - DNA, 23 bp, Artificial Sequence
  epidermal growth factor receptor (EGFR), ERBB1 phosphotyrosine kinase siRNA
tcgttcggaagcgcacgctgcgg

SEQ ID NO: 7100 - DNA, 23 bp, Artificial Sequence
  epidermal growth factor receptor (EGFR), ERBB1 phosphotyrosine kinase siRNA
cgttcggaagcgcacgctgcgga

SEQ ID NO: 7101 - DNA, 23 bp, Artificial Sequence
  epidermal growth factor receptor (EGFR), ERBB1 phosphotyrosine kinase siRNA
gttcggaagcgcacgctgcggag

SEQ ID NO: 7102 - DNA, 23 bp, Artificial Sequence
  epidermal growth factor receptor (EGFR), ERBB1 phosphotyrosine kinase siRNA
ttcggaagcgcacgctgcggagg

SEQ ID NO: 7103 - DNA, 23 bp, Artificial Sequence
  epidermal growth factor receptor (EGFR), ERBB1 phosphotyrosine kinase siRNA
tcggaagcgcacgctgcggaggc

SEQ ID NO: 7104 - DNA, 23 bp, Artificial Sequence
  epidermal growth factor receptor (EGFR), ERBB1 phosphotyrosine kinase siRNA
cggaagcgcacgctgcggaggct

SEQ ID NO: 7105 - DNA, 23 bp, Artificial Sequence
  epidermal growth factor receptor (EGFR), ERBB1 phosphotyrosine kinase siRNA
ggaagcgcacgctgcggaggctg

SEQ ID NO: 7106 - DNA, 23 bp, Artificial Sequence
  epidermal growth factor receptor (EGFR), ERBB1 phosphotyrosine kinase siRNA
gaagcgcacgctgcggaggctgc

SEQ ID NO: 7107 - DNA, 23 bp, Artificial Sequence
  epidermal growth factor receptor (EGFR), ERBB1 phosphotyrosine kinase siRNA
aagcgcacgctgcggaggctgct

SEQ ID NO: 7108 - DNA, 23 bp, Artificial Sequence
  epidermal growth factor receptor (EGFR), ERBB1 phosphotyrosine kinase siRNA
agcgcacgctgcggaggctgctg

SEQ ID NO: 7109 - DNA, 23 bp, Artificial Sequence
  epidermal growth factor receptor (EGFR), ERBB1 phosphotyrosine kinase siRNA
gcgcacgctgcggaggctgctgc

SEQ ID NO: 7110 - DNA, 23 bp, Artificial Sequence
  epidermal growth factor receptor (EGFR), ERBB1 phosphotyrosine kinase siRNA
cgcacgctgcggaggctgctgca

SEQ ID NO: 7111 - DNA, 23 bp, Artificial Sequence
  epidermal growth factor receptor (EGFR), ERBB1 phosphotyrosine kinase siRNA
gcacgctgcggaggctgctgcag

SEQ ID NO: 7112 - DNA, 23 bp, Artificial Sequence
  epidermal growth factor receptor (EGFR), ERBB1 phosphotyrosine kinase siRNA
cacgctgcggaggctgctgcagg

SEQ ID NO: 7113 - DNA, 23 bp, Artificial Sequence
  epidermal growth factor receptor (EGFR), ERBB1 phosphotyrosine kinase siRNA
acgctgcggaggctgctgcagga

SEQ ID NO: 7114 - DNA, 23 bp, Artificial Sequence
  epidermal growth factor receptor (EGFR), ERBB1 phosphotyrosine kinase siRNA
cgctgcggaggctgctgcaggag

SEQ ID NO: 7115 - DNA, 23 bp, Artificial Sequence
  epidermal growth factor receptor (EGFR), ERBB1 phosphotyrosine kinase siRNA
gctgcggaggctgctgcaggaga

SEQ ID NO: 7116 - DNA, 23 bp, Artificial Sequence
  epidermal growth factor receptor (EGFR), ERBB1 phosphotyrosine kinase siRNA
ctgcggaggctgctgcaggagag

SEQ ID NO: 7117 - DNA, 23 bp, Artificial Sequence
  epidermal growth factor receptor (EGFR), ERBB1 phosphotyrosine kinase siRNA
tgcggaggctgctgcaggagagg

SEQ ID NO: 7118 - DNA, 23 bp, Artificial Sequence
  epidermal growth factor receptor (EGFR), ERBB1 phosphotyrosine kinase siRNA
gcggaggctgctgcaggagaggg

SEQ ID NO: 7119 - DNA, 23 bp, Artificial Sequence
  epidermal growth factor receptor (EGFR), ERBB1 phosphotyrosine kinase siRNA
cggaggctgctgcaggagaggga

SEQ ID NO: 7120 - DNA, 23 bp, Artificial Sequence
  epidermal growth factor receptor (EGFR), ERBB1 phosphotyrosine kinase siRNA
ggaggctgctgcaggagagggag

SEQ ID NO: 7121 - DNA, 23 bp, Artificial Sequence
  epidermal growth factor receptor (EGFR), ERBB1 phosphotyrosine kinase siRNA
gaggctgctgcaggagagggagc

SEQ ID NO: 7122 - DNA, 23 bp, Artificial Sequence
  epidermal growth factor receptor (EGFR), ERBB1 phosphotyrosine kinase siRNA
aggctgctgcaggagagggagct

SEQ ID NO: 7123 - DNA, 23 bp, Artificial Sequence
  epidermal growth factor receptor (EGFR), ERBB1 phosphotyrosine kinase siRNA
ggctgctgcaggagagggagctt

SEQ ID NO: 7124 - DNA, 23 bp, Artificial Sequence
  epidermal growth factor receptor (EGFR), ERBB1 phosphotyrosine kinase siRNA
gctgctgcaggagagggagcttg

SEQ ID NO: 7125 - DNA, 23 bp, Artificial Sequence
  epidermal growth factor receptor (EGFR), ERBB1 phosphotyrosine kinase siRNA
ctgctgcaggagagggagcttgt

SEQ ID NO: 7126 - DNA, 23 bp, Artificial Sequence
  epidermal growth factor receptor (EGFR), ERBB1 phosphotyrosine kinase siRNA
tgctgcaggagagggagcttgtg

SEQ ID NO: 7127 - DNA, 23 bp, Artificial Sequence
  epidermal growth factor receptor (EGFR), ERBB1 phosphotyrosine kinase siRNA
gctgcaggagagggagcttgtgg

SEQ ID NO: 7128 - DNA, 23 bp, Artificial Sequence
  epidermal growth factor receptor (EGFR), ERBB1 phosphotyrosine kinase siRNA
ctgcaggagagggagcttgtgga

SEQ ID NO: 7129 - DNA, 23 bp, Artificial Sequence
  epidermal growth factor receptor (EGFR), ERBB1 phosphotyrosine kinase siRNA
tgcaggagagggagcttgtggag

SEQ ID NO: 7130 - DNA, 23 bp, Artificial Sequence
  epidermal growth factor receptor (EGFR), ERBB1 phosphotyrosine kinase siRNA
gcaggagagggagcttgtggagc

SEQ ID NO: 7131 - DNA, 23 bp, Artificial Sequence
  epidermal growth factor receptor (EGFR), ERBB1 phosphotyrosine kinase siRNA
caggagagggagcttgtggagcc

SEQ ID NO: 7132 - DNA, 23 bp, Artificial Sequence
  epidermal growth factor receptor (EGFR), ERBB1 phosphotyrosine kinase siRNA
aggagagggagcttgtggagcct

SEQ ID NO: 7133 - DNA, 23 bp, Artificial Sequence
  epidermal growth factor receptor (EGFR), ERBB1 phosphotyrosine kinase siRNA
ggagagggagcttgtggagcctc

SEQ ID NO: 7134 - DNA, 23 bp, Artificial Sequence
  epidermal growth factor receptor (EGFR), ERBB1 phosphotyrosine kinase siRNA
gagagggagcttgtggagcctct

SEQ ID NO: 7135 - DNA, 23 bp, Artificial Sequence
  epidermal growth factor receptor (EGFR), ERBB1 phosphotyrosine kinase siRNA
agagggagcttgtggagcctctt

SEQ ID NO: 7136 - DNA, 23 bp, Artificial Sequence
  epidermal growth factor receptor (EGFR), ERBB1 phosphotyrosine kinase siRNA
gagggagcttgtggagcctctta

SEQ ID NO: 7137 - DNA, 23 bp, Artificial Sequence
  epidermal growth factor receptor (EGFR), ERBB1 phosphotyrosine kinase siRNA
agggagcttgtggagcctcttac

SEQ ID NO: 7138 - DNA, 23 bp, Artificial Sequence
  epidermal growth factor receptor (EGFR), ERBB1 phosphotyrosine kinase siRNA
gggagcttgtggagcctcttaca

SEQ ID NO: 7139 - DNA, 23 bp, Artificial Sequence
  epidermal growth factor receptor (EGFR), ERBB1 phosphotyrosine kinase siRNA
ggagcttgtggagcctcttacac

SEQ ID NO: 7140 - DNA, 23 bp, Artificial Sequence
  epidermal growth factor receptor (EGFR), ERBB1 phosphotyrosine kinase siRNA
gagcttgtggagcctcttacacc

SEQ ID NO: 7141 - DNA, 23 bp, Artificial Sequence
  epidermal growth factor receptor (EGFR), ERBB1 phosphotyrosine kinase siRNA
agcttgtggagcctcttacaccc

SEQ ID NO: 7142 - DNA, 23 bp, Artificial Sequence
  epidermal growth factor receptor (EGFR), ERBB1 phosphotyrosine kinase siRNA
gcttgtggagcctcttacaccca

SEQ ID NO: 7143 - DNA, 23 bp, Artificial Sequence
  epidermal growth factor receptor (EGFR), ERBB1 phosphotyrosine kinase siRNA
cttgtggagcctcttacacccag

SEQ ID NO: 7144 - DNA, 23 bp, Artificial Sequence
  epidermal growth factor receptor (EGFR), ERBB1 phosphotyrosine kinase siRNA
ttgtggagcctcttacacccagt

SEQ ID NO: 7145 - DNA, 23 bp, Artificial Sequence
  epidermal growth factor receptor (EGFR), ERBB1 phosphotyrosine kinase siRNA
tgtggagcctcttacacccagtg

SEQ ID NO: 7146 - DNA, 23 bp, Artificial Sequence
  epidermal growth factor receptor (EGFR), ERBB1 phosphotyrosine kinase siRNA
gtggagcctcttacacccagtgg

SEQ ID NO: 7147 - DNA, 23 bp, Artificial Sequence
  epidermal growth factor receptor (EGFR), ERBB1 phosphotyrosine kinase siRNA
tggagcctcttacacccagtgga

SEQ ID NO: 7148 - DNA, 23 bp, Artificial Sequence
  epidermal growth factor receptor (EGFR), ERBB1 phosphotyrosine kinase siRNA
ggagcctcttacacccagtggag

SEQ ID NO: 7149 - DNA, 23 bp, Artificial Sequence
  epidermal growth factor receptor (EGFR), ERBB1 phosphotyrosine kinase siRNA
gagcctcttacacccagtggaga

SEQ ID NO: 7150 - DNA, 23 bp, Artificial Sequence
  epidermal growth factor receptor (EGFR), ERBB1 phosphotyrosine kinase siRNA
agcctcttacacccagtggagaa

SEQ ID NO: 7151 - DNA, 23 bp, Artificial Sequence
  epidermal growth factor receptor (EGFR), ERBB1 phosphotyrosine kinase siRNA
gcctcttacacccagtggagaag

SEQ ID NO: 7152 - DNA, 23 bp, Artificial Sequence
  epidermal growth factor receptor (EGFR), ERBB1 phosphotyrosine kinase siRNA
cctcttacacccagtggagaagc

SEQ ID NO: 7153 - DNA, 23 bp, Artificial Sequence
  epidermal growth factor receptor (EGFR), ERBB1 phosphotyrosine kinase siRNA
ctcttacacccagtggagaagct

SEQ ID NO: 7154 - DNA, 23 bp, Artificial Sequence
  epidermal growth factor receptor (EGFR), ERBB1 phosphotyrosine kinase siRNA
tcttacacccagtggagaagctc

SEQ ID NO: 7155 - DNA, 23 bp, Artificial Sequence
  epidermal growth factor receptor (EGFR), ERBB1 phosphotyrosine kinase siRNA
cttacacccagtggagaagctcc

SEQ ID NO: 7156 - DNA, 23 bp, Artificial Sequence
  epidermal growth factor receptor (EGFR), ERBB1 phosphotyrosine kinase siRNA
ttacacccagtggagaagctccc

SEQ ID NO: 7157 - DNA, 23 bp, Artificial Sequence
  epidermal growth factor receptor (EGFR), ERBB1 phosphotyrosine kinase siRNA
tacacccagtggagaagctccca

SEQ ID NO: 7158 - DNA, 23 bp, Artificial Sequence
  epidermal growth factor receptor (EGFR), ERBB1 phosphotyrosine kinase siRNA
acacccagtggagaagctcccaa

SEQ ID NO: 7159 - DNA, 23 bp, Artificial Sequence
  epidermal growth factor receptor (EGFR), ERBB1 phosphotyrosine kinase siRNA
cacccagtggagaagctcccaac

SEQ ID NO: 7160 - DNA, 23 bp, Artificial Sequence
  epidermal growth factor receptor (EGFR), ERBB1 phosphotyrosine kinase siRNA
acccagtggagaagctcccaacc

SEQ ID NO: 7161 - DNA, 23 bp, Artificial Sequence
  epidermal growth factor receptor (EGFR), ERBB1 phosphotyrosine kinase siRNA
cccagtggagaagctcccaacca

SEQ ID NO: 7162 - DNA, 23 bp, Artificial Sequence
  epidermal growth factor receptor (EGFR), ERBB1 phosphotyrosine kinase siRNA
ccagtggagaagctcccaaccaa

SEQ ID NO: 7163 - DNA, 23 bp, Artificial Sequence
  epidermal growth factor receptor (EGFR), ERBB1 phosphotyrosine kinase siRNA
cagtggagaagctcccaaccaag

SEQ ID NO: 7164 - DNA, 23 bp, Artificial Sequence
  epidermal growth factor receptor (EGFR), ERBB1 phosphotyrosine kinase siRNA
agtggagaagctcccaaccaagc

SEQ ID NO: 7165 - DNA, 23 bp, Artificial Sequence
  epidermal growth factor receptor (EGFR), ERBB1 phosphotyrosine kinase siRNA
gtggagaagctcccaaccaagct

SEQ ID NO: 7166 - DNA, 23 bp, Artificial Sequence
  epidermal growth factor receptor (EGFR), ERBB1 phosphotyrosine kinase siRNA
tggagaagctcccaaccaagctc

SEQ ID NO: 7167 - DNA, 23 bp, Artificial Sequence
  epidermal growth factor receptor (EGFR), ERBB1 phosphotyrosine kinase siRNA
ggagaagctcccaaccaagctct

SEQ ID NO: 7168 - DNA, 23 bp, Artificial Sequence
  epidermal growth factor receptor (EGFR), ERBB1 phosphotyrosine kinase siRNA
gagaagctcccaaccaagctctc

SEQ ID NO: 7169 - DNA, 23 bp, Artificial Sequence
  epidermal growth factor receptor (EGFR), ERBB1 phosphotyrosine kinase siRNA
agaagctcccaaccaagctctct

SEQ ID NO: 7170 - DNA, 23 bp, Artificial Sequence
  epidermal growth factor receptor (EGFR), ERBB1 phosphotyrosine kinase siRNA
gaagctcccaaccaagctctctt

SEQ ID NO: 7171 - DNA, 23 bp, Artificial Sequence
  epidermal growth factor receptor (EGFR), ERBB1 phosphotyrosine kinase siRNA
aagctcccaaccaagctctcttg

SEQ ID NO: 7172 - DNA, 23 bp, Artificial Sequence
  epidermal growth factor receptor (EGFR), ERBB1 phosphotyrosine kinase siRNA
agctcccaaccaagctctcttga

SEQ ID NO: 7173 - DNA, 23 bp, Artificial Sequence
  epidermal growth factor receptor (EGFR), ERBB1 phosphotyrosine kinase siRNA
gctcccaaccaagctctcttgag

SEQ ID NO: 7174 - DNA, 23 bp, Artificial Sequence
  epidermal growth factor receptor (EGFR), ERBB1 phosphotyrosine kinase siRNA
ctcccaaccaagctctcttgagg

SEQ ID NO: 7175 - DNA, 23 bp, Artificial Sequence
  epidermal growth factor receptor (EGFR), ERBB1 phosphotyrosine kinase siRNA
tcccaaccaagctctcttgagga

SEQ ID NO: 7176 - DNA, 23 bp, Artificial Sequence
  epidermal growth factor receptor (EGFR), ERBB1 phosphotyrosine kinase siRNA
cccaaccaagctctcttgaggat

SEQ ID NO: 7177 - DNA, 23 bp, Artificial Sequence
  epidermal growth factor receptor (EGFR), ERBB1 phosphotyrosine kinase siRNA
ccaaccaagctctcttgaggatc

SEQ ID NO: 7178 - DNA, 23 bp, Artificial Sequence
  epidermal growth factor receptor (EGFR), ERBB1 phosphotyrosine kinase siRNA
caaccaagctctcttgaggatct

SEQ ID NO: 7179 - DNA, 23 bp, Artificial Sequence
  epidermal growth factor receptor (EGFR), ERBB1 phosphotyrosine kinase siRNA
aaccaagctctcttgaggatctt

SEQ ID NO: 7180 - DNA, 23 bp, Artificial Sequence
  epidermal growth factor receptor (EGFR), ERBB1 phosphotyrosine kinase siRNA
accaagctctcttgaggatcttg

SEQ ID NO: 7181 - DNA, 23 bp, Artificial Sequence
  epidermal growth factor receptor (EGFR), ERBB1 phosphotyrosine kinase siRNA
ccaagctctcttgaggatcttga

SEQ ID NO: 7182 - DNA, 23 bp, Artificial Sequence
  epidermal growth factor receptor (EGFR), ERBB1 phosphotyrosine kinase siRNA
caagctctcttgaggatcttgaa

SEQ ID NO: 7183 - DNA, 23 bp, Artificial Sequence
  epidermal growth factor receptor (EGFR), ERBB1 phosphotyrosine kinase siRNA
aagctctcttgaggatcttgaag

SEQ ID NO: 7184 - DNA, 23 bp, Artificial Sequence
  epidermal growth factor receptor (EGFR), ERBB1 phosphotyrosine kinase siRNA
agctctcttgaggatcttgaagg

SEQ ID NO: 7185 - DNA, 23 bp, Artificial Sequence
  epidermal growth factor receptor (EGFR), ERBB1 phosphotyrosine kinase siRNA
gctctcttgaggatcttgaagga

SEQ ID NO: 7186 - DNA, 23 bp, Artificial Sequence
  epidermal growth factor receptor (EGFR), ERBB1 phosphotyrosine kinase siRNA
ctctcttgaggatcttgaaggaa

SEQ ID NO: 7187 - DNA, 23 bp, Artificial Sequence
  epidermal growth factor receptor (EGFR), ERBB1 phosphotyrosine kinase siRNA
tctcttgaggatcttgaaggaaa

SEQ ID NO: 7188 - DNA, 23 bp, Artificial Sequence
  epidermal growth factor receptor (EGFR), ERBB1 phosphotyrosine kinase siRNA
ctcttgaggatcttgaaggaaac

SEQ ID NO: 7189 - DNA, 23 bp, Artificial Sequence
  epidermal growth factor receptor (EGFR), ERBB1 phosphotyrosine kinase siRNA
tcttgaggatcttgaaggaaact

SEQ ID NO: 7190 - DNA, 23 bp, Artificial Sequence
  epidermal growth factor receptor (EGFR), ERBB1 phosphotyrosine kinase siRNA
cttgaggatcttgaaggaaactg

SEQ ID NO: 7191 - DNA, 23 bp, Artificial Sequence
  epidermal growth factor receptor (EGFR), ERBB1 phosphotyrosine kinase siRNA
ttgaggatcttgaaggaaactga

SEQ ID NO: 7192 - DNA, 23 bp, Artificial Sequence
  epidermal growth factor receptor (EGFR), ERBB1 phosphotyrosine kinase siRNA
tgaggatcttgaaggaaactgaa

SEQ ID NO: 7193 - DNA, 23 bp, Artificial Sequence
  epidermal growth factor receptor (EGFR), ERBB1 phosphotyrosine kinase siRNA
gaggatcttgaaggaaactgaat

SEQ ID NO: 7194 - DNA, 23 bp, Artificial Sequence
  epidermal growth factor receptor (EGFR), ERBB1 phosphotyrosine kinase siRNA
aggatcttgaaggaaactgaatt

SEQ ID NO: 7195 - DNA, 23 bp, Artificial Sequence
  epidermal growth factor receptor (EGFR), ERBB1 phosphotyrosine kinase siRNA
ggatcttgaaggaaactgaattc

SEQ ID NO: 7196 - DNA, 23 bp, Artificial Sequence
  epidermal growth factor receptor (EGFR), ERBB1 phosphotyrosine kinase siRNA
gatcttgaaggaaactgaattca

SEQ ID NO: 7197 - DNA, 23 bp, Artificial Sequence
  epidermal growth factor receptor (EGFR), ERBB1 phosphotyrosine kinase siRNA
atcttgaaggaaactgaattcaa

SEQ ID NO: 7198 - DNA, 23 bp, Artificial Sequence
  epidermal growth factor receptor (EGFR), ERBB1 phosphotyrosine kinase siRNA
tcttgaaggaaactgaattcaaa

SEQ ID NO: 7199 - DNA, 23 bp, Artificial Sequence
  epidermal growth factor receptor (EGFR), ERBB1 phosphotyrosine kinase siRNA
cttgaaggaaactgaattcaaaa

SEQ ID NO: 7200 - DNA, 23 bp, Artificial Sequence
  epidermal growth factor receptor (EGFR), ERBB1 phosphotyrosine kinase siRNA
ttgaaggaaactgaattcaaaaa

SEQ ID NO: 7201 - DNA, 23 bp, Artificial Sequence
  epidermal growth factor receptor (EGFR), ERBB1 phosphotyrosine kinase siRNA
tgaaggaaactgaattcaaaaag

SEQ ID NO: 7202 - DNA, 23 bp, Artificial Sequence
  epidermal growth factor receptor (EGFR), ERBB1 phosphotyrosine kinase siRNA
gaaggaaactgaattcaaaaaga

SEQ ID NO: 7203 - DNA, 23 bp, Artificial Sequence
  epidermal growth factor receptor (EGFR), ERBB1 phosphotyrosine kinase siRNA
aaggaaactgaattcaaaaagat

SEQ ID NO: 7204 - DNA, 23 bp, Artificial Sequence
  epidermal growth factor receptor (EGFR), ERBB1 phosphotyrosine kinase siRNA
aggaaactgaattcaaaaagatc

SEQ ID NO: 7205 - DNA, 23 bp, Artificial Sequence
  epidermal growth factor receptor (EGFR), ERBB1 phosphotyrosine kinase siRNA
ggaaactgaattcaaaaagatca

SEQ ID NO: 7206 - DNA, 23 bp, Artificial Sequence
  epidermal growth factor receptor (EGFR), ERBB1 phosphotyrosine kinase siRNA
gaaactgaattcaaaaagatcaa

SEQ ID NO: 7207 - DNA, 23 bp, Artificial Sequence
  epidermal growth factor receptor (EGFR), ERBB1 phosphotyrosine kinase siRNA
aaactgaattcaaaaagatcaaa

SEQ ID NO: 7208 - DNA, 23 bp, Artificial Sequence
  epidermal growth factor receptor (EGFR), ERBB1 phosphotyrosine kinase siRNA
aactgaattcaaaaagatcaaag

SEQ ID NO: 7209 - DNA, 23 bp, Artificial Sequence
  epidermal growth factor receptor (EGFR), ERBB1 phosphotyrosine kinase siRNA
actgaattcaaaaagatcaaagt

SEQ ID NO: 7210 - DNA, 23 bp, Artificial Sequence
  epidermal growth factor receptor (EGFR), ERBB1 phosphotyrosine kinase siRNA
ctgaattcaaaaagatcaaagtg

SEQ ID NO: 7211 - DNA, 23 bp, Artificial Sequence
  epidermal growth factor receptor (EGFR), ERBB1 phosphotyrosine kinase siRNA
tgaattcaaaaagatcaaagtgc

SEQ ID NO: 7212 - DNA, 23 bp, Artificial Sequence
  epidermal growth factor receptor (EGFR), ERBB1 phosphotyrosine kinase siRNA
gaattcaaaaagatcaaagtgct

SEQ ID NO: 7213 - DNA, 23 bp, Artificial Sequence
  epidermal growth factor receptor (EGFR), ERBB1 phosphotyrosine kinase siRNA
aattcaaaaagatcaaagtgctg

SEQ ID NO: 7214 - DNA, 23 bp, Artificial Sequence
  epidermal growth factor receptor (EGFR), ERBB1 phosphotyrosine kinase siRNA
attcaaaaagatcaaagtgctgg

SEQ ID NO: 7215 - DNA, 23 bp, Artificial Sequence
  epidermal growth factor receptor (EGFR), ERBB1 phosphotyrosine kinase siRNA
ttcaaaaagatcaaagtgctggg

SEQ ID NO: 7216 - DNA, 23 bp, Artificial Sequence
  epidermal growth factor receptor (EGFR), ERBB1 phosphotyrosine kinase siRNA
tcaaaaagatcaaagtgctgggc

SEQ ID NO: 7217 - DNA, 23 bp, Artificial Sequence
  epidermal growth factor receptor (EGFR), ERBB1 phosphotyrosine kinase siRNA
caaaaagatcaaagtgctgggct

SEQ ID NO: 7218 - DNA, 23 bp, Artificial Sequence
  epidermal growth factor receptor (EGFR), ERBB1 phosphotyrosine kinase siRNA
aaaaagatcaaagtgctgggctc

SEQ ID NO: 7219 - DNA, 23 bp, Artificial Sequence
  epidermal growth factor receptor (EGFR), ERBB1 phosphotyrosine kinase siRNA
aaaagatcaaagtgctgggctcc

SEQ ID NO: 7220 - DNA, 23 bp, Artificial Sequence
  epidermal growth factor receptor (EGFR), ERBB1 phosphotyrosine kinase siRNA
aaagatcaaagtgctgggctccg

SEQ ID NO: 7221 - DNA, 23 bp, Artificial Sequence
  epidermal growth factor receptor (EGFR), ERBB1 phosphotyrosine kinase siRNA
aagatcaaagtgctgggctccgg

SEQ ID NO: 7222 - DNA, 23 bp, Artificial Sequence
  epidermal growth factor receptor (EGFR), ERBB1 phosphotyrosine kinase siRNA
agatcaaagtgctgggctccggt

SEQ ID NO: 7223 - DNA, 23 bp, Artificial Sequence
  epidermal growth factor receptor (EGFR), ERBB1 phosphotyrosine kinase siRNA
gatcaaagtgctgggctccggtg

SEQ ID NO: 7224 - DNA, 23 bp, Artificial Sequence
  epidermal growth factor receptor (EGFR), ERBB1 phosphotyrosine kinase siRNA
atcaaagtgctgggctccggtgc

SEQ ID NO: 7225 - DNA, 23 bp, Artificial Sequence
  epidermal growth factor receptor (EGFR), ERBB1 phosphotyrosine kinase siRNA
tcaaagtgctgggctccggtgcg

SEQ ID NO: 7226 - DNA, 23 bp, Artificial Sequence
  epidermal growth factor receptor (EGFR), ERBB1 phosphotyrosine kinase siRNA
caaagtgctgggctccggtgcgt

SEQ ID NO: 7227 - DNA, 23 bp, Artificial Sequence
  epidermal growth factor receptor (EGFR), ERBB1 phosphotyrosine kinase siRNA
aaagtgctgggctccggtgcgtt

SEQ ID NO: 7228 - DNA, 23 bp, Artificial Sequence
  epidermal growth factor receptor (EGFR), ERBB1 phosphotyrosine kinase siRNA
aagtgctgggctccggtgcgttc

SEQ ID NO: 7229 - DNA, 23 bp, Artificial Sequence
  epidermal growth factor receptor (EGFR), ERBB1 phosphotyrosine kinase siRNA
agtgctgggctccggtgcgttcg

SEQ ID NO: 7230 - DNA, 23 bp, Artificial Sequence
  epidermal growth factor receptor (EGFR), ERBB1 phosphotyrosine kinase siRNA
gtgctgggctccggtgcgttcgg

SEQ ID NO: 7231 - DNA, 23 bp, Artificial Sequence
  epidermal growth factor receptor (EGFR), ERBB1 phosphotyrosine kinase siRNA
tgctgggctccggtgcgttcggc

SEQ ID NO: 7232 - DNA, 23 bp, Artificial Sequence
  epidermal growth factor receptor (EGFR), ERBB1 phosphotyrosine kinase siRNA
gctgggctccggtgcgttcggca

SEQ ID NO: 7233 - DNA, 23 bp, Artificial Sequence
  epidermal growth factor receptor (EGFR), ERBB1 phosphotyrosine kinase siRNA
ctgggctccggtgcgttcggcac

SEQ ID NO: 7234 - DNA, 23 bp, Artificial Sequence
  epidermal growth factor receptor (EGFR), ERBB1 phosphotyrosine kinase siRNA
tgggctccggtgcgttcggcacg

SEQ ID NO: 7235 - DNA, 23 bp, Artificial Sequence
  epidermal growth factor receptor (EGFR), ERBB1 phosphotyrosine kinase siRNA
gggctccggtgcgttcggcacgg

SEQ ID NO: 7236 - DNA, 23 bp, Artificial Sequence
  epidermal growth factor receptor (EGFR), ERBB1 phosphotyrosine kinase siRNA
ggctccggtgcgttcggcacggt

SEQ ID NO: 7237 - DNA, 23 bp, Artificial Sequence
  epidermal growth factor receptor (EGFR), ERBB1 phosphotyrosine kinase siRNA
gctccggtgcgttcggcacggtg

SEQ ID NO: 7238 - DNA, 23 bp, Artificial Sequence
  epidermal growth factor receptor (EGFR), ERBB1 phosphotyrosine kinase siRNA
ctccggtgcgttcggcacggtgt

SEQ ID NO: 7239 - DNA, 23 bp, Artificial Sequence
  epidermal growth factor receptor (EGFR), ERBB1 phosphotyrosine kinase siRNA
tccggtgcgttcggcacggtgta

SEQ ID NO: 7240 - DNA, 23 bp, Artificial Sequence
  epidermal growth factor receptor (EGFR), ERBB1 phosphotyrosine kinase siRNA
ccggtgcgttcggcacggtgtat

SEQ ID NO: 7241 - DNA, 23 bp, Artificial Sequence
  epidermal growth factor receptor (EGFR), ERBB1 phosphotyrosine kinase siRNA
cggtgcgttcggcacggtgtata

SEQ ID NO: 7242 - DNA, 23 bp, Artificial Sequence
  epidermal growth factor receptor (EGFR), ERBB1 phosphotyrosine kinase siRNA
ggtgcgttcggcacggtgtataa

SEQ ID NO: 7243 - DNA, 23 bp, Artificial Sequence
  epidermal growth factor receptor (EGFR), ERBB1 phosphotyrosine kinase siRNA
gtgcgttcggcacggtgtataag

SEQ ID NO: 7244 - DNA, 23 bp, Artificial Sequence
  epidermal growth factor receptor (EGFR), ERBB1 phosphotyrosine kinase siRNA
tgcgttcggcacggtgtataagg

SEQ ID NO: 7245 - DNA, 23 bp, Artificial Sequence
  epidermal growth factor receptor (EGFR), ERBB1 phosphotyrosine kinase siRNA
gcgttcggcacggtgtataaggg

SEQ ID NO: 7246 - DNA, 23 bp, Artificial Sequence
  epidermal growth factor receptor (EGFR), ERBB1 phosphotyrosine kinase siRNA
cgttcggcacggtgtataaggga

SEQ ID NO: 7247 - DNA, 23 bp, Artificial Sequence
  epidermal growth factor receptor (EGFR), ERBB1 phosphotyrosine kinase siRNA
gttcggcacggtgtataagggac

SEQ ID NO: 7248 - DNA, 23 bp, Artificial Sequence
  epidermal growth factor receptor (EGFR), ERBB1 phosphotyrosine kinase siRNA
ttcggcacggtgtataagggact

SEQ ID NO: 7249 - DNA, 23 bp, Artificial Sequence
  epidermal growth factor receptor (EGFR), ERBB1 phosphotyrosine kinase siRNA
tcggcacggtgtataagggactc

SEQ ID NO: 7250 - DNA, 23 bp, Artificial Sequence
  epidermal growth factor receptor (EGFR), ERBB1 phosphotyrosine kinase siRNA
cggcacggtgtataagggactct

SEQ ID NO: 7251 - DNA, 23 bp, Artificial Sequence
  epidermal growth factor receptor (EGFR), ERBB1 phosphotyrosine kinase siRNA
ggcacggtgtataagggactctg

SEQ ID NO: 7252 - DNA, 23 bp, Artificial Sequence
  epidermal growth factor receptor (EGFR), ERBB1 phosphotyrosine kinase siRNA
gcacggtgtataagggactctgg

SEQ ID NO: 7253 - DNA, 23 bp, Artificial Sequence
  epidermal growth factor receptor (EGFR), ERBB1 phosphotyrosine kinase siRNA
cacggtgtataagggactctgga

SEQ ID NO: 7254 - DNA, 23 bp, Artificial Sequence
  epidermal growth factor receptor (EGFR), ERBB1 phosphotyrosine kinase siRNA
acggtgtataagggactctggat

SEQ ID NO: 7255 - DNA, 23 bp, Artificial Sequence
  epidermal growth factor receptor (EGFR), ERBB1 phosphotyrosine kinase siRNA
cggtgtataagggactctggatc

SEQ ID NO: 7256 - DNA, 23 bp, Artificial Sequence
  epidermal growth factor receptor (EGFR), ERBB1 phosphotyrosine kinase siRNA
ggtgtataagggactctggatcc

SEQ ID NO: 7257 - DNA, 23 bp, Artificial Sequence
  epidermal growth factor receptor (EGFR), ERBB1 phosphotyrosine kinase siRNA
gtgtataagggactctggatccc

SEQ ID NO: 7258 - DNA, 23 bp, Artificial Sequence
  epidermal growth factor receptor (EGFR), ERBB1 phosphotyrosine kinase siRNA
tgtataagggactctggatccca

SEQ ID NO: 7259 - DNA, 23 bp, Artificial Sequence
  epidermal growth factor receptor (EGFR), ERBB1 phosphotyrosine kinase siRNA
gtataagggactctggatcccag

SEQ ID NO: 7260 - DNA, 23 bp, Artificial Sequence
  epidermal growth factor receptor (EGFR), ERBB1 phosphotyrosine kinase siRNA
tataagggactctggatcccaga

SEQ ID NO: 7261 - DNA, 23 bp, Artificial Sequence
  epidermal growth factor receptor (EGFR), ERBB1 phosphotyrosine kinase siRNA
ataagggactctggatcccagaa

SEQ ID NO: 7262 - DNA, 23 bp, Artificial Sequence
  epidermal growth factor receptor (EGFR), ERBB1 phosphotyrosine kinase siRNA
taagggactctggatcccagaag

SEQ ID NO: 7263 - DNA, 23 bp, Artificial Sequence
  epidermal growth factor receptor (EGFR), ERBB1 phosphotyrosine kinase siRNA
aagggactctggatcccagaagg

SEQ ID NO: 7264 - DNA, 23 bp, Artificial Sequence
  epidermal growth factor receptor (EGFR), ERBB1 phosphotyrosine kinase siRNA
agggactctggatcccagaaggt

SEQ ID NO: 7265 - DNA, 23 bp, Artificial Sequence
  epidermal growth factor receptor (EGFR), ERBB1 phosphotyrosine kinase siRNA
gggactctggatcccagaaggtg

SEQ ID NO: 7266 - DNA, 23 bp, Artificial Sequence
  epidermal growth factor receptor (EGFR), ERBB1 phosphotyrosine kinase siRNA
ggactctggatcccagaaggtga

SEQ ID NO: 7267 - DNA, 23 bp, Artificial Sequence
  epidermal growth factor receptor (EGFR), ERBB1 phosphotyrosine kinase siRNA
gactctggatcccagaaggtgag

SEQ ID NO: 7268 - DNA, 23 bp, Artificial Sequence
  epidermal growth factor receptor (EGFR), ERBB1 phosphotyrosine kinase siRNA
actctggatcccagaaggtgaga

SEQ ID NO: 7269 - DNA, 23 bp, Artificial Sequence
  epidermal growth factor receptor (EGFR), ERBB1 phosphotyrosine kinase siRNA
ctctggatcccagaaggtgagaa

SEQ ID NO: 7270 - DNA, 23 bp, Artificial Sequence
  epidermal growth factor receptor (EGFR), ERBB1 phosphotyrosine kinase siRNA
tctggatcccagaaggtgagaaa

SEQ ID NO: 7271 - DNA, 23 bp, Artificial Sequence
  epidermal growth factor receptor (EGFR), ERBB1 phosphotyrosine kinase siRNA
ctggatcccagaaggtgagaaag

SEQ ID NO: 7272 - DNA, 23 bp, Artificial Sequence
  epidermal growth factor receptor (EGFR), ERBB1 phosphotyrosine kinase siRNA
tggatcccagaaggtgagaaagt

SEQ ID NO: 7273 - DNA, 23 bp, Artificial Sequence
  epidermal growth factor receptor (EGFR), ERBB1 phosphotyrosine kinase siRNA
ggatcccagaaggtgagaaagtt

SEQ ID NO: 7274 - DNA, 23 bp, Artificial Sequence
  epidermal growth factor receptor (EGFR), ERBB1 phosphotyrosine kinase siRNA
gatcccagaaggtgagaaagtta

SEQ ID NO: 7275 - DNA, 23 bp, Artificial Sequence
  epidermal growth factor receptor (EGFR), ERBB1 phosphotyrosine kinase siRNA
atcccagaaggtgagaaagttaa

SEQ ID NO: 7276 - DNA, 23 bp, Artificial Sequence
  epidermal growth factor receptor (EGFR), ERBB1 phosphotyrosine kinase siRNA
tcccagaaggtgagaaagttaaa

SEQ ID NO: 7277 - DNA, 23 bp, Artificial Sequence
  epidermal growth factor receptor (EGFR), ERBB1 phosphotyrosine kinase siRNA
cccagaaggtgagaaagttaaaa

SEQ ID NO: 7278 - DNA, 23 bp, Artificial Sequence
  epidermal growth factor receptor (EGFR), ERBB1 phosphotyrosine kinase siRNA
ccagaaggtgagaaagttaaaat

SEQ ID NO: 7279 - DNA, 23 bp, Artificial Sequence
  epidermal growth factor receptor (EGFR), ERBB1 phosphotyrosine kinase siRNA
cagaaggtgagaaagttaaaatt

SEQ ID NO: 7280 - DNA, 23 bp, Artificial Sequence
  epidermal growth factor receptor (EGFR), ERBB1 phosphotyrosine kinase siRNA
agaaggtgagaaagttaaaattc

SEQ ID NO: 7281 - DNA, 23 bp, Artificial Sequence
  epidermal growth factor receptor (EGFR), ERBB1 phosphotyrosine kinase siRNA
gaaggtgagaaagttaaaattcc

SEQ ID NO: 7282 - DNA, 23 bp, Artificial Sequence
  epidermal growth factor receptor (EGFR), ERBB1 phosphotyrosine kinase siRNA
aaggtgagaaagttaaaattccc

SEQ ID NO: 7283 - DNA, 23 bp, Artificial Sequence
  epidermal growth factor receptor (EGFR), ERBB1 phosphotyrosine kinase siRNA
aggtgagaaagttaaaattcccg

SEQ ID NO: 7284 - DNA, 23 bp, Artificial Sequence
  epidermal growth factor receptor (EGFR), ERBB1 phosphotyrosine kinase siRNA
ggtgagaaagttaaaattcccgt

SEQ ID NO: 7285 - DNA, 23 bp, Artificial Sequence
  epidermal growth factor receptor (EGFR), ERBB1 phosphotyrosine kinase siRNA
gtgagaaagttaaaattcccgtc

SEQ ID NO: 7286 - DNA, 23 bp, Artificial Sequence
  epidermal growth factor receptor (EGFR), ERBB1 phosphotyrosine kinase siRNA
tgagaaagttaaaattcccgtcg

SEQ ID NO: 7287 - DNA, 23 bp, Artificial Sequence
  epidermal growth factor receptor (EGFR), ERBB1 phosphotyrosine kinase siRNA
gagaaagttaaaattcccgtcgc

SEQ ID NO: 7288 - DNA, 23 bp, Artificial Sequence
  epidermal growth factor receptor (EGFR), ERBB1 phosphotyrosine kinase siRNA
agaaagttaaaattcccgtcgct

SEQ ID NO: 7289 - DNA, 23 bp, Artificial Sequence
  epidermal growth factor receptor (EGFR), ERBB1 phosphotyrosine kinase siRNA
gaaagttaaaattcccgtcgcta

SEQ ID NO: 7290 - DNA, 23 bp, Artificial Sequence
  epidermal growth factor receptor (EGFR), ERBB1 phosphotyrosine kinase siRNA
aaagttaaaattcccgtcgctat

SEQ ID NO: 7291 - DNA, 23 bp, Artificial Sequence
  epidermal growth factor receptor (EGFR), ERBB1 phosphotyrosine kinase siRNA
aagttaaaattcccgtcgctatc

SEQ ID NO: 7292 - DNA, 23 bp, Artificial Sequence
  epidermal growth factor receptor (EGFR), ERBB1 phosphotyrosine kinase siRNA
agttaaaattcccgtcgctatca

SEQ ID NO: 7293 - DNA, 23 bp, Artificial Sequence
  epidermal growth factor receptor (EGFR), ERBB1 phosphotyrosine kinase siRNA
gttaaaattcccgtcgctatcaa

SEQ ID NO: 7294 - DNA, 23 bp, Artificial Sequence
  epidermal growth factor receptor (EGFR), ERBB1 phosphotyrosine kinase siRNA
ttaaaattcccgtcgctatcaag

SEQ ID NO: 7295 - DNA, 23 bp, Artificial Sequence
  epidermal growth factor receptor (EGFR), ERBB1 phosphotyrosine kinase siRNA
taaaattcccgtcgctatcaagg

SEQ ID NO: 7296 - DNA, 23 bp, Artificial Sequence
  epidermal growth factor receptor (EGFR), ERBB1 phosphotyrosine kinase siRNA
aaaattcccgtcgctatcaagga

SEQ ID NO: 7297 - DNA, 23 bp, Artificial Sequence
  epidermal growth factor receptor (EGFR), ERBB1 phosphotyrosine kinase siRNA
aaattcccgtcgctatcaaggaa

SEQ ID NO: 7298 - DNA, 23 bp, Artificial Sequence
  epidermal growth factor receptor (EGFR), ERBB1 phosphotyrosine kinase siRNA
aattcccgtcgctatcaaggaat

SEQ ID NO: 7299 - DNA, 23 bp, Artificial Sequence
  epidermal growth factor receptor (EGFR), ERBB1 phosphotyrosine kinase siRNA
attcccgtcgctatcaaggaatt

SEQ ID NO: 7300 - DNA, 23 bp, Artificial Sequence
  epidermal growth factor receptor (EGFR), ERBB1 phosphotyrosine kinase siRNA
ttcccgtcgctatcaaggaatta

SEQ ID NO: 7301 - DNA, 23 bp, Artificial Sequence
  epidermal growth factor receptor (EGFR), ERBB1 phosphotyrosine kinase siRNA
tcccgtcgctatcaaggaattaa

SEQ ID NO: 7302 - DNA, 23 bp, Artificial Sequence
  epidermal growth factor receptor (EGFR), ERBB1 phosphotyrosine kinase siRNA
cccgtcgctatcaaggaattaag

SEQ ID NO: 7303 - DNA, 23 bp, Artificial Sequence
  epidermal growth factor receptor (EGFR), ERBB1 phosphotyrosine kinase siRNA
ccgtcgctatcaaggaattaaga

SEQ ID NO: 7304 - DNA, 23 bp, Artificial Sequence
  epidermal growth factor receptor (EGFR), ERBB1 phosphotyrosine kinase siRNA
cgtcgctatcaaggaattaagag

SEQ ID NO: 7305 - DNA, 23 bp, Artificial Sequence
  epidermal growth factor receptor (EGFR), ERBB1 phosphotyrosine kinase siRNA
gtcgctatcaaggaattaagaga

SEQ ID NO: 7306 - DNA, 23 bp, Artificial Sequence
  epidermal growth factor receptor (EGFR), ERBB1 phosphotyrosine kinase siRNA
tcgctatcaaggaattaagagaa

SEQ ID NO: 7307 - DNA, 23 bp, Artificial Sequence
  epidermal growth factor receptor (EGFR), ERBB1 phosphotyrosine kinase siRNA
cgctatcaaggaattaagagaag

SEQ ID NO: 7308 - DNA, 23 bp, Artificial Sequence
  epidermal growth factor receptor (EGFR), ERBB1 phosphotyrosine kinase siRNA
gctatcaaggaattaagagaagc

SEQ ID NO: 7309 - DNA, 23 bp, Artificial Sequence
  epidermal growth factor receptor (EGFR), ERBB1 phosphotyrosine kinase siRNA
ctatcaaggaattaagagaagca

SEQ ID NO: 7310 - DNA, 23 bp, Artificial Sequence
  epidermal growth factor receptor (EGFR), ERBB1 phosphotyrosine kinase siRNA
tatcaaggaattaagagaagcaa

SEQ ID NO: 7311 - DNA, 23 bp, Artificial Sequence
  epidermal growth factor receptor (EGFR), ERBB1 phosphotyrosine kinase siRNA
atcaaggaattaagagaagcaac

SEQ ID NO: 7312 - DNA, 23 bp, Artificial Sequence
  epidermal growth factor receptor (EGFR), ERBB1 phosphotyrosine kinase siRNA
tcaaggaattaagagaagcaaca

SEQ ID NO: 7313 - DNA, 23 bp, Artificial Sequence
  epidermal growth factor receptor (EGFR), ERBB1 phosphotyrosine kinase siRNA
caaggaattaagagaagcaacat

SEQ ID NO: 7314 - DNA, 23 bp, Artificial Sequence
  epidermal growth factor receptor (EGFR), ERBB1 phosphotyrosine kinase siRNA
aaggaattaagagaagcaacatc

SEQ ID NO: 7315 - DNA, 23 bp, Artificial Sequence
  epidermal growth factor receptor (EGFR), ERBB1 phosphotyrosine kinase siRNA
aggaattaagagaagcaacatct

SEQ ID NO: 7316 - DNA, 23 bp, Artificial Sequence
  epidermal growth factor receptor (EGFR), ERBB1 phosphotyrosine kinase siRNA
ggaattaagagaagcaacatctc

SEQ ID NO: 7317 - DNA, 23 bp, Artificial Sequence
  epidermal growth factor receptor (EGFR), ERBB1 phosphotyrosine kinase siRNA
gaattaagagaagcaacatctcc

SEQ ID NO: 7318 - DNA, 23 bp, Artificial Sequence
  epidermal growth factor receptor (EGFR), ERBB1 phosphotyrosine kinase siRNA
aattaagagaagcaacatctccg

SEQ ID NO: 7319 - DNA, 23 bp, Artificial Sequence
  epidermal growth factor receptor (EGFR), ERBB1 phosphotyrosine kinase siRNA
attaagagaagcaacatctccga

SEQ ID NO: 7320 - DNA, 23 bp, Artificial Sequence
  epidermal growth factor receptor (EGFR), ERBB1 phosphotyrosine kinase siRNA
ttaagagaagcaacatctccgaa

SEQ ID NO: 7321 - DNA, 23 bp, Artificial Sequence
  epidermal growth factor receptor (EGFR), ERBB1 phosphotyrosine kinase siRNA
taagagaagcaacatctccgaaa

SEQ ID NO: 7322 - DNA, 23 bp, Artificial Sequence
  epidermal growth factor receptor (EGFR), ERBB1 phosphotyrosine kinase siRNA
aagagaagcaacatctccgaaag

SEQ ID NO: 7323 - DNA, 23 bp, Artificial Sequence
  epidermal growth factor receptor (EGFR), ERBB1 phosphotyrosine kinase siRNA
agagaagcaacatctccgaaagc

SEQ ID NO: 7324 - DNA, 23 bp, Artificial Sequence
  epidermal growth factor receptor (EGFR), ERBB1 phosphotyrosine kinase siRNA
gagaagcaacatctccgaaagcc

SEQ ID NO: 7325 - DNA, 23 bp, Artificial Sequence
  epidermal growth factor receptor (EGFR), ERBB1 phosphotyrosine kinase siRNA
agaagcaacatctccgaaagcca

SEQ ID NO: 7326 - DNA, 23 bp, Artificial Sequence
  epidermal growth factor receptor (EGFR), ERBB1 phosphotyrosine kinase siRNA
gaagcaacatctccgaaagccaa

SEQ ID NO: 7327 - DNA, 23 bp, Artificial Sequence
  epidermal growth factor receptor (EGFR), ERBB1 phosphotyrosine kinase siRNA
aagcaacatctccgaaagccaac

SEQ ID NO: 7328 - DNA, 23 bp, Artificial Sequence
  epidermal growth factor receptor (EGFR), ERBB1 phosphotyrosine kinase siRNA
agcaacatctccgaaagccaaca

SEQ ID NO: 7329 - DNA, 23 bp, Artificial Sequence
  epidermal growth factor receptor (EGFR), ERBB1 phosphotyrosine kinase siRNA
gcaacatctccgaaagccaacaa

SEQ ID NO: 7330 - DNA, 23 bp, Artificial Sequence
  epidermal growth factor receptor (EGFR), ERBB1 phosphotyrosine kinase siRNA
caacatctccgaaagccaacaag

SEQ ID NO: 7331 - DNA, 23 bp, Artificial Sequence
  epidermal growth factor receptor (EGFR), ERBB1 phosphotyrosine kinase siRNA
aacatctccgaaagccaacaagg

SEQ ID NO: 7332 - DNA, 23 bp, Artificial Sequence
  epidermal growth factor receptor (EGFR), ERBB1 phosphotyrosine kinase siRNA
acatctccgaaagccaacaagga

SEQ ID NO: 7333 - DNA, 23 bp, Artificial Sequence
  epidermal growth factor receptor (EGFR), ERBB1 phosphotyrosine kinase siRNA
catctccgaaagccaacaaggaa

SEQ ID NO: 7334 - DNA, 23 bp, Artificial Sequence
  epidermal growth factor receptor (EGFR), ERBB1 phosphotyrosine kinase siRNA
atctccgaaagccaacaaggaaa

SEQ ID NO: 7335 - DNA, 23 bp, Artificial Sequence
  epidermal growth factor receptor (EGFR), ERBB1 phosphotyrosine kinase siRNA
tctccgaaagccaacaaggaaat

SEQ ID NO: 7336 - DNA, 23 bp, Artificial Sequence
  epidermal growth factor receptor (EGFR), ERBB1 phosphotyrosine kinase siRNA
ctccgaaagccaacaaggaaatc

SEQ ID NO: 7337 - DNA, 23 bp, Artificial Sequence
  epidermal growth factor receptor (EGFR), ERBB1 phosphotyrosine kinase siRNA
tccgaaagccaacaaggaaatcc

SEQ ID NO: 7338 - DNA, 23 bp, Artificial Sequence
  epidermal growth factor receptor (EGFR), ERBB1 phosphotyrosine kinase siRNA
ccgaaagccaacaaggaaatcct

SEQ ID NO: 7339 - DNA, 23 bp, Artificial Sequence
  epidermal growth factor receptor (EGFR), ERBB1 phosphotyrosine kinase siRNA
cgaaagccaacaaggaaatcctc

SEQ ID NO: 7340 - DNA, 23 bp, Artificial Sequence
  epidermal growth factor receptor (EGFR), ERBB1 phosphotyrosine kinase siRNA
gaaagccaacaaggaaatcctcg

SEQ ID NO: 7341 - DNA, 23 bp, Artificial Sequence
  epidermal growth factor receptor (EGFR), ERBB1 phosphotyrosine kinase siRNA
aaagccaacaaggaaatcctcga

SEQ ID NO: 7342 - DNA, 23 bp, Artificial Sequence
  epidermal growth factor receptor (EGFR), ERBB1 phosphotyrosine kinase siRNA
aagccaacaaggaaatcctcgat

SEQ ID NO: 7343 - DNA, 23 bp, Artificial Sequence
  epidermal growth factor receptor (EGFR), ERBB1 phosphotyrosine kinase siRNA
agccaacaaggaaatcctcgatg

SEQ ID NO: 7344 - DNA, 23 bp, Artificial Sequence
  epidermal growth factor receptor (EGFR), ERBB1 phosphotyrosine kinase siRNA
gccaacaaggaaatcctcgatga

SEQ ID NO: 7345 - DNA, 23 bp, Artificial Sequence
  epidermal growth factor receptor (EGFR), ERBB1 phosphotyrosine kinase siRNA
ccaacaaggaaatcctcgatgaa

SEQ ID NO: 7346 - DNA, 23 bp, Artificial Sequence
  epidermal growth factor receptor (EGFR), ERBB1 phosphotyrosine kinase siRNA
caacaaggaaatcctcgatgaag

SEQ ID NO: 7347 - DNA, 23 bp, Artificial Sequence
  epidermal growth factor receptor (EGFR), ERBB1 phosphotyrosine kinase siRNA
aacaaggaaatcctcgatgaagc

SEQ ID NO: 7348 - DNA, 23 bp, Artificial Sequence
  epidermal growth factor receptor (EGFR), ERBB1 phosphotyrosine kinase siRNA
acaaggaaatcctcgatgaagcc

SEQ ID NO: 7349 - DNA, 23 bp, Artificial Sequence
  epidermal growth factor receptor (EGFR), ERBB1 phosphotyrosine kinase siRNA
caaggaaatcctcgatgaagcct

SEQ ID NO: 7350 - DNA, 23 bp, Artificial Sequence
  epidermal growth factor receptor (EGFR), ERBB1 phosphotyrosine kinase siRNA
aaggaaatcctcgatgaagccta

SEQ ID NO: 7351 - DNA, 23 bp, Artificial Sequence
  epidermal growth factor receptor (EGFR), ERBB1 phosphotyrosine kinase siRNA
aggaaatcctcgatgaagcctac

SEQ ID NO: 7352 - DNA, 23 bp, Artificial Sequence
  epidermal growth factor receptor (EGFR), ERBB1 phosphotyrosine kinase siRNA
ggaaatcctcgatgaagcctacg

SEQ ID NO: 7353 - DNA, 23 bp, Artificial Sequence
  epidermal growth factor receptor (EGFR), ERBB1 phosphotyrosine kinase siRNA
gaaatcctcgatgaagcctacgt

SEQ ID NO: 7354 - DNA, 23 bp, Artificial Sequence
  epidermal growth factor receptor (EGFR), ERBB1 phosphotyrosine kinase siRNA
aaatcctcgatgaagcctacgtg

SEQ ID NO: 7355 - DNA, 23 bp, Artificial Sequence
  epidermal growth factor receptor (EGFR), ERBB1 phosphotyrosine kinase siRNA
aatcctcgatgaagcctacgtga

SEQ ID NO: 7356 - DNA, 23 bp, Artificial Sequence
  epidermal growth factor receptor (EGFR), ERBB1 phosphotyrosine kinase siRNA
atcctcgatgaagcctacgtgat

SEQ ID NO: 7357 - DNA, 23 bp, Artificial Sequence
  epidermal growth factor receptor (EGFR), ERBB1 phosphotyrosine kinase siRNA
tcctcgatgaagcctacgtgatg

SEQ ID NO: 7358 - DNA, 23 bp, Artificial Sequence
  epidermal growth factor receptor (EGFR), ERBB1 phosphotyrosine kinase siRNA
cctcgatgaagcctacgtgatgg

SEQ ID NO: 7359 - DNA, 23 bp, Artificial Sequence
  epidermal growth factor receptor (EGFR), ERBB1 phosphotyrosine kinase siRNA
ctcgatgaagcctacgtgatggc

SEQ ID NO: 7360 - DNA, 23 bp, Artificial Sequence
  epidermal growth factor receptor (EGFR), ERBB1 phosphotyrosine kinase siRNA
tcgatgaagcctacgtgatggcc

SEQ ID NO: 7361 - DNA, 23 bp, Artificial Sequence
  epidermal growth factor receptor (EGFR), ERBB1 phosphotyrosine kinase siRNA
cgatgaagcctacgtgatggcca

SEQ ID NO: 7362 - DNA, 23 bp, Artificial Sequence
  epidermal growth factor receptor (EGFR), ERBB1 phosphotyrosine kinase siRNA
gatgaagcctacgtgatggccag

SEQ ID NO: 7363 - DNA, 23 bp, Artificial Sequence
  epidermal growth factor receptor (EGFR), ERBB1 phosphotyrosine kinase siRNA
atgaagcctacgtgatggccagc

SEQ ID NO: 7364 - DNA, 23 bp, Artificial Sequence
  epidermal growth factor receptor (EGFR), ERBB1 phosphotyrosine kinase siRNA
tgaagcctacgtgatggccagcg

SEQ ID NO: 7365 - DNA, 23 bp, Artificial Sequence
  epidermal growth factor receptor (EGFR), ERBB1 phosphotyrosine kinase siRNA
gaagcctacgtgatggccagcgt

SEQ ID NO: 7366 - DNA, 23 bp, Artificial Sequence
  epidermal growth factor receptor (EGFR), ERBB1 phosphotyrosine kinase siRNA
aagcctacgtgatggccagcgtg

SEQ ID NO: 7367 - DNA, 23 bp, Artificial Sequence
  epidermal growth factor receptor (EGFR), ERBB1 phosphotyrosine kinase siRNA
agcctacgtgatggccagcgtgg

SEQ ID NO: 7368 - DNA, 23 bp, Artificial Sequence
  epidermal growth factor receptor (EGFR), ERBB1 phosphotyrosine kinase siRNA
gcctacgtgatggccagcgtgga

SEQ ID NO: 7369 - DNA, 23 bp, Artificial Sequence
  epidermal growth factor receptor (EGFR), ERBB1 phosphotyrosine kinase siRNA
cctacgtgatggccagcgtggac

SEQ ID NO: 7370 - DNA, 23 bp, Artificial Sequence
  epidermal growth factor receptor (EGFR), ERBB1 phosphotyrosine kinase siRNA
ctacgtgatggccagcgtggaca

SEQ ID NO: 7371 - DNA, 23 bp, Artificial Sequence
  epidermal growth factor receptor (EGFR), ERBB1 phosphotyrosine kinase siRNA
tacgtgatggccagcgtggacaa

SEQ ID NO: 7372 - DNA, 23 bp, Artificial Sequence
  epidermal growth factor receptor (EGFR), ERBB1 phosphotyrosine kinase siRNA
acgtgatggccagcgtggacaac

SEQ ID NO: 7373 - DNA, 23 bp, Artificial Sequence
  epidermal growth factor receptor (EGFR), ERBB1 phosphotyrosine kinase siRNA
cgtgatggccagcgtggacaacc

SEQ ID NO: 7374 - DNA, 23 bp, Artificial Sequence
  epidermal growth factor receptor (EGFR), ERBB1 phosphotyrosine kinase siRNA
gtgatggccagcgtggacaaccc

SEQ ID NO: 7375 - DNA, 23 bp, Artificial Sequence
  epidermal growth factor receptor (EGFR), ERBB1 phosphotyrosine kinase siRNA
tgatggccagcgtggacaacccc

SEQ ID NO: 7376 - DNA, 23 bp, Artificial Sequence
  epidermal growth factor receptor (EGFR), ERBB1 phosphotyrosine kinase siRNA
gatggccagcgtggacaaccccc

SEQ ID NO: 7377 - DNA, 23 bp, Artificial Sequence
  epidermal growth factor receptor (EGFR), ERBB1 phosphotyrosine kinase siRNA
atggccagcgtggacaaccccca

SEQ ID NO: 7378 - DNA, 23 bp, Artificial Sequence
  epidermal growth factor receptor (EGFR), ERBB1 phosphotyrosine kinase siRNA
tggccagcgtggacaacccccac

SEQ ID NO: 7379 - DNA, 23 bp, Artificial Sequence
  epidermal growth factor receptor (EGFR), ERBB1 phosphotyrosine kinase siRNA
ggccagcgtggacaacccccacg

SEQ ID NO: 7380 - DNA, 23 bp, Artificial Sequence
  epidermal growth factor receptor (EGFR), ERBB1 phosphotyrosine kinase siRNA
gccagcgtggacaacccccacgt

SEQ ID NO: 7381 - DNA, 23 bp, Artificial Sequence
  epidermal growth factor receptor (EGFR), ERBB1 phosphotyrosine kinase siRNA
ccagcgtggacaacccccacgtg

SEQ ID NO: 7382 - DNA, 23 bp, Artificial Sequence
  epidermal growth factor receptor (EGFR), ERBB1 phosphotyrosine kinase siRNA
cagcgtggacaacccccacgtgt

SEQ ID NO: 7383 - DNA, 23 bp, Artificial Sequence
  epidermal growth factor receptor (EGFR), ERBB1 phosphotyrosine kinase siRNA
agcgtggacaacccccacgtgtg

SEQ ID NO: 7384 - DNA, 23 bp, Artificial Sequence
  epidermal growth factor receptor (EGFR), ERBB1 phosphotyrosine kinase siRNA
gcgtggacaacccccacgtgtgc

SEQ ID NO: 7385 - DNA, 23 bp, Artificial Sequence
  epidermal growth factor receptor (EGFR), ERBB1 phosphotyrosine kinase siRNA
cgtggacaacccccacgtgtgcc

SEQ ID NO: 7386 - DNA, 23 bp, Artificial Sequence
  epidermal growth factor receptor (EGFR), ERBB1 phosphotyrosine kinase siRNA
gtggacaacccccacgtgtgccg

SEQ ID NO: 7387 - DNA, 23 bp, Artificial Sequence
  epidermal growth factor receptor (EGFR), ERBB1 phosphotyrosine kinase siRNA
tggacaacccccacgtgtgccgc

SEQ ID NO: 7388 - DNA, 23 bp, Artificial Sequence
  epidermal growth factor receptor (EGFR), ERBB1 phosphotyrosine kinase siRNA
ggacaacccccacgtgtgccgcc

SEQ ID NO: 7389 - DNA, 23 bp, Artificial Sequence
  epidermal growth factor receptor (EGFR), ERBB1 phosphotyrosine kinase siRNA
gacaacccccacgtgtgccgcct

SEQ ID NO: 7390 - DNA, 23 bp, Artificial Sequence
  epidermal growth factor receptor (EGFR), ERBB1 phosphotyrosine kinase siRNA
acaacccccacgtgtgccgcctg

SEQ ID NO: 7391 - DNA, 23 bp, Artificial Sequence
  epidermal growth factor receptor (EGFR), ERBB1 phosphotyrosine kinase siRNA
caacccccacgtgtgccgcctgc

SEQ ID NO: 7392 - DNA, 23 bp, Artificial Sequence
  epidermal growth factor receptor (EGFR), ERBB1 phosphotyrosine kinase siRNA
aacccccacgtgtgccgcctgct

SEQ ID NO: 7393 - DNA, 23 bp, Artificial Sequence
  epidermal growth factor receptor (EGFR), ERBB1 phosphotyrosine kinase siRNA
acccccacgtgtgccgcctgctg

SEQ ID NO: 7394 - DNA, 23 bp, Artificial Sequence
  epidermal growth factor receptor (EGFR), ERBB1 phosphotyrosine kinase siRNA
cccccacgtgtgccgcctgctgg

SEQ ID NO: 7395 - DNA, 23 bp, Artificial Sequence
  epidermal growth factor receptor (EGFR), ERBB1 phosphotyrosine kinase siRNA
ccccacgtgtgccgcctgctggg

SEQ ID NO: 7396 - DNA, 23 bp, Artificial Sequence
  epidermal growth factor receptor (EGFR), ERBB1 phosphotyrosine kinase siRNA
cccacgtgtgccgcctgctgggc

SEQ ID NO: 7397 - DNA, 23 bp, Artificial Sequence
  epidermal growth factor receptor (EGFR), ERBB1 phosphotyrosine kinase siRNA
ccacgtgtgccgcctgctgggca

SEQ ID NO: 7398 - DNA, 23 bp, Artificial Sequence
  epidermal growth factor receptor (EGFR), ERBB1 phosphotyrosine kinase siRNA
cacgtgtgccgcctgctgggcat

SEQ ID NO: 7399 - DNA, 23 bp, Artificial Sequence
  epidermal growth factor receptor (EGFR), ERBB1 phosphotyrosine kinase siRNA
acgtgtgccgcctgctgggcatc

SEQ ID NO: 7400 - DNA, 23 bp, Artificial Sequence
  epidermal growth factor receptor (EGFR), ERBB1 phosphotyrosine kinase siRNA
cgtgtgccgcctgctgggcatct

SEQ ID NO: 7401 - DNA, 23 bp, Artificial Sequence
  epidermal growth factor receptor (EGFR), ERBB1 phosphotyrosine kinase siRNA
gtgtgccgcctgctgggcatctg

SEQ ID NO: 7402 - DNA, 23 bp, Artificial Sequence
  epidermal growth factor receptor (EGFR), ERBB1 phosphotyrosine kinase siRNA
tgtgccgcctgctgggcatctgc

SEQ ID NO: 7403 - DNA, 23 bp, Artificial Sequence
  epidermal growth factor receptor (EGFR), ERBB1 phosphotyrosine kinase siRNA
gtgccgcctgctgggcatctgcc

SEQ ID NO: 7404 - DNA, 23 bp, Artificial Sequence
  epidermal growth factor receptor (EGFR), ERBB1 phosphotyrosine kinase siRNA
tgccgcctgctgggcatctgcct

SEQ ID NO: 7405 - DNA, 23 bp, Artificial Sequence
  epidermal growth factor receptor (EGFR), ERBB1 phosphotyrosine kinase siRNA
gccgcctgctgggcatctgcctc

SEQ ID NO: 7406 - DNA, 23 bp, Artificial Sequence
  epidermal growth factor receptor (EGFR), ERBB1 phosphotyrosine kinase siRNA
ccgcctgctgggcatctgcctca

SEQ ID NO: 7407 - DNA, 23 bp, Artificial Sequence
  epidermal growth factor receptor (EGFR), ERBB1 phosphotyrosine kinase siRNA
cgcctgctgggcatctgcctcac

SEQ ID NO: 7408 - DNA, 23 bp, Artificial Sequence
  epidermal growth factor receptor (EGFR), ERBB1 phosphotyrosine kinase siRNA
gcctgctgggcatctgcctcacc

SEQ ID NO: 7409 - DNA, 23 bp, Artificial Sequence
  epidermal growth factor receptor (EGFR), ERBB1 phosphotyrosine kinase siRNA
cctgctgggcatctgcctcacct

SEQ ID NO: 7410 - DNA, 23 bp, Artificial Sequence
  epidermal growth factor receptor (EGFR), ERBB1 phosphotyrosine kinase siRNA
ctgctgggcatctgcctcacctc

SEQ ID NO: 7411 - DNA, 23 bp, Artificial Sequence
  epidermal growth factor receptor (EGFR), ERBB1 phosphotyrosine kinase siRNA
tgctgggcatctgcctcacctcc

SEQ ID NO: 7412 - DNA, 23 bp, Artificial Sequence
  epidermal growth factor receptor (EGFR), ERBB1 phosphotyrosine kinase siRNA
gctgggcatctgcctcacctcca

SEQ ID NO: 7413 - DNA, 23 bp, Artificial Sequence
  epidermal growth factor receptor (EGFR), ERBB1 phosphotyrosine kinase siRNA
ctgggcatctgcctcacctccac

SEQ ID NO: 7414 - DNA, 23 bp, Artificial Sequence
  epidermal growth factor receptor (EGFR), ERBB1 phosphotyrosine kinase siRNA
tgggcatctgcctcacctccacc

SEQ ID NO: 7415 - DNA, 23 bp, Artificial Sequence
  epidermal growth factor receptor (EGFR), ERBB1 phosphotyrosine kinase siRNA
gggcatctgcctcacctccaccg

SEQ ID NO: 7416 - DNA, 23 bp, Artificial Sequence
  epidermal growth factor receptor (EGFR), ERBB1 phosphotyrosine kinase siRNA
ggcatctgcctcacctccaccgt

SEQ ID NO: 7417 - DNA, 23 bp, Artificial Sequence
  epidermal growth factor receptor (EGFR), ERBB1 phosphotyrosine kinase siRNA
gcatctgcctcacctccaccgtg

SEQ ID NO: 7418 - DNA, 23 bp, Artificial Sequence
  epidermal growth factor receptor (EGFR), ERBB1 phosphotyrosine kinase siRNA
catctgcctcacctccaccgtgc

SEQ ID NO: 7419 - DNA, 23 bp, Artificial Sequence
  epidermal growth factor receptor (EGFR), ERBB1 phosphotyrosine kinase siRNA
atctgcctcacctccaccgtgca

SEQ ID NO: 7420 - DNA, 23 bp, Artificial Sequence
  epidermal growth factor receptor (EGFR), ERBB1 phosphotyrosine kinase siRNA
tctgcctcacctccaccgtgcag

SEQ ID NO: 7421 - DNA, 23 bp, Artificial Sequence
  epidermal growth factor receptor (EGFR), ERBB1 phosphotyrosine kinase siRNA
ctgcctcacctccaccgtgcagc

SEQ ID NO: 7422 - DNA, 23 bp, Artificial Sequence
  epidermal growth factor receptor (EGFR), ERBB1 phosphotyrosine kinase siRNA
tgcctcacctccaccgtgcagct

SEQ ID NO: 7423 - DNA, 23 bp, Artificial Sequence
  epidermal growth factor receptor (EGFR), ERBB1 phosphotyrosine kinase siRNA
gcctcacctccaccgtgcagctc

SEQ ID NO: 7424 - DNA, 23 bp, Artificial Sequence
  epidermal growth factor receptor (EGFR), ERBB1 phosphotyrosine kinase siRNA
cctcacctccaccgtgcagctca

SEQ ID NO: 7425 - DNA, 23 bp, Artificial Sequence
  epidermal growth factor receptor (EGFR), ERBB1 phosphotyrosine kinase siRNA
ctcacctccaccgtgcagctcat

SEQ ID NO: 7426 - DNA, 23 bp, Artificial Sequence
  epidermal growth factor receptor (EGFR), ERBB1 phosphotyrosine kinase siRNA
tcacctccaccgtgcagctcatc

SEQ ID NO: 7427 - DNA, 23 bp, Artificial Sequence
  epidermal growth factor receptor (EGFR), ERBB1 phosphotyrosine kinase siRNA
cacctccaccgtgcagctcatca

SEQ ID NO: 7428 - DNA, 23 bp, Artificial Sequence
  epidermal growth factor receptor (EGFR), ERBB1 phosphotyrosine kinase siRNA
acctccaccgtgcagctcatcac

SEQ ID NO: 7429 - DNA, 23 bp, Artificial Sequence
  epidermal growth factor receptor (EGFR), ERBB1 phosphotyrosine kinase siRNA
cctccaccgtgcagctcatcacg

SEQ ID NO: 7430 - DNA, 23 bp, Artificial Sequence
  epidermal growth factor receptor (EGFR), ERBB1 phosphotyrosine kinase siRNA
ctccaccgtgcagctcatcacgc

SEQ ID NO: 7431 - DNA, 23 bp, Artificial Sequence
  epidermal growth factor receptor (EGFR), ERBB1 phosphotyrosine kinase siRNA
tccaccgtgcagctcatcacgca

SEQ ID NO: 7432 - DNA, 23 bp, Artificial Sequence
  epidermal growth factor receptor (EGFR), ERBB1 phosphotyrosine kinase siRNA
ccaccgtgcagctcatcacgcag

SEQ ID NO: 7433 - DNA, 23 bp, Artificial Sequence
  epidermal growth factor receptor (EGFR), ERBB1 phosphotyrosine kinase siRNA
caccgtgcagctcatcacgcagc

SEQ ID NO: 7434 - DNA, 23 bp, Artificial Sequence
  epidermal growth factor receptor (EGFR), ERBB1 phosphotyrosine kinase siRNA
accgtgcagctcatcacgcagct

SEQ ID NO: 7435 - DNA, 23 bp, Artificial Sequence
  epidermal growth factor receptor (EGFR), ERBB1 phosphotyrosine kinase siRNA
ccgtgcagctcatcacgcagctc

SEQ ID NO: 7436 - DNA, 23 bp, Artificial Sequence
  epidermal growth factor receptor (EGFR), ERBB1 phosphotyrosine kinase siRNA
cgtgcagctcatcacgcagctca

SEQ ID NO: 7437 - DNA, 23 bp, Artificial Sequence
  epidermal growth factor receptor (EGFR), ERBB1 phosphotyrosine kinase siRNA
gtgcagctcatcacgcagctcat

SEQ ID NO: 7438 - DNA, 23 bp, Artificial Sequence
  epidermal growth factor receptor (EGFR), ERBB1 phosphotyrosine kinase siRNA
tgcagctcatcacgcagctcatg

SEQ ID NO: 7439 - DNA, 23 bp, Artificial Sequence
  epidermal growth factor receptor (EGFR), ERBB1 phosphotyrosine kinase siRNA
gcagctcatcacgcagctcatgc

SEQ ID NO: 7440 - DNA, 23 bp, Artificial Sequence
  epidermal growth factor receptor (EGFR), ERBB1 phosphotyrosine kinase siRNA
cagctcatcacgcagctcatgcc

SEQ ID NO: 7441 - DNA, 23 bp, Artificial Sequence
  epidermal growth factor receptor (EGFR), ERBB1 phosphotyrosine kinase siRNA
agctcatcacgcagctcatgccc

SEQ ID NO: 7442 - DNA, 23 bp, Artificial Sequence
  epidermal growth factor receptor (EGFR), ERBB1 phosphotyrosine kinase siRNA
gctcatcacgcagctcatgccct

SEQ ID NO: 7443 - DNA, 23 bp, Artificial Sequence
  epidermal growth factor receptor (EGFR), ERBB1 phosphotyrosine kinase siRNA
ctcatcacgcagctcatgccctt

SEQ ID NO: 7444 - DNA, 23 bp, Artificial Sequence
  epidermal growth factor receptor (EGFR), ERBB1 phosphotyrosine kinase siRNA
tcatcacgcagctcatgcccttc

SEQ ID NO: 7445 - DNA, 23 bp, Artificial Sequence
  epidermal growth factor receptor (EGFR), ERBB1 phosphotyrosine kinase siRNA
catcacgcagctcatgcccttcg

SEQ ID NO: 7446 - DNA, 23 bp, Artificial Sequence
  epidermal growth factor receptor (EGFR), ERBB1 phosphotyrosine kinase siRNA
atcacgcagctcatgcccttcgg

SEQ ID NO: 7447 - DNA, 23 bp, Artificial Sequence
  epidermal growth factor receptor (EGFR), ERBB1 phosphotyrosine kinase siRNA
tcacgcagctcatgcccttcggc

SEQ ID NO: 7448 - DNA, 23 bp, Artificial Sequence
  epidermal growth factor receptor (EGFR), ERBB1 phosphotyrosine kinase siRNA
cacgcagctcatgcccttcggct

SEQ ID NO: 7449 - DNA, 23 bp, Artificial Sequence
  epidermal growth factor receptor (EGFR), ERBB1 phosphotyrosine kinase siRNA
acgcagctcatgcccttcggctg

SEQ ID NO: 7450 - DNA, 23 bp, Artificial Sequence
  epidermal growth factor receptor (EGFR), ERBB1 phosphotyrosine kinase siRNA
cgcagctcatgcccttcggctgc

SEQ ID NO: 7451 - DNA, 23 bp, Artificial Sequence
  epidermal growth factor receptor (EGFR), ERBB1 phosphotyrosine kinase siRNA
gcagctcatgcccttcggctgcc

SEQ ID NO: 7452 - DNA, 23 bp, Artificial Sequence
  epidermal growth factor receptor (EGFR), ERBB1 phosphotyrosine kinase siRNA
cagctcatgcccttcggctgcct

SEQ ID NO: 7453 - DNA, 23 bp, Artificial Sequence
  epidermal growth factor receptor (EGFR), ERBB1 phosphotyrosine kinase siRNA
agctcatgcccttcggctgcctc

SEQ ID NO: 7454 - DNA, 23 bp, Artificial Sequence
  epidermal growth factor receptor (EGFR), ERBB1 phosphotyrosine kinase siRNA
gctcatgcccttcggctgcctcc

SEQ ID NO: 7455 - DNA, 23 bp, Artificial Sequence
  epidermal growth factor receptor (EGFR), ERBB1 phosphotyrosine kinase siRNA
ctcatgcccttcggctgcctcct

SEQ ID NO: 7456 - DNA, 23 bp, Artificial Sequence
  epidermal growth factor receptor (EGFR), ERBB1 phosphotyrosine kinase siRNA
tcatgcccttcggctgcctcctg

SEQ ID NO: 7457 - DNA, 23 bp, Artificial Sequence
  epidermal growth factor receptor (EGFR), ERBB1 phosphotyrosine kinase siRNA
catgcccttcggctgcctcctgg

SEQ ID NO: 7458 - DNA, 23 bp, Artificial Sequence
  epidermal growth factor receptor (EGFR), ERBB1 phosphotyrosine kinase siRNA
atgcccttcggctgcctcctgga

SEQ ID NO: 7459 - DNA, 23 bp, Artificial Sequence
  epidermal growth factor receptor (EGFR), ERBB1 phosphotyrosine kinase siRNA
tgcccttcggctgcctcctggac

SEQ ID NO: 7460 - DNA, 23 bp, Artificial Sequence
  epidermal growth factor receptor (EGFR), ERBB1 phosphotyrosine kinase siRNA
gcccttcggctgcctcctggact

SEQ ID NO: 7461 - DNA, 23 bp, Artificial Sequence
  epidermal growth factor receptor (EGFR), ERBB1 phosphotyrosine kinase siRNA
cccttcggctgcctcctggacta

SEQ ID NO: 7462 - DNA, 23 bp, Artificial Sequence
  epidermal growth factor receptor (EGFR), ERBB1 phosphotyrosine kinase siRNA
ccttcggctgcctcctggactat

SEQ ID NO: 7463 - DNA, 23 bp, Artificial Sequence
  epidermal growth factor receptor (EGFR), ERBB1 phosphotyrosine kinase siRNA
cttcggctgcctcctggactatg

SEQ ID NO: 7464 - DNA, 23 bp, Artificial Sequence
  epidermal growth factor receptor (EGFR), ERBB1 phosphotyrosine kinase siRNA
ttcggctgcctcctggactatgt

SEQ ID NO: 7465 - DNA, 23 bp, Artificial Sequence
  epidermal growth factor receptor (EGFR), ERBB1 phosphotyrosine kinase siRNA
tcggctgcctcctggactatgtc

SEQ ID NO: 7466 - DNA, 23 bp, Artificial Sequence
  epidermal growth factor receptor (EGFR), ERBB1 phosphotyrosine kinase siRNA
cggctgcctcctggactatgtcc

SEQ ID NO: 7467 - DNA, 23 bp, Artificial Sequence
  epidermal growth factor receptor (EGFR), ERBB1 phosphotyrosine kinase siRNA
ggctgcctcctggactatgtccg

SEQ ID NO: 7468 - DNA, 23 bp, Artificial Sequence
  epidermal growth factor receptor (EGFR), ERBB1 phosphotyrosine kinase siRNA
gctgcctcctggactatgtccgg

SEQ ID NO: 7469 - DNA, 23 bp, Artificial Sequence
  epidermal growth factor receptor (EGFR), ERBB1 phosphotyrosine kinase siRNA
ctgcctcctggactatgtccggg

SEQ ID NO: 7470 - DNA, 23 bp, Artificial Sequence
  epidermal growth factor receptor (EGFR), ERBB1 phosphotyrosine kinase siRNA
tgcctcctggactatgtccggga

SEQ ID NO: 7471 - DNA, 23 bp, Artificial Sequence
  epidermal growth factor receptor (EGFR), ERBB1 phosphotyrosine kinase siRNA
gcctcctggactatgtccgggaa

SEQ ID NO: 7472 - DNA, 23 bp, Artificial Sequence
  epidermal growth factor receptor (EGFR), ERBB1 phosphotyrosine kinase siRNA
cctcctggactatgtccgggaac

SEQ ID NO: 7473 - DNA, 23 bp, Artificial Sequence
  epidermal growth factor receptor (EGFR), ERBB1 phosphotyrosine kinase siRNA
ctcctggactatgtccgggaaca

SEQ ID NO: 7474 - DNA, 23 bp, Artificial Sequence
  epidermal growth factor receptor (EGFR), ERBB1 phosphotyrosine kinase siRNA
tcctggactatgtccgggaacac

SEQ ID NO: 7475 - DNA, 23 bp, Artificial Sequence
  epidermal growth factor receptor (EGFR), ERBB1 phosphotyrosine kinase siRNA
cctggactatgtccgggaacaca

SEQ ID NO: 7476 - DNA, 23 bp, Artificial Sequence
  epidermal growth factor receptor (EGFR), ERBB1 phosphotyrosine kinase siRNA
ctggactatgtccgggaacacaa

SEQ ID NO: 7477 - DNA, 23 bp, Artificial Sequence
  epidermal growth factor receptor (EGFR), ERBB1 phosphotyrosine kinase siRNA
tggactatgtccgggaacacaaa

SEQ ID NO: 7478 - DNA, 23 bp, Artificial Sequence
  epidermal growth factor receptor (EGFR), ERBB1 phosphotyrosine kinase siRNA
ggactatgtccgggaacacaaag

SEQ ID NO: 7479 - DNA, 23 bp, Artificial Sequence
  epidermal growth factor receptor (EGFR), ERBB1 phosphotyrosine kinase siRNA
gactatgtccgggaacacaaaga

SEQ ID NO: 7480 - DNA, 23 bp, Artificial Sequence
  epidermal growth factor receptor (EGFR), ERBB1 phosphotyrosine kinase siRNA
actatgtccgggaacacaaagac

SEQ ID NO: 7481 - DNA, 23 bp, Artificial Sequence
  epidermal growth factor receptor (EGFR), ERBB1 phosphotyrosine kinase siRNA
ctatgtccgggaacacaaagaca

SEQ ID NO: 7482 - DNA, 23 bp, Artificial Sequence
  epidermal growth factor receptor (EGFR), ERBB1 phosphotyrosine kinase siRNA
tatgtccgggaacacaaagacaa

SEQ ID NO: 7483 - DNA, 23 bp, Artificial Sequence
  epidermal growth factor receptor (EGFR), ERBB1 phosphotyrosine kinase siRNA
atgtccgggaacacaaagacaat

SEQ ID NO: 7484 - DNA, 23 bp, Artificial Sequence
  epidermal growth factor receptor (EGFR), ERBB1 phosphotyrosine kinase siRNA
tgtccgggaacacaaagacaata

SEQ ID NO: 7485 - DNA, 23 bp, Artificial Sequence
  epidermal growth factor receptor (EGFR), ERBB1 phosphotyrosine kinase siRNA
gtccgggaacacaaagacaatat

SEQ ID NO: 7486 - DNA, 23 bp, Artificial Sequence
  epidermal growth factor receptor (EGFR), ERBB1 phosphotyrosine kinase siRNA
tccgggaacacaaagacaatatt

SEQ ID NO: 7487 - DNA, 23 bp, Artificial Sequence
  epidermal growth factor receptor (EGFR), ERBB1 phosphotyrosine kinase siRNA
ccgggaacacaaagacaatattg

SEQ ID NO: 7488 - DNA, 23 bp, Artificial Sequence
  epidermal growth factor receptor (EGFR), ERBB1 phosphotyrosine kinase siRNA
cgggaacacaaagacaatattgg

SEQ ID NO: 7489 - DNA, 23 bp, Artificial Sequence
  epidermal growth factor receptor (EGFR), ERBB1 phosphotyrosine kinase siRNA
gggaacacaaagacaatattggc

SEQ ID NO: 7490 - DNA, 23 bp, Artificial Sequence
  epidermal growth factor receptor (EGFR), ERBB1 phosphotyrosine kinase siRNA
ggaacacaaagacaatattggct

SEQ ID NO: 7491 - DNA, 23 bp, Artificial Sequence
  epidermal growth factor receptor (EGFR), ERBB1 phosphotyrosine kinase siRNA
gaacacaaagacaatattggctc

SEQ ID NO: 7492 - DNA, 23 bp, Artificial Sequence
  epidermal growth factor receptor (EGFR), ERBB1 phosphotyrosine kinase siRNA
aacacaaagacaatattggctcc

SEQ ID NO: 7493 - DNA, 23 bp, Artificial Sequence
  epidermal growth factor receptor (EGFR), ERBB1 phosphotyrosine kinase siRNA
acacaaagacaatattggctccc

SEQ ID NO: 7494 - DNA, 23 bp, Artificial Sequence
  epidermal growth factor receptor (EGFR), ERBB1 phosphotyrosine kinase siRNA
cacaaagacaatattggctccca

SEQ ID NO: 7495 - DNA, 23 bp, Artificial Sequence
  epidermal growth factor receptor (EGFR), ERBB1 phosphotyrosine kinase siRNA
acaaagacaatattggctcccag

SEQ ID NO: 7496 - DNA, 23 bp, Artificial Sequence
  epidermal growth factor receptor (EGFR), ERBB1 phosphotyrosine kinase siRNA
caaagacaatattggctcccagt

SEQ ID NO: 7497 - DNA, 23 bp, Artificial Sequence
  epidermal growth factor receptor (EGFR), ERBB1 phosphotyrosine kinase siRNA
aaagacaatattggctcccagta

SEQ ID NO: 7498 - DNA, 23 bp, Artificial Sequence
  epidermal growth factor receptor (EGFR), ERBB1 phosphotyrosine kinase siRNA
aagacaatattggctcccagtac

SEQ ID NO: 7499 - DNA, 23 bp, Artificial Sequence
  epidermal growth factor receptor (EGFR), ERBB1 phosphotyrosine kinase siRNA
agacaatattggctcccagtacc

SEQ ID NO: 7500 - DNA, 23 bp, Artificial Sequence
  epidermal growth factor receptor (EGFR), ERBB1 phosphotyrosine kinase siRNA
gacaatattggctcccagtacct

SEQ ID NO: 7501 - DNA, 23 bp, Artificial Sequence
  epidermal growth factor receptor (EGFR), ERBB1 phosphotyrosine kinase siRNA
acaatattggctcccagtacctg

SEQ ID NO: 7502 - DNA, 23 bp, Artificial Sequence
  epidermal growth factor receptor (EGFR), ERBB1 phosphotyrosine kinase siRNA
caatattggctcccagtacctgc

SEQ ID NO: 7503 - DNA, 23 bp, Artificial Sequence
  epidermal growth factor receptor (EGFR), ERBB1 phosphotyrosine kinase siRNA
aatattggctcccagtacctgct

SEQ ID NO: 7504 - DNA, 23 bp, Artificial Sequence
  epidermal growth factor receptor (EGFR), ERBB1 phosphotyrosine kinase siRNA
atattggctcccagtacctgctc

SEQ ID NO: 7505 - DNA, 23 bp, Artificial Sequence
  epidermal growth factor receptor (EGFR), ERBB1 phosphotyrosine kinase siRNA
tattggctcccagtacctgctca

SEQ ID NO: 7506 - DNA, 23 bp, Artificial Sequence
  epidermal growth factor receptor (EGFR), ERBB1 phosphotyrosine kinase siRNA
attggctcccagtacctgctcaa

SEQ ID NO: 7507 - DNA, 23 bp, Artificial Sequence
  epidermal growth factor receptor (EGFR), ERBB1 phosphotyrosine kinase siRNA
ttggctcccagtacctgctcaac

SEQ ID NO: 7508 - DNA, 23 bp, Artificial Sequence
  epidermal growth factor receptor (EGFR), ERBB1 phosphotyrosine kinase siRNA
tggctcccagtacctgctcaact

SEQ ID NO: 7509 - DNA, 23 bp, Artificial Sequence
  epidermal growth factor receptor (EGFR), ERBB1 phosphotyrosine kinase siRNA
ggctcccagtacctgctcaactg

SEQ ID NO: 7510 - DNA, 23 bp, Artificial Sequence
  epidermal growth factor receptor (EGFR), ERBB1 phosphotyrosine kinase siRNA
gctcccagtacctgctcaactgg

SEQ ID NO: 7511 - DNA, 23 bp, Artificial Sequence
  epidermal growth factor receptor (EGFR), ERBB1 phosphotyrosine kinase siRNA
ctcccagtacctgctcaactggt

SEQ ID NO: 7512 - DNA, 23 bp, Artificial Sequence
  epidermal growth factor receptor (EGFR), ERBB1 phosphotyrosine kinase siRNA
tcccagtacctgctcaactggtg

SEQ ID NO: 7513 - DNA, 23 bp, Artificial Sequence
  epidermal growth factor receptor (EGFR), ERBB1 phosphotyrosine kinase siRNA
cccagtacctgctcaactggtgt

SEQ ID NO: 7514 - DNA, 23 bp, Artificial Sequence
  epidermal growth factor receptor (EGFR), ERBB1 phosphotyrosine kinase siRNA
ccagtacctgctcaactggtgtg

SEQ ID NO: 7515 - DNA, 23 bp, Artificial Sequence
  epidermal growth factor receptor (EGFR), ERBB1 phosphotyrosine kinase siRNA
cagtacctgctcaactggtgtgt

SEQ ID NO: 7516 - DNA, 23 bp, Artificial Sequence
  epidermal growth factor receptor (EGFR), ERBB1 phosphotyrosine kinase siRNA
agtacctgctcaactggtgtgtg

SEQ ID NO: 7517 - DNA, 23 bp, Artificial Sequence
  epidermal growth factor receptor (EGFR), ERBB1 phosphotyrosine kinase siRNA
gtacctgctcaactggtgtgtgc

SEQ ID NO: 7518 - DNA, 23 bp, Artificial Sequence
  epidermal growth factor receptor (EGFR), ERBB1 phosphotyrosine kinase siRNA
tacctgctcaactggtgtgtgca

SEQ ID NO: 7519 - DNA, 23 bp, Artificial Sequence
  epidermal growth factor receptor (EGFR), ERBB1 phosphotyrosine kinase siRNA
acctgctcaactggtgtgtgcag

SEQ ID NO: 7520 - DNA, 23 bp, Artificial Sequence
  epidermal growth factor receptor (EGFR), ERBB1 phosphotyrosine kinase siRNA
cctgctcaactggtgtgtgcaga

SEQ ID NO: 7521 - DNA, 23 bp, Artificial Sequence
  epidermal growth factor receptor (EGFR), ERBB1 phosphotyrosine kinase siRNA
ctgctcaactggtgtgtgcagat

SEQ ID NO: 7522 - DNA, 23 bp, Artificial Sequence
  epidermal growth factor receptor (EGFR), ERBB1 phosphotyrosine kinase siRNA
tgctcaactggtgtgtgcagatc

SEQ ID NO: 7523 - DNA, 23 bp, Artificial Sequence
  epidermal growth factor receptor (EGFR), ERBB1 phosphotyrosine kinase siRNA
gctcaactggtgtgtgcagatcg

SEQ ID NO: 7524 - DNA, 23 bp, Artificial Sequence
  epidermal growth factor receptor (EGFR), ERBB1 phosphotyrosine kinase siRNA
ctcaactggtgtgtgcagatcgc

SEQ ID NO: 7525 - DNA, 23 bp, Artificial Sequence
  epidermal growth factor receptor (EGFR), ERBB1 phosphotyrosine kinase siRNA
tcaactggtgtgtgcagatcgca

SEQ ID NO: 7526 - DNA, 23 bp, Artificial Sequence
  epidermal growth factor receptor (EGFR), ERBB1 phosphotyrosine kinase siRNA
caactggtgtgtgcagatcgcaa

SEQ ID NO: 7527 - DNA, 23 bp, Artificial Sequence
  epidermal growth factor receptor (EGFR), ERBB1 phosphotyrosine kinase siRNA
aactggtgtgtgcagatcgcaaa

SEQ ID NO: 7528 - DNA, 23 bp, Artificial Sequence
  epidermal growth factor receptor (EGFR), ERBB1 phosphotyrosine kinase siRNA
actggtgtgtgcagatcgcaaag

SEQ ID NO: 7529 - DNA, 23 bp, Artificial Sequence
  epidermal growth factor receptor (EGFR), ERBB1 phosphotyrosine kinase siRNA
ctggtgtgtgcagatcgcaaagg

SEQ ID NO: 7530 - DNA, 23 bp, Artificial Sequence
  epidermal growth factor receptor (EGFR), ERBB1 phosphotyrosine kinase siRNA
tggtgtgtgcagatcgcaaaggg

SEQ ID NO: 7531 - DNA, 23 bp, Artificial Sequence
  epidermal growth factor receptor (EGFR), ERBB1 phosphotyrosine kinase siRNA
ggtgtgtgcagatcgcaaagggc

SEQ ID NO: 7532 - DNA, 23 bp, Artificial Sequence
  epidermal growth factor receptor (EGFR), ERBB1 phosphotyrosine kinase siRNA
gtgtgtgcagatcgcaaagggca

SEQ ID NO: 7533 - DNA, 23 bp, Artificial Sequence
  epidermal growth factor receptor (EGFR), ERBB1 phosphotyrosine kinase siRNA
tgtgtgcagatcgcaaagggcat

SEQ ID NO: 7534 - DNA, 23 bp, Artificial Sequence
  epidermal growth factor receptor (EGFR), ERBB1 phosphotyrosine kinase siRNA
gtgtgcagatcgcaaagggcatg

SEQ ID NO: 7535 - DNA, 23 bp, Artificial Sequence
  epidermal growth factor receptor (EGFR), ERBB1 phosphotyrosine kinase siRNA
tgtgcagatcgcaaagggcatga

SEQ ID NO: 7536 - DNA, 23 bp, Artificial Sequence
  epidermal growth factor receptor (EGFR), ERBB1 phosphotyrosine kinase siRNA
gtgcagatcgcaaagggcatgaa

SEQ ID NO: 7537 - DNA, 23 bp, Artificial Sequence
  epidermal growth factor receptor (EGFR), ERBB1 phosphotyrosine kinase siRNA
tgcagatcgcaaagggcatgaac

SEQ ID NO: 7538 - DNA, 23 bp, Artificial Sequence
  epidermal growth factor receptor (EGFR), ERBB1 phosphotyrosine kinase siRNA
gcagatcgcaaagggcatgaact

SEQ ID NO: 7539 - DNA, 23 bp, Artificial Sequence
  epidermal growth factor receptor (EGFR), ERBB1 phosphotyrosine kinase siRNA
cagatcgcaaagggcatgaacta

SEQ ID NO: 7540 - DNA, 23 bp, Artificial Sequence
  epidermal growth factor receptor (EGFR), ERBB1 phosphotyrosine kinase siRNA
agatcgcaaagggcatgaactac

SEQ ID NO: 7541 - DNA, 23 bp, Artificial Sequence
  epidermal growth factor receptor (EGFR), ERBB1 phosphotyrosine kinase siRNA
gatcgcaaagggcatgaactact

SEQ ID NO: 7542 - DNA, 23 bp, Artificial Sequence
  epidermal growth factor receptor (EGFR), ERBB1 phosphotyrosine kinase siRNA
atcgcaaagggcatgaactactt

SEQ ID NO: 7543 - DNA, 23 bp, Artificial Sequence
  epidermal growth factor receptor (EGFR), ERBB1 phosphotyrosine kinase siRNA
tcgcaaagggcatgaactacttg

SEQ ID NO: 7544 - DNA, 23 bp, Artificial Sequence
  epidermal growth factor receptor (EGFR), ERBB1 phosphotyrosine kinase siRNA
cgcaaagggcatgaactacttgg

SEQ ID NO: 7545 - DNA, 23 bp, Artificial Sequence
  epidermal growth factor receptor (EGFR), ERBB1 phosphotyrosine kinase siRNA
gcaaagggcatgaactacttgga

SEQ ID NO: 7546 - DNA, 23 bp, Artificial Sequence
  epidermal growth factor receptor (EGFR), ERBB1 phosphotyrosine kinase siRNA
caaagggcatgaactacttggag

SEQ ID NO: 7547 - DNA, 23 bp, Artificial Sequence
  epidermal growth factor receptor (EGFR), ERBB1 phosphotyrosine kinase siRNA
aaagggcatgaactacttggagg

SEQ ID NO: 7548 - DNA, 23 bp, Artificial Sequence
  epidermal growth factor receptor (EGFR), ERBB1 phosphotyrosine kinase siRNA
aagggcatgaactacttggagga

SEQ ID NO: 7549 - DNA, 23 bp, Artificial Sequence
  epidermal growth factor receptor (EGFR), ERBB1 phosphotyrosine kinase siRNA
agggcatgaactacttggaggac

SEQ ID NO: 7550 - DNA, 23 bp, Artificial Sequence
  epidermal growth factor receptor (EGFR), ERBB1 phosphotyrosine kinase siRNA
gggcatgaactacttggaggacc

SEQ ID NO: 7551 - DNA, 23 bp, Artificial Sequence
  epidermal growth factor receptor (EGFR), ERBB1 phosphotyrosine kinase siRNA
ggcatgaactacttggaggaccg

SEQ ID NO: 7552 - DNA, 23 bp, Artificial Sequence
  epidermal growth factor receptor (EGFR), ERBB1 phosphotyrosine kinase siRNA
gcatgaactacttggaggaccgt

SEQ ID NO: 7553 - DNA, 23 bp, Artificial Sequence
  epidermal growth factor receptor (EGFR), ERBB1 phosphotyrosine kinase siRNA
catgaactacttggaggaccgtc

SEQ ID NO: 7554 - DNA, 23 bp, Artificial Sequence
  epidermal growth factor receptor (EGFR), ERBB1 phosphotyrosine kinase siRNA
atgaactacttggaggaccgtcg

SEQ ID NO: 7555 - DNA, 23 bp, Artificial Sequence
  epidermal growth factor receptor (EGFR), ERBB1 phosphotyrosine kinase siRNA
tgaactacttggaggaccgtcgc

SEQ ID NO: 7556 - DNA, 23 bp, Artificial Sequence
  epidermal growth factor receptor (EGFR), ERBB1 phosphotyrosine kinase siRNA
gaactacttggaggaccgtcgct

SEQ ID NO: 7557 - DNA, 23 bp, Artificial Sequence
  epidermal growth factor receptor (EGFR), ERBB1 phosphotyrosine kinase siRNA
aactacttggaggaccgtcgctt

SEQ ID NO: 7558 - DNA, 23 bp, Artificial Sequence
  epidermal growth factor receptor (EGFR), ERBB1 phosphotyrosine kinase siRNA
actacttggaggaccgtcgcttg

SEQ ID NO: 7559 - DNA, 23 bp, Artificial Sequence
  epidermal growth factor receptor (EGFR), ERBB1 phosphotyrosine kinase siRNA
ctacttggaggaccgtcgcttgg

SEQ ID NO: 7560 - DNA, 23 bp, Artificial Sequence
  epidermal growth factor receptor (EGFR), ERBB1 phosphotyrosine kinase siRNA
tacttggaggaccgtcgcttggt

SEQ ID NO: 7561 - DNA, 23 bp, Artificial Sequence
  epidermal growth factor receptor (EGFR), ERBB1 phosphotyrosine kinase siRNA
acttggaggaccgtcgcttggtg

SEQ ID NO: 7562 - DNA, 23 bp, Artificial Sequence
  epidermal growth factor receptor (EGFR), ERBB1 phosphotyrosine kinase siRNA
cttggaggaccgtcgcttggtgc

SEQ ID NO: 7563 - DNA, 23 bp, Artificial Sequence
  epidermal growth factor receptor (EGFR), ERBB1 phosphotyrosine kinase siRNA
ttggaggaccgtcgcttggtgca

SEQ ID NO: 7564 - DNA, 23 bp, Artificial Sequence
  epidermal growth factor receptor (EGFR), ERBB1 phosphotyrosine kinase siRNA
tggaggaccgtcgcttggtgcac

SEQ ID NO: 7565 - DNA, 23 bp, Artificial Sequence
  epidermal growth factor receptor (EGFR), ERBB1 phosphotyrosine kinase siRNA
ggaggaccgtcgcttggtgcacc

SEQ ID NO: 7566 - DNA, 23 bp, Artificial Sequence
  epidermal growth factor receptor (EGFR), ERBB1 phosphotyrosine kinase siRNA
gaggaccgtcgcttggtgcaccg

SEQ ID NO: 7567 - DNA, 23 bp, Artificial Sequence
  epidermal growth factor receptor (EGFR), ERBB1 phosphotyrosine kinase siRNA
aggaccgtcgcttggtgcaccgc

SEQ ID NO: 7568 - DNA, 23 bp, Artificial Sequence
  epidermal growth factor receptor (EGFR), ERBB1 phosphotyrosine kinase siRNA
ggaccgtcgcttggtgcaccgcg

SEQ ID NO: 7569 - DNA, 23 bp, Artificial Sequence
  epidermal growth factor receptor (EGFR), ERBB1 phosphotyrosine kinase siRNA
gaccgtcgcttggtgcaccgcga

SEQ ID NO: 7570 - DNA, 23 bp, Artificial Sequence
  epidermal growth factor receptor (EGFR), ERBB1 phosphotyrosine kinase siRNA
accgtcgcttggtgcaccgcgac

SEQ ID NO: 7571 - DNA, 23 bp, Artificial Sequence
  epidermal growth factor receptor (EGFR), ERBB1 phosphotyrosine kinase siRNA
ccgtcgcttggtgcaccgcgacc

SEQ ID NO: 7572 - DNA, 23 bp, Artificial Sequence
  epidermal growth factor receptor (EGFR), ERBB1 phosphotyrosine kinase siRNA
cgtcgcttggtgcaccgcgacct

SEQ ID NO: 7573 - DNA, 23 bp, Artificial Sequence
  epidermal growth factor receptor (EGFR), ERBB1 phosphotyrosine kinase siRNA
gtcgcttggtgcaccgcgacctg

SEQ ID NO: 7574 - DNA, 23 bp, Artificial Sequence
  epidermal growth factor receptor (EGFR), ERBB1 phosphotyrosine kinase siRNA
tcgcttggtgcaccgcgacctgg

SEQ ID NO: 7575 - DNA, 23 bp, Artificial Sequence
  epidermal growth factor receptor (EGFR), ERBB1 phosphotyrosine kinase siRNA
cgcttggtgcaccgcgacctggc

SEQ ID NO: 7576 - DNA, 23 bp, Artificial Sequence
  epidermal growth factor receptor (EGFR), ERBB1 phosphotyrosine kinase siRNA
gcttggtgcaccgcgacctggca

SEQ ID NO: 7577 - DNA, 23 bp, Artificial Sequence
  epidermal growth factor receptor (EGFR), ERBB1 phosphotyrosine kinase siRNA
cttggtgcaccgcgacctggcag

SEQ ID NO: 7578 - DNA, 23 bp, Artificial Sequence
  epidermal growth factor receptor (EGFR), ERBB1 phosphotyrosine kinase siRNA
ttggtgcaccgcgacctggcagc

SEQ ID NO: 7579 - DNA, 23 bp, Artificial Sequence
  epidermal growth factor receptor (EGFR), ERBB1 phosphotyrosine kinase siRNA
tggtgcaccgcgacctggcagcc

SEQ ID NO: 7580 - DNA, 23 bp, Artificial Sequence
  epidermal growth factor receptor (EGFR), ERBB1 phosphotyrosine kinase siRNA
ggtgcaccgcgacctggcagcca

SEQ ID NO: 7581 - DNA, 23 bp, Artificial Sequence
  epidermal growth factor receptor (EGFR), ERBB1 phosphotyrosine kinase siRNA
gtgcaccgcgacctggcagccag

SEQ ID NO: 7582 - DNA, 23 bp, Artificial Sequence
  epidermal growth factor receptor (EGFR), ERBB1 phosphotyrosine kinase siRNA
tgcaccgcgacctggcagccagg

SEQ ID NO: 7583 - DNA, 23 bp, Artificial Sequence
  epidermal growth factor receptor (EGFR), ERBB1 phosphotyrosine kinase siRNA
gcaccgcgacctggcagccagga

SEQ ID NO: 7584 - DNA, 23 bp, Artificial Sequence
  epidermal growth factor receptor (EGFR), ERBB1 phosphotyrosine kinase siRNA
caccgcgacctggcagccaggaa

SEQ ID NO: 7585 - DNA, 23 bp, Artificial Sequence
  epidermal growth factor receptor (EGFR), ERBB1 phosphotyrosine kinase siRNA
accgcgacctggcagccaggaac

SEQ ID NO: 7586 - DNA, 23 bp, Artificial Sequence
  epidermal growth factor receptor (EGFR), ERBB1 phosphotyrosine kinase siRNA
ccgcgacctggcagccaggaacg

SEQ ID NO: 7587 - DNA, 23 bp, Artificial Sequence
  epidermal growth factor receptor (EGFR), ERBB1 phosphotyrosine kinase siRNA
cgcgacctggcagccaggaacgt

SEQ ID NO: 7588 - DNA, 23 bp, Artificial Sequence
  epidermal growth factor receptor (EGFR), ERBB1 phosphotyrosine kinase siRNA
gcgacctggcagccaggaacgta

SEQ ID NO: 7589 - DNA, 23 bp, Artificial Sequence
  epidermal growth factor receptor (EGFR), ERBB1 phosphotyrosine kinase siRNA
cgacctggcagccaggaacgtac

SEQ ID NO: 7590 - DNA, 23 bp, Artificial Sequence
  epidermal growth factor receptor (EGFR), ERBB1 phosphotyrosine kinase siRNA
gacctggcagccaggaacgtact

SEQ ID NO: 7591 - DNA, 23 bp, Artificial Sequence
  epidermal growth factor receptor (EGFR), ERBB1 phosphotyrosine kinase siRNA
acctggcagccaggaacgtactg

SEQ ID NO: 7592 - DNA, 23 bp, Artificial Sequence
  epidermal growth factor receptor (EGFR), ERBB1 phosphotyrosine kinase siRNA
cctggcagccaggaacgtactgg

SEQ ID NO: 7593 - DNA, 23 bp, Artificial Sequence
  epidermal growth factor receptor (EGFR), ERBB1 phosphotyrosine kinase siRNA
ctggcagccaggaacgtactggt

SEQ ID NO: 7594 - DNA, 23 bp, Artificial Sequence
  epidermal growth factor receptor (EGFR), ERBB1 phosphotyrosine kinase siRNA
tggcagccaggaacgtactggtg

SEQ ID NO: 7595 - DNA, 23 bp, Artificial Sequence
  epidermal growth factor receptor (EGFR), ERBB1 phosphotyrosine kinase siRNA
ggcagccaggaacgtactggtga

SEQ ID NO: 7596 - DNA, 23 bp, Artificial Sequence
  epidermal growth factor receptor (EGFR), ERBB1 phosphotyrosine kinase siRNA
gcagccaggaacgtactggtgaa

SEQ ID NO: 7597 - DNA, 23 bp, Artificial Sequence
  epidermal growth factor receptor (EGFR), ERBB1 phosphotyrosine kinase siRNA
cagccaggaacgtactggtgaaa

SEQ ID NO: 7598 - DNA, 23 bp, Artificial Sequence
  epidermal growth factor receptor (EGFR), ERBB1 phosphotyrosine kinase siRNA
agccaggaacgtactggtgaaaa

SEQ ID NO: 7599 - DNA, 23 bp, Artificial Sequence
  epidermal growth factor receptor (EGFR), ERBB1 phosphotyrosine kinase siRNA
gccaggaacgtactggtgaaaac

SEQ ID NO: 7600 - DNA, 23 bp, Artificial Sequence
  epidermal growth factor receptor (EGFR), ERBB1 phosphotyrosine kinase siRNA
ccaggaacgtactggtgaaaaca

SEQ ID NO: 7601 - DNA, 23 bp, Artificial Sequence
  epidermal growth factor receptor (EGFR), ERBB1 phosphotyrosine kinase siRNA
caggaacgtactggtgaaaacac

SEQ ID NO: 7602 - DNA, 23 bp, Artificial Sequence
  epidermal growth factor receptor (EGFR), ERBB1 phosphotyrosine kinase siRNA
aggaacgtactggtgaaaacacc

SEQ ID NO: 7603 - DNA, 23 bp, Artificial Sequence
  epidermal growth factor receptor (EGFR), ERBB1 phosphotyrosine kinase siRNA
ggaacgtactggtgaaaacaccg

SEQ ID NO: 7604 - DNA, 23 bp, Artificial Sequence
  epidermal growth factor receptor (EGFR), ERBB1 phosphotyrosine kinase siRNA
gaacgtactggtgaaaacaccgc

SEQ ID NO: 7605 - DNA, 23 bp, Artificial Sequence
  epidermal growth factor receptor (EGFR), ERBB1 phosphotyrosine kinase siRNA
aacgtactggtgaaaacaccgca

SEQ ID NO: 7606 - DNA, 23 bp, Artificial Sequence
  epidermal growth factor receptor (EGFR), ERBB1 phosphotyrosine kinase siRNA
acgtactggtgaaaacaccgcag

SEQ ID NO: 7607 - DNA, 23 bp, Artificial Sequence
  epidermal growth factor receptor (EGFR), ERBB1 phosphotyrosine kinase siRNA
cgtactggtgaaaacaccgcagc

SEQ ID NO: 7608 - DNA, 23 bp, Artificial Sequence
  epidermal growth factor receptor (EGFR), ERBB1 phosphotyrosine kinase siRNA
gtactggtgaaaacaccgcagca

SEQ ID NO: 7609 - DNA, 23 bp, Artificial Sequence
  epidermal growth factor receptor (EGFR), ERBB1 phosphotyrosine kinase siRNA
tactggtgaaaacaccgcagcat

SEQ ID NO: 7610 - DNA, 23 bp, Artificial Sequence
  epidermal growth factor receptor (EGFR), ERBB1 phosphotyrosine kinase siRNA
actggtgaaaacaccgcagcatg

SEQ ID NO: 7611 - DNA, 23 bp, Artificial Sequence
  epidermal growth factor receptor (EGFR), ERBB1 phosphotyrosine kinase siRNA
ctggtgaaaacaccgcagcatgt

SEQ ID NO: 7612 - DNA, 23 bp, Artificial Sequence
  epidermal growth factor receptor (EGFR), ERBB1 phosphotyrosine kinase siRNA
tggtgaaaacaccgcagcatgtc

SEQ ID NO: 7613 - DNA, 23 bp, Artificial Sequence
  epidermal growth factor receptor (EGFR), ERBB1 phosphotyrosine kinase siRNA
ggtgaaaacaccgcagcatgtca

SEQ ID NO: 7614 - DNA, 23 bp, Artificial Sequence
  epidermal growth factor receptor (EGFR), ERBB1 phosphotyrosine kinase siRNA
gtgaaaacaccgcagcatgtcaa

SEQ ID NO: 7615 - DNA, 23 bp, Artificial Sequence
  epidermal growth factor receptor (EGFR), ERBB1 phosphotyrosine kinase siRNA
tgaaaacaccgcagcatgtcaag

SEQ ID NO: 7616 - DNA, 23 bp, Artificial Sequence
  epidermal growth factor receptor (EGFR), ERBB1 phosphotyrosine kinase siRNA
gaaaacaccgcagcatgtcaaga

SEQ ID NO: 7617 - DNA, 23 bp, Artificial Sequence
  epidermal growth factor receptor (EGFR), ERBB1 phosphotyrosine kinase siRNA
aaaacaccgcagcatgtcaagat

SEQ ID NO: 7618 - DNA, 23 bp, Artificial Sequence
  epidermal growth factor receptor (EGFR), ERBB1 phosphotyrosine kinase siRNA
aaacaccgcagcatgtcaagatc

SEQ ID NO: 7619 - DNA, 23 bp, Artificial Sequence
  epidermal growth factor receptor (EGFR), ERBB1 phosphotyrosine kinase siRNA
aacaccgcagcatgtcaagatca

SEQ ID NO: 7620 - DNA, 23 bp, Artificial Sequence
  epidermal growth factor receptor (EGFR), ERBB1 phosphotyrosine kinase siRNA
acaccgcagcatgtcaagatcac

SEQ ID NO: 7621 - DNA, 23 bp, Artificial Sequence
  epidermal growth factor receptor (EGFR), ERBB1 phosphotyrosine kinase siRNA
caccgcagcatgtcaagatcaca

SEQ ID NO: 7622 - DNA, 23 bp, Artificial Sequence
  epidermal growth factor receptor (EGFR), ERBB1 phosphotyrosine kinase siRNA
accgcagcatgtcaagatcacag

SEQ ID NO: 7623 - DNA, 23 bp, Artificial Sequence
  epidermal growth factor receptor (EGFR), ERBB1 phosphotyrosine kinase siRNA
ccgcagcatgtcaagatcacaga

SEQ ID NO: 7624 - DNA, 23 bp, Artificial Sequence
  epidermal growth factor receptor (EGFR), ERBB1 phosphotyrosine kinase siRNA
cgcagcatgtcaagatcacagat

SEQ ID NO: 7625 - DNA, 23 bp, Artificial Sequence
  epidermal growth factor receptor (EGFR), ERBB1 phosphotyrosine kinase siRNA
gcagcatgtcaagatcacagatt

SEQ ID NO: 7626 - DNA, 23 bp, Artificial Sequence
  epidermal growth factor receptor (EGFR), ERBB1 phosphotyrosine kinase siRNA
cagcatgtcaagatcacagattt

SEQ ID NO: 7627 - DNA, 23 bp, Artificial Sequence
  epidermal growth factor receptor (EGFR), ERBB1 phosphotyrosine kinase siRNA
agcatgtcaagatcacagatttt

SEQ ID NO: 7628 - DNA, 23 bp, Artificial Sequence
  epidermal growth factor receptor (EGFR), ERBB1 phosphotyrosine kinase siRNA
gcatgtcaagatcacagattttg

SEQ ID NO: 7629 - DNA, 23 bp, Artificial Sequence
  epidermal growth factor receptor (EGFR), ERBB1 phosphotyrosine kinase siRNA
catgtcaagatcacagattttgg

SEQ ID NO: 7630 - DNA, 23 bp, Artificial Sequence
  epidermal growth factor receptor (EGFR), ERBB1 phosphotyrosine kinase siRNA
atgtcaagatcacagattttggg

SEQ ID NO: 7631 - DNA, 23 bp, Artificial Sequence
  epidermal growth factor receptor (EGFR), ERBB1 phosphotyrosine kinase siRNA
tgtcaagatcacagattttgggc

SEQ ID NO: 7632 - DNA, 23 bp, Artificial Sequence
  epidermal growth factor receptor (EGFR), ERBB1 phosphotyrosine kinase siRNA
gtcaagatcacagattttgggct

SEQ ID NO: 7633 - DNA, 23 bp, Artificial Sequence
  epidermal growth factor receptor (EGFR), ERBB1 phosphotyrosine kinase siRNA
tcaagatcacagattttgggctg

SEQ ID NO: 7634 - DNA, 23 bp, Artificial Sequence
  epidermal growth factor receptor (EGFR), ERBB1 phosphotyrosine kinase siRNA
caagatcacagattttgggctgg

SEQ ID NO: 7635 - DNA, 23 bp, Artificial Sequence
  epidermal growth factor receptor (EGFR), ERBB1 phosphotyrosine kinase siRNA
aagatcacagattttgggctggc

SEQ ID NO: 7636 - DNA, 23 bp, Artificial Sequence
  epidermal growth factor receptor (EGFR), ERBB1 phosphotyrosine kinase siRNA
agatcacagattttgggctggcc

SEQ ID NO: 7637 - DNA, 23 bp, Artificial Sequence
  epidermal growth factor receptor (EGFR), ERBB1 phosphotyrosine kinase siRNA
gatcacagattttgggctggcca

SEQ ID NO: 7638 - DNA, 23 bp, Artificial Sequence
  epidermal growth factor receptor (EGFR), ERBB1 phosphotyrosine kinase siRNA
atcacagattttgggctggccaa

SEQ ID NO: 7639 - DNA, 23 bp, Artificial Sequence
  epidermal growth factor receptor (EGFR), ERBB1 phosphotyrosine kinase siRNA
tcacagattttgggctggccaaa

SEQ ID NO: 7640 - DNA, 23 bp, Artificial Sequence
  epidermal growth factor receptor (EGFR), ERBB1 phosphotyrosine kinase siRNA
cacagattttgggctggccaaac

SEQ ID NO: 7641 - DNA, 23 bp, Artificial Sequence
  epidermal growth factor receptor (EGFR), ERBB1 phosphotyrosine kinase siRNA
acagattttgggctggccaaact

SEQ ID NO: 7642 - DNA, 23 bp, Artificial Sequence
  epidermal growth factor receptor (EGFR), ERBB1 phosphotyrosine kinase siRNA
cagattttgggctggccaaactg

SEQ ID NO: 7643 - DNA, 23 bp, Artificial Sequence
  epidermal growth factor receptor (EGFR), ERBB1 phosphotyrosine kinase siRNA
agattttgggctggccaaactgc

SEQ ID NO: 7644 - DNA, 23 bp, Artificial Sequence
  epidermal growth factor receptor (EGFR), ERBB1 phosphotyrosine kinase siRNA
gattttgggctggccaaactgct

SEQ ID NO: 7645 - DNA, 23 bp, Artificial Sequence
  epidermal growth factor receptor (EGFR), ERBB1 phosphotyrosine kinase siRNA
attttgggctggccaaactgctg

SEQ ID NO: 7646 - DNA, 23 bp, Artificial Sequence
  epidermal growth factor receptor (EGFR), ERBB1 phosphotyrosine kinase siRNA
ttttgggctggccaaactgctgg

SEQ ID NO: 7647 - DNA, 23 bp, Artificial Sequence
  epidermal growth factor receptor (EGFR), ERBB1 phosphotyrosine kinase siRNA
tttgggctggccaaactgctggg

SEQ ID NO: 7648 - DNA, 23 bp, Artificial Sequence
  epidermal growth factor receptor (EGFR), ERBB1 phosphotyrosine kinase siRNA
ttgggctggccaaactgctgggt

SEQ ID NO: 7649 - DNA, 23 bp, Artificial Sequence
  epidermal growth factor receptor (EGFR), ERBB1 phosphotyrosine kinase siRNA
tgggctggccaaactgctgggtg

SEQ ID NO: 7650 - DNA, 23 bp, Artificial Sequence
  epidermal growth factor receptor (EGFR), ERBB1 phosphotyrosine kinase siRNA
gggctggccaaactgctgggtgc

SEQ ID NO: 7651 - DNA, 23 bp, Artificial Sequence
  epidermal growth factor receptor (EGFR), ERBB1 phosphotyrosine kinase siRNA
ggctggccaaactgctgggtgcg

SEQ ID NO: 7652 - DNA, 23 bp, Artificial Sequence
  epidermal growth factor receptor (EGFR), ERBB1 phosphotyrosine kinase siRNA
gctggccaaactgctgggtgcgg

SEQ ID NO: 7653 - DNA, 23 bp, Artificial Sequence
  epidermal growth factor receptor (EGFR), ERBB1 phosphotyrosine kinase siRNA
ctggccaaactgctgggtgcgga

SEQ ID NO: 7654 - DNA, 23 bp, Artificial Sequence
  epidermal growth factor receptor (EGFR), ERBB1 phosphotyrosine kinase siRNA
tggccaaactgctgggtgcggaa

SEQ ID NO: 7655 - DNA, 23 bp, Artificial Sequence
  epidermal growth factor receptor (EGFR), ERBB1 phosphotyrosine kinase siRNA
ggccaaactgctgggtgcggaag

SEQ ID NO: 7656 - DNA, 23 bp, Artificial Sequence
  epidermal growth factor receptor (EGFR), ERBB1 phosphotyrosine kinase siRNA
gccaaactgctgggtgcggaaga

SEQ ID NO: 7657 - DNA, 23 bp, Artificial Sequence
  epidermal growth factor receptor (EGFR), ERBB1 phosphotyrosine kinase siRNA
ccaaactgctgggtgcggaagag

SEQ ID NO: 7658 - DNA, 23 bp, Artificial Sequence
  epidermal growth factor receptor (EGFR), ERBB1 phosphotyrosine kinase siRNA
caaactgctgggtgcggaagaga

SEQ ID NO: 7659 - DNA, 23 bp, Artificial Sequence
  epidermal growth factor receptor (EGFR), ERBB1 phosphotyrosine kinase siRNA
aaactgctgggtgcggaagagaa

SEQ ID NO: 7660 - DNA, 23 bp, Artificial Sequence
  epidermal growth factor receptor (EGFR), ERBB1 phosphotyrosine kinase siRNA
aactgctgggtgcggaagagaaa

SEQ ID NO: 7661 - DNA, 23 bp, Artificial Sequence
  epidermal growth factor receptor (EGFR), ERBB1 phosphotyrosine kinase siRNA
actgctgggtgcggaagagaaag

SEQ ID NO: 7662 - DNA, 23 bp, Artificial Sequence
  epidermal growth factor receptor (EGFR), ERBB1 phosphotyrosine kinase siRNA
ctgctgggtgcggaagagaaaga

SEQ ID NO: 7663 - DNA, 23 bp, Artificial Sequence
  epidermal growth factor receptor (EGFR), ERBB1 phosphotyrosine kinase siRNA
tgctgggtgcggaagagaaagaa

SEQ ID NO: 7664 - DNA, 23 bp, Artificial Sequence
  epidermal growth factor receptor (EGFR), ERBB1 phosphotyrosine kinase siRNA
gctgggtgcggaagagaaagaat

SEQ ID NO: 7665 - DNA, 23 bp, Artificial Sequence
  epidermal growth factor receptor (EGFR), ERBB1 phosphotyrosine kinase siRNA
ctgggtgcggaagagaaagaata

SEQ ID NO: 7666 - DNA, 23 bp, Artificial Sequence
  epidermal growth factor receptor (EGFR), ERBB1 phosphotyrosine kinase siRNA
tgggtgcggaagagaaagaatac

SEQ ID NO: 7667 - DNA, 23 bp, Artificial Sequence
  epidermal growth factor receptor (EGFR), ERBB1 phosphotyrosine kinase siRNA
gggtgcggaagagaaagaatacc

SEQ ID NO: 7668 - DNA, 23 bp, Artificial Sequence
  epidermal growth factor receptor (EGFR), ERBB1 phosphotyrosine kinase siRNA
ggtgcggaagagaaagaatacca

SEQ ID NO: 7669 - DNA, 23 bp, Artificial Sequence
  epidermal growth factor receptor (EGFR), ERBB1 phosphotyrosine kinase siRNA
gtgcggaagagaaagaataccat

SEQ ID NO: 7670 - DNA, 23 bp, Artificial Sequence
  epidermal growth factor receptor (EGFR), ERBB1 phosphotyrosine kinase siRNA
tgcggaagagaaagaataccatg

SEQ ID NO: 7671 - DNA, 23 bp, Artificial Sequence
  epidermal growth factor receptor (EGFR), ERBB1 phosphotyrosine kinase siRNA
gcggaagagaaagaataccatgc

SEQ ID NO: 7672 - DNA, 23 bp, Artificial Sequence
  epidermal growth factor receptor (EGFR), ERBB1 phosphotyrosine kinase siRNA
cggaagagaaagaataccatgca

SEQ ID NO: 7673 - DNA, 23 bp, Artificial Sequence
  epidermal growth factor receptor (EGFR), ERBB1 phosphotyrosine kinase siRNA
ggaagagaaagaataccatgcag

SEQ ID NO: 7674 - DNA, 23 bp, Artificial Sequence
  epidermal growth factor receptor (EGFR), ERBB1 phosphotyrosine kinase siRNA
gaagagaaagaataccatgcaga

SEQ ID NO: 7675 - DNA, 23 bp, Artificial Sequence
  epidermal growth factor receptor (EGFR), ERBB1 phosphotyrosine kinase siRNA
aagagaaagaataccatgcagaa

SEQ ID NO: 7676 - DNA, 23 bp, Artificial Sequence
  epidermal growth factor receptor (EGFR), ERBB1 phosphotyrosine kinase siRNA
agagaaagaataccatgcagaag

SEQ ID NO: 7677 - DNA, 23 bp, Artificial Sequence
  epidermal growth factor receptor (EGFR), ERBB1 phosphotyrosine kinase siRNA
gagaaagaataccatgcagaagg

SEQ ID NO: 7678 - DNA, 23 bp, Artificial Sequence
  epidermal growth factor receptor (EGFR), ERBB1 phosphotyrosine kinase siRNA
agaaagaataccatgcagaagga

SEQ ID NO: 7679 - DNA, 23 bp, Artificial Sequence
  epidermal growth factor receptor (EGFR), ERBB1 phosphotyrosine kinase siRNA
gaaagaataccatgcagaaggag

SEQ ID NO: 7680 - DNA, 23 bp, Artificial Sequence
  epidermal growth factor receptor (EGFR), ERBB1 phosphotyrosine kinase siRNA
aaagaataccatgcagaaggagg

SEQ ID NO: 7681 - DNA, 23 bp, Artificial Sequence
  epidermal growth factor receptor (EGFR), ERBB1 phosphotyrosine kinase siRNA
aagaataccatgcagaaggaggc

SEQ ID NO: 7682 - DNA, 23 bp, Artificial Sequence
  epidermal growth factor receptor (EGFR), ERBB1 phosphotyrosine kinase siRNA
agaataccatgcagaaggaggca

SEQ ID NO: 7683 - DNA, 23 bp, Artificial Sequence
  epidermal growth factor receptor (EGFR), ERBB1 phosphotyrosine kinase siRNA
gaataccatgcagaaggaggcaa

SEQ ID NO: 7684 - DNA, 23 bp, Artificial Sequence
  epidermal growth factor receptor (EGFR), ERBB1 phosphotyrosine kinase siRNA
aataccatgcagaaggaggcaaa

SEQ ID NO: 7685 - DNA, 23 bp, Artificial Sequence
  epidermal growth factor receptor (EGFR), ERBB1 phosphotyrosine kinase siRNA
ataccatgcagaaggaggcaaag

SEQ ID NO: 7686 - DNA, 23 bp, Artificial Sequence
  epidermal growth factor receptor (EGFR), ERBB1 phosphotyrosine kinase siRNA
taccatgcagaaggaggcaaagt

SEQ ID NO: 7687 - DNA, 23 bp, Artificial Sequence
  epidermal growth factor receptor (EGFR), ERBB1 phosphotyrosine kinase siRNA
accatgcagaaggaggcaaagtg

SEQ ID NO: 7688 - DNA, 23 bp, Artificial Sequence
  epidermal growth factor receptor (EGFR), ERBB1 phosphotyrosine kinase siRNA
ccatgcagaaggaggcaaagtgc

SEQ ID NO: 7689 - DNA, 23 bp, Artificial Sequence
  epidermal growth factor receptor (EGFR), ERBB1 phosphotyrosine kinase siRNA
catgcagaaggaggcaaagtgcc

SEQ ID NO: 7690 - DNA, 23 bp, Artificial Sequence
  epidermal growth factor receptor (EGFR), ERBB1 phosphotyrosine kinase siRNA
atgcagaaggaggcaaagtgcct

SEQ ID NO: 7691 - DNA, 23 bp, Artificial Sequence
  epidermal growth factor receptor (EGFR), ERBB1 phosphotyrosine kinase siRNA
tgcagaaggaggcaaagtgccta

SEQ ID NO: 7692 - DNA, 23 bp, Artificial Sequence
  epidermal growth factor receptor (EGFR), ERBB1 phosphotyrosine kinase siRNA
gcagaaggaggcaaagtgcctat

SEQ ID NO: 7693 - DNA, 23 bp, Artificial Sequence
  epidermal growth factor receptor (EGFR), ERBB1 phosphotyrosine kinase siRNA
cagaaggaggcaaagtgcctatc

SEQ ID NO: 7694 - DNA, 23 bp, Artificial Sequence
  epidermal growth factor receptor (EGFR), ERBB1 phosphotyrosine kinase siRNA
agaaggaggcaaagtgcctatca

SEQ ID NO: 7695 - DNA, 23 bp, Artificial Sequence
  epidermal growth factor receptor (EGFR), ERBB1 phosphotyrosine kinase siRNA
gaaggaggcaaagtgcctatcaa

SEQ ID NO: 7696 - DNA, 23 bp, Artificial Sequence
  epidermal growth factor receptor (EGFR), ERBB1 phosphotyrosine kinase siRNA
aaggaggcaaagtgcctatcaag

SEQ ID NO: 7697 - DNA, 23 bp, Artificial Sequence
  epidermal growth factor receptor (EGFR), ERBB1 phosphotyrosine kinase siRNA
aggaggcaaagtgcctatcaagt

SEQ ID NO: 7698 - DNA, 23 bp, Artificial Sequence
  epidermal growth factor receptor (EGFR), ERBB1 phosphotyrosine kinase siRNA
ggaggcaaagtgcctatcaagtg

SEQ ID NO: 7699 - DNA, 23 bp, Artificial Sequence
  epidermal growth factor receptor (EGFR), ERBB1 phosphotyrosine kinase siRNA
gaggcaaagtgcctatcaagtgg

SEQ ID NO: 7700 - DNA, 23 bp, Artificial Sequence
  epidermal growth factor receptor (EGFR), ERBB1 phosphotyrosine kinase siRNA
aggcaaagtgcctatcaagtgga

SEQ ID NO: 7701 - DNA, 23 bp, Artificial Sequence
  epidermal growth factor receptor (EGFR), ERBB1 phosphotyrosine kinase siRNA
ggcaaagtgcctatcaagtggat

SEQ ID NO: 7702 - DNA, 23 bp, Artificial Sequence
  epidermal growth factor receptor (EGFR), ERBB1 phosphotyrosine kinase siRNA
gcaaagtgcctatcaagtggatg

SEQ ID NO: 7703 - DNA, 23 bp, Artificial Sequence
  epidermal growth factor receptor (EGFR), ERBB1 phosphotyrosine kinase siRNA
caaagtgcctatcaagtggatgg

SEQ ID NO: 7704 - DNA, 23 bp, Artificial Sequence
  epidermal growth factor receptor (EGFR), ERBB1 phosphotyrosine kinase siRNA
aaagtgcctatcaagtggatggc

SEQ ID NO: 7705 - DNA, 23 bp, Artificial Sequence
  epidermal growth factor receptor (EGFR), ERBB1 phosphotyrosine kinase siRNA
aagtgcctatcaagtggatggca

SEQ ID NO: 7706 - DNA, 23 bp, Artificial Sequence
  epidermal growth factor receptor (EGFR), ERBB1 phosphotyrosine kinase siRNA
agtgcctatcaagtggatggcat

SEQ ID NO: 7707 - DNA, 23 bp, Artificial Sequence
  epidermal growth factor receptor (EGFR), ERBB1 phosphotyrosine kinase siRNA
gtgcctatcaagtggatggcatt

SEQ ID NO: 7708 - DNA, 23 bp, Artificial Sequence
  epidermal growth factor receptor (EGFR), ERBB1 phosphotyrosine kinase siRNA
tgcctatcaagtggatggcattg

SEQ ID NO: 7709 - DNA, 23 bp, Artificial Sequence
  epidermal growth factor receptor (EGFR), ERBB1 phosphotyrosine kinase siRNA
gcctatcaagtggatggcattgg

SEQ ID NO: 7710 - DNA, 23 bp, Artificial Sequence
  epidermal growth factor receptor (EGFR), ERBB1 phosphotyrosine kinase siRNA
cctatcaagtggatggcattgga

SEQ ID NO: 7711 - DNA, 23 bp, Artificial Sequence
  epidermal growth factor receptor (EGFR), ERBB1 phosphotyrosine kinase siRNA
ctatcaagtggatggcattggaa

SEQ ID NO: 7712 - DNA, 23 bp, Artificial Sequence
  epidermal growth factor receptor (EGFR), ERBB1 phosphotyrosine kinase siRNA
tatcaagtggatggcattggaat

SEQ ID NO: 7713 - DNA, 23 bp, Artificial Sequence
  epidermal growth factor receptor (EGFR), ERBB1 phosphotyrosine kinase siRNA
atcaagtggatggcattggaatc

SEQ ID NO: 7714 - DNA, 23 bp, Artificial Sequence
  epidermal growth factor receptor (EGFR), ERBB1 phosphotyrosine kinase siRNA
tcaagtggatggcattggaatca

SEQ ID NO: 7715 - DNA, 23 bp, Artificial Sequence
  epidermal growth factor receptor (EGFR), ERBB1 phosphotyrosine kinase siRNA
caagtggatggcattggaatcaa

SEQ ID NO: 7716 - DNA, 23 bp, Artificial Sequence
  epidermal growth factor receptor (EGFR), ERBB1 phosphotyrosine kinase siRNA
aagtggatggcattggaatcaat

SEQ ID NO: 7717 - DNA, 23 bp, Artificial Sequence
  epidermal growth factor receptor (EGFR), ERBB1 phosphotyrosine kinase siRNA
agtggatggcattggaatcaatt

SEQ ID NO: 7718 - DNA, 23 bp, Artificial Sequence
  epidermal growth factor receptor (EGFR), ERBB1 phosphotyrosine kinase siRNA
gtggatggcattggaatcaattt

SEQ ID NO: 7719 - DNA, 23 bp, Artificial Sequence
  epidermal growth factor receptor (EGFR), ERBB1 phosphotyrosine kinase siRNA
tggatggcattggaatcaatttt

SEQ ID NO: 7720 - DNA, 23 bp, Artificial Sequence
  epidermal growth factor receptor (EGFR), ERBB1 phosphotyrosine kinase siRNA
ggatggcattggaatcaatttta

SEQ ID NO: 7721 - DNA, 23 bp, Artificial Sequence
  epidermal growth factor receptor (EGFR), ERBB1 phosphotyrosine kinase siRNA
gatggcattggaatcaattttac

SEQ ID NO: 7722 - DNA, 23 bp, Artificial Sequence
  epidermal growth factor receptor (EGFR), ERBB1 phosphotyrosine kinase siRNA
atggcattggaatcaattttaca

SEQ ID NO: 7723 - DNA, 23 bp, Artificial Sequence
  epidermal growth factor receptor (EGFR), ERBB1 phosphotyrosine kinase siRNA
tggcattggaatcaattttacac

SEQ ID NO: 7724 - DNA, 23 bp, Artificial Sequence
  epidermal growth factor receptor (EGFR), ERBB1 phosphotyrosine kinase siRNA
ggcattggaatcaattttacaca

SEQ ID NO: 7725 - DNA, 23 bp, Artificial Sequence
  epidermal growth factor receptor (EGFR), ERBB1 phosphotyrosine kinase siRNA
gcattggaatcaattttacacag

SEQ ID NO: 7726 - DNA, 23 bp, Artificial Sequence
  epidermal growth factor receptor (EGFR), ERBB1 phosphotyrosine kinase siRNA
cattggaatcaattttacacaga

SEQ ID NO: 7727 - DNA, 23 bp, Artificial Sequence
  epidermal growth factor receptor (EGFR), ERBB1 phosphotyrosine kinase siRNA
attggaatcaattttacacagaa

SEQ ID NO: 7728 - DNA, 23 bp, Artificial Sequence
  epidermal growth factor receptor (EGFR), ERBB1 phosphotyrosine kinase siRNA
ttggaatcaattttacacagaat

SEQ ID NO: 7729 - DNA, 23 bp, Artificial Sequence
  epidermal growth factor receptor (EGFR), ERBB1 phosphotyrosine kinase siRNA
tggaatcaattttacacagaatc

SEQ ID NO: 7730 - DNA, 23 bp, Artificial Sequence
  epidermal growth factor receptor (EGFR), ERBB1 phosphotyrosine kinase siRNA
ggaatcaattttacacagaatct

SEQ ID NO: 7731 - DNA, 23 bp, Artificial Sequence
  epidermal growth factor receptor (EGFR), ERBB1 phosphotyrosine kinase siRNA
gaatcaattttacacagaatcta

SEQ ID NO: 7732 - DNA, 23 bp, Artificial Sequence
  epidermal growth factor receptor (EGFR), ERBB1 phosphotyrosine kinase siRNA
aatcaattttacacagaatctat

SEQ ID NO: 7733 - DNA, 23 bp, Artificial Sequence
  epidermal growth factor receptor (EGFR), ERBB1 phosphotyrosine kinase siRNA
atcaattttacacagaatctata

SEQ ID NO: 7734 - DNA, 23 bp, Artificial Sequence
  epidermal growth factor receptor (EGFR), ERBB1 phosphotyrosine kinase siRNA
tcaattttacacagaatctatac

SEQ ID NO: 7735 - DNA, 23 bp, Artificial Sequence
  epidermal growth factor receptor (EGFR), ERBB1 phosphotyrosine kinase siRNA
caattttacacagaatctatacc

SEQ ID NO: 7736 - DNA, 23 bp, Artificial Sequence
  epidermal growth factor receptor (EGFR), ERBB1 phosphotyrosine kinase siRNA
aattttacacagaatctataccc

SEQ ID NO: 7737 - DNA, 23 bp, Artificial Sequence
  epidermal growth factor receptor (EGFR), ERBB1 phosphotyrosine kinase siRNA
attttacacagaatctataccca

SEQ ID NO: 7738 - DNA, 23 bp, Artificial Sequence
  epidermal growth factor receptor (EGFR), ERBB1 phosphotyrosine kinase siRNA
ttttacacagaatctatacccac

SEQ ID NO: 7739 - DNA, 23 bp, Artificial Sequence
  epidermal growth factor receptor (EGFR), ERBB1 phosphotyrosine kinase siRNA
tttacacagaatctatacccacc

SEQ ID NO: 7740 - DNA, 23 bp, Artificial Sequence
  epidermal growth factor receptor (EGFR), ERBB1 phosphotyrosine kinase siRNA
ttacacagaatctatacccacca

SEQ ID NO: 7741 - DNA, 23 bp, Artificial Sequence
  epidermal growth factor receptor (EGFR), ERBB1 phosphotyrosine kinase siRNA
tacacagaatctatacccaccag

SEQ ID NO: 7742 - DNA, 23 bp, Artificial Sequence
  epidermal growth factor receptor (EGFR), ERBB1 phosphotyrosine kinase siRNA
acacagaatctatacccaccaga

SEQ ID NO: 7743 - DNA, 23 bp, Artificial Sequence
  epidermal growth factor receptor (EGFR), ERBB1 phosphotyrosine kinase siRNA
cacagaatctatacccaccagag

SEQ ID NO: 7744 - DNA, 23 bp, Artificial Sequence
  epidermal growth factor receptor (EGFR), ERBB1 phosphotyrosine kinase siRNA
acagaatctatacccaccagagt

SEQ ID NO: 7745 - DNA, 23 bp, Artificial Sequence
  epidermal growth factor receptor (EGFR), ERBB1 phosphotyrosine kinase siRNA
cagaatctatacccaccagagtg

SEQ ID NO: 7746 - DNA, 23 bp, Artificial Sequence
  epidermal growth factor receptor (EGFR), ERBB1 phosphotyrosine kinase siRNA
agaatctatacccaccagagtga

SEQ ID NO: 7747 - DNA, 23 bp, Artificial Sequence
  epidermal growth factor receptor (EGFR), ERBB1 phosphotyrosine kinase siRNA
gaatctatacccaccagagtgat

SEQ ID NO: 7748 - DNA, 23 bp, Artificial Sequence
  epidermal growth factor receptor (EGFR), ERBB1 phosphotyrosine kinase siRNA
aatctatacccaccagagtgatg

SEQ ID NO: 7749 - DNA, 23 bp, Artificial Sequence
  epidermal growth factor receptor (EGFR), ERBB1 phosphotyrosine kinase siRNA
atctatacccaccagagtgatgt

SEQ ID NO: 7750 - DNA, 23 bp, Artificial Sequence
  epidermal growth factor receptor (EGFR), ERBB1 phosphotyrosine kinase siRNA
tctatacccaccagagtgatgtc

SEQ ID NO: 7751 - DNA, 23 bp, Artificial Sequence
  epidermal growth factor receptor (EGFR), ERBB1 phosphotyrosine kinase siRNA
ctatacccaccagagtgatgtct

SEQ ID NO: 7752 - DNA, 23 bp, Artificial Sequence
  epidermal growth factor receptor (EGFR), ERBB1 phosphotyrosine kinase siRNA
tatacccaccagagtgatgtctg

SEQ ID NO: 7753 - DNA, 23 bp, Artificial Sequence
  epidermal growth factor receptor (EGFR), ERBB1 phosphotyrosine kinase siRNA
atacccaccagagtgatgtctgg

SEQ ID NO: 7754 - DNA, 23 bp, Artificial Sequence
  epidermal growth factor receptor (EGFR), ERBB1 phosphotyrosine kinase siRNA
tacccaccagagtgatgtctgga

SEQ ID NO: 7755 - DNA, 23 bp, Artificial Sequence
  epidermal growth factor receptor (EGFR), ERBB1 phosphotyrosine kinase siRNA
acccaccagagtgatgtctggag

SEQ ID NO: 7756 - DNA, 23 bp, Artificial Sequence
  epidermal growth factor receptor (EGFR), ERBB1 phosphotyrosine kinase siRNA
cccaccagagtgatgtctggagc

SEQ ID NO: 7757 - DNA, 23 bp, Artificial Sequence
  epidermal growth factor receptor (EGFR), ERBB1 phosphotyrosine kinase siRNA
ccaccagagtgatgtctggagct

SEQ ID NO: 7758 - DNA, 23 bp, Artificial Sequence
  epidermal growth factor receptor (EGFR), ERBB1 phosphotyrosine kinase siRNA
caccagagtgatgtctggagcta

SEQ ID NO: 7759 - DNA, 23 bp, Artificial Sequence
  epidermal growth factor receptor (EGFR), ERBB1 phosphotyrosine kinase siRNA
accagagtgatgtctggagctac

SEQ ID NO: 7760 - DNA, 23 bp, Artificial Sequence
  epidermal growth factor receptor (EGFR), ERBB1 phosphotyrosine kinase siRNA
ccagagtgatgtctggagctacg

SEQ ID NO: 7761 - DNA, 23 bp, Artificial Sequence
  epidermal growth factor receptor (EGFR), ERBB1 phosphotyrosine kinase siRNA
cagagtgatgtctggagctacgg

SEQ ID NO: 7762 - DNA, 23 bp, Artificial Sequence
  epidermal growth factor receptor (EGFR), ERBB1 phosphotyrosine kinase siRNA
agagtgatgtctggagctacggg

SEQ ID NO: 7763 - DNA, 23 bp, Artificial Sequence
  epidermal growth factor receptor (EGFR), ERBB1 phosphotyrosine kinase siRNA
gagtgatgtctggagctacgggg

SEQ ID NO: 7764 - DNA, 23 bp, Artificial Sequence
  epidermal growth factor receptor (EGFR), ERBB1 phosphotyrosine kinase siRNA
agtgatgtctggagctacggggt

SEQ ID NO: 7765 - DNA, 23 bp, Artificial Sequence
  epidermal growth factor receptor (EGFR), ERBB1 phosphotyrosine kinase siRNA
gtgatgtctggagctacggggtg

SEQ ID NO: 7766 - DNA, 23 bp, Artificial Sequence
  epidermal growth factor receptor (EGFR), ERBB1 phosphotyrosine kinase siRNA
tgatgtctggagctacggggtga

SEQ ID NO: 7767 - DNA, 23 bp, Artificial Sequence
  epidermal growth factor receptor (EGFR), ERBB1 phosphotyrosine kinase siRNA
gatgtctggagctacggggtgac

SEQ ID NO: 7768 - DNA, 23 bp, Artificial Sequence
  epidermal growth factor receptor (EGFR), ERBB1 phosphotyrosine kinase siRNA
atgtctggagctacggggtgacc

SEQ ID NO: 7769 - DNA, 23 bp, Artificial Sequence
  epidermal growth factor receptor (EGFR), ERBB1 phosphotyrosine kinase siRNA
tgtctggagctacggggtgaccg

SEQ ID NO: 7770 - DNA, 23 bp, Artificial Sequence
  epidermal growth factor receptor (EGFR), ERBB1 phosphotyrosine kinase siRNA
gtctggagctacggggtgaccgt

SEQ ID NO: 7771 - DNA, 23 bp, Artificial Sequence
  epidermal growth factor receptor (EGFR), ERBB1 phosphotyrosine kinase siRNA
tctggagctacggggtgaccgtt

SEQ ID NO: 7772 - DNA, 23 bp, Artificial Sequence
  epidermal growth factor receptor (EGFR), ERBB1 phosphotyrosine kinase siRNA
ctggagctacggggtgaccgttt

SEQ ID NO: 7773 - DNA, 23 bp, Artificial Sequence
  epidermal growth factor receptor (EGFR), ERBB1 phosphotyrosine kinase siRNA
tggagctacggggtgaccgtttg

SEQ ID NO: 7774 - DNA, 23 bp, Artificial Sequence
  epidermal growth factor receptor (EGFR), ERBB1 phosphotyrosine kinase siRNA
ggagctacggggtgaccgtttgg

SEQ ID NO: 7775 - DNA, 23 bp, Artificial Sequence
  epidermal growth factor receptor (EGFR), ERBB1 phosphotyrosine kinase siRNA
gagctacggggtgaccgtttggg

SEQ ID NO: 7776 - DNA, 23 bp, Artificial Sequence
  epidermal growth factor receptor (EGFR), ERBB1 phosphotyrosine kinase siRNA
agctacggggtgaccgtttggga

SEQ ID NO: 7777 - DNA, 23 bp, Artificial Sequence
  epidermal growth factor receptor (EGFR), ERBB1 phosphotyrosine kinase siRNA
gctacggggtgaccgtttgggag

SEQ ID NO: 7778 - DNA, 23 bp, Artificial Sequence
  epidermal growth factor receptor (EGFR), ERBB1 phosphotyrosine kinase siRNA
ctacggggtgaccgtttgggagt

SEQ ID NO: 7779 - DNA, 23 bp, Artificial Sequence
  epidermal growth factor receptor (EGFR), ERBB1 phosphotyrosine kinase siRNA
tacggggtgaccgtttgggagtt

SEQ ID NO: 7780 - DNA, 23 bp, Artificial Sequence
  epidermal growth factor receptor (EGFR), ERBB1 phosphotyrosine kinase siRNA
acggggtgaccgtttgggagttg

SEQ ID NO: 7781 - DNA, 23 bp, Artificial Sequence
  epidermal growth factor receptor (EGFR), ERBB1 phosphotyrosine kinase siRNA
cggggtgaccgtttgggagttga

SEQ ID NO: 7782 - DNA, 23 bp, Artificial Sequence
  epidermal growth factor receptor (EGFR), ERBB1 phosphotyrosine kinase siRNA
ggggtgaccgtttgggagttgat

SEQ ID NO: 7783 - DNA, 23 bp, Artificial Sequence
  epidermal growth factor receptor (EGFR), ERBB1 phosphotyrosine kinase siRNA
gggtgaccgtttgggagttgatg

SEQ ID NO: 7784 - DNA, 23 bp, Artificial Sequence
  epidermal growth factor receptor (EGFR), ERBB1 phosphotyrosine kinase siRNA
ggtgaccgtttgggagttgatga

SEQ ID NO: 7785 - DNA, 23 bp, Artificial Sequence
  epidermal growth factor receptor (EGFR), ERBB1 phosphotyrosine kinase siRNA
gtgaccgtttgggagttgatgac

SEQ ID NO: 7786 - DNA, 23 bp, Artificial Sequence
  epidermal growth factor receptor (EGFR), ERBB1 phosphotyrosine kinase siRNA
tgaccgtttgggagttgatgacc

SEQ ID NO: 7787 - DNA, 23 bp, Artificial Sequence
  epidermal growth factor receptor (EGFR), ERBB1 phosphotyrosine kinase siRNA
gaccgtttgggagttgatgacct

SEQ ID NO: 7788 - DNA, 23 bp, Artificial Sequence
  epidermal growth factor receptor (EGFR), ERBB1 phosphotyrosine kinase siRNA
accgtttgggagttgatgacctt

SEQ ID NO: 7789 - DNA, 23 bp, Artificial Sequence
  epidermal growth factor receptor (EGFR), ERBB1 phosphotyrosine kinase siRNA
ccgtttgggagttgatgaccttt

SEQ ID NO: 7790 - DNA, 23 bp, Artificial Sequence
  epidermal growth factor receptor (EGFR), ERBB1 phosphotyrosine kinase siRNA
cgtttgggagttgatgacctttg

SEQ ID NO: 7791 - DNA, 23 bp, Artificial Sequence
  epidermal growth factor receptor (EGFR), ERBB1 phosphotyrosine kinase siRNA
gtttgggagttgatgacctttgg

SEQ ID NO: 7792 - DNA, 23 bp, Artificial Sequence
  epidermal growth factor receptor (EGFR), ERBB1 phosphotyrosine kinase siRNA
tttgggagttgatgacctttgga

SEQ ID NO: 7793 - DNA, 23 bp, Artificial Sequence
  epidermal growth factor receptor (EGFR), ERBB1 phosphotyrosine kinase siRNA
ttgggagttgatgacctttggat

SEQ ID NO: 7794 - DNA, 23 bp, Artificial Sequence
  epidermal growth factor receptor (EGFR), ERBB1 phosphotyrosine kinase siRNA
tgggagttgatgacctttggatc

SEQ ID NO: 7795 - DNA, 23 bp, Artificial Sequence
  epidermal growth factor receptor (EGFR), ERBB1 phosphotyrosine kinase siRNA
gggagttgatgacctttggatcc

SEQ ID NO: 7796 - DNA, 23 bp, Artificial Sequence
  epidermal growth factor receptor (EGFR), ERBB1 phosphotyrosine kinase siRNA
ggagttgatgacctttggatcca

SEQ ID NO: 7797 - DNA, 23 bp, Artificial Sequence
  epidermal growth factor receptor (EGFR), ERBB1 phosphotyrosine kinase siRNA
gagttgatgacctttggatccaa

SEQ ID NO: 7798 - DNA, 23 bp, Artificial Sequence
  epidermal growth factor receptor (EGFR), ERBB1 phosphotyrosine kinase siRNA
agttgatgacctttggatccaag

SEQ ID NO: 7799 - DNA, 23 bp, Artificial Sequence
  epidermal growth factor receptor (EGFR), ERBB1 phosphotyrosine kinase siRNA
gttgatgacctttggatccaagc

SEQ ID NO: 7800 - DNA, 23 bp, Artificial Sequence
  epidermal growth factor receptor (EGFR), ERBB1 phosphotyrosine kinase siRNA
ttgatgacctttggatccaagcc

SEQ ID NO: 7801 - DNA, 23 bp, Artificial Sequence
  epidermal growth factor receptor (EGFR), ERBB1 phosphotyrosine kinase siRNA
tgatgacctttggatccaagcca

SEQ ID NO: 7802 - DNA, 23 bp, Artificial Sequence
  epidermal growth factor receptor (EGFR), ERBB1 phosphotyrosine kinase siRNA
gatgacctttggatccaagccat

SEQ ID NO: 7803 - DNA, 23 bp, Artificial Sequence
  epidermal growth factor receptor (EGFR), ERBB1 phosphotyrosine kinase siRNA
atgacctttggatccaagccata

SEQ ID NO: 7804 - DNA, 23 bp, Artificial Sequence
  epidermal growth factor receptor (EGFR), ERBB1 phosphotyrosine kinase siRNA
tgacctttggatccaagccatat

SEQ ID NO: 7805 - DNA, 23 bp, Artificial Sequence
  epidermal growth factor receptor (EGFR), ERBB1 phosphotyrosine kinase siRNA
gacctttggatccaagccatatg

SEQ ID NO: 7806 - DNA, 23 bp, Artificial Sequence
  epidermal growth factor receptor (EGFR), ERBB1 phosphotyrosine kinase siRNA
acctttggatccaagccatatga

SEQ ID NO: 7807 - DNA, 23 bp, Artificial Sequence
  epidermal growth factor receptor (EGFR), ERBB1 phosphotyrosine kinase siRNA
cctttggatccaagccatatgac

SEQ ID NO: 7808 - DNA, 23 bp, Artificial Sequence
  epidermal growth factor receptor (EGFR), ERBB1 phosphotyrosine kinase siRNA
ctttggatccaagccatatgacg

SEQ ID NO: 7809 - DNA, 23 bp, Artificial Sequence
  epidermal growth factor receptor (EGFR), ERBB1 phosphotyrosine kinase siRNA
tttggatccaagccatatgacgg

SEQ ID NO: 7810 - DNA, 23 bp, Artificial Sequence
  epidermal growth factor receptor (EGFR), ERBB1 phosphotyrosine kinase siRNA
ttggatccaagccatatgacgga

SEQ ID NO: 7811 - DNA, 23 bp, Artificial Sequence
  epidermal growth factor receptor (EGFR), ERBB1 phosphotyrosine kinase siRNA
tggatccaagccatatgacggaa

SEQ ID NO: 7812 - DNA, 23 bp, Artificial Sequence
  epidermal growth factor receptor (EGFR), ERBB1 phosphotyrosine kinase siRNA
ggatccaagccatatgacggaat

SEQ ID NO: 7813 - DNA, 23 bp, Artificial Sequence
  epidermal growth factor receptor (EGFR), ERBB1 phosphotyrosine kinase siRNA
gatccaagccatatgacggaatc

SEQ ID NO: 7814 - DNA, 23 bp, Artificial Sequence
  epidermal growth factor receptor (EGFR), ERBB1 phosphotyrosine kinase siRNA
atccaagccatatgacggaatcc

SEQ ID NO: 7815 - DNA, 23 bp, Artificial Sequence
  epidermal growth factor receptor (EGFR), ERBB1 phosphotyrosine kinase siRNA
tccaagccatatgacggaatccc

SEQ ID NO: 7816 - DNA, 23 bp, Artificial Sequence
  epidermal growth factor receptor (EGFR), ERBB1 phosphotyrosine kinase siRNA
ccaagccatatgacggaatccct

SEQ ID NO: 7817 - DNA, 23 bp, Artificial Sequence
  epidermal growth factor receptor (EGFR), ERBB1 phosphotyrosine kinase siRNA
caagccatatgacggaatccctg

SEQ ID NO: 7818 - DNA, 23 bp, Artificial Sequence
  epidermal growth factor receptor (EGFR), ERBB1 phosphotyrosine kinase siRNA
aagccatatgacggaatccctgc

SEQ ID NO: 7819 - DNA, 23 bp, Artificial Sequence
  epidermal growth factor receptor (EGFR), ERBB1 phosphotyrosine kinase siRNA
agccatatgacggaatccctgcc

SEQ ID NO: 7820 - DNA, 23 bp, Artificial Sequence
  epidermal growth factor receptor (EGFR), ERBB1 phosphotyrosine kinase siRNA
gccatatgacggaatccctgcca

SEQ ID NO: 7821 - DNA, 23 bp, Artificial Sequence
  epidermal growth factor receptor (EGFR), ERBB1 phosphotyrosine kinase siRNA
ccatatgacggaatccctgccag

SEQ ID NO: 7822 - DNA, 23 bp, Artificial Sequence
  epidermal growth factor receptor (EGFR), ERBB1 phosphotyrosine kinase siRNA
catatgacggaatccctgccagc

SEQ ID NO: 7823 - DNA, 23 bp, Artificial Sequence
  epidermal growth factor receptor (EGFR), ERBB1 phosphotyrosine kinase siRNA
atatgacggaatccctgccagcg

SEQ ID NO: 7824 - DNA, 23 bp, Artificial Sequence
  epidermal growth factor receptor (EGFR), ERBB1 phosphotyrosine kinase siRNA
tatgacggaatccctgccagcga

SEQ ID NO: 7825 - DNA, 23 bp, Artificial Sequence
  epidermal growth factor receptor (EGFR), ERBB1 phosphotyrosine kinase siRNA
atgacggaatccctgccagcgag

SEQ ID NO: 7826 - DNA, 23 bp, Artificial Sequence
  epidermal growth factor receptor (EGFR), ERBB1 phosphotyrosine kinase siRNA
tgacggaatccctgccagcgaga

SEQ ID NO: 7827 - DNA, 23 bp, Artificial Sequence
  epidermal growth factor receptor (EGFR), ERBB1 phosphotyrosine kinase siRNA
gacggaatccctgccagcgagat

SEQ ID NO: 7828 - DNA, 23 bp, Artificial Sequence
  epidermal growth factor receptor (EGFR), ERBB1 phosphotyrosine kinase siRNA
acggaatccctgccagcgagatc

SEQ ID NO: 7829 - DNA, 23 bp, Artificial Sequence
  epidermal growth factor receptor (EGFR), ERBB1 phosphotyrosine kinase siRNA
cggaatccctgccagcgagatct

SEQ ID NO: 7830 - DNA, 23 bp, Artificial Sequence
  epidermal growth factor receptor (EGFR), ERBB1 phosphotyrosine kinase siRNA
ggaatccctgccagcgagatctc

SEQ ID NO: 7831 - DNA, 23 bp, Artificial Sequence
  epidermal growth factor receptor (EGFR), ERBB1 phosphotyrosine kinase siRNA
gaatccctgccagcgagatctcc

SEQ ID NO: 7832 - DNA, 23 bp, Artificial Sequence
  epidermal growth factor receptor (EGFR), ERBB1 phosphotyrosine kinase siRNA
aatccctgccagcgagatctcct

SEQ ID NO: 7833 - DNA, 23 bp, Artificial Sequence
  epidermal growth factor receptor (EGFR), ERBB1 phosphotyrosine kinase siRNA
atccctgccagcgagatctcctc

SEQ ID NO: 7834 - DNA, 23 bp, Artificial Sequence
  epidermal growth factor receptor (EGFR), ERBB1 phosphotyrosine kinase siRNA
tccctgccagcgagatctcctcc

SEQ ID NO: 7835 - DNA, 23 bp, Artificial Sequence
  epidermal growth factor receptor (EGFR), ERBB1 phosphotyrosine kinase siRNA
ccctgccagcgagatctcctcca

SEQ ID NO: 7836 - DNA, 23 bp, Artificial Sequence
  epidermal growth factor receptor (EGFR), ERBB1 phosphotyrosine kinase siRNA
cctgccagcgagatctcctccat

SEQ ID NO: 7837 - DNA, 23 bp, Artificial Sequence
  epidermal growth factor receptor (EGFR), ERBB1 phosphotyrosine kinase siRNA
ctgccagcgagatctcctccatc

SEQ ID NO: 7838 - DNA, 23 bp, Artificial Sequence
  epidermal growth factor receptor (EGFR), ERBB1 phosphotyrosine kinase siRNA
tgccagcgagatctcctccatcc

SEQ ID NO: 7839 - DNA, 23 bp, Artificial Sequence
  epidermal growth factor receptor (EGFR), ERBB1 phosphotyrosine kinase siRNA
gccagcgagatctcctccatcct

SEQ ID NO: 7840 - DNA, 23 bp, Artificial Sequence
  epidermal growth factor receptor (EGFR), ERBB1 phosphotyrosine kinase siRNA
ccagcgagatctcctccatcctg

SEQ ID NO: 7841 - DNA, 23 bp, Artificial Sequence
  epidermal growth factor receptor (EGFR), ERBB1 phosphotyrosine kinase siRNA
cagcgagatctcctccatcctgg

SEQ ID NO: 7842 - DNA, 23 bp, Artificial Sequence
  epidermal growth factor receptor (EGFR), ERBB1 phosphotyrosine kinase siRNA
agcgagatctcctccatcctgga

SEQ ID NO: 7843 - DNA, 23 bp, Artificial Sequence
  epidermal growth factor receptor (EGFR), ERBB1 phosphotyrosine kinase siRNA
gcgagatctcctccatcctggag

SEQ ID NO: 7844 - DNA, 23 bp, Artificial Sequence
  epidermal growth factor receptor (EGFR), ERBB1 phosphotyrosine kinase siRNA
cgagatctcctccatcctggaga

SEQ ID NO: 7845 - DNA, 23 bp, Artificial Sequence
  epidermal growth factor receptor (EGFR), ERBB1 phosphotyrosine kinase siRNA
gagatctcctccatcctggagaa

SEQ ID NO: 7846 - DNA, 23 bp, Artificial Sequence
  epidermal growth factor receptor (EGFR), ERBB1 phosphotyrosine kinase siRNA
agatctcctccatcctggagaaa

SEQ ID NO: 7847 - DNA, 23 bp, Artificial Sequence
  epidermal growth factor receptor (EGFR), ERBB1 phosphotyrosine kinase siRNA
gatctcctccatcctggagaaag

SEQ ID NO: 7848 - DNA, 23 bp, Artificial Sequence
  epidermal growth factor receptor (EGFR), ERBB1 phosphotyrosine kinase siRNA
atctcctccatcctggagaaagg

SEQ ID NO: 7849 - DNA, 23 bp, Artificial Sequence
  epidermal growth factor receptor (EGFR), ERBB1 phosphotyrosine kinase siRNA
tctcctccatcctggagaaagga

SEQ ID NO: 7850 - DNA, 23 bp, Artificial Sequence
  epidermal growth factor receptor (EGFR), ERBB1 phosphotyrosine kinase siRNA
ctcctccatcctggagaaaggag

SEQ ID NO: 7851 - DNA, 23 bp, Artificial Sequence
  epidermal growth factor receptor (EGFR), ERBB1 phosphotyrosine kinase siRNA
tcctccatcctggagaaaggaga

SEQ ID NO: 7852 - DNA, 23 bp, Artificial Sequence
  epidermal growth factor receptor (EGFR), ERBB1 phosphotyrosine kinase siRNA
cctccatcctggagaaaggagaa

SEQ ID NO: 7853 - DNA, 23 bp, Artificial Sequence
  epidermal growth factor receptor (EGFR), ERBB1 phosphotyrosine kinase siRNA
ctccatcctggagaaaggagaac

SEQ ID NO: 7854 - DNA, 23 bp, Artificial Sequence
  epidermal growth factor receptor (EGFR), ERBB1 phosphotyrosine kinase siRNA
tccatcctggagaaaggagaacg

SEQ ID NO: 7855 - DNA, 23 bp, Artificial Sequence
  epidermal growth factor receptor (EGFR), ERBB1 phosphotyrosine kinase siRNA
ccatcctggagaaaggagaacgc

SEQ ID NO: 7856 - DNA, 23 bp, Artificial Sequence
  epidermal growth factor receptor (EGFR), ERBB1 phosphotyrosine kinase siRNA
catcctggagaaaggagaacgcc

SEQ ID NO: 7857 - DNA, 23 bp, Artificial Sequence
  epidermal growth factor receptor (EGFR), ERBB1 phosphotyrosine kinase siRNA
atcctggagaaaggagaacgcct

SEQ ID NO: 7858 - DNA, 23 bp, Artificial Sequence
  epidermal growth factor receptor (EGFR), ERBB1 phosphotyrosine kinase siRNA
tcctggagaaaggagaacgcctc

SEQ ID NO: 7859 - DNA, 23 bp, Artificial Sequence
  epidermal growth factor receptor (EGFR), ERBB1 phosphotyrosine kinase siRNA
cctggagaaaggagaacgcctcc

SEQ ID NO: 7860 - DNA, 23 bp, Artificial Sequence
  epidermal growth factor receptor (EGFR), ERBB1 phosphotyrosine kinase siRNA
ctggagaaaggagaacgcctccc

SEQ ID NO: 7861 - DNA, 23 bp, Artificial Sequence
  epidermal growth factor receptor (EGFR), ERBB1 phosphotyrosine kinase siRNA
tggagaaaggagaacgcctccct

SEQ ID NO: 7862 - DNA, 23 bp, Artificial Sequence
  epidermal growth factor receptor (EGFR), ERBB1 phosphotyrosine kinase siRNA
ggagaaaggagaacgcctccctc

SEQ ID NO: 7863 - DNA, 23 bp, Artificial Sequence
  epidermal growth factor receptor (EGFR), ERBB1 phosphotyrosine kinase siRNA
gagaaaggagaacgcctccctca

SEQ ID NO: 7864 - DNA, 23 bp, Artificial Sequence
  epidermal growth factor receptor (EGFR), ERBB1 phosphotyrosine kinase siRNA
agaaaggagaacgcctccctcag

SEQ ID NO: 7865 - DNA, 23 bp, Artificial Sequence
  epidermal growth factor receptor (EGFR), ERBB1 phosphotyrosine kinase siRNA
gaaaggagaacgcctccctcagc

SEQ ID NO: 7866 - DNA, 23 bp, Artificial Sequence
  epidermal growth factor receptor (EGFR), ERBB1 phosphotyrosine kinase siRNA
aaaggagaacgcctccctcagcc

SEQ ID NO: 7867 - DNA, 23 bp, Artificial Sequence
  epidermal growth factor receptor (EGFR), ERBB1 phosphotyrosine kinase siRNA
aaggagaacgcctccctcagcca

SEQ ID NO: 7868 - DNA, 23 bp, Artificial Sequence
  epidermal growth factor receptor (EGFR), ERBB1 phosphotyrosine kinase siRNA
aggagaacgcctccctcagccac

SEQ ID NO: 7869 - DNA, 23 bp, Artificial Sequence
  epidermal growth factor receptor (EGFR), ERBB1 phosphotyrosine kinase siRNA
ggagaacgcctccctcagccacc

SEQ ID NO: 7870 - DNA, 23 bp, Artificial Sequence
  epidermal growth factor receptor (EGFR), ERBB1 phosphotyrosine kinase siRNA
gagaacgcctccctcagccaccc

SEQ ID NO: 7871 - DNA, 23 bp, Artificial Sequence
  epidermal growth factor receptor (EGFR), ERBB1 phosphotyrosine kinase siRNA
agaacgcctccctcagccaccca

SEQ ID NO: 7872 - DNA, 23 bp, Artificial Sequence
  epidermal growth factor receptor (EGFR), ERBB1 phosphotyrosine kinase siRNA
gaacgcctccctcagccacccat

SEQ ID NO: 7873 - DNA, 23 bp, Artificial Sequence
  epidermal growth factor receptor (EGFR), ERBB1 phosphotyrosine kinase siRNA
aacgcctccctcagccacccata

SEQ ID NO: 7874 - DNA, 23 bp, Artificial Sequence
  epidermal growth factor receptor (EGFR), ERBB1 phosphotyrosine kinase siRNA
acgcctccctcagccacccatat

SEQ ID NO: 7875 - DNA, 23 bp, Artificial Sequence
  epidermal growth factor receptor (EGFR), ERBB1 phosphotyrosine kinase siRNA
cgcctccctcagccacccatatg

SEQ ID NO: 7876 - DNA, 23 bp, Artificial Sequence
  epidermal growth factor receptor (EGFR), ERBB1 phosphotyrosine kinase siRNA
gcctccctcagccacccatatgt

SEQ ID NO: 7877 - DNA, 23 bp, Artificial Sequence
  epidermal growth factor receptor (EGFR), ERBB1 phosphotyrosine kinase siRNA
cctccctcagccacccatatgta

SEQ ID NO: 7878 - DNA, 23 bp, Artificial Sequence
  epidermal growth factor receptor (EGFR), ERBB1 phosphotyrosine kinase siRNA
ctccctcagccacccatatgtac

SEQ ID NO: 7879 - DNA, 23 bp, Artificial Sequence
  epidermal growth factor receptor (EGFR), ERBB1 phosphotyrosine kinase siRNA
tccctcagccacccatatgtacc

SEQ ID NO: 7880 - DNA, 23 bp, Artificial Sequence
  epidermal growth factor receptor (EGFR), ERBB1 phosphotyrosine kinase siRNA
ccctcagccacccatatgtacca

SEQ ID NO: 7881 - DNA, 23 bp, Artificial Sequence
  epidermal growth factor receptor (EGFR), ERBB1 phosphotyrosine kinase siRNA
cctcagccacccatatgtaccat

SEQ ID NO: 7882 - DNA, 23 bp, Artificial Sequence
  epidermal growth factor receptor (EGFR), ERBB1 phosphotyrosine kinase siRNA
ctcagccacccatatgtaccatc

SEQ ID NO: 7883 - DNA, 23 bp, Artificial Sequence
  epidermal growth factor receptor (EGFR), ERBB1 phosphotyrosine kinase siRNA
tcagccacccatatgtaccatcg

SEQ ID NO: 7884 - DNA, 23 bp, Artificial Sequence
  epidermal growth factor receptor (EGFR), ERBB1 phosphotyrosine kinase siRNA
cagccacccatatgtaccatcga

SEQ ID NO: 7885 - DNA, 23 bp, Artificial Sequence
  epidermal growth factor receptor (EGFR), ERBB1 phosphotyrosine kinase siRNA
agccacccatatgtaccatcgat

SEQ ID NO: 7886 - DNA, 23 bp, Artificial Sequence
  epidermal growth factor receptor (EGFR), ERBB1 phosphotyrosine kinase siRNA
gccacccatatgtaccatcgatg

SEQ ID NO: 7887 - DNA, 23 bp, Artificial Sequence
  epidermal growth factor receptor (EGFR), ERBB1 phosphotyrosine kinase siRNA
ccacccatatgtaccatcgatgt

SEQ ID NO: 7888 - DNA, 23 bp, Artificial Sequence
  epidermal growth factor receptor (EGFR), ERBB1 phosphotyrosine kinase siRNA
cacccatatgtaccatcgatgtc

SEQ ID NO: 7889 - DNA, 23 bp, Artificial Sequence
  epidermal growth factor receptor (EGFR), ERBB1 phosphotyrosine kinase siRNA
acccatatgtaccatcgatgtct

SEQ ID NO: 7890 - DNA, 23 bp, Artificial Sequence
  epidermal growth factor receptor (EGFR), ERBB1 phosphotyrosine kinase siRNA
cccatatgtaccatcgatgtcta

SEQ ID NO: 7891 - DNA, 23 bp, Artificial Sequence
  epidermal growth factor receptor (EGFR), ERBB1 phosphotyrosine kinase siRNA
ccatatgtaccatcgatgtctac

SEQ ID NO: 7892 - DNA, 23 bp, Artificial Sequence
  epidermal growth factor receptor (EGFR), ERBB1 phosphotyrosine kinase siRNA
catatgtaccatcgatgtctaca

SEQ ID NO: 7893 - DNA, 23 bp, Artificial Sequence
  epidermal growth factor receptor (EGFR), ERBB1 phosphotyrosine kinase siRNA
atatgtaccatcgatgtctacat

SEQ ID NO: 7894 - DNA, 23 bp, Artificial Sequence
  epidermal growth factor receptor (EGFR), ERBB1 phosphotyrosine kinase siRNA
tatgtaccatcgatgtctacatg

SEQ ID NO: 7895 - DNA, 23 bp, Artificial Sequence
  epidermal growth factor receptor (EGFR), ERBB1 phosphotyrosine kinase siRNA
atgtaccatcgatgtctacatga

SEQ ID NO: 7896 - DNA, 23 bp, Artificial Sequence
  epidermal growth factor receptor (EGFR), ERBB1 phosphotyrosine kinase siRNA
tgtaccatcgatgtctacatgat

SEQ ID NO: 7897 - DNA, 23 bp, Artificial Sequence
  epidermal growth factor receptor (EGFR), ERBB1 phosphotyrosine kinase siRNA
gtaccatcgatgtctacatgatc

SEQ ID NO: 7898 - DNA, 23 bp, Artificial Sequence
  epidermal growth factor receptor (EGFR), ERBB1 phosphotyrosine kinase siRNA
taccatcgatgtctacatgatca

SEQ ID NO: 7899 - DNA, 23 bp, Artificial Sequence
  epidermal growth factor receptor (EGFR), ERBB1 phosphotyrosine kinase siRNA
accatcgatgtctacatgatcat

SEQ ID NO: 7900 - DNA, 23 bp, Artificial Sequence
  epidermal growth factor receptor (EGFR), ERBB1 phosphotyrosine kinase siRNA
ccatcgatgtctacatgatcatg

SEQ ID NO: 7901 - DNA, 23 bp, Artificial Sequence
  epidermal growth factor receptor (EGFR), ERBB1 phosphotyrosine kinase siRNA
catcgatgtctacatgatcatgg

SEQ ID NO: 7902 - DNA, 23 bp, Artificial Sequence
  epidermal growth factor receptor (EGFR), ERBB1 phosphotyrosine kinase siRNA
atcgatgtctacatgatcatggt

SEQ ID NO: 7903 - DNA, 23 bp, Artificial Sequence
  epidermal growth factor receptor (EGFR), ERBB1 phosphotyrosine kinase siRNA
tcgatgtctacatgatcatggtc

SEQ ID NO: 7904 - DNA, 23 bp, Artificial Sequence
  epidermal growth factor receptor (EGFR), ERBB1 phosphotyrosine kinase siRNA
cgatgtctacatgatcatggtca

SEQ ID NO: 7905 - DNA, 23 bp, Artificial Sequence
  epidermal growth factor receptor (EGFR), ERBB1 phosphotyrosine kinase siRNA
gatgtctacatgatcatggtcaa

SEQ ID NO: 7906 - DNA, 23 bp, Artificial Sequence
  epidermal growth factor receptor (EGFR), ERBB1 phosphotyrosine kinase siRNA
atgtctacatgatcatggtcaag

SEQ ID NO: 7907 - DNA, 23 bp, Artificial Sequence
  epidermal growth factor receptor (EGFR), ERBB1 phosphotyrosine kinase siRNA
tgtctacatgatcatggtcaagt

SEQ ID NO: 7908 - DNA, 23 bp, Artificial Sequence
  epidermal growth factor receptor (EGFR), ERBB1 phosphotyrosine kinase siRNA
gtctacatgatcatggtcaagtg

SEQ ID NO: 7909 - DNA, 23 bp, Artificial Sequence
  epidermal growth factor receptor (EGFR), ERBB1 phosphotyrosine kinase siRNA
tctacatgatcatggtcaagtgc

SEQ ID NO: 7910 - DNA, 23 bp, Artificial Sequence
  epidermal growth factor receptor (EGFR), ERBB1 phosphotyrosine kinase siRNA
ctacatgatcatggtcaagtgct

SEQ ID NO: 7911 - DNA, 23 bp, Artificial Sequence
  epidermal growth factor receptor (EGFR), ERBB1 phosphotyrosine kinase siRNA
tacatgatcatggtcaagtgctg

SEQ ID NO: 7912 - DNA, 23 bp, Artificial Sequence
  epidermal growth factor receptor (EGFR), ERBB1 phosphotyrosine kinase siRNA
acatgatcatggtcaagtgctgg

SEQ ID NO: 7913 - DNA, 23 bp, Artificial Sequence
  epidermal growth factor receptor (EGFR), ERBB1 phosphotyrosine kinase siRNA
catgatcatggtcaagtgctgga

SEQ ID NO: 7914 - DNA, 23 bp, Artificial Sequence
  epidermal growth factor receptor (EGFR), ERBB1 phosphotyrosine kinase siRNA
atgatcatggtcaagtgctggat

SEQ ID NO: 7915 - DNA, 23 bp, Artificial Sequence
  epidermal growth factor receptor (EGFR), ERBB1 phosphotyrosine kinase siRNA
tgatcatggtcaagtgctggatg

SEQ ID NO: 7916 - DNA, 23 bp, Artificial Sequence
  epidermal growth factor receptor (EGFR), ERBB1 phosphotyrosine kinase siRNA
gatcatggtcaagtgctggatga

SEQ ID NO: 7917 - DNA, 23 bp, Artificial Sequence
  epidermal growth factor receptor (EGFR), ERBB1 phosphotyrosine kinase siRNA
atcatggtcaagtgctggatgat

SEQ ID NO: 7918 - DNA, 23 bp, Artificial Sequence
  epidermal growth factor receptor (EGFR), ERBB1 phosphotyrosine kinase siRNA
tcatggtcaagtgctggatgata

SEQ ID NO: 7919 - DNA, 23 bp, Artificial Sequence
  epidermal growth factor receptor (EGFR), ERBB1 phosphotyrosine kinase siRNA
catggtcaagtgctggatgatag

SEQ ID NO: 7920 - DNA, 23 bp, Artificial Sequence
  epidermal growth factor receptor (EGFR), ERBB1 phosphotyrosine kinase siRNA
atggtcaagtgctggatgataga

SEQ ID NO: 7921 - DNA, 23 bp, Artificial Sequence
  epidermal growth factor receptor (EGFR), ERBB1 phosphotyrosine kinase siRNA
tggtcaagtgctggatgatagac

SEQ ID NO: 7922 - DNA, 23 bp, Artificial Sequence
  epidermal growth factor receptor (EGFR), ERBB1 phosphotyrosine kinase siRNA
ggtcaagtgctggatgatagacg

SEQ ID NO: 7923 - DNA, 23 bp, Artificial Sequence
  epidermal growth factor receptor (EGFR), ERBB1 phosphotyrosine kinase siRNA
gtcaagtgctggatgatagacgc

SEQ ID NO: 7924 - DNA, 23 bp, Artificial Sequence
  epidermal growth factor receptor (EGFR), ERBB1 phosphotyrosine kinase siRNA
tcaagtgctggatgatagacgca

SEQ ID NO: 7925 - DNA, 23 bp, Artificial Sequence
  epidermal growth factor receptor (EGFR), ERBB1 phosphotyrosine kinase siRNA
caagtgctggatgatagacgcag

SEQ ID NO: 7926 - DNA, 23 bp, Artificial Sequence
  epidermal growth factor receptor (EGFR), ERBB1 phosphotyrosine kinase siRNA
aagtgctggatgatagacgcaga

SEQ ID NO: 7927 - DNA, 23 bp, Artificial Sequence
  epidermal growth factor receptor (EGFR), ERBB1 phosphotyrosine kinase siRNA
agtgctggatgatagacgcagat

SEQ ID NO: 7928 - DNA, 23 bp, Artificial Sequence
  epidermal growth factor receptor (EGFR), ERBB1 phosphotyrosine kinase siRNA
gtgctggatgatagacgcagata

SEQ ID NO: 7929 - DNA, 23 bp, Artificial Sequence
  epidermal growth factor receptor (EGFR), ERBB1 phosphotyrosine kinase siRNA
tgctggatgatagacgcagatag

SEQ ID NO: 7930 - DNA, 23 bp, Artificial Sequence
  epidermal growth factor receptor (EGFR), ERBB1 phosphotyrosine kinase siRNA
gctggatgatagacgcagatagt

SEQ ID NO: 7931 - DNA, 23 bp, Artificial Sequence
  epidermal growth factor receptor (EGFR), ERBB1 phosphotyrosine kinase siRNA
ctggatgatagacgcagatagtc

SEQ ID NO: 7932 - DNA, 23 bp, Artificial Sequence
  epidermal growth factor receptor (EGFR), ERBB1 phosphotyrosine kinase siRNA
tggatgatagacgcagatagtcg

SEQ ID NO: 7933 - DNA, 23 bp, Artificial Sequence
  epidermal growth factor receptor (EGFR), ERBB1 phosphotyrosine kinase siRNA
ggatgatagacgcagatagtcgc

SEQ ID NO: 7934 - DNA, 23 bp, Artificial Sequence
  epidermal growth factor receptor (EGFR), ERBB1 phosphotyrosine kinase siRNA
gatgatagacgcagatagtcgcc

SEQ ID NO: 7935 - DNA, 23 bp, Artificial Sequence
  epidermal growth factor receptor (EGFR), ERBB1 phosphotyrosine kinase siRNA
atgatagacgcagatagtcgccc

SEQ ID NO: 7936 - DNA, 23 bp, Artificial Sequence
  epidermal growth factor receptor (EGFR), ERBB1 phosphotyrosine kinase siRNA
tgatagacgcagatagtcgccca

SEQ ID NO: 7937 - DNA, 23 bp, Artificial Sequence
  epidermal growth factor receptor (EGFR), ERBB1 phosphotyrosine kinase siRNA
gatagacgcagatagtcgcccaa

SEQ ID NO: 7938 - DNA, 23 bp, Artificial Sequence
  epidermal growth factor receptor (EGFR), ERBB1 phosphotyrosine kinase siRNA
atagacgcagatagtcgcccaaa

SEQ ID NO: 7939 - DNA, 23 bp, Artificial Sequence
  epidermal growth factor receptor (EGFR), ERBB1 phosphotyrosine kinase siRNA
tagacgcagatagtcgcccaaag

SEQ ID NO: 7940 - DNA, 23 bp, Artificial Sequence
  epidermal growth factor receptor (EGFR), ERBB1 phosphotyrosine kinase siRNA
agacgcagatagtcgcccaaagt

SEQ ID NO: 7941 - DNA, 23 bp, Artificial Sequence
  epidermal growth factor receptor (EGFR), ERBB1 phosphotyrosine kinase siRNA
gacgcagatagtcgcccaaagtt

SEQ ID NO: 7942 - DNA, 23 bp, Artificial Sequence
  epidermal growth factor receptor (EGFR), ERBB1 phosphotyrosine kinase siRNA
acgcagatagtcgcccaaagttc

SEQ ID NO: 7943 - DNA, 23 bp, Artificial Sequence
  epidermal growth factor receptor (EGFR), ERBB1 phosphotyrosine kinase siRNA
cgcagatagtcgcccaaagttcc

SEQ ID NO: 7944 - DNA, 23 bp, Artificial Sequence
  epidermal growth factor receptor (EGFR), ERBB1 phosphotyrosine kinase siRNA
gcagatagtcgcccaaagttccg

SEQ ID NO: 7945 - DNA, 23 bp, Artificial Sequence
  epidermal growth factor receptor (EGFR), ERBB1 phosphotyrosine kinase siRNA
cagatagtcgcccaaagttccgt

SEQ ID NO: 7946 - DNA, 23 bp, Artificial Sequence
  epidermal growth factor receptor (EGFR), ERBB1 phosphotyrosine kinase siRNA
agatagtcgcccaaagttccgtg

SEQ ID NO: 7947 - DNA, 23 bp, Artificial Sequence
  epidermal growth factor receptor (EGFR), ERBB1 phosphotyrosine kinase siRNA
gatagtcgcccaaagttccgtga

SEQ ID NO: 7948 - DNA, 23 bp, Artificial Sequence
  epidermal growth factor receptor (EGFR), ERBB1 phosphotyrosine kinase siRNA
atagtcgcccaaagttccgtgag

SEQ ID NO: 7949 - DNA, 23 bp, Artificial Sequence
  epidermal growth factor receptor (EGFR), ERBB1 phosphotyrosine kinase siRNA
tagtcgcccaaagttccgtgagt

SEQ ID NO: 7950 - DNA, 23 bp, Artificial Sequence
  epidermal growth factor receptor (EGFR), ERBB1 phosphotyrosine kinase siRNA
agtcgcccaaagttccgtgagtt

SEQ ID NO: 7951 - DNA, 23 bp, Artificial Sequence
  epidermal growth factor receptor (EGFR), ERBB1 phosphotyrosine kinase siRNA
gtcgcccaaagttccgtgagttg

SEQ ID NO: 7952 - DNA, 23 bp, Artificial Sequence
  epidermal growth factor receptor (EGFR), ERBB1 phosphotyrosine kinase siRNA
tcgcccaaagttccgtgagttga

SEQ ID NO: 7953 - DNA, 23 bp, Artificial Sequence
  epidermal growth factor receptor (EGFR), ERBB1 phosphotyrosine kinase siRNA
cgcccaaagttccgtgagttgat

SEQ ID NO: 7954 - DNA, 23 bp, Artificial Sequence
  epidermal growth factor receptor (EGFR), ERBB1 phosphotyrosine kinase siRNA
gcccaaagttccgtgagttgatc

SEQ ID NO: 7955 - DNA, 23 bp, Artificial Sequence
  epidermal growth factor receptor (EGFR), ERBB1 phosphotyrosine kinase siRNA
cccaaagttccgtgagttgatca

SEQ ID NO: 7956 - DNA, 23 bp, Artificial Sequence
  epidermal growth factor receptor (EGFR), ERBB1 phosphotyrosine kinase siRNA
ccaaagttccgtgagttgatcat

SEQ ID NO: 7957 - DNA, 23 bp, Artificial Sequence
  epidermal growth factor receptor (EGFR), ERBB1 phosphotyrosine kinase siRNA
caaagttccgtgagttgatcatc

SEQ ID NO: 7958 - DNA, 23 bp, Artificial Sequence
  epidermal growth factor receptor (EGFR), ERBB1 phosphotyrosine kinase siRNA
aaagttccgtgagttgatcatcg

SEQ ID NO: 7959 - DNA, 23 bp, Artificial Sequence
  epidermal growth factor receptor (EGFR), ERBB1 phosphotyrosine kinase siRNA
aagttccgtgagttgatcatcga

SEQ ID NO: 7960 - DNA, 23 bp, Artificial Sequence
  epidermal growth factor receptor (EGFR), ERBB1 phosphotyrosine kinase siRNA
agttccgtgagttgatcatcgaa

SEQ ID NO: 7961 - DNA, 23 bp, Artificial Sequence
  epidermal growth factor receptor (EGFR), ERBB1 phosphotyrosine kinase siRNA
gttccgtgagttgatcatcgaat

SEQ ID NO: 7962 - DNA, 23 bp, Artificial Sequence
  epidermal growth factor receptor (EGFR), ERBB1 phosphotyrosine kinase siRNA
ttccgtgagttgatcatcgaatt

SEQ ID NO: 7963 - DNA, 23 bp, Artificial Sequence
  epidermal growth factor receptor (EGFR), ERBB1 phosphotyrosine kinase siRNA
tccgtgagttgatcatcgaattc

SEQ ID NO: 7964 - DNA, 23 bp, Artificial Sequence
  epidermal growth factor receptor (EGFR), ERBB1 phosphotyrosine kinase siRNA
ccgtgagttgatcatcgaattct

SEQ ID NO: 7965 - DNA, 23 bp, Artificial Sequence
  epidermal growth factor receptor (EGFR), ERBB1 phosphotyrosine kinase siRNA
cgtgagttgatcatcgaattctc

SEQ ID NO: 7966 - DNA, 23 bp, Artificial Sequence
  epidermal growth factor receptor (EGFR), ERBB1 phosphotyrosine kinase siRNA
gtgagttgatcatcgaattctcc

SEQ ID NO: 7967 - DNA, 23 bp, Artificial Sequence
  epidermal growth factor receptor (EGFR), ERBB1 phosphotyrosine kinase siRNA
tgagttgatcatcgaattctcca

SEQ ID NO: 7968 - DNA, 23 bp, Artificial Sequence
  epidermal growth factor receptor (EGFR), ERBB1 phosphotyrosine kinase siRNA
gagttgatcatcgaattctccaa

SEQ ID NO: 7969 - DNA, 23 bp, Artificial Sequence
  epidermal growth factor receptor (EGFR), ERBB1 phosphotyrosine kinase siRNA
agttgatcatcgaattctccaaa

SEQ ID NO: 7970 - DNA, 23 bp, Artificial Sequence
  epidermal growth factor receptor (EGFR), ERBB1 phosphotyrosine kinase siRNA
gttgatcatcgaattctccaaaa

SEQ ID NO: 7971 - DNA, 23 bp, Artificial Sequence
  epidermal growth factor receptor (EGFR), ERBB1 phosphotyrosine kinase siRNA
ttgatcatcgaattctccaaaat

SEQ ID NO: 7972 - DNA, 23 bp, Artificial Sequence
  epidermal growth factor receptor (EGFR), ERBB1 phosphotyrosine kinase siRNA
tgatcatcgaattctccaaaatg

SEQ ID NO: 7973 - DNA, 23 bp, Artificial Sequence
  epidermal growth factor receptor (EGFR), ERBB1 phosphotyrosine kinase siRNA
gatcatcgaattctccaaaatgg

SEQ ID NO: 7974 - DNA, 23 bp, Artificial Sequence
  epidermal growth factor receptor (EGFR), ERBB1 phosphotyrosine kinase siRNA
atcatcgaattctccaaaatggc

SEQ ID NO: 7975 - DNA, 23 bp, Artificial Sequence
  epidermal growth factor receptor (EGFR), ERBB1 phosphotyrosine kinase siRNA
tcatcgaattctccaaaatggcc

SEQ ID NO: 7976 - DNA, 23 bp, Artificial Sequence
  epidermal growth factor receptor (EGFR), ERBB1 phosphotyrosine kinase siRNA
catcgaattctccaaaatggccc

SEQ ID NO: 7977 - DNA, 23 bp, Artificial Sequence
  epidermal growth factor receptor (EGFR), ERBB1 phosphotyrosine kinase siRNA
atcgaattctccaaaatggcccg

SEQ ID NO: 7978 - DNA, 23 bp, Artificial Sequence
  epidermal growth factor receptor (EGFR), ERBB1 phosphotyrosine kinase siRNA
tcgaattctccaaaatggcccga

SEQ ID NO: 7979 - DNA, 23 bp, Artificial Sequence
  epidermal growth factor receptor (EGFR), ERBB1 phosphotyrosine kinase siRNA
cgaattctccaaaatggcccgag

SEQ ID NO: 7980 - DNA, 23 bp, Artificial Sequence
  epidermal growth factor receptor (EGFR), ERBB1 phosphotyrosine kinase siRNA
gaattctccaaaatggcccgaga

SEQ ID NO: 7981 - DNA, 23 bp, Artificial Sequence
  epidermal growth factor receptor (EGFR), ERBB1 phosphotyrosine kinase siRNA
aattctccaaaatggcccgagac

SEQ ID NO: 7982 - DNA, 23 bp, Artificial Sequence
  epidermal growth factor receptor (EGFR), ERBB1 phosphotyrosine kinase siRNA
attctccaaaatggcccgagacc

SEQ ID NO: 7983 - DNA, 23 bp, Artificial Sequence
  epidermal growth factor receptor (EGFR), ERBB1 phosphotyrosine kinase siRNA
ttctccaaaatggcccgagaccc

SEQ ID NO: 7984 - DNA, 23 bp, Artificial Sequence
  epidermal growth factor receptor (EGFR), ERBB1 phosphotyrosine kinase siRNA
tctccaaaatggcccgagacccc

SEQ ID NO: 7985 - DNA, 23 bp, Artificial Sequence
  epidermal growth factor receptor (EGFR), ERBB1 phosphotyrosine kinase siRNA
ctccaaaatggcccgagaccccc

SEQ ID NO: 7986 - DNA, 23 bp, Artificial Sequence
  epidermal growth factor receptor (EGFR), ERBB1 phosphotyrosine kinase siRNA
tccaaaatggcccgagaccccca

SEQ ID NO: 7987 - DNA, 23 bp, Artificial Sequence
  epidermal growth factor receptor (EGFR), ERBB1 phosphotyrosine kinase siRNA
ccaaaatggcccgagacccccag

SEQ ID NO: 7988 - DNA, 23 bp, Artificial Sequence
  epidermal growth factor receptor (EGFR), ERBB1 phosphotyrosine kinase siRNA
caaaatggcccgagacccccagc

SEQ ID NO: 7989 - DNA, 23 bp, Artificial Sequence
  epidermal growth factor receptor (EGFR), ERBB1 phosphotyrosine kinase siRNA
aaaatggcccgagacccccagcg

SEQ ID NO: 7990 - DNA, 23 bp, Artificial Sequence
  epidermal growth factor receptor (EGFR), ERBB1 phosphotyrosine kinase siRNA
aaatggcccgagacccccagcgc

SEQ ID NO: 7991 - DNA, 23 bp, Artificial Sequence
  epidermal growth factor receptor (EGFR), ERBB1 phosphotyrosine kinase siRNA
aatggcccgagacccccagcgct

SEQ ID NO: 7992 - DNA, 23 bp, Artificial Sequence
  epidermal growth factor receptor (EGFR), ERBB1 phosphotyrosine kinase siRNA
atggcccgagacccccagcgcta

SEQ ID NO: 7993 - DNA, 23 bp, Artificial Sequence
  epidermal growth factor receptor (EGFR), ERBB1 phosphotyrosine kinase siRNA
tggcccgagacccccagcgctac

SEQ ID NO: 7994 - DNA, 23 bp, Artificial Sequence
  epidermal growth factor receptor (EGFR), ERBB1 phosphotyrosine kinase siRNA
ggcccgagacccccagcgctacc

SEQ ID NO: 7995 - DNA, 23 bp, Artificial Sequence
  epidermal growth factor receptor (EGFR), ERBB1 phosphotyrosine kinase siRNA
gcccgagacccccagcgctacct

SEQ ID NO: 7996 - DNA, 23 bp, Artificial Sequence
  epidermal growth factor receptor (EGFR), ERBB1 phosphotyrosine kinase siRNA
cccgagacccccagcgctacctt

SEQ ID NO: 7997 - DNA, 23 bp, Artificial Sequence
  epidermal growth factor receptor (EGFR), ERBB1 phosphotyrosine kinase siRNA
ccgagacccccagcgctaccttg

SEQ ID NO: 7998 - DNA, 23 bp, Artificial Sequence
  epidermal growth factor receptor (EGFR), ERBB1 phosphotyrosine kinase siRNA
cgagacccccagcgctaccttgt

SEQ ID NO: 7999 - DNA, 23 bp, Artificial Sequence
  epidermal growth factor receptor (EGFR), ERBB1 phosphotyrosine kinase siRNA
gagacccccagcgctaccttgtc

SEQ ID NO: 8000 - DNA, 23 bp, Artificial Sequence
  epidermal growth factor receptor (EGFR), ERBB1 phosphotyrosine kinase siRNA
agacccccagcgctaccttgtca

SEQ ID NO: 8001 - DNA, 23 bp, Artificial Sequence
  epidermal growth factor receptor (EGFR), ERBB1 phosphotyrosine kinase siRNA
gacccccagcgctaccttgtcat

SEQ ID NO: 8002 - DNA, 23 bp, Artificial Sequence
  epidermal growth factor receptor (EGFR), ERBB1 phosphotyrosine kinase siRNA
acccccagcgctaccttgtcatt

SEQ ID NO: 8003 - DNA, 23 bp, Artificial Sequence
  epidermal growth factor receptor (EGFR), ERBB1 phosphotyrosine kinase siRNA
cccccagcgctaccttgtcattc

SEQ ID NO: 8004 - DNA, 23 bp, Artificial Sequence
  epidermal growth factor receptor (EGFR), ERBB1 phosphotyrosine kinase siRNA
ccccagcgctaccttgtcattca

SEQ ID NO: 8005 - DNA, 23 bp, Artificial Sequence
  epidermal growth factor receptor (EGFR), ERBB1 phosphotyrosine kinase siRNA
cccagcgctaccttgtcattcag

SEQ ID NO: 8006 - DNA, 23 bp, Artificial Sequence
  epidermal growth factor receptor (EGFR), ERBB1 phosphotyrosine kinase siRNA
ccagcgctaccttgtcattcagg

SEQ ID NO: 8007 - DNA, 23 bp, Artificial Sequence
  epidermal growth factor receptor (EGFR), ERBB1 phosphotyrosine kinase siRNA
cagcgctaccttgtcattcaggg

SEQ ID NO: 8008 - DNA, 23 bp, Artificial Sequence
  epidermal growth factor receptor (EGFR), ERBB1 phosphotyrosine kinase siRNA
agcgctaccttgtcattcagggg

SEQ ID NO: 8009 - DNA, 23 bp, Artificial Sequence
  epidermal growth factor receptor (EGFR), ERBB1 phosphotyrosine kinase siRNA
gcgctaccttgtcattcaggggg

SEQ ID NO: 8010 - DNA, 23 bp, Artificial Sequence
  epidermal growth factor receptor (EGFR), ERBB1 phosphotyrosine kinase siRNA
cgctaccttgtcattcaggggga

SEQ ID NO: 8011 - DNA, 23 bp, Artificial Sequence
  epidermal growth factor receptor (EGFR), ERBB1 phosphotyrosine kinase siRNA
gctaccttgtcattcagggggat

SEQ ID NO: 8012 - DNA, 23 bp, Artificial Sequence
  epidermal growth factor receptor (EGFR), ERBB1 phosphotyrosine kinase siRNA
ctaccttgtcattcagggggatg

SEQ ID NO: 8013 - DNA, 23 bp, Artificial Sequence
  epidermal growth factor receptor (EGFR), ERBB1 phosphotyrosine kinase siRNA
taccttgtcattcagggggatga

SEQ ID NO: 8014 - DNA, 23 bp, Artificial Sequence
  epidermal growth factor receptor (EGFR), ERBB1 phosphotyrosine kinase siRNA
accttgtcattcagggggatgaa

SEQ ID NO: 8015 - DNA, 23 bp, Artificial Sequence
  epidermal growth factor receptor (EGFR), ERBB1 phosphotyrosine kinase siRNA
ccttgtcattcagggggatgaaa

SEQ ID NO: 8016 - DNA, 23 bp, Artificial Sequence
  epidermal growth factor receptor (EGFR), ERBB1 phosphotyrosine kinase siRNA
cttgtcattcagggggatgaaag

SEQ ID NO: 8017 - DNA, 23 bp, Artificial Sequence
  epidermal growth factor receptor (EGFR), ERBB1 phosphotyrosine kinase siRNA
ttgtcattcagggggatgaaaga

SEQ ID NO: 8018 - DNA, 23 bp, Artificial Sequence
  epidermal growth factor receptor (EGFR), ERBB1 phosphotyrosine kinase siRNA
tgtcattcagggggatgaaagaa

SEQ ID NO: 8019 - DNA, 23 bp, Artificial Sequence
  epidermal growth factor receptor (EGFR), ERBB1 phosphotyrosine kinase siRNA
gtcattcagggggatgaaagaat

SEQ ID NO: 8020 - DNA, 23 bp, Artificial Sequence
  epidermal growth factor receptor (EGFR), ERBB1 phosphotyrosine kinase siRNA
tcattcagggggatgaaagaatg

SEQ ID NO: 8021 - DNA, 23 bp, Artificial Sequence
  epidermal growth factor receptor (EGFR), ERBB1 phosphotyrosine kinase siRNA
cattcagggggatgaaagaatgc

SEQ ID NO: 8022 - DNA, 23 bp, Artificial Sequence
  epidermal growth factor receptor (EGFR), ERBB1 phosphotyrosine kinase siRNA
attcagggggatgaaagaatgca

SEQ ID NO: 8023 - DNA, 23 bp, Artificial Sequence
  epidermal growth factor receptor (EGFR), ERBB1 phosphotyrosine kinase siRNA
ttcagggggatgaaagaatgcat

SEQ ID NO: 8024 - DNA, 23 bp, Artificial Sequence
  epidermal growth factor receptor (EGFR), ERBB1 phosphotyrosine kinase siRNA
tcagggggatgaaagaatgcatt

SEQ ID NO: 8025 - DNA, 23 bp, Artificial Sequence
  epidermal growth factor receptor (EGFR), ERBB1 phosphotyrosine kinase siRNA
cagggggatgaaagaatgcattt

SEQ ID NO: 8026 - DNA, 23 bp, Artificial Sequence
  epidermal growth factor receptor (EGFR), ERBB1 phosphotyrosine kinase siRNA
agggggatgaaagaatgcatttg

SEQ ID NO: 8027 - DNA, 23 bp, Artificial Sequence
  epidermal growth factor receptor (EGFR), ERBB1 phosphotyrosine kinase siRNA
gggggatgaaagaatgcatttgc

SEQ ID NO: 8028 - DNA, 23 bp, Artificial Sequence
  epidermal growth factor receptor (EGFR), ERBB1 phosphotyrosine kinase siRNA
ggggatgaaagaatgcatttgcc

SEQ ID NO: 8029 - DNA, 23 bp, Artificial Sequence
  epidermal growth factor receptor (EGFR), ERBB1 phosphotyrosine kinase siRNA
gggatgaaagaatgcatttgcca

SEQ ID NO: 8030 - DNA, 23 bp, Artificial Sequence
  epidermal growth factor receptor (EGFR), ERBB1 phosphotyrosine kinase siRNA
ggatgaaagaatgcatttgccaa

SEQ ID NO: 8031 - DNA, 23 bp, Artificial Sequence
  epidermal growth factor receptor (EGFR), ERBB1 phosphotyrosine kinase siRNA
gatgaaagaatgcatttgccaag

SEQ ID NO: 8032 - DNA, 23 bp, Artificial Sequence
  epidermal growth factor receptor (EGFR), ERBB1 phosphotyrosine kinase siRNA
atgaaagaatgcatttgccaagt

SEQ ID NO: 8033 - DNA, 23 bp, Artificial Sequence
  epidermal growth factor receptor (EGFR), ERBB1 phosphotyrosine kinase siRNA
tgaaagaatgcatttgccaagtc

SEQ ID NO: 8034 - DNA, 23 bp, Artificial Sequence
  epidermal growth factor receptor (EGFR), ERBB1 phosphotyrosine kinase siRNA
gaaagaatgcatttgccaagtcc

SEQ ID NO: 8035 - DNA, 23 bp, Artificial Sequence
  epidermal growth factor receptor (EGFR), ERBB1 phosphotyrosine kinase siRNA
aaagaatgcatttgccaagtcct

SEQ ID NO: 8036 - DNA, 23 bp, Artificial Sequence
  epidermal growth factor receptor (EGFR), ERBB1 phosphotyrosine kinase siRNA
aagaatgcatttgccaagtccta

SEQ ID NO: 8037 - DNA, 23 bp, Artificial Sequence
  epidermal growth factor receptor (EGFR), ERBB1 phosphotyrosine kinase siRNA
agaatgcatttgccaagtcctac

SEQ ID NO: 8038 - DNA, 23 bp, Artificial Sequence
  epidermal growth factor receptor (EGFR), ERBB1 phosphotyrosine kinase siRNA
gaatgcatttgccaagtcctaca

SEQ ID NO: 8039 - DNA, 23 bp, Artificial Sequence
  epidermal growth factor receptor (EGFR), ERBB1 phosphotyrosine kinase siRNA
aatgcatttgccaagtcctacag

SEQ ID NO: 8040 - DNA, 23 bp, Artificial Sequence
  epidermal growth factor receptor (EGFR), ERBB1 phosphotyrosine kinase siRNA
atgcatttgccaagtcctacaga

SEQ ID NO: 8041 - DNA, 23 bp, Artificial Sequence
  epidermal growth factor receptor (EGFR), ERBB1 phosphotyrosine kinase siRNA
tgcatttgccaagtcctacagac

SEQ ID NO: 8042 - DNA, 23 bp, Artificial Sequence
  epidermal growth factor receptor (EGFR), ERBB1 phosphotyrosine kinase siRNA
gcatttgccaagtcctacagact

SEQ ID NO: 8043 - DNA, 23 bp, Artificial Sequence
  epidermal growth factor receptor (EGFR), ERBB1 phosphotyrosine kinase siRNA
catttgccaagtcctacagactc

SEQ ID NO: 8044 - DNA, 23 bp, Artificial Sequence
  epidermal growth factor receptor (EGFR), ERBB1 phosphotyrosine kinase siRNA
atttgccaagtcctacagactcc

SEQ ID NO: 8045 - DNA, 23 bp, Artificial Sequence
  epidermal growth factor receptor (EGFR), ERBB1 phosphotyrosine kinase siRNA
tttgccaagtcctacagactcca

SEQ ID NO: 8046 - DNA, 23 bp, Artificial Sequence
  epidermal growth factor receptor (EGFR), ERBB1 phosphotyrosine kinase siRNA
ttgccaagtcctacagactccaa

SEQ ID NO: 8047 - DNA, 23 bp, Artificial Sequence
  epidermal growth factor receptor (EGFR), ERBB1 phosphotyrosine kinase siRNA
tgccaagtcctacagactccaac

SEQ ID NO: 8048 - DNA, 23 bp, Artificial Sequence
  epidermal growth factor receptor (EGFR), ERBB1 phosphotyrosine kinase siRNA
gccaagtcctacagactccaact

SEQ ID NO: 8049 - DNA, 23 bp, Artificial Sequence
  epidermal growth factor receptor (EGFR), ERBB1 phosphotyrosine kinase siRNA
ccaagtcctacagactccaactt

SEQ ID NO: 8050 - DNA, 23 bp, Artificial Sequence
  epidermal growth factor receptor (EGFR), ERBB1 phosphotyrosine kinase siRNA
caagtcctacagactccaacttc

SEQ ID NO: 8051 - DNA, 23 bp, Artificial Sequence
  epidermal growth factor receptor (EGFR), ERBB1 phosphotyrosine kinase siRNA
aagtcctacagactccaacttct

SEQ ID NO: 8052 - DNA, 23 bp, Artificial Sequence
  epidermal growth factor receptor (EGFR), ERBB1 phosphotyrosine kinase siRNA
agtcctacagactccaacttcta

SEQ ID NO: 8053 - DNA, 23 bp, Artificial Sequence
  epidermal growth factor receptor (EGFR), ERBB1 phosphotyrosine kinase siRNA
gtcctacagactccaacttctac

SEQ ID NO: 8054 - DNA, 23 bp, Artificial Sequence
  epidermal growth factor receptor (EGFR), ERBB1 phosphotyrosine kinase siRNA
tcctacagactccaacttctacc

SEQ ID NO: 8055 - DNA, 23 bp, Artificial Sequence
  epidermal growth factor receptor (EGFR), ERBB1 phosphotyrosine kinase siRNA
cctacagactccaacttctaccg

SEQ ID NO: 8056 - DNA, 23 bp, Artificial Sequence
  epidermal growth factor receptor (EGFR), ERBB1 phosphotyrosine kinase siRNA
ctacagactccaacttctaccgt

SEQ ID NO: 8057 - DNA, 23 bp, Artificial Sequence
  epidermal growth factor receptor (EGFR), ERBB1 phosphotyrosine kinase siRNA
tacagactccaacttctaccgtg

SEQ ID NO: 8058 - DNA, 23 bp, Artificial Sequence
  epidermal growth factor receptor (EGFR), ERBB1 phosphotyrosine kinase siRNA
acagactccaacttctaccgtgc

SEQ ID NO: 8059 - DNA, 23 bp, Artificial Sequence
  epidermal growth factor receptor (EGFR), ERBB1 phosphotyrosine kinase siRNA
cagactccaacttctaccgtgcc

SEQ ID NO: 8060 - DNA, 23 bp, Artificial Sequence
  epidermal growth factor receptor (EGFR), ERBB1 phosphotyrosine kinase siRNA
agactccaacttctaccgtgccc

SEQ ID NO: 8061 - DNA, 23 bp, Artificial Sequence
  epidermal growth factor receptor (EGFR), ERBB1 phosphotyrosine kinase siRNA
gactccaacttctaccgtgccct

SEQ ID NO: 8062 - DNA, 23 bp, Artificial Sequence
  epidermal growth factor receptor (EGFR), ERBB1 phosphotyrosine kinase siRNA
actccaacttctaccgtgccctg

SEQ ID NO: 8063 - DNA, 23 bp, Artificial Sequence
  epidermal growth factor receptor (EGFR), ERBB1 phosphotyrosine kinase siRNA
ctccaacttctaccgtgccctga

SEQ ID NO: 8064 - DNA, 23 bp, Artificial Sequence
  epidermal growth factor receptor (EGFR), ERBB1 phosphotyrosine kinase siRNA
tccaacttctaccgtgccctgat

SEQ ID NO: 8065 - DNA, 23 bp, Artificial Sequence
  epidermal growth factor receptor (EGFR), ERBB1 phosphotyrosine kinase siRNA
ccaacttctaccgtgccctgatg

SEQ ID NO: 8066 - DNA, 23 bp, Artificial Sequence
  epidermal growth factor receptor (EGFR), ERBB1 phosphotyrosine kinase siRNA
caacttctaccgtgccctgatgg

SEQ ID NO: 8067 - DNA, 23 bp, Artificial Sequence
  epidermal growth factor receptor (EGFR), ERBB1 phosphotyrosine kinase siRNA
aacttctaccgtgccctgatgga

SEQ ID NO: 8068 - DNA, 23 bp, Artificial Sequence
  epidermal growth factor receptor (EGFR), ERBB1 phosphotyrosine kinase siRNA
acttctaccgtgccctgatggat

SEQ ID NO: 8069 - DNA, 23 bp, Artificial Sequence
  epidermal growth factor receptor (EGFR), ERBB1 phosphotyrosine kinase siRNA
cttctaccgtgccctgatggatg

SEQ ID NO: 8070 - DNA, 23 bp, Artificial Sequence
  epidermal growth factor receptor (EGFR), ERBB1 phosphotyrosine kinase siRNA
ttctaccgtgccctgatggatga

SEQ ID NO: 8071 - DNA, 23 bp, Artificial Sequence
  epidermal growth factor receptor (EGFR), ERBB1 phosphotyrosine kinase siRNA
tctaccgtgccctgatggatgaa

SEQ ID NO: 8072 - DNA, 23 bp, Artificial Sequence
  epidermal growth factor receptor (EGFR), ERBB1 phosphotyrosine kinase siRNA
ctaccgtgccctgatggatgaag

SEQ ID NO: 8073 - DNA, 23 bp, Artificial Sequence
  epidermal growth factor receptor (EGFR), ERBB1 phosphotyrosine kinase siRNA
taccgtgccctgatggatgaaga

SEQ ID NO: 8074 - DNA, 23 bp, Artificial Sequence
  epidermal growth factor receptor (EGFR), ERBB1 phosphotyrosine kinase siRNA
accgtgccctgatggatgaagaa

SEQ ID NO: 8075 - DNA, 23 bp, Artificial Sequence
  epidermal growth factor receptor (EGFR), ERBB1 phosphotyrosine kinase siRNA
ccgtgccctgatggatgaagaag

SEQ ID NO: 8076 - DNA, 23 bp, Artificial Sequence
  epidermal growth factor receptor (EGFR), ERBB1 phosphotyrosine kinase siRNA
cgtgccctgatggatgaagaaga

SEQ ID NO: 8077 - DNA, 23 bp, Artificial Sequence
  epidermal growth factor receptor (EGFR), ERBB1 phosphotyrosine kinase siRNA
gtgccctgatggatgaagaagac

SEQ ID NO: 8078 - DNA, 23 bp, Artificial Sequence
  epidermal growth factor receptor (EGFR), ERBB1 phosphotyrosine kinase siRNA
tgccctgatggatgaagaagaca

SEQ ID NO: 8079 - DNA, 23 bp, Artificial Sequence
  epidermal growth factor receptor (EGFR), ERBB1 phosphotyrosine kinase siRNA
gccctgatggatgaagaagacat

SEQ ID NO: 8080 - DNA, 23 bp, Artificial Sequence
  epidermal growth factor receptor (EGFR), ERBB1 phosphotyrosine kinase siRNA
ccctgatggatgaagaagacatg

SEQ ID NO: 8081 - DNA, 23 bp, Artificial Sequence
  epidermal growth factor receptor (EGFR), ERBB1 phosphotyrosine kinase siRNA
cctgatggatgaagaagacatgg

SEQ ID NO: 8082 - DNA, 23 bp, Artificial Sequence
  epidermal growth factor receptor (EGFR), ERBB1 phosphotyrosine kinase siRNA
ctgatggatgaagaagacatgga

SEQ ID NO: 8083 - DNA, 23 bp, Artificial Sequence
  epidermal growth factor receptor (EGFR), ERBB1 phosphotyrosine kinase siRNA
tgatggatgaagaagacatggac

SEQ ID NO: 8084 - DNA, 23 bp, Artificial Sequence
  epidermal growth factor receptor (EGFR), ERBB1 phosphotyrosine kinase siRNA
gatggatgaagaagacatggacg

SEQ ID NO: 8085 - DNA, 23 bp, Artificial Sequence
  epidermal growth factor receptor (EGFR), ERBB1 phosphotyrosine kinase siRNA
atggatgaagaagacatggacga

SEQ ID NO: 8086 - DNA, 23 bp, Artificial Sequence
  epidermal growth factor receptor (EGFR), ERBB1 phosphotyrosine kinase siRNA
tggatgaagaagacatggacgac

SEQ ID NO: 8087 - DNA, 23 bp, Artificial Sequence
  epidermal growth factor receptor (EGFR), ERBB1 phosphotyrosine kinase siRNA
ggatgaagaagacatggacgacg

SEQ ID NO: 8088 - DNA, 23 bp, Artificial Sequence
  epidermal growth factor receptor (EGFR), ERBB1 phosphotyrosine kinase siRNA
gatgaagaagacatggacgacgt

SEQ ID NO: 8089 - DNA, 23 bp, Artificial Sequence
  epidermal growth factor receptor (EGFR), ERBB1 phosphotyrosine kinase siRNA
atgaagaagacatggacgacgtg

SEQ ID NO: 8090 - DNA, 23 bp, Artificial Sequence
  epidermal growth factor receptor (EGFR), ERBB1 phosphotyrosine kinase siRNA
tgaagaagacatggacgacgtgg

SEQ ID NO: 8091 - DNA, 23 bp, Artificial Sequence
  epidermal growth factor receptor (EGFR), ERBB1 phosphotyrosine kinase siRNA
gaagaagacatggacgacgtggt

SEQ ID NO: 8092 - DNA, 23 bp, Artificial Sequence
  epidermal growth factor receptor (EGFR), ERBB1 phosphotyrosine kinase siRNA
aagaagacatggacgacgtggtg

SEQ ID NO: 8093 - DNA, 23 bp, Artificial Sequence
  epidermal growth factor receptor (EGFR), ERBB1 phosphotyrosine kinase siRNA
agaagacatggacgacgtggtgg

SEQ ID NO: 8094 - DNA, 23 bp, Artificial Sequence
  epidermal growth factor receptor (EGFR), ERBB1 phosphotyrosine kinase siRNA
gaagacatggacgacgtggtgga

SEQ ID NO: 8095 - DNA, 23 bp, Artificial Sequence
  epidermal growth factor receptor (EGFR), ERBB1 phosphotyrosine kinase siRNA
aagacatggacgacgtggtggat

SEQ ID NO: 8096 - DNA, 23 bp, Artificial Sequence
  epidermal growth factor receptor (EGFR), ERBB1 phosphotyrosine kinase siRNA
agacatggacgacgtggtggatg

SEQ ID NO: 8097 - DNA, 23 bp, Artificial Sequence
  epidermal growth factor receptor (EGFR), ERBB1 phosphotyrosine kinase siRNA
gacatggacgacgtggtggatgc

SEQ ID NO: 8098 - DNA, 23 bp, Artificial Sequence
  epidermal growth factor receptor (EGFR), ERBB1 phosphotyrosine kinase siRNA
acatggacgacgtggtggatgcc

SEQ ID NO: 8099 - DNA, 23 bp, Artificial Sequence
  epidermal growth factor receptor (EGFR), ERBB1 phosphotyrosine kinase siRNA
catggacgacgtggtggatgccg

SEQ ID NO: 8100 - DNA, 23 bp, Artificial Sequence
  epidermal growth factor receptor (EGFR), ERBB1 phosphotyrosine kinase siRNA
atggacgacgtggtggatgccga

SEQ ID NO: 8101 - DNA, 23 bp, Artificial Sequence
  epidermal growth factor receptor (EGFR), ERBB1 phosphotyrosine kinase siRNA
tggacgacgtggtggatgccgac

SEQ ID NO: 8102 - DNA, 23 bp, Artificial Sequence
  epidermal growth factor receptor (EGFR), ERBB1 phosphotyrosine kinase siRNA
ggacgacgtggtggatgccgacg

SEQ ID NO: 8103 - DNA, 23 bp, Artificial Sequence
  epidermal growth factor receptor (EGFR), ERBB1 phosphotyrosine kinase siRNA
gacgacgtggtggatgccgacga

SEQ ID NO: 8104 - DNA, 23 bp, Artificial Sequence
  epidermal growth factor receptor (EGFR), ERBB1 phosphotyrosine kinase siRNA
acgacgtggtggatgccgacgag

SEQ ID NO: 8105 - DNA, 23 bp, Artificial Sequence
  epidermal growth factor receptor (EGFR), ERBB1 phosphotyrosine kinase siRNA
cgacgtggtggatgccgacgagt

SEQ ID NO: 8106 - DNA, 23 bp, Artificial Sequence
  epidermal growth factor receptor (EGFR), ERBB1 phosphotyrosine kinase siRNA
gacgtggtggatgccgacgagta

SEQ ID NO: 8107 - DNA, 23 bp, Artificial Sequence
  epidermal growth factor receptor (EGFR), ERBB1 phosphotyrosine kinase siRNA
acgtggtggatgccgacgagtac

SEQ ID NO: 8108 - DNA, 23 bp, Artificial Sequence
  epidermal growth factor receptor (EGFR), ERBB1 phosphotyrosine kinase siRNA
cgtggtggatgccgacgagtacc

SEQ ID NO: 8109 - DNA, 23 bp, Artificial Sequence
  epidermal growth factor receptor (EGFR), ERBB1 phosphotyrosine kinase siRNA
gtggtggatgccgacgagtacct

SEQ ID NO: 8110 - DNA, 23 bp, Artificial Sequence
  epidermal growth factor receptor (EGFR), ERBB1 phosphotyrosine kinase siRNA
tggtggatgccgacgagtacctc

SEQ ID NO: 8111 - DNA, 23 bp, Artificial Sequence
  epidermal growth factor receptor (EGFR), ERBB1 phosphotyrosine kinase siRNA
ggtggatgccgacgagtacctca

SEQ ID NO: 8112 - DNA, 23 bp, Artificial Sequence
  epidermal growth factor receptor (EGFR), ERBB1 phosphotyrosine kinase siRNA
gtggatgccgacgagtacctcat

SEQ ID NO: 8113 - DNA, 23 bp, Artificial Sequence
  epidermal growth factor receptor (EGFR), ERBB1 phosphotyrosine kinase siRNA
tggatgccgacgagtacctcatc

SEQ ID NO: 8114 - DNA, 23 bp, Artificial Sequence
  epidermal growth factor receptor (EGFR), ERBB1 phosphotyrosine kinase siRNA
ggatgccgacgagtacctcatcc

SEQ ID NO: 8115 - DNA, 23 bp, Artificial Sequence
  epidermal growth factor receptor (EGFR), ERBB1 phosphotyrosine kinase siRNA
gatgccgacgagtacctcatccc

SEQ ID NO: 8116 - DNA, 23 bp, Artificial Sequence
  epidermal growth factor receptor (EGFR), ERBB1 phosphotyrosine kinase siRNA
atgccgacgagtacctcatccca

SEQ ID NO: 8117 - DNA, 23 bp, Artificial Sequence
  epidermal growth factor receptor (EGFR), ERBB1 phosphotyrosine kinase siRNA
tgccgacgagtacctcatcccac

SEQ ID NO: 8118 - DNA, 23 bp, Artificial Sequence
  epidermal growth factor receptor (EGFR), ERBB1 phosphotyrosine kinase siRNA
gccgacgagtacctcatcccaca

SEQ ID NO: 8119 - DNA, 23 bp, Artificial Sequence
  epidermal growth factor receptor (EGFR), ERBB1 phosphotyrosine kinase siRNA
ccgacgagtacctcatcccacag

SEQ ID NO: 8120 - DNA, 23 bp, Artificial Sequence
  epidermal growth factor receptor (EGFR), ERBB1 phosphotyrosine kinase siRNA
cgacgagtacctcatcccacagc

SEQ ID NO: 8121 - DNA, 23 bp, Artificial Sequence
  epidermal growth factor receptor (EGFR), ERBB1 phosphotyrosine kinase siRNA
gacgagtacctcatcccacagca

SEQ ID NO: 8122 - DNA, 23 bp, Artificial Sequence
  epidermal growth factor receptor (EGFR), ERBB1 phosphotyrosine kinase siRNA
acgagtacctcatcccacagcag

SEQ ID NO: 8123 - DNA, 23 bp, Artificial Sequence
  epidermal growth factor receptor (EGFR), ERBB1 phosphotyrosine kinase siRNA
cgagtacctcatcccacagcagg

SEQ ID NO: 8124 - DNA, 23 bp, Artificial Sequence
  epidermal growth factor receptor (EGFR), ERBB1 phosphotyrosine kinase siRNA
gagtacctcatcccacagcaggg

SEQ ID NO: 8125 - DNA, 23 bp, Artificial Sequence
  epidermal growth factor receptor (EGFR), ERBB1 phosphotyrosine kinase siRNA
agtacctcatcccacagcagggc

SEQ ID NO: 8126 - DNA, 23 bp, Artificial Sequence
  epidermal growth factor receptor (EGFR), ERBB1 phosphotyrosine kinase siRNA
gtacctcatcccacagcagggct

SEQ ID NO: 8127 - DNA, 23 bp, Artificial Sequence
  epidermal growth factor receptor (EGFR), ERBB1 phosphotyrosine kinase siRNA
tacctcatcccacagcagggctt

SEQ ID NO: 8128 - DNA, 23 bp, Artificial Sequence
  epidermal growth factor receptor (EGFR), ERBB1 phosphotyrosine kinase siRNA
acctcatcccacagcagggcttc

SEQ ID NO: 8129 - DNA, 23 bp, Artificial Sequence
  epidermal growth factor receptor (EGFR), ERBB1 phosphotyrosine kinase siRNA
cctcatcccacagcagggcttct

SEQ ID NO: 8130 - DNA, 23 bp, Artificial Sequence
  epidermal growth factor receptor (EGFR), ERBB1 phosphotyrosine kinase siRNA
ctcatcccacagcagggcttctt

SEQ ID NO: 8131 - DNA, 23 bp, Artificial Sequence
  epidermal growth factor receptor (EGFR), ERBB1 phosphotyrosine kinase siRNA
tcatcccacagcagggcttcttc

SEQ ID NO: 8132 - DNA, 23 bp, Artificial Sequence
  epidermal growth factor receptor (EGFR), ERBB1 phosphotyrosine kinase siRNA
catcccacagcagggcttcttca

SEQ ID NO: 8133 - DNA, 23 bp, Artificial Sequence
  epidermal growth factor receptor (EGFR), ERBB1 phosphotyrosine kinase siRNA
atcccacagcagggcttcttcag

SEQ ID NO: 8134 - DNA, 23 bp, Artificial Sequence
  epidermal growth factor receptor (EGFR), ERBB1 phosphotyrosine kinase siRNA
tcccacagcagggcttcttcagc

SEQ ID NO: 8135 - DNA, 23 bp, Artificial Sequence
  epidermal growth factor receptor (EGFR), ERBB1 phosphotyrosine kinase siRNA
cccacagcagggcttcttcagca

SEQ ID NO: 8136 - DNA, 23 bp, Artificial Sequence
  epidermal growth factor receptor (EGFR), ERBB1 phosphotyrosine kinase siRNA
ccacagcagggcttcttcagcag

SEQ ID NO: 8137 - DNA, 23 bp, Artificial Sequence
  epidermal growth factor receptor (EGFR), ERBB1 phosphotyrosine kinase siRNA
cacagcagggcttcttcagcagc

SEQ ID NO: 8138 - DNA, 23 bp, Artificial Sequence
  epidermal growth factor receptor (EGFR), ERBB1 phosphotyrosine kinase siRNA
acagcagggcttcttcagcagcc

SEQ ID NO: 8139 - DNA, 23 bp, Artificial Sequence
  epidermal growth factor receptor (EGFR), ERBB1 phosphotyrosine kinase siRNA
cagcagggcttcttcagcagccc

SEQ ID NO: 8140 - DNA, 23 bp, Artificial Sequence
  epidermal growth factor receptor (EGFR), ERBB1 phosphotyrosine kinase siRNA
agcagggcttcttcagcagcccc

SEQ ID NO: 8141 - DNA, 23 bp, Artificial Sequence
  epidermal growth factor receptor (EGFR), ERBB1 phosphotyrosine kinase siRNA
gcagggcttcttcagcagcccct

SEQ ID NO: 8142 - DNA, 23 bp, Artificial Sequence
  epidermal growth factor receptor (EGFR), ERBB1 phosphotyrosine kinase siRNA
cagggcttcttcagcagcccctc

SEQ ID NO: 8143 - DNA, 23 bp, Artificial Sequence
  epidermal growth factor receptor (EGFR), ERBB1 phosphotyrosine kinase siRNA
agggcttcttcagcagcccctcc

SEQ ID NO: 8144 - DNA, 23 bp, Artificial Sequence
  epidermal growth factor receptor (EGFR), ERBB1 phosphotyrosine kinase siRNA
gggcttcttcagcagcccctcca

SEQ ID NO: 8145 - DNA, 23 bp, Artificial Sequence
  epidermal growth factor receptor (EGFR), ERBB1 phosphotyrosine kinase siRNA
ggcttcttcagcagcccctccac

SEQ ID NO: 8146 - DNA, 23 bp, Artificial Sequence
  epidermal growth factor receptor (EGFR), ERBB1 phosphotyrosine kinase siRNA
gcttcttcagcagcccctccacg

SEQ ID NO: 8147 - DNA, 23 bp, Artificial Sequence
  epidermal growth factor receptor (EGFR), ERBB1 phosphotyrosine kinase siRNA
cttcttcagcagcccctccacgt

SEQ ID NO: 8148 - DNA, 23 bp, Artificial Sequence
  epidermal growth factor receptor (EGFR), ERBB1 phosphotyrosine kinase siRNA
ttcttcagcagcccctccacgtc

SEQ ID NO: 8149 - DNA, 23 bp, Artificial Sequence
  epidermal growth factor receptor (EGFR), ERBB1 phosphotyrosine kinase siRNA
tcttcagcagcccctccacgtca

SEQ ID NO: 8150 - DNA, 23 bp, Artificial Sequence
  epidermal growth factor receptor (EGFR), ERBB1 phosphotyrosine kinase siRNA
cttcagcagcccctccacgtcac

SEQ ID NO: 8151 - DNA, 23 bp, Artificial Sequence
  epidermal growth factor receptor (EGFR), ERBB1 phosphotyrosine kinase siRNA
ttcagcagcccctccacgtcacg

SEQ ID NO: 8152 - DNA, 23 bp, Artificial Sequence
  epidermal growth factor receptor (EGFR), ERBB1 phosphotyrosine kinase siRNA
tcagcagcccctccacgtcacgg

SEQ ID NO: 8153 - DNA, 23 bp, Artificial Sequence
  epidermal growth factor receptor (EGFR), ERBB1 phosphotyrosine kinase siRNA
cagcagcccctccacgtcacgga

SEQ ID NO: 8154 - DNA, 23 bp, Artificial Sequence
  epidermal growth factor receptor (EGFR), ERBB1 phosphotyrosine kinase siRNA
agcagcccctccacgtcacggac

SEQ ID NO: 8155 - DNA, 23 bp, Artificial Sequence
  epidermal growth factor receptor (EGFR), ERBB1 phosphotyrosine kinase siRNA
gcagcccctccacgtcacggact

SEQ ID NO: 8156 - DNA, 23 bp, Artificial Sequence
  epidermal growth factor receptor (EGFR), ERBB1 phosphotyrosine kinase siRNA
cagcccctccacgtcacggactc

SEQ ID NO: 8157 - DNA, 23 bp, Artificial Sequence
  epidermal growth factor receptor (EGFR), ERBB1 phosphotyrosine kinase siRNA
agcccctccacgtcacggactcc

SEQ ID NO: 8158 - DNA, 23 bp, Artificial Sequence
  epidermal growth factor receptor (EGFR), ERBB1 phosphotyrosine kinase siRNA
gcccctccacgtcacggactccc

SEQ ID NO: 8159 - DNA, 23 bp, Artificial Sequence
  epidermal growth factor receptor (EGFR), ERBB1 phosphotyrosine kinase siRNA
cccctccacgtcacggactcccc

SEQ ID NO: 8160 - DNA, 23 bp, Artificial Sequence
  epidermal growth factor receptor (EGFR), ERBB1 phosphotyrosine kinase siRNA
ccctccacgtcacggactcccct

SEQ ID NO: 8161 - DNA, 23 bp, Artificial Sequence
  epidermal growth factor receptor (EGFR), ERBB1 phosphotyrosine kinase siRNA
cctccacgtcacggactcccctc

SEQ ID NO: 8162 - DNA, 23 bp, Artificial Sequence
  epidermal growth factor receptor (EGFR), ERBB1 phosphotyrosine kinase siRNA
ctccacgtcacggactcccctcc

SEQ ID NO: 8163 - DNA, 23 bp, Artificial Sequence
  epidermal growth factor receptor (EGFR), ERBB1 phosphotyrosine kinase siRNA
tccacgtcacggactcccctcct

SEQ ID NO: 8164 - DNA, 23 bp, Artificial Sequence
  epidermal growth factor receptor (EGFR), ERBB1 phosphotyrosine kinase siRNA
ccacgtcacggactcccctcctg

SEQ ID NO: 8165 - DNA, 23 bp, Artificial Sequence
  epidermal growth factor receptor (EGFR), ERBB1 phosphotyrosine kinase siRNA
cacgtcacggactcccctcctga

SEQ ID NO: 8166 - DNA, 23 bp, Artificial Sequence
  epidermal growth factor receptor (EGFR), ERBB1 phosphotyrosine kinase siRNA
acgtcacggactcccctcctgag

SEQ ID NO: 8167 - DNA, 23 bp, Artificial Sequence
  epidermal growth factor receptor (EGFR), ERBB1 phosphotyrosine kinase siRNA
cgtcacggactcccctcctgagc

SEQ ID NO: 8168 - DNA, 23 bp, Artificial Sequence
  epidermal growth factor receptor (EGFR), ERBB1 phosphotyrosine kinase siRNA
gtcacggactcccctcctgagct

SEQ ID NO: 8169 - DNA, 23 bp, Artificial Sequence
  epidermal growth factor receptor (EGFR), ERBB1 phosphotyrosine kinase siRNA
tcacggactcccctcctgagctc

SEQ ID NO: 8170 - DNA, 23 bp, Artificial Sequence
  epidermal growth factor receptor (EGFR), ERBB1 phosphotyrosine kinase siRNA
cacggactcccctcctgagctct

SEQ ID NO: 8171 - DNA, 23 bp, Artificial Sequence
  epidermal growth factor receptor (EGFR), ERBB1 phosphotyrosine kinase siRNA
acggactcccctcctgagctctc

SEQ ID NO: 8172 - DNA, 23 bp, Artificial Sequence
  epidermal growth factor receptor (EGFR), ERBB1 phosphotyrosine kinase siRNA
cggactcccctcctgagctctct

SEQ ID NO: 8173 - DNA, 23 bp, Artificial Sequence
  epidermal growth factor receptor (EGFR), ERBB1 phosphotyrosine kinase siRNA
ggactcccctcctgagctctctg

SEQ ID NO: 8174 - DNA, 23 bp, Artificial Sequence
  epidermal growth factor receptor (EGFR), ERBB1 phosphotyrosine kinase siRNA
gactcccctcctgagctctctga

SEQ ID NO: 8175 - DNA, 23 bp, Artificial Sequence
  epidermal growth factor receptor (EGFR), ERBB1 phosphotyrosine kinase siRNA
actcccctcctgagctctctgag

SEQ ID NO: 8176 - DNA, 23 bp, Artificial Sequence
  epidermal growth factor receptor (EGFR), ERBB1 phosphotyrosine kinase siRNA
ctcccctcctgagctctctgagt

SEQ ID NO: 8177 - DNA, 23 bp, Artificial Sequence
  epidermal growth factor receptor (EGFR), ERBB1 phosphotyrosine kinase siRNA
tcccctcctgagctctctgagtg

SEQ ID NO: 8178 - DNA, 23 bp, Artificial Sequence
  epidermal growth factor receptor (EGFR), ERBB1 phosphotyrosine kinase siRNA
cccctcctgagctctctgagtgc

SEQ ID NO: 8179 - DNA, 23 bp, Artificial Sequence
  epidermal growth factor receptor (EGFR), ERBB1 phosphotyrosine kinase siRNA
ccctcctgagctctctgagtgca

SEQ ID NO: 8180 - DNA, 23 bp, Artificial Sequence
  epidermal growth factor receptor (EGFR), ERBB1 phosphotyrosine kinase siRNA
cctcctgagctctctgagtgcaa

SEQ ID NO: 8181 - DNA, 23 bp, Artificial Sequence
  epidermal growth factor receptor (EGFR), ERBB1 phosphotyrosine kinase siRNA
ctcctgagctctctgagtgcaac

SEQ ID NO: 8182 - DNA, 23 bp, Artificial Sequence
  epidermal growth factor receptor (EGFR), ERBB1 phosphotyrosine kinase siRNA
tcctgagctctctgagtgcaacc

SEQ ID NO: 8183 - DNA, 23 bp, Artificial Sequence
  epidermal growth factor receptor (EGFR), ERBB1 phosphotyrosine kinase siRNA
cctgagctctctgagtgcaacca

SEQ ID NO: 8184 - DNA, 23 bp, Artificial Sequence
  epidermal growth factor receptor (EGFR), ERBB1 phosphotyrosine kinase siRNA
ctgagctctctgagtgcaaccag

SEQ ID NO: 8185 - DNA, 23 bp, Artificial Sequence
  epidermal growth factor receptor (EGFR), ERBB1 phosphotyrosine kinase siRNA
tgagctctctgagtgcaaccagc

SEQ ID NO: 8186 - DNA, 23 bp, Artificial Sequence
  epidermal growth factor receptor (EGFR), ERBB1 phosphotyrosine kinase siRNA
gagctctctgagtgcaaccagca

SEQ ID NO: 8187 - DNA, 23 bp, Artificial Sequence
  epidermal growth factor receptor (EGFR), ERBB1 phosphotyrosine kinase siRNA
agctctctgagtgcaaccagcaa

SEQ ID NO: 8188 - DNA, 23 bp, Artificial Sequence
  epidermal growth factor receptor (EGFR), ERBB1 phosphotyrosine kinase siRNA
gctctctgagtgcaaccagcaac

SEQ ID NO: 8189 - DNA, 23 bp, Artificial Sequence
  epidermal growth factor receptor (EGFR), ERBB1 phosphotyrosine kinase siRNA
ctctctgagtgcaaccagcaaca

SEQ ID NO: 8190 - DNA, 23 bp, Artificial Sequence
  epidermal growth factor receptor (EGFR), ERBB1 phosphotyrosine kinase siRNA
tctctgagtgcaaccagcaacaa

SEQ ID NO: 8191 - DNA, 23 bp, Artificial Sequence
  epidermal growth factor receptor (EGFR), ERBB1 phosphotyrosine kinase siRNA
ctctgagtgcaaccagcaacaat

SEQ ID NO: 8192 - DNA, 23 bp, Artificial Sequence
  epidermal growth factor receptor (EGFR), ERBB1 phosphotyrosine kinase siRNA
tctgagtgcaaccagcaacaatt

SEQ ID NO: 8193 - DNA, 23 bp, Artificial Sequence
  epidermal growth factor receptor (EGFR), ERBB1 phosphotyrosine kinase siRNA
ctgagtgcaaccagcaacaattc

SEQ ID NO: 8194 - DNA, 23 bp, Artificial Sequence
  epidermal growth factor receptor (EGFR), ERBB1 phosphotyrosine kinase siRNA
tgagtgcaaccagcaacaattcc

SEQ ID NO: 8195 - DNA, 23 bp, Artificial Sequence
  epidermal growth factor receptor (EGFR), ERBB1 phosphotyrosine kinase siRNA
gagtgcaaccagcaacaattcca

SEQ ID NO: 8196 - DNA, 23 bp, Artificial Sequence
  epidermal growth factor receptor (EGFR), ERBB1 phosphotyrosine kinase siRNA
agtgcaaccagcaacaattccac

SEQ ID NO: 8197 - DNA, 23 bp, Artificial Sequence
  epidermal growth factor receptor (EGFR), ERBB1 phosphotyrosine kinase siRNA
gtgcaaccagcaacaattccacc

SEQ ID NO: 8198 - DNA, 23 bp, Artificial Sequence
  epidermal growth factor receptor (EGFR), ERBB1 phosphotyrosine kinase siRNA
tgcaaccagcaacaattccaccg

SEQ ID NO: 8199 - DNA, 23 bp, Artificial Sequence
  epidermal growth factor receptor (EGFR), ERBB1 phosphotyrosine kinase siRNA
gcaaccagcaacaattccaccgt

SEQ ID NO: 8200 - DNA, 23 bp, Artificial Sequence
  epidermal growth factor receptor (EGFR), ERBB1 phosphotyrosine kinase siRNA
caaccagcaacaattccaccgtg

SEQ ID NO: 8201 - DNA, 23 bp, Artificial Sequence
  epidermal growth factor receptor (EGFR), ERBB1 phosphotyrosine kinase siRNA
aaccagcaacaattccaccgtgg

SEQ ID NO: 8202 - DNA, 23 bp, Artificial Sequence
  epidermal growth factor receptor (EGFR), ERBB1 phosphotyrosine kinase siRNA
accagcaacaattccaccgtggc

SEQ ID NO: 8203 - DNA, 23 bp, Artificial Sequence
  epidermal growth factor receptor (EGFR), ERBB1 phosphotyrosine kinase siRNA
ccagcaacaattccaccgtggct

SEQ ID NO: 8204 - DNA, 23 bp, Artificial Sequence
  epidermal growth factor receptor (EGFR), ERBB1 phosphotyrosine kinase siRNA
cagcaacaattccaccgtggctt

SEQ ID NO: 8205 - DNA, 23 bp, Artificial Sequence
  epidermal growth factor receptor (EGFR), ERBB1 phosphotyrosine kinase siRNA
agcaacaattccaccgtggcttg

SEQ ID NO: 8206 - DNA, 23 bp, Artificial Sequence
  epidermal growth factor receptor (EGFR), ERBB1 phosphotyrosine kinase siRNA
gcaacaattccaccgtggcttgc

SEQ ID NO: 8207 - DNA, 23 bp, Artificial Sequence
  epidermal growth factor receptor (EGFR), ERBB1 phosphotyrosine kinase siRNA
caacaattccaccgtggcttgca

SEQ ID NO: 8208 - DNA, 23 bp, Artificial Sequence
  epidermal growth factor receptor (EGFR), ERBB1 phosphotyrosine kinase siRNA
aacaattccaccgtggcttgcat

SEQ ID NO: 8209 - DNA, 23 bp, Artificial Sequence
  epidermal growth factor receptor (EGFR), ERBB1 phosphotyrosine kinase siRNA
acaattccaccgtggcttgcatt

SEQ ID NO: 8210 - DNA, 23 bp, Artificial Sequence
  epidermal growth factor receptor (EGFR), ERBB1 phosphotyrosine kinase siRNA
caattccaccgtggcttgcattg

SEQ ID NO: 8211 - DNA, 23 bp, Artificial Sequence
  epidermal growth factor receptor (EGFR), ERBB1 phosphotyrosine kinase siRNA
aattccaccgtggcttgcattga

SEQ ID NO: 8212 - DNA, 23 bp, Artificial Sequence
  epidermal growth factor receptor (EGFR), ERBB1 phosphotyrosine kinase siRNA
attccaccgtggcttgcattgat

SEQ ID NO: 8213 - DNA, 23 bp, Artificial Sequence
  epidermal growth factor receptor (EGFR), ERBB1 phosphotyrosine kinase siRNA
ttccaccgtggcttgcattgata

SEQ ID NO: 8214 - DNA, 23 bp, Artificial Sequence
  epidermal growth factor receptor (EGFR), ERBB1 phosphotyrosine kinase siRNA
tccaccgtggcttgcattgatag

SEQ ID NO: 8215 - DNA, 23 bp, Artificial Sequence
  epidermal growth factor receptor (EGFR), ERBB1 phosphotyrosine kinase siRNA
ccaccgtggcttgcattgataga

SEQ ID NO: 8216 - DNA, 23 bp, Artificial Sequence
  epidermal growth factor receptor (EGFR), ERBB1 phosphotyrosine kinase siRNA
caccgtggcttgcattgatagaa

SEQ ID NO: 8217 - DNA, 23 bp, Artificial Sequence
  epidermal growth factor receptor (EGFR), ERBB1 phosphotyrosine kinase siRNA
accgtggcttgcattgatagaaa

SEQ ID NO: 8218 - DNA, 23 bp, Artificial Sequence
  epidermal growth factor receptor (EGFR), ERBB1 phosphotyrosine kinase siRNA
ccgtggcttgcattgatagaaat

SEQ ID NO: 8219 - DNA, 23 bp, Artificial Sequence
  epidermal growth factor receptor (EGFR), ERBB1 phosphotyrosine kinase siRNA
cgtggcttgcattgatagaaatg

SEQ ID NO: 8220 - DNA, 23 bp, Artificial Sequence
  epidermal growth factor receptor (EGFR), ERBB1 phosphotyrosine kinase siRNA
gtggcttgcattgatagaaatgg

SEQ ID NO: 8221 - DNA, 23 bp, Artificial Sequence
  epidermal growth factor receptor (EGFR), ERBB1 phosphotyrosine kinase siRNA
tggcttgcattgatagaaatggg

SEQ ID NO: 8222 - DNA, 23 bp, Artificial Sequence
  epidermal growth factor receptor (EGFR), ERBB1 phosphotyrosine kinase siRNA
ggcttgcattgatagaaatgggc

SEQ ID NO: 8223 - DNA, 23 bp, Artificial Sequence
  epidermal growth factor receptor (EGFR), ERBB1 phosphotyrosine kinase siRNA
gcttgcattgatagaaatgggct

SEQ ID NO: 8224 - DNA, 23 bp, Artificial Sequence
  epidermal growth factor receptor (EGFR), ERBB1 phosphotyrosine kinase siRNA
cttgcattgatagaaatgggctg

SEQ ID NO: 8225 - DNA, 23 bp, Artificial Sequence
  epidermal growth factor receptor (EGFR), ERBB1 phosphotyrosine kinase siRNA
ttgcattgatagaaatgggctgc

SEQ ID NO: 8226 - DNA, 23 bp, Artificial Sequence
  epidermal growth factor receptor (EGFR), ERBB1 phosphotyrosine kinase siRNA
tgcattgatagaaatgggctgca

SEQ ID NO: 8227 - DNA, 23 bp, Artificial Sequence
  epidermal growth factor receptor (EGFR), ERBB1 phosphotyrosine kinase siRNA
gcattgatagaaatgggctgcaa

SEQ ID NO: 8228 - DNA, 23 bp, Artificial Sequence
  epidermal growth factor receptor (EGFR), ERBB1 phosphotyrosine kinase siRNA
cattgatagaaatgggctgcaaa

SEQ ID NO: 8229 - DNA, 23 bp, Artificial Sequence
  epidermal growth factor receptor (EGFR), ERBB1 phosphotyrosine kinase siRNA
attgatagaaatgggctgcaaag

SEQ ID NO: 8230 - DNA, 23 bp, Artificial Sequence
  epidermal growth factor receptor (EGFR), ERBB1 phosphotyrosine kinase siRNA
ttgatagaaatgggctgcaaagc

SEQ ID NO: 8231 - DNA, 23 bp, Artificial Sequence
  epidermal growth factor receptor (EGFR), ERBB1 phosphotyrosine kinase siRNA
tgatagaaatgggctgcaaagct

SEQ ID NO: 8232 - DNA, 23 bp, Artificial Sequence
  epidermal growth factor receptor (EGFR), ERBB1 phosphotyrosine kinase siRNA
gatagaaatgggctgcaaagctg

SEQ ID NO: 8233 - DNA, 23 bp, Artificial Sequence
  epidermal growth factor receptor (EGFR), ERBB1 phosphotyrosine kinase siRNA
atagaaatgggctgcaaagctgt

SEQ ID NO: 8234 - DNA, 23 bp, Artificial Sequence
  epidermal growth factor receptor (EGFR), ERBB1 phosphotyrosine kinase siRNA
tagaaatgggctgcaaagctgtc

SEQ ID NO: 8235 - DNA, 23 bp, Artificial Sequence
  epidermal growth factor receptor (EGFR), ERBB1 phosphotyrosine kinase siRNA
agaaatgggctgcaaagctgtcc

SEQ ID NO: 8236 - DNA, 23 bp, Artificial Sequence
  epidermal growth factor receptor (EGFR), ERBB1 phosphotyrosine kinase siRNA
gaaatgggctgcaaagctgtccc

SEQ ID NO: 8237 - DNA, 23 bp, Artificial Sequence
  epidermal growth factor receptor (EGFR), ERBB1 phosphotyrosine kinase siRNA
aaatgggctgcaaagctgtccca

SEQ ID NO: 8238 - DNA, 23 bp, Artificial Sequence
  epidermal growth factor receptor (EGFR), ERBB1 phosphotyrosine kinase siRNA
aatgggctgcaaagctgtcccat

SEQ ID NO: 8239 - DNA, 23 bp, Artificial Sequence
  epidermal growth factor receptor (EGFR), ERBB1 phosphotyrosine kinase siRNA
atgggctgcaaagctgtcccatc

SEQ ID NO: 8240 - DNA, 23 bp, Artificial Sequence
  epidermal growth factor receptor (EGFR), ERBB1 phosphotyrosine kinase siRNA
tgggctgcaaagctgtcccatca

SEQ ID NO: 8241 - DNA, 23 bp, Artificial Sequence
  epidermal growth factor receptor (EGFR), ERBB1 phosphotyrosine kinase siRNA
gggctgcaaagctgtcccatcaa

SEQ ID NO: 8242 - DNA, 23 bp, Artificial Sequence
  epidermal growth factor receptor (EGFR), ERBB1 phosphotyrosine kinase siRNA
ggctgcaaagctgtcccatcaag

SEQ ID NO: 8243 - DNA, 23 bp, Artificial Sequence
  epidermal growth factor receptor (EGFR), ERBB1 phosphotyrosine kinase siRNA
gctgcaaagctgtcccatcaagg

SEQ ID NO: 8244 - DNA, 23 bp, Artificial Sequence
  epidermal growth factor receptor (EGFR), ERBB1 phosphotyrosine kinase siRNA
ctgcaaagctgtcccatcaagga

SEQ ID NO: 8245 - DNA, 23 bp, Artificial Sequence
  epidermal growth factor receptor (EGFR), ERBB1 phosphotyrosine kinase siRNA
tgcaaagctgtcccatcaaggaa

SEQ ID NO: 8246 - DNA, 23 bp, Artificial Sequence
  epidermal growth factor receptor (EGFR), ERBB1 phosphotyrosine kinase siRNA
gcaaagctgtcccatcaaggaag

SEQ ID NO: 8247 - DNA, 23 bp, Artificial Sequence
  epidermal growth factor receptor (EGFR), ERBB1 phosphotyrosine kinase siRNA
caaagctgtcccatcaaggaaga

SEQ ID NO: 8248 - DNA, 23 bp, Artificial Sequence
  epidermal growth factor receptor (EGFR), ERBB1 phosphotyrosine kinase siRNA
aaagctgtcccatcaaggaagac

SEQ ID NO: 8249 - DNA, 23 bp, Artificial Sequence
  epidermal growth factor receptor (EGFR), ERBB1 phosphotyrosine kinase siRNA
aagctgtcccatcaaggaagaca

SEQ ID NO: 8250 - DNA, 23 bp, Artificial Sequence
  epidermal growth factor receptor (EGFR), ERBB1 phosphotyrosine kinase siRNA
agctgtcccatcaaggaagacag

SEQ ID NO: 8251 - DNA, 23 bp, Artificial Sequence
  epidermal growth factor receptor (EGFR), ERBB1 phosphotyrosine kinase siRNA
gctgtcccatcaaggaagacagc

SEQ ID NO: 8252 - DNA, 23 bp, Artificial Sequence
  epidermal growth factor receptor (EGFR), ERBB1 phosphotyrosine kinase siRNA
ctgtcccatcaaggaagacagct

SEQ ID NO: 8253 - DNA, 23 bp, Artificial Sequence
  epidermal growth factor receptor (EGFR), ERBB1 phosphotyrosine kinase siRNA
tgtcccatcaaggaagacagctt

SEQ ID NO: 8254 - DNA, 23 bp, Artificial Sequence
  epidermal growth factor receptor (EGFR), ERBB1 phosphotyrosine kinase siRNA
gtcccatcaaggaagacagcttc

SEQ ID NO: 8255 - DNA, 23 bp, Artificial Sequence
  epidermal growth factor receptor (EGFR), ERBB1 phosphotyrosine kinase siRNA
tcccatcaaggaagacagcttct

SEQ ID NO: 8256 - DNA, 23 bp, Artificial Sequence
  epidermal growth factor receptor (EGFR), ERBB1 phosphotyrosine kinase siRNA
cccatcaaggaagacagcttctt

SEQ ID NO: 8257 - DNA, 23 bp, Artificial Sequence
  epidermal growth factor receptor (EGFR), ERBB1 phosphotyrosine kinase siRNA
ccatcaaggaagacagcttcttg

SEQ ID NO: 8258 - DNA, 23 bp, Artificial Sequence
  epidermal growth factor receptor (EGFR), ERBB1 phosphotyrosine kinase siRNA
catcaaggaagacagcttcttgc

SEQ ID NO: 8259 - DNA, 23 bp, Artificial Sequence
  epidermal growth factor receptor (EGFR), ERBB1 phosphotyrosine kinase siRNA
atcaaggaagacagcttcttgca

SEQ ID NO: 8260 - DNA, 23 bp, Artificial Sequence
  epidermal growth factor receptor (EGFR), ERBB1 phosphotyrosine kinase siRNA
tcaaggaagacagcttcttgcag

SEQ ID NO: 8261 - DNA, 23 bp, Artificial Sequence
  epidermal growth factor receptor (EGFR), ERBB1 phosphotyrosine kinase siRNA
caaggaagacagcttcttgcagc

SEQ ID NO: 8262 - DNA, 23 bp, Artificial Sequence
  epidermal growth factor receptor (EGFR), ERBB1 phosphotyrosine kinase siRNA
aaggaagacagcttcttgcagcg

SEQ ID NO: 8263 - DNA, 23 bp, Artificial Sequence
  epidermal growth factor receptor (EGFR), ERBB1 phosphotyrosine kinase siRNA
aggaagacagcttcttgcagcga

SEQ ID NO: 8264 - DNA, 23 bp, Artificial Sequence
  epidermal growth factor receptor (EGFR), ERBB1 phosphotyrosine kinase siRNA
ggaagacagcttcttgcagcgat

SEQ ID NO: 8265 - DNA, 23 bp, Artificial Sequence
  epidermal growth factor receptor (EGFR), ERBB1 phosphotyrosine kinase siRNA
gaagacagcttcttgcagcgata

SEQ ID NO: 8266 - DNA, 23 bp, Artificial Sequence
  epidermal growth factor receptor (EGFR), ERBB1 phosphotyrosine kinase siRNA
aagacagcttcttgcagcgatac

SEQ ID NO: 8267 - DNA, 23 bp, Artificial Sequence
  epidermal growth factor receptor (EGFR), ERBB1 phosphotyrosine kinase siRNA
agacagcttcttgcagcgataca

SEQ ID NO: 8268 - DNA, 23 bp, Artificial Sequence
  epidermal growth factor receptor (EGFR), ERBB1 phosphotyrosine kinase siRNA
gacagcttcttgcagcgatacag

SEQ ID NO: 8269 - DNA, 23 bp, Artificial Sequence
  epidermal growth factor receptor (EGFR), ERBB1 phosphotyrosine kinase siRNA
acagcttcttgcagcgatacagc

SEQ ID NO: 8270 - DNA, 23 bp, Artificial Sequence
  epidermal growth factor receptor (EGFR), ERBB1 phosphotyrosine kinase siRNA
cagcttcttgcagcgatacagct

SEQ ID NO: 8271 - DNA, 23 bp, Artificial Sequence
  epidermal growth factor receptor (EGFR), ERBB1 phosphotyrosine kinase siRNA
agcttcttgcagcgatacagctc

SEQ ID NO: 8272 - DNA, 23 bp, Artificial Sequence
  epidermal growth factor receptor (EGFR), ERBB1 phosphotyrosine kinase siRNA
gcttcttgcagcgatacagctca

SEQ ID NO: 8273 - DNA, 23 bp, Artificial Sequence
  epidermal growth factor receptor (EGFR), ERBB1 phosphotyrosine kinase siRNA
cttcttgcagcgatacagctcag

SEQ ID NO: 8274 - DNA, 23 bp, Artificial Sequence
  epidermal growth factor receptor (EGFR), ERBB1 phosphotyrosine kinase siRNA
ttcttgcagcgatacagctcaga

SEQ ID NO: 8275 - DNA, 23 bp, Artificial Sequence
  epidermal growth factor receptor (EGFR), ERBB1 phosphotyrosine kinase siRNA
tcttgcagcgatacagctcagac

SEQ ID NO: 8276 - DNA, 23 bp, Artificial Sequence
  epidermal growth factor receptor (EGFR), ERBB1 phosphotyrosine kinase siRNA
cttgcagcgatacagctcagacc

SEQ ID NO: 8277 - DNA, 23 bp, Artificial Sequence
  epidermal growth factor receptor (EGFR), ERBB1 phosphotyrosine kinase siRNA
ttgcagcgatacagctcagaccc

SEQ ID NO: 8278 - DNA, 23 bp, Artificial Sequence
  epidermal growth factor receptor (EGFR), ERBB1 phosphotyrosine kinase siRNA
tgcagcgatacagctcagacccc

SEQ ID NO: 8279 - DNA, 23 bp, Artificial Sequence
  epidermal growth factor receptor (EGFR), ERBB1 phosphotyrosine kinase siRNA
gcagcgatacagctcagacccca

SEQ ID NO: 8280 - DNA, 23 bp, Artificial Sequence
  epidermal growth factor receptor (EGFR), ERBB1 phosphotyrosine kinase siRNA
cagcgatacagctcagaccccac

SEQ ID NO: 8281 - DNA, 23 bp, Artificial Sequence
  epidermal growth factor receptor (EGFR), ERBB1 phosphotyrosine kinase siRNA
agcgatacagctcagaccccaca

SEQ ID NO: 8282 - DNA, 23 bp, Artificial Sequence
  epidermal growth factor receptor (EGFR), ERBB1 phosphotyrosine kinase siRNA
gcgatacagctcagaccccacag

SEQ ID NO: 8283 - DNA, 23 bp, Artificial Sequence
  epidermal growth factor receptor (EGFR), ERBB1 phosphotyrosine kinase siRNA
cgatacagctcagaccccacagg

SEQ ID NO: 8284 - DNA, 23 bp, Artificial Sequence
  epidermal growth factor receptor (EGFR), ERBB1 phosphotyrosine kinase siRNA
gatacagctcagaccccacaggc

SEQ ID NO: 8285 - DNA, 23 bp, Artificial Sequence
  epidermal growth factor receptor (EGFR), ERBB1 phosphotyrosine kinase siRNA
atacagctcagaccccacaggcg

SEQ ID NO: 8286 - DNA, 23 bp, Artificial Sequence
  epidermal growth factor receptor (EGFR), ERBB1 phosphotyrosine kinase siRNA
tacagctcagaccccacaggcgc

SEQ ID NO: 8287 - DNA, 23 bp, Artificial Sequence
  epidermal growth factor receptor (EGFR), ERBB1 phosphotyrosine kinase siRNA
acagctcagaccccacaggcgcc

SEQ ID NO: 8288 - DNA, 23 bp, Artificial Sequence
  epidermal growth factor receptor (EGFR), ERBB1 phosphotyrosine kinase siRNA
cagctcagaccccacaggcgcct

SEQ ID NO: 8289 - DNA, 23 bp, Artificial Sequence
  epidermal growth factor receptor (EGFR), ERBB1 phosphotyrosine kinase siRNA
agctcagaccccacaggcgcctt

SEQ ID NO: 8290 - DNA, 23 bp, Artificial Sequence
  epidermal growth factor receptor (EGFR), ERBB1 phosphotyrosine kinase siRNA
gctcagaccccacaggcgccttg

SEQ ID NO: 8291 - DNA, 23 bp, Artificial Sequence
  epidermal growth factor receptor (EGFR), ERBB1 phosphotyrosine kinase siRNA
ctcagaccccacaggcgccttga

SEQ ID NO: 8292 - DNA, 23 bp, Artificial Sequence
  epidermal growth factor receptor (EGFR), ERBB1 phosphotyrosine kinase siRNA
tcagaccccacaggcgccttgac

SEQ ID NO: 8293 - DNA, 23 bp, Artificial Sequence
  epidermal growth factor receptor (EGFR), ERBB1 phosphotyrosine kinase siRNA
cagaccccacaggcgccttgact

SEQ ID NO: 8294 - DNA, 23 bp, Artificial Sequence
  epidermal growth factor receptor (EGFR), ERBB1 phosphotyrosine kinase siRNA
agaccccacaggcgccttgactg

SEQ ID NO: 8295 - DNA, 23 bp, Artificial Sequence
  epidermal growth factor receptor (EGFR), ERBB1 phosphotyrosine kinase siRNA
gaccccacaggcgccttgactga

SEQ ID NO: 8296 - DNA, 23 bp, Artificial Sequence
  epidermal growth factor receptor (EGFR), ERBB1 phosphotyrosine kinase siRNA
accccacaggcgccttgactgag

SEQ ID NO: 8297 - DNA, 23 bp, Artificial Sequence
  epidermal growth factor receptor (EGFR), ERBB1 phosphotyrosine kinase siRNA
ccccacaggcgccttgactgagg

SEQ ID NO: 8298 - DNA, 23 bp, Artificial Sequence
  epidermal growth factor receptor (EGFR), ERBB1 phosphotyrosine kinase siRNA
cccacaggcgccttgactgagga

SEQ ID NO: 8299 - DNA, 23 bp, Artificial Sequence
  epidermal growth factor receptor (EGFR), ERBB1 phosphotyrosine kinase siRNA
ccacaggcgccttgactgaggac

SEQ ID NO: 8300 - DNA, 23 bp, Artificial Sequence
  epidermal growth factor receptor (EGFR), ERBB1 phosphotyrosine kinase siRNA
cacaggcgccttgactgaggaca

SEQ ID NO: 8301 - DNA, 23 bp, Artificial Sequence
  epidermal growth factor receptor (EGFR), ERBB1 phosphotyrosine kinase siRNA
acaggcgccttgactgaggacag

SEQ ID NO: 8302 - DNA, 23 bp, Artificial Sequence
  epidermal growth factor receptor (EGFR), ERBB1 phosphotyrosine kinase siRNA
caggcgccttgactgaggacagc

SEQ ID NO: 8303 - DNA, 23 bp, Artificial Sequence
  epidermal growth factor receptor (EGFR), ERBB1 phosphotyrosine kinase siRNA
aggcgccttgactgaggacagca

SEQ ID NO: 8304 - DNA, 23 bp, Artificial Sequence
  epidermal growth factor receptor (EGFR), ERBB1 phosphotyrosine kinase siRNA
ggcgccttgactgaggacagcat

SEQ ID NO: 8305 - DNA, 23 bp, Artificial Sequence
  epidermal growth factor receptor (EGFR), ERBB1 phosphotyrosine kinase siRNA
gcgccttgactgaggacagcata

SEQ ID NO: 8306 - DNA, 23 bp, Artificial Sequence
  epidermal growth factor receptor (EGFR), ERBB1 phosphotyrosine kinase siRNA
cgccttgactgaggacagcatag

SEQ ID NO: 8307 - DNA, 23 bp, Artificial Sequence
  epidermal growth factor receptor (EGFR), ERBB1 phosphotyrosine kinase siRNA
gccttgactgaggacagcataga

SEQ ID NO: 8308 - DNA, 23 bp, Artificial Sequence
  epidermal growth factor receptor (EGFR), ERBB1 phosphotyrosine kinase siRNA
ccttgactgaggacagcatagac

SEQ ID NO: 8309 - DNA, 23 bp, Artificial Sequence
  epidermal growth factor receptor (EGFR), ERBB1 phosphotyrosine kinase siRNA
cttgactgaggacagcatagacg

SEQ ID NO: 8310 - DNA, 23 bp, Artificial Sequence
  epidermal growth factor receptor (EGFR), ERBB1 phosphotyrosine kinase siRNA
ttgactgaggacagcatagacga

SEQ ID NO: 8311 - DNA, 23 bp, Artificial Sequence
  epidermal growth factor receptor (EGFR), ERBB1 phosphotyrosine kinase siRNA
tgactgaggacagcatagacgac

SEQ ID NO: 8312 - DNA, 23 bp, Artificial Sequence
  epidermal growth factor receptor (EGFR), ERBB1 phosphotyrosine kinase siRNA
gactgaggacagcatagacgaca

SEQ ID NO: 8313 - DNA, 23 bp, Artificial Sequence
  epidermal growth factor receptor (EGFR), ERBB1 phosphotyrosine kinase siRNA
actgaggacagcatagacgacac

SEQ ID NO: 8314 - DNA, 23 bp, Artificial Sequence
  epidermal growth factor receptor (EGFR), ERBB1 phosphotyrosine kinase siRNA
ctgaggacagcatagacgacacc

SEQ ID NO: 8315 - DNA, 23 bp, Artificial Sequence
  epidermal growth factor receptor (EGFR), ERBB1 phosphotyrosine kinase siRNA
tgaggacagcatagacgacacct

SEQ ID NO: 8316 - DNA, 23 bp, Artificial Sequence
  epidermal growth factor receptor (EGFR), ERBB1 phosphotyrosine kinase siRNA
gaggacagcatagacgacacctt

SEQ ID NO: 8317 - DNA, 23 bp, Artificial Sequence
  epidermal growth factor receptor (EGFR), ERBB1 phosphotyrosine kinase siRNA
aggacagcatagacgacaccttc

SEQ ID NO: 8318 - DNA, 23 bp, Artificial Sequence
  epidermal growth factor receptor (EGFR), ERBB1 phosphotyrosine kinase siRNA
ggacagcatagacgacaccttcc

SEQ ID NO: 8319 - DNA, 23 bp, Artificial Sequence
  epidermal growth factor receptor (EGFR), ERBB1 phosphotyrosine kinase siRNA
gacagcatagacgacaccttcct

SEQ ID NO: 8320 - DNA, 23 bp, Artificial Sequence
  epidermal growth factor receptor (EGFR), ERBB1 phosphotyrosine kinase siRNA
acagcatagacgacaccttcctc

SEQ ID NO: 8321 - DNA, 23 bp, Artificial Sequence
  epidermal growth factor receptor (EGFR), ERBB1 phosphotyrosine kinase siRNA
cagcatagacgacaccttcctcc

SEQ ID NO: 8322 - DNA, 23 bp, Artificial Sequence
  epidermal growth factor receptor (EGFR), ERBB1 phosphotyrosine kinase siRNA
agcatagacgacaccttcctccc

SEQ ID NO: 8323 - DNA, 23 bp, Artificial Sequence
  epidermal growth factor receptor (EGFR), ERBB1 phosphotyrosine kinase siRNA
gcatagacgacaccttcctccca

SEQ ID NO: 8324 - DNA, 23 bp, Artificial Sequence
  epidermal growth factor receptor (EGFR), ERBB1 phosphotyrosine kinase siRNA
catagacgacaccttcctcccag

SEQ ID NO: 8325 - DNA, 23 bp, Artificial Sequence
  epidermal growth factor receptor (EGFR), ERBB1 phosphotyrosine kinase siRNA
atagacgacaccttcctcccagt

SEQ ID NO: 8326 - DNA, 23 bp, Artificial Sequence
  epidermal growth factor receptor (EGFR), ERBB1 phosphotyrosine kinase siRNA
tagacgacaccttcctcccagtg

SEQ ID NO: 8327 - DNA, 23 bp, Artificial Sequence
  epidermal growth factor receptor (EGFR), ERBB1 phosphotyrosine kinase siRNA
agacgacaccttcctcccagtgc

SEQ ID NO: 8328 - DNA, 23 bp, Artificial Sequence
  epidermal growth factor receptor (EGFR), ERBB1 phosphotyrosine kinase siRNA
gacgacaccttcctcccagtgcc

SEQ ID NO: 8329 - DNA, 23 bp, Artificial Sequence
  epidermal growth factor receptor (EGFR), ERBB1 phosphotyrosine kinase siRNA
acgacaccttcctcccagtgcct

SEQ ID NO: 8330 - DNA, 23 bp, Artificial Sequence
  epidermal growth factor receptor (EGFR), ERBB1 phosphotyrosine kinase siRNA
cgacaccttcctcccagtgcctg

SEQ ID NO: 8331 - DNA, 23 bp, Artificial Sequence
  epidermal growth factor receptor (EGFR), ERBB1 phosphotyrosine kinase siRNA
gacaccttcctcccagtgcctga

SEQ ID NO: 8332 - DNA, 23 bp, Artificial Sequence
  epidermal growth factor receptor (EGFR), ERBB1 phosphotyrosine kinase siRNA
acaccttcctcccagtgcctgaa

SEQ ID NO: 8333 - DNA, 23 bp, Artificial Sequence
  epidermal growth factor receptor (EGFR), ERBB1 phosphotyrosine kinase siRNA
caccttcctcccagtgcctgaat

SEQ ID NO: 8334 - DNA, 23 bp, Artificial Sequence
  epidermal growth factor receptor (EGFR), ERBB1 phosphotyrosine kinase siRNA
accttcctcccagtgcctgaata

SEQ ID NO: 8335 - DNA, 23 bp, Artificial Sequence
  epidermal growth factor receptor (EGFR), ERBB1 phosphotyrosine kinase siRNA
ccttcctcccagtgcctgaatac

SEQ ID NO: 8336 - DNA, 23 bp, Artificial Sequence
  epidermal growth factor receptor (EGFR), ERBB1 phosphotyrosine kinase siRNA
cttcctcccagtgcctgaataca

SEQ ID NO: 8337 - DNA, 23 bp, Artificial Sequence
  epidermal growth factor receptor (EGFR), ERBB1 phosphotyrosine kinase siRNA
ttcctcccagtgcctgaatacat

SEQ ID NO: 8338 - DNA, 23 bp, Artificial Sequence
  epidermal growth factor receptor (EGFR), ERBB1 phosphotyrosine kinase siRNA
tcctcccagtgcctgaatacata

SEQ ID NO: 8339 - DNA, 23 bp, Artificial Sequence
  epidermal growth factor receptor (EGFR), ERBB1 phosphotyrosine kinase siRNA
cctcccagtgcctgaatacataa

SEQ ID NO: 8340 - DNA, 23 bp, Artificial Sequence
  epidermal growth factor receptor (EGFR), ERBB1 phosphotyrosine kinase siRNA
ctcccagtgcctgaatacataaa

SEQ ID NO: 8341 - DNA, 23 bp, Artificial Sequence
  epidermal growth factor receptor (EGFR), ERBB1 phosphotyrosine kinase siRNA
tcccagtgcctgaatacataaac

SEQ ID NO: 8342 - DNA, 23 bp, Artificial Sequence
  epidermal growth factor receptor (EGFR), ERBB1 phosphotyrosine kinase siRNA
cccagtgcctgaatacataaacc

SEQ ID NO: 8343 - DNA, 23 bp, Artificial Sequence
  epidermal growth factor receptor (EGFR), ERBB1 phosphotyrosine kinase siRNA
ccagtgcctgaatacataaacca

SEQ ID NO: 8344 - DNA, 23 bp, Artificial Sequence
  epidermal growth factor receptor (EGFR), ERBB1 phosphotyrosine kinase siRNA
cagtgcctgaatacataaaccag

SEQ ID NO: 8345 - DNA, 23 bp, Artificial Sequence
  epidermal growth factor receptor (EGFR), ERBB1 phosphotyrosine kinase siRNA
agtgcctgaatacataaaccagt

SEQ ID NO: 8346 - DNA, 23 bp, Artificial Sequence
  epidermal growth factor receptor (EGFR), ERBB1 phosphotyrosine kinase siRNA
gtgcctgaatacataaaccagtc

SEQ ID NO: 8347 - DNA, 23 bp, Artificial Sequence
  epidermal growth factor receptor (EGFR), ERBB1 phosphotyrosine kinase siRNA
tgcctgaatacataaaccagtcc

SEQ ID NO: 8348 - DNA, 23 bp, Artificial Sequence
  epidermal growth factor receptor (EGFR), ERBB1 phosphotyrosine kinase siRNA
gcctgaatacataaaccagtccg

SEQ ID NO: 8349 - DNA, 23 bp, Artificial Sequence
  epidermal growth factor receptor (EGFR), ERBB1 phosphotyrosine kinase siRNA
cctgaatacataaaccagtccgt

SEQ ID NO: 8350 - DNA, 23 bp, Artificial Sequence
  epidermal growth factor receptor (EGFR), ERBB1 phosphotyrosine kinase siRNA
ctgaatacataaaccagtccgtt

SEQ ID NO: 8351 - DNA, 23 bp, Artificial Sequence
  epidermal growth factor receptor (EGFR), ERBB1 phosphotyrosine kinase siRNA
tgaatacataaaccagtccgttc

SEQ ID NO: 8352 - DNA, 23 bp, Artificial Sequence
  epidermal growth factor receptor (EGFR), ERBB1 phosphotyrosine kinase siRNA
gaatacataaaccagtccgttcc

SEQ ID NO: 8353 - DNA, 23 bp, Artificial Sequence
  epidermal growth factor receptor (EGFR), ERBB1 phosphotyrosine kinase siRNA
aatacataaaccagtccgttccc

SEQ ID NO: 8354 - DNA, 23 bp, Artificial Sequence
  epidermal growth factor receptor (EGFR), ERBB1 phosphotyrosine kinase siRNA
atacataaaccagtccgttccca

SEQ ID NO: 8355 - DNA, 23 bp, Artificial Sequence
  epidermal growth factor receptor (EGFR), ERBB1 phosphotyrosine kinase siRNA
tacataaaccagtccgttcccaa

SEQ ID NO: 8356 - DNA, 23 bp, Artificial Sequence
  epidermal growth factor receptor (EGFR), ERBB1 phosphotyrosine kinase siRNA
acataaaccagtccgttcccaaa

SEQ ID NO: 8357 - DNA, 23 bp, Artificial Sequence
  epidermal growth factor receptor (EGFR), ERBB1 phosphotyrosine kinase siRNA
cataaaccagtccgttcccaaaa

SEQ ID NO: 8358 - DNA, 23 bp, Artificial Sequence
  epidermal growth factor receptor (EGFR), ERBB1 phosphotyrosine kinase siRNA
ataaaccagtccgttcccaaaag

SEQ ID NO: 8359 - DNA, 23 bp, Artificial Sequence
  epidermal growth factor receptor (EGFR), ERBB1 phosphotyrosine kinase siRNA
taaaccagtccgttcccaaaagg

SEQ ID NO: 8360 - DNA, 23 bp, Artificial Sequence
  epidermal growth factor receptor (EGFR), ERBB1 phosphotyrosine kinase siRNA
aaaccagtccgttcccaaaaggc

SEQ ID NO: 8361 - DNA, 23 bp, Artificial Sequence
  epidermal growth factor receptor (EGFR), ERBB1 phosphotyrosine kinase siRNA
aaccagtccgttcccaaaaggcc

SEQ ID NO: 8362 - DNA, 23 bp, Artificial Sequence
  epidermal growth factor receptor (EGFR), ERBB1 phosphotyrosine kinase siRNA
accagtccgttcccaaaaggccc

SEQ ID NO: 8363 - DNA, 23 bp, Artificial Sequence
  epidermal growth factor receptor (EGFR), ERBB1 phosphotyrosine kinase siRNA
ccagtccgttcccaaaaggcccg

SEQ ID NO: 8364 - DNA, 23 bp, Artificial Sequence
  epidermal growth factor receptor (EGFR), ERBB1 phosphotyrosine kinase siRNA
cagtccgttcccaaaaggcccgc

SEQ ID NO: 8365 - DNA, 23 bp, Artificial Sequence
  epidermal growth factor receptor (EGFR), ERBB1 phosphotyrosine kinase siRNA
agtccgttcccaaaaggcccgct

SEQ ID NO: 8366 - DNA, 23 bp, Artificial Sequence
  epidermal growth factor receptor (EGFR), ERBB1 phosphotyrosine kinase siRNA
gtccgttcccaaaaggcccgctg

SEQ ID NO: 8367 - DNA, 23 bp, Artificial Sequence
  epidermal growth factor receptor (EGFR), ERBB1 phosphotyrosine kinase siRNA
tccgttcccaaaaggcccgctgg

SEQ ID NO: 8368 - DNA, 23 bp, Artificial Sequence
  epidermal growth factor receptor (EGFR), ERBB1 phosphotyrosine kinase siRNA
ccgttcccaaaaggcccgctggc

SEQ ID NO: 8369 - DNA, 23 bp, Artificial Sequence
  epidermal growth factor receptor (EGFR), ERBB1 phosphotyrosine kinase siRNA
cgttcccaaaaggcccgctggct

SEQ ID NO: 8370 - DNA, 23 bp, Artificial Sequence
  epidermal growth factor receptor (EGFR), ERBB1 phosphotyrosine kinase siRNA
gttcccaaaaggcccgctggctc

SEQ ID NO: 8371 - DNA, 23 bp, Artificial Sequence
  epidermal growth factor receptor (EGFR), ERBB1 phosphotyrosine kinase siRNA
ttcccaaaaggcccgctggctct

SEQ ID NO: 8372 - DNA, 23 bp, Artificial Sequence
  epidermal growth factor receptor (EGFR), ERBB1 phosphotyrosine kinase siRNA
tcccaaaaggcccgctggctctg

SEQ ID NO: 8373 - DNA, 23 bp, Artificial Sequence
  epidermal growth factor receptor (EGFR), ERBB1 phosphotyrosine kinase siRNA
cccaaaaggcccgctggctctgt

SEQ ID NO: 8374 - DNA, 23 bp, Artificial Sequence
  epidermal growth factor receptor (EGFR), ERBB1 phosphotyrosine kinase siRNA
ccaaaaggcccgctggctctgtg

SEQ ID NO: 8375 - DNA, 23 bp, Artificial Sequence
  epidermal growth factor receptor (EGFR), ERBB1 phosphotyrosine kinase siRNA
caaaaggcccgctggctctgtgc

SEQ ID NO: 8376 - DNA, 23 bp, Artificial Sequence
  epidermal growth factor receptor (EGFR), ERBB1 phosphotyrosine kinase siRNA
aaaaggcccgctggctctgtgca

SEQ ID NO: 8377 - DNA, 23 bp, Artificial Sequence
  epidermal growth factor receptor (EGFR), ERBB1 phosphotyrosine kinase siRNA
aaaggcccgctggctctgtgcag

SEQ ID NO: 8378 - DNA, 23 bp, Artificial Sequence
  epidermal growth factor receptor (EGFR), ERBB1 phosphotyrosine kinase siRNA
aaggcccgctggctctgtgcaga

SEQ ID NO: 8379 - DNA, 23 bp, Artificial Sequence
  epidermal growth factor receptor (EGFR), ERBB1 phosphotyrosine kinase siRNA
aggcccgctggctctgtgcagaa

SEQ ID NO: 8380 - DNA, 23 bp, Artificial Sequence
  epidermal growth factor receptor (EGFR), ERBB1 phosphotyrosine kinase siRNA
ggcccgctggctctgtgcagaat

SEQ ID NO: 8381 - DNA, 23 bp, Artificial Sequence
  epidermal growth factor receptor (EGFR), ERBB1 phosphotyrosine kinase siRNA
gcccgctggctctgtgcagaatc

SEQ ID NO: 8382 - DNA, 23 bp, Artificial Sequence
  epidermal growth factor receptor (EGFR), ERBB1 phosphotyrosine kinase siRNA
cccgctggctctgtgcagaatcc

SEQ ID NO: 8383 - DNA, 23 bp, Artificial Sequence
  epidermal growth factor receptor (EGFR), ERBB1 phosphotyrosine kinase siRNA
ccgctggctctgtgcagaatcct

SEQ ID NO: 8384 - DNA, 23 bp, Artificial Sequence
  epidermal growth factor receptor (EGFR), ERBB1 phosphotyrosine kinase siRNA
cgctggctctgtgcagaatcctg

SEQ ID NO: 8385 - DNA, 23 bp, Artificial Sequence
  epidermal growth factor receptor (EGFR), ERBB1 phosphotyrosine kinase siRNA
gctggctctgtgcagaatcctgt

SEQ ID NO: 8386 - DNA, 23 bp, Artificial Sequence
  epidermal growth factor receptor (EGFR), ERBB1 phosphotyrosine kinase siRNA
ctggctctgtgcagaatcctgtc

SEQ ID NO: 8387 - DNA, 23 bp, Artificial Sequence
  epidermal growth factor receptor (EGFR), ERBB1 phosphotyrosine kinase siRNA
tggctctgtgcagaatcctgtct

SEQ ID NO: 8388 - DNA, 23 bp, Artificial Sequence
  epidermal growth factor receptor (EGFR), ERBB1 phosphotyrosine kinase siRNA
ggctctgtgcagaatcctgtcta

SEQ ID NO: 8389 - DNA, 23 bp, Artificial Sequence
  epidermal growth factor receptor (EGFR), ERBB1 phosphotyrosine kinase siRNA
gctctgtgcagaatcctgtctat

SEQ ID NO: 8390 - DNA, 23 bp, Artificial Sequence
  epidermal growth factor receptor (EGFR), ERBB1 phosphotyrosine kinase siRNA
ctctgtgcagaatcctgtctatc

SEQ ID NO: 8391 - DNA, 23 bp, Artificial Sequence
  epidermal growth factor receptor (EGFR), ERBB1 phosphotyrosine kinase siRNA
tctgtgcagaatcctgtctatca

SEQ ID NO: 8392 - DNA, 23 bp, Artificial Sequence
  epidermal growth factor receptor (EGFR), ERBB1 phosphotyrosine kinase siRNA
ctgtgcagaatcctgtctatcac

SEQ ID NO: 8393 - DNA, 23 bp, Artificial Sequence
  epidermal growth factor receptor (EGFR), ERBB1 phosphotyrosine kinase siRNA
tgtgcagaatcctgtctatcaca

SEQ ID NO: 8394 - DNA, 23 bp, Artificial Sequence
  epidermal growth factor receptor (EGFR), ERBB1 phosphotyrosine kinase siRNA
gtgcagaatcctgtctatcacaa

SEQ ID NO: 8395 - DNA, 23 bp, Artificial Sequence
  epidermal growth factor receptor (EGFR), ERBB1 phosphotyrosine kinase siRNA
tgcagaatcctgtctatcacaat

SEQ ID NO: 8396 - DNA, 23 bp, Artificial Sequence
  epidermal growth factor receptor (EGFR), ERBB1 phosphotyrosine kinase siRNA
gcagaatcctgtctatcacaatc

SEQ ID NO: 8397 - DNA, 23 bp, Artificial Sequence
  epidermal growth factor receptor (EGFR), ERBB1 phosphotyrosine kinase siRNA
cagaatcctgtctatcacaatca

SEQ ID NO: 8398 - DNA, 23 bp, Artificial Sequence
  epidermal growth factor receptor (EGFR), ERBB1 phosphotyrosine kinase siRNA
agaatcctgtctatcacaatcag

SEQ ID NO: 8399 - DNA, 23 bp, Artificial Sequence
  epidermal growth factor receptor (EGFR), ERBB1 phosphotyrosine kinase siRNA
gaatcctgtctatcacaatcagc

SEQ ID NO: 8400 - DNA, 23 bp, Artificial Sequence
  epidermal growth factor receptor (EGFR), ERBB1 phosphotyrosine kinase siRNA
aatcctgtctatcacaatcagcc

SEQ ID NO: 8401 - DNA, 23 bp, Artificial Sequence
  epidermal growth factor receptor (EGFR), ERBB1 phosphotyrosine kinase siRNA
atcctgtctatcacaatcagcct

SEQ ID NO: 8402 - DNA, 23 bp, Artificial Sequence
  epidermal growth factor receptor (EGFR), ERBB1 phosphotyrosine kinase siRNA
tcctgtctatcacaatcagcctc

SEQ ID NO: 8403 - DNA, 23 bp, Artificial Sequence
  epidermal growth factor receptor (EGFR), ERBB1 phosphotyrosine kinase siRNA
cctgtctatcacaatcagcctct

SEQ ID NO: 8404 - DNA, 23 bp, Artificial Sequence
  epidermal growth factor receptor (EGFR), ERBB1 phosphotyrosine kinase siRNA
ctgtctatcacaatcagcctctg

SEQ ID NO: 8405 - DNA, 23 bp, Artificial Sequence
  epidermal growth factor receptor (EGFR), ERBB1 phosphotyrosine kinase siRNA
tgtctatcacaatcagcctctga

SEQ ID NO: 8406 - DNA, 23 bp, Artificial Sequence
  epidermal growth factor receptor (EGFR), ERBB1 phosphotyrosine kinase siRNA
gtctatcacaatcagcctctgaa

SEQ ID NO: 8407 - DNA, 23 bp, Artificial Sequence
  epidermal growth factor receptor (EGFR), ERBB1 phosphotyrosine kinase siRNA
tctatcacaatcagcctctgaac

SEQ ID NO: 8408 - DNA, 23 bp, Artificial Sequence
  epidermal growth factor receptor (EGFR), ERBB1 phosphotyrosine kinase siRNA
ctatcacaatcagcctctgaacc

SEQ ID NO: 8409 - DNA, 23 bp, Artificial Sequence
  epidermal growth factor receptor (EGFR), ERBB1 phosphotyrosine kinase siRNA
tatcacaatcagcctctgaaccc

SEQ ID NO: 8410 - DNA, 23 bp, Artificial Sequence
  epidermal growth factor receptor (EGFR), ERBB1 phosphotyrosine kinase siRNA
atcacaatcagcctctgaacccc

SEQ ID NO: 8411 - DNA, 23 bp, Artificial Sequence
  epidermal growth factor receptor (EGFR), ERBB1 phosphotyrosine kinase siRNA
tcacaatcagcctctgaaccccg

SEQ ID NO: 8412 - DNA, 23 bp, Artificial Sequence
  epidermal growth factor receptor (EGFR), ERBB1 phosphotyrosine kinase siRNA
cacaatcagcctctgaaccccgc

SEQ ID NO: 8413 - DNA, 23 bp, Artificial Sequence
  epidermal growth factor receptor (EGFR), ERBB1 phosphotyrosine kinase siRNA
acaatcagcctctgaaccccgcg

SEQ ID NO: 8414 - DNA, 23 bp, Artificial Sequence
  epidermal growth factor receptor (EGFR), ERBB1 phosphotyrosine kinase siRNA
caatcagcctctgaaccccgcgc

SEQ ID NO: 8415 - DNA, 23 bp, Artificial Sequence
  epidermal growth factor receptor (EGFR), ERBB1 phosphotyrosine kinase siRNA
ccgcgcccagcagagacccacac

SEQ ID NO: 8416 - DNA, 23 bp, Artificial Sequence
  epidermal growth factor receptor (EGFR), ERBB1 phosphotyrosine kinase siRNA
cgcgcccagcagagacccacact

SEQ ID NO: 8417 - DNA, 23 bp, Artificial Sequence
  epidermal growth factor receptor (EGFR), ERBB1 phosphotyrosine kinase siRNA
gcgcccagcagagacccacacta

SEQ ID NO: 8418 - DNA, 23 bp, Artificial Sequence
  epidermal growth factor receptor (EGFR), ERBB1 phosphotyrosine kinase siRNA
cgcccagcagagacccacactac

SEQ ID NO: 8419 - DNA, 23 bp, Artificial Sequence
  epidermal growth factor receptor (EGFR), ERBB1 phosphotyrosine kinase siRNA
gcccagcagagacccacactacc

SEQ ID NO: 8420 - DNA, 23 bp, Artificial Sequence
  epidermal growth factor receptor (EGFR), ERBB1 phosphotyrosine kinase siRNA
cccagcagagacccacactacca

SEQ ID NO: 8421 - DNA, 23 bp, Artificial Sequence
  epidermal growth factor receptor (EGFR), ERBB1 phosphotyrosine kinase siRNA
ccagcagagacccacactaccag

SEQ ID NO: 8422 - DNA, 23 bp, Artificial Sequence
  epidermal growth factor receptor (EGFR), ERBB1 phosphotyrosine kinase siRNA
cagcagagacccacactaccagg

SEQ ID NO: 8423 - DNA, 23 bp, Artificial Sequence
  epidermal growth factor receptor (EGFR), ERBB1 phosphotyrosine kinase siRNA
agcagagacccacactaccagga

SEQ ID NO: 8424 - DNA, 23 bp, Artificial Sequence
  epidermal growth factor receptor (EGFR), ERBB1 phosphotyrosine kinase siRNA
gcagagacccacactaccaggac

SEQ ID NO: 8425 - DNA, 23 bp, Artificial Sequence
  epidermal growth factor receptor (EGFR), ERBB1 phosphotyrosine kinase siRNA
cagagacccacactaccaggacc

SEQ ID NO: 8426 - DNA, 23 bp, Artificial Sequence
  epidermal growth factor receptor (EGFR), ERBB1 phosphotyrosine kinase siRNA
agagacccacactaccaggaccc

SEQ ID NO: 8427 - DNA, 23 bp, Artificial Sequence
  epidermal growth factor receptor (EGFR), ERBB1 phosphotyrosine kinase siRNA
gagacccacactaccaggacccc

SEQ ID NO: 8428 - DNA, 23 bp, Artificial Sequence
  epidermal growth factor receptor (EGFR), ERBB1 phosphotyrosine kinase siRNA
agacccacactaccaggaccccc

SEQ ID NO: 8429 - DNA, 23 bp, Artificial Sequence
  epidermal growth factor receptor (EGFR), ERBB1 phosphotyrosine kinase siRNA
gacccacactaccaggaccccca

SEQ ID NO: 8430 - DNA, 23 bp, Artificial Sequence
  epidermal growth factor receptor (EGFR), ERBB1 phosphotyrosine kinase siRNA
acccacactaccaggacccccac

SEQ ID NO: 8431 - DNA, 23 bp, Artificial Sequence
  epidermal growth factor receptor (EGFR), ERBB1 phosphotyrosine kinase siRNA
cccacactaccaggacccccaca

SEQ ID NO: 8432 - DNA, 23 bp, Artificial Sequence
  epidermal growth factor receptor (EGFR), ERBB1 phosphotyrosine kinase siRNA
ccacactaccaggacccccacag

SEQ ID NO: 8433 - DNA, 23 bp, Artificial Sequence
  epidermal growth factor receptor (EGFR), ERBB1 phosphotyrosine kinase siRNA
cacactaccaggacccccacagc

SEQ ID NO: 8434 - DNA, 23 bp, Artificial Sequence
  epidermal growth factor receptor (EGFR), ERBB1 phosphotyrosine kinase siRNA
acactaccaggacccccacagca

SEQ ID NO: 8435 - DNA, 23 bp, Artificial Sequence
  epidermal growth factor receptor (EGFR), ERBB1 phosphotyrosine kinase siRNA
cactaccaggacccccacagcac

SEQ ID NO: 8436 - DNA, 23 bp, Artificial Sequence
  epidermal growth factor receptor (EGFR), ERBB1 phosphotyrosine kinase siRNA
actaccaggacccccacagcact

SEQ ID NO: 8437 - DNA, 23 bp, Artificial Sequence
  epidermal growth factor receptor (EGFR), ERBB1 phosphotyrosine kinase siRNA
ctaccaggacccccacagcactg

SEQ ID NO: 8438 - DNA, 23 bp, Artificial Sequence
  epidermal growth factor receptor (EGFR), ERBB1 phosphotyrosine kinase siRNA
taccaggacccccacagcactgc

SEQ ID NO: 8439 - DNA, 23 bp, Artificial Sequence
  epidermal growth factor receptor (EGFR), ERBB1 phosphotyrosine kinase siRNA
accaggacccccacagcactgca

SEQ ID NO: 8440 - DNA, 23 bp, Artificial Sequence
  epidermal growth factor receptor (EGFR), ERBB1 phosphotyrosine kinase siRNA
ccaggacccccacagcactgcag

SEQ ID NO: 8441 - DNA, 23 bp, Artificial Sequence
  epidermal growth factor receptor (EGFR), ERBB1 phosphotyrosine kinase siRNA
caggacccccacagcactgcagt

SEQ ID NO: 8442 - DNA, 23 bp, Artificial Sequence
  epidermal growth factor receptor (EGFR), ERBB1 phosphotyrosine kinase siRNA
aggacccccacagcactgcagtg

SEQ ID NO: 8443 - DNA, 23 bp, Artificial Sequence
  epidermal growth factor receptor (EGFR), ERBB1 phosphotyrosine kinase siRNA
ggacccccacagcactgcagtgg

SEQ ID NO: 8444 - DNA, 23 bp, Artificial Sequence
  epidermal growth factor receptor (EGFR), ERBB1 phosphotyrosine kinase siRNA
gacccccacagcactgcagtggg

SEQ ID NO: 8445 - DNA, 23 bp, Artificial Sequence
  epidermal growth factor receptor (EGFR), ERBB1 phosphotyrosine kinase siRNA
acccccacagcactgcagtgggc

SEQ ID NO: 8446 - DNA, 23 bp, Artificial Sequence
  epidermal growth factor receptor (EGFR), ERBB1 phosphotyrosine kinase siRNA
cccccacagcactgcagtgggca

SEQ ID NO: 8447 - DNA, 23 bp, Artificial Sequence
  epidermal growth factor receptor (EGFR), ERBB1 phosphotyrosine kinase siRNA
ccccacagcactgcagtgggcaa

SEQ ID NO: 8448 - DNA, 23 bp, Artificial Sequence
  epidermal growth factor receptor (EGFR), ERBB1 phosphotyrosine kinase siRNA
cccacagcactgcagtgggcaac

SEQ ID NO: 8449 - DNA, 23 bp, Artificial Sequence
  epidermal growth factor receptor (EGFR), ERBB1 phosphotyrosine kinase siRNA
ccacagcactgcagtgggcaacc

SEQ ID NO: 8450 - DNA, 23 bp, Artificial Sequence
  epidermal growth factor receptor (EGFR), ERBB1 phosphotyrosine kinase siRNA
cacagcactgcagtgggcaaccc

SEQ ID NO: 8451 - DNA, 23 bp, Artificial Sequence
  epidermal growth factor receptor (EGFR), ERBB1 phosphotyrosine kinase siRNA
acagcactgcagtgggcaacccc

SEQ ID NO: 8452 - DNA, 23 bp, Artificial Sequence
  epidermal growth factor receptor (EGFR), ERBB1 phosphotyrosine kinase siRNA
cagcactgcagtgggcaaccccg

SEQ ID NO: 8453 - DNA, 23 bp, Artificial Sequence
  epidermal growth factor receptor (EGFR), ERBB1 phosphotyrosine kinase siRNA
agcactgcagtgggcaaccccga

SEQ ID NO: 8454 - DNA, 23 bp, Artificial Sequence
  epidermal growth factor receptor (EGFR), ERBB1 phosphotyrosine kinase siRNA
gcactgcagtgggcaaccccgag

SEQ ID NO: 8455 - DNA, 23 bp, Artificial Sequence
  epidermal growth factor receptor (EGFR), ERBB1 phosphotyrosine kinase siRNA
cactgcagtgggcaaccccgagt

SEQ ID NO: 8456 - DNA, 23 bp, Artificial Sequence
  epidermal growth factor receptor (EGFR), ERBB1 phosphotyrosine kinase siRNA
actgcagtgggcaaccccgagta

SEQ ID NO: 8457 - DNA, 23 bp, Artificial Sequence
  epidermal growth factor receptor (EGFR), ERBB1 phosphotyrosine kinase siRNA
ctgcagtgggcaaccccgagtat

SEQ ID NO: 8458 - DNA, 23 bp, Artificial Sequence
  epidermal growth factor receptor (EGFR), ERBB1 phosphotyrosine kinase siRNA
tgcagtgggcaaccccgagtatc

SEQ ID NO: 8459 - DNA, 23 bp, Artificial Sequence
  epidermal growth factor receptor (EGFR), ERBB1 phosphotyrosine kinase siRNA
gcagtgggcaaccccgagtatct

SEQ ID NO: 8460 - DNA, 23 bp, Artificial Sequence
  epidermal growth factor receptor (EGFR), ERBB1 phosphotyrosine kinase siRNA
cagtgggcaaccccgagtatctc

SEQ ID NO: 8461 - DNA, 23 bp, Artificial Sequence
  epidermal growth factor receptor (EGFR), ERBB1 phosphotyrosine kinase siRNA
agtgggcaaccccgagtatctca

SEQ ID NO: 8462 - DNA, 23 bp, Artificial Sequence
  epidermal growth factor receptor (EGFR), ERBB1 phosphotyrosine kinase siRNA
gtgggcaaccccgagtatctcaa

SEQ ID NO: 8463 - DNA, 23 bp, Artificial Sequence
  epidermal growth factor receptor (EGFR), ERBB1 phosphotyrosine kinase siRNA
tgggcaaccccgagtatctcaac

SEQ ID NO: 8464 - DNA, 23 bp, Artificial Sequence
  epidermal growth factor receptor (EGFR), ERBB1 phosphotyrosine kinase siRNA
gggcaaccccgagtatctcaaca

SEQ ID NO: 8465 - DNA, 23 bp, Artificial Sequence
  epidermal growth factor receptor (EGFR), ERBB1 phosphotyrosine kinase siRNA
ggcaaccccgagtatctcaacac

SEQ ID NO: 8466 - DNA, 23 bp, Artificial Sequence
  epidermal growth factor receptor (EGFR), ERBB1 phosphotyrosine kinase siRNA
gcaaccccgagtatctcaacact

SEQ ID NO: 8467 - DNA, 23 bp, Artificial Sequence
  epidermal growth factor receptor (EGFR), ERBB1 phosphotyrosine kinase siRNA
caaccccgagtatctcaacactg

SEQ ID NO: 8468 - DNA, 23 bp, Artificial Sequence
  epidermal growth factor receptor (EGFR), ERBB1 phosphotyrosine kinase siRNA
aaccccgagtatctcaacactgt

SEQ ID NO: 8469 - DNA, 23 bp, Artificial Sequence
  epidermal growth factor receptor (EGFR), ERBB1 phosphotyrosine kinase siRNA
accccgagtatctcaacactgtc

SEQ ID NO: 8470 - DNA, 23 bp, Artificial Sequence
  epidermal growth factor receptor (EGFR), ERBB1 phosphotyrosine kinase siRNA
ccccgagtatctcaacactgtcc

SEQ ID NO: 8471 - DNA, 23 bp, Artificial Sequence
  epidermal growth factor receptor (EGFR), ERBB1 phosphotyrosine kinase siRNA
cccgagtatctcaacactgtcca

SEQ ID NO: 8472 - DNA, 23 bp, Artificial Sequence
  epidermal growth factor receptor (EGFR), ERBB1 phosphotyrosine kinase siRNA
ccgagtatctcaacactgtccag

SEQ ID NO: 8473 - DNA, 23 bp, Artificial Sequence
  epidermal growth factor receptor (EGFR), ERBB1 phosphotyrosine kinase siRNA
cgagtatctcaacactgtccagc

SEQ ID NO: 8474 - DNA, 23 bp, Artificial Sequence
  epidermal growth factor receptor (EGFR), ERBB1 phosphotyrosine kinase siRNA
gagtatctcaacactgtccagcc

SEQ ID NO: 8475 - DNA, 23 bp, Artificial Sequence
  epidermal growth factor receptor (EGFR), ERBB1 phosphotyrosine kinase siRNA
agtatctcaacactgtccagccc

SEQ ID NO: 8476 - DNA, 23 bp, Artificial Sequence
  epidermal growth factor receptor (EGFR), ERBB1 phosphotyrosine kinase siRNA
gtatctcaacactgtccagccca

SEQ ID NO: 8477 - DNA, 23 bp, Artificial Sequence
  epidermal growth factor receptor (EGFR), ERBB1 phosphotyrosine kinase siRNA
tatctcaacactgtccagcccac

SEQ ID NO: 8478 - DNA, 23 bp, Artificial Sequence
  epidermal growth factor receptor (EGFR), ERBB1 phosphotyrosine kinase siRNA
atctcaacactgtccagcccacc

SEQ ID NO: 8479 - DNA, 23 bp, Artificial Sequence
  epidermal growth factor receptor (EGFR), ERBB1 phosphotyrosine kinase siRNA
tctcaacactgtccagcccacct

SEQ ID NO: 8480 - DNA, 23 bp, Artificial Sequence
  epidermal growth factor receptor (EGFR), ERBB1 phosphotyrosine kinase siRNA
ctcaacactgtccagcccacctg

SEQ ID NO: 8481 - DNA, 23 bp, Artificial Sequence
  epidermal growth factor receptor (EGFR), ERBB1 phosphotyrosine kinase siRNA
tcaacactgtccagcccacctgt

SEQ ID NO: 8482 - DNA, 23 bp, Artificial Sequence
  epidermal growth factor receptor (EGFR), ERBB1 phosphotyrosine kinase siRNA
caacactgtccagcccacctgtg

SEQ ID NO: 8483 - DNA, 23 bp, Artificial Sequence
  epidermal growth factor receptor (EGFR), ERBB1 phosphotyrosine kinase siRNA
aacactgtccagcccacctgtgt

SEQ ID NO: 8484 - DNA, 23 bp, Artificial Sequence
  epidermal growth factor receptor (EGFR), ERBB1 phosphotyrosine kinase siRNA
acactgtccagcccacctgtgtc

SEQ ID NO: 8485 - DNA, 23 bp, Artificial Sequence
  epidermal growth factor receptor (EGFR), ERBB1 phosphotyrosine kinase siRNA
cactgtccagcccacctgtgtca

SEQ ID NO: 8486 - DNA, 23 bp, Artificial Sequence
  epidermal growth factor receptor (EGFR), ERBB1 phosphotyrosine kinase siRNA
actgtccagcccacctgtgtcaa

SEQ ID NO: 8487 - DNA, 23 bp, Artificial Sequence
  epidermal growth factor receptor (EGFR), ERBB1 phosphotyrosine kinase siRNA
ctgtccagcccacctgtgtcaac

SEQ ID NO: 8488 - DNA, 23 bp, Artificial Sequence
  epidermal growth factor receptor (EGFR), ERBB1 phosphotyrosine kinase siRNA
tgtccagcccacctgtgtcaaca

SEQ ID NO: 8489 - DNA, 23 bp, Artificial Sequence
  epidermal growth factor receptor (EGFR), ERBB1 phosphotyrosine kinase siRNA
gtccagcccacctgtgtcaacag

SEQ ID NO: 8490 - DNA, 23 bp, Artificial Sequence
  epidermal growth factor receptor (EGFR), ERBB1 phosphotyrosine kinase siRNA
tccagcccacctgtgtcaacagc

SEQ ID NO: 8491 - DNA, 23 bp, Artificial Sequence
  epidermal growth factor receptor (EGFR), ERBB1 phosphotyrosine kinase siRNA
ccagcccacctgtgtcaacagca

SEQ ID NO: 8492 - DNA, 23 bp, Artificial Sequence
  epidermal growth factor receptor (EGFR), ERBB1 phosphotyrosine kinase siRNA
cagcccacctgtgtcaacagcac

SEQ ID NO: 8493 - DNA, 23 bp, Artificial Sequence
  epidermal growth factor receptor (EGFR), ERBB1 phosphotyrosine kinase siRNA
agcccacctgtgtcaacagcaca

SEQ ID NO: 8494 - DNA, 23 bp, Artificial Sequence
  epidermal growth factor receptor (EGFR), ERBB1 phosphotyrosine kinase siRNA
gcccacctgtgtcaacagcacat

SEQ ID NO: 8495 - DNA, 23 bp, Artificial Sequence
  epidermal growth factor receptor (EGFR), ERBB1 phosphotyrosine kinase siRNA
cccacctgtgtcaacagcacatt

SEQ ID NO: 8496 - DNA, 23 bp, Artificial Sequence
  epidermal growth factor receptor (EGFR), ERBB1 phosphotyrosine kinase siRNA
ccacctgtgtcaacagcacattc

SEQ ID NO: 8497 - DNA, 23 bp, Artificial Sequence
  epidermal growth factor receptor (EGFR), ERBB1 phosphotyrosine kinase siRNA
cacctgtgtcaacagcacattcg

SEQ ID NO: 8498 - DNA, 23 bp, Artificial Sequence
  epidermal growth factor receptor (EGFR), ERBB1 phosphotyrosine kinase siRNA
acctgtgtcaacagcacattcga

SEQ ID NO: 8499 - DNA, 23 bp, Artificial Sequence
  epidermal growth factor receptor (EGFR), ERBB1 phosphotyrosine kinase siRNA
cctgtgtcaacagcacattcgac

SEQ ID NO: 8500 - DNA, 23 bp, Artificial Sequence
  epidermal growth factor receptor (EGFR), ERBB1 phosphotyrosine kinase siRNA
ctgtgtcaacagcacattcgaca

SEQ ID NO: 8501 - DNA, 23 bp, Artificial Sequence
  epidermal growth factor receptor (EGFR), ERBB1 phosphotyrosine kinase siRNA
tgtgtcaacagcacattcgacag

SEQ ID NO: 8502 - DNA, 23 bp, Artificial Sequence
  epidermal growth factor receptor (EGFR), ERBB1 phosphotyrosine kinase siRNA
gtgtcaacagcacattcgacagc

SEQ ID NO: 8503 - DNA, 23 bp, Artificial Sequence
  epidermal growth factor receptor (EGFR), ERBB1 phosphotyrosine kinase siRNA
tgtcaacagcacattcgacagcc

SEQ ID NO: 8504 - DNA, 23 bp, Artificial Sequence
  epidermal growth factor receptor (EGFR), ERBB1 phosphotyrosine kinase siRNA
gtcaacagcacattcgacagccc

SEQ ID NO: 8505 - DNA, 23 bp, Artificial Sequence
  epidermal growth factor receptor (EGFR), ERBB1 phosphotyrosine kinase siRNA
tcaacagcacattcgacagccct

SEQ ID NO: 8506 - DNA, 23 bp, Artificial Sequence
  epidermal growth factor receptor (EGFR), ERBB1 phosphotyrosine kinase siRNA
caacagcacattcgacagccctg

SEQ ID NO: 8507 - DNA, 23 bp, Artificial Sequence
  epidermal growth factor receptor (EGFR), ERBB1 phosphotyrosine kinase siRNA
aacagcacattcgacagccctgc

SEQ ID NO: 8508 - DNA, 23 bp, Artificial Sequence
  epidermal growth factor receptor (EGFR), ERBB1 phosphotyrosine kinase siRNA
acagcacattcgacagccctgcc

SEQ ID NO: 8509 - DNA, 23 bp, Artificial Sequence
  epidermal growth factor receptor (EGFR), ERBB1 phosphotyrosine kinase siRNA
cagcacattcgacagccctgccc

SEQ ID NO: 8510 - DNA, 23 bp, Artificial Sequence
  epidermal growth factor receptor (EGFR), ERBB1 phosphotyrosine kinase siRNA
agcacattcgacagccctgccca

SEQ ID NO: 8511 - DNA, 23 bp, Artificial Sequence
  epidermal growth factor receptor (EGFR), ERBB1 phosphotyrosine kinase siRNA
gcacattcgacagccctgcccac

SEQ ID NO: 8512 - DNA, 23 bp, Artificial Sequence
  epidermal growth factor receptor (EGFR), ERBB1 phosphotyrosine kinase siRNA
cacattcgacagccctgcccact

SEQ ID NO: 8513 - DNA, 23 bp, Artificial Sequence
  epidermal growth factor receptor (EGFR), ERBB1 phosphotyrosine kinase siRNA
acattcgacagccctgcccactg

SEQ ID NO: 8514 - DNA, 23 bp, Artificial Sequence
  epidermal growth factor receptor (EGFR), ERBB1 phosphotyrosine kinase siRNA
cattcgacagccctgcccactgg

SEQ ID NO: 8515 - DNA, 23 bp, Artificial Sequence
  epidermal growth factor receptor (EGFR), ERBB1 phosphotyrosine kinase siRNA
attcgacagccctgcccactggg

SEQ ID NO: 8516 - DNA, 23 bp, Artificial Sequence
  epidermal growth factor receptor (EGFR), ERBB1 phosphotyrosine kinase siRNA
ttcgacagccctgcccactgggc

SEQ ID NO: 8517 - DNA, 23 bp, Artificial Sequence
  epidermal growth factor receptor (EGFR), ERBB1 phosphotyrosine kinase siRNA
tcgacagccctgcccactgggcc

SEQ ID NO: 8518 - DNA, 23 bp, Artificial Sequence
  epidermal growth factor receptor (EGFR), ERBB1 phosphotyrosine kinase siRNA
cgacagccctgcccactgggccc

SEQ ID NO: 8519 - DNA, 23 bp, Artificial Sequence
  epidermal growth factor receptor (EGFR), ERBB1 phosphotyrosine kinase siRNA
gacagccctgcccactgggccca

SEQ ID NO: 8520 - DNA, 23 bp, Artificial Sequence
  epidermal growth factor receptor (EGFR), ERBB1 phosphotyrosine kinase siRNA
acagccctgcccactgggcccag

SEQ ID NO: 8521 - DNA, 23 bp, Artificial Sequence
  epidermal growth factor receptor (EGFR), ERBB1 phosphotyrosine kinase siRNA
cagccctgcccactgggcccaga

SEQ ID NO: 8522 - DNA, 23 bp, Artificial Sequence
  epidermal growth factor receptor (EGFR), ERBB1 phosphotyrosine kinase siRNA
agccctgcccactgggcccagaa

SEQ ID NO: 8523 - DNA, 23 bp, Artificial Sequence
  epidermal growth factor receptor (EGFR), ERBB1 phosphotyrosine kinase siRNA
gccctgcccactgggcccagaaa

SEQ ID NO: 8524 - DNA, 23 bp, Artificial Sequence
  epidermal growth factor receptor (EGFR), ERBB1 phosphotyrosine kinase siRNA
ccctgcccactgggcccagaaag

SEQ ID NO: 8525 - DNA, 23 bp, Artificial Sequence
  epidermal growth factor receptor (EGFR), ERBB1 phosphotyrosine kinase siRNA
cctgcccactgggcccagaaagg

SEQ ID NO: 8526 - DNA, 23 bp, Artificial Sequence
  epidermal growth factor receptor (EGFR), ERBB1 phosphotyrosine kinase siRNA
ctgcccactgggcccagaaaggc

SEQ ID NO: 8527 - DNA, 23 bp, Artificial Sequence
  epidermal growth factor receptor (EGFR), ERBB1 phosphotyrosine kinase siRNA
tgcccactgggcccagaaaggca

SEQ ID NO: 8528 - DNA, 23 bp, Artificial Sequence
  epidermal growth factor receptor (EGFR), ERBB1 phosphotyrosine kinase siRNA
gcccactgggcccagaaaggcag

SEQ ID NO: 8529 - DNA, 23 bp, Artificial Sequence
  epidermal growth factor receptor (EGFR), ERBB1 phosphotyrosine kinase siRNA
cccactgggcccagaaaggcagc

SEQ ID NO: 8530 - DNA, 23 bp, Artificial Sequence
  epidermal growth factor receptor (EGFR), ERBB1 phosphotyrosine kinase siRNA
ccactgggcccagaaaggcagcc

SEQ ID NO: 8531 - DNA, 23 bp, Artificial Sequence
  epidermal growth factor receptor (EGFR), ERBB1 phosphotyrosine kinase siRNA
cactgggcccagaaaggcagcca

SEQ ID NO: 8532 - DNA, 23 bp, Artificial Sequence
  epidermal growth factor receptor (EGFR), ERBB1 phosphotyrosine kinase siRNA
actgggcccagaaaggcagccac

SEQ ID NO: 8533 - DNA, 23 bp, Artificial Sequence
  epidermal growth factor receptor (EGFR), ERBB1 phosphotyrosine kinase siRNA
ctgggcccagaaaggcagccacc

SEQ ID NO: 8534 - DNA, 23 bp, Artificial Sequence
  epidermal growth factor receptor (EGFR), ERBB1 phosphotyrosine kinase siRNA
tgggcccagaaaggcagccacca

SEQ ID NO: 8535 - DNA, 23 bp, Artificial Sequence
  epidermal growth factor receptor (EGFR), ERBB1 phosphotyrosine kinase siRNA
gggcccagaaaggcagccaccaa

SEQ ID NO: 8536 - DNA, 23 bp, Artificial Sequence
  epidermal growth factor receptor (EGFR), ERBB1 phosphotyrosine kinase siRNA
ggcccagaaaggcagccaccaaa

SEQ ID NO: 8537 - DNA, 23 bp, Artificial Sequence
  epidermal growth factor receptor (EGFR), ERBB1 phosphotyrosine kinase siRNA
gcccagaaaggcagccaccaaat

SEQ ID NO: 8538 - DNA, 23 bp, Artificial Sequence
  epidermal growth factor receptor (EGFR), ERBB1 phosphotyrosine kinase siRNA
cccagaaaggcagccaccaaatt

SEQ ID NO: 8539 - DNA, 23 bp, Artificial Sequence
  epidermal growth factor receptor (EGFR), ERBB1 phosphotyrosine kinase siRNA
ccagaaaggcagccaccaaatta

SEQ ID NO: 8540 - DNA, 23 bp, Artificial Sequence
  epidermal growth factor receptor (EGFR), ERBB1 phosphotyrosine kinase siRNA
cagaaaggcagccaccaaattag

SEQ ID NO: 8541 - DNA, 23 bp, Artificial Sequence
  epidermal growth factor receptor (EGFR), ERBB1 phosphotyrosine kinase siRNA
agaaaggcagccaccaaattagc

SEQ ID NO: 8542 - DNA, 23 bp, Artificial Sequence
  epidermal growth factor receptor (EGFR), ERBB1 phosphotyrosine kinase siRNA
gaaaggcagccaccaaattagcc

SEQ ID NO: 8543 - DNA, 23 bp, Artificial Sequence
  epidermal growth factor receptor (EGFR), ERBB1 phosphotyrosine kinase siRNA
aaaggcagccaccaaattagcct

SEQ ID NO: 8544 - DNA, 23 bp, Artificial Sequence
  epidermal growth factor receptor (EGFR), ERBB1 phosphotyrosine kinase siRNA
aaggcagccaccaaattagcctg

SEQ ID NO: 8545 - DNA, 23 bp, Artificial Sequence
  epidermal growth factor receptor (EGFR), ERBB1 phosphotyrosine kinase siRNA
aggcagccaccaaattagcctgg

SEQ ID NO: 8546 - DNA, 23 bp, Artificial Sequence
  epidermal growth factor receptor (EGFR), ERBB1 phosphotyrosine kinase siRNA
ggcagccaccaaattagcctgga

SEQ ID NO: 8547 - DNA, 23 bp, Artificial Sequence
  epidermal growth factor receptor (EGFR), ERBB1 phosphotyrosine kinase siRNA
gcagccaccaaattagcctggac

SEQ ID NO: 8548 - DNA, 23 bp, Artificial Sequence
  epidermal growth factor receptor (EGFR), ERBB1 phosphotyrosine kinase siRNA
cagccaccaaattagcctggaca

SEQ ID NO: 8549 - DNA, 23 bp, Artificial Sequence
  epidermal growth factor receptor (EGFR), ERBB1 phosphotyrosine kinase siRNA
agccaccaaattagcctggacaa

SEQ ID NO: 8550 - DNA, 23 bp, Artificial Sequence
  epidermal growth factor receptor (EGFR), ERBB1 phosphotyrosine kinase siRNA
gccaccaaattagcctggacaac

SEQ ID NO: 8551 - DNA, 23 bp, Artificial Sequence
  epidermal growth factor receptor (EGFR), ERBB1 phosphotyrosine kinase siRNA
ccaccaaattagcctggacaacc

SEQ ID NO: 8552 - DNA, 23 bp, Artificial Sequence
  epidermal growth factor receptor (EGFR), ERBB1 phosphotyrosine kinase siRNA
caccaaattagcctggacaaccc

SEQ ID NO: 8553 - DNA, 23 bp, Artificial Sequence
  epidermal growth factor receptor (EGFR), ERBB1 phosphotyrosine kinase siRNA
accaaattagcctggacaaccct

SEQ ID NO: 8554 - DNA, 23 bp, Artificial Sequence
  epidermal growth factor receptor (EGFR), ERBB1 phosphotyrosine kinase siRNA
ccaaattagcctggacaaccctg

SEQ ID NO: 8555 - DNA, 23 bp, Artificial Sequence
  epidermal growth factor receptor (EGFR), ERBB1 phosphotyrosine kinase siRNA
caaattagcctggacaaccctga

SEQ ID NO: 8556 - DNA, 23 bp, Artificial Sequence
  epidermal growth factor receptor (EGFR), ERBB1 phosphotyrosine kinase siRNA
aaattagcctggacaaccctgac

SEQ ID NO: 8557 - DNA, 23 bp, Artificial Sequence
  epidermal growth factor receptor (EGFR), ERBB1 phosphotyrosine kinase siRNA
aattagcctggacaaccctgact

SEQ ID NO: 8558 - DNA, 23 bp, Artificial Sequence
  epidermal growth factor receptor (EGFR), ERBB1 phosphotyrosine kinase siRNA
attagcctggacaaccctgacta

SEQ ID NO: 8559 - DNA, 23 bp, Artificial Sequence
  epidermal growth factor receptor (EGFR), ERBB1 phosphotyrosine kinase siRNA
ttagcctggacaaccctgactac

SEQ ID NO: 8560 - DNA, 23 bp, Artificial Sequence
  epidermal growth factor receptor (EGFR), ERBB1 phosphotyrosine kinase siRNA
tagcctggacaaccctgactacc

SEQ ID NO: 8561 - DNA, 23 bp, Artificial Sequence
  epidermal growth factor receptor (EGFR), ERBB1 phosphotyrosine kinase siRNA
agcctggacaaccctgactacca

SEQ ID NO: 8562 - DNA, 23 bp, Artificial Sequence
  epidermal growth factor receptor (EGFR), ERBB1 phosphotyrosine kinase siRNA
gcctggacaaccctgactaccag

SEQ ID NO: 8563 - DNA, 23 bp, Artificial Sequence
  epidermal growth factor receptor (EGFR), ERBB1 phosphotyrosine kinase siRNA
cctggacaaccctgactaccagc

SEQ ID NO: 8564 - DNA, 23 bp, Artificial Sequence
  epidermal growth factor receptor (EGFR), ERBB1 phosphotyrosine kinase siRNA
ctggacaaccctgactaccagca

SEQ ID NO: 8565 - DNA, 23 bp, Artificial Sequence
  epidermal growth factor receptor (EGFR), ERBB1 phosphotyrosine kinase siRNA
tggacaaccctgactaccagcag

SEQ ID NO: 8566 - DNA, 23 bp, Artificial Sequence
  epidermal growth factor receptor (EGFR), ERBB1 phosphotyrosine kinase siRNA
ggacaaccctgactaccagcagg

SEQ ID NO: 8567 - DNA, 23 bp, Artificial Sequence
  epidermal growth factor receptor (EGFR), ERBB1 phosphotyrosine kinase siRNA
gacaaccctgactaccagcagga

SEQ ID NO: 8568 - DNA, 23 bp, Artificial Sequence
  epidermal growth factor receptor (EGFR), ERBB1 phosphotyrosine kinase siRNA
acaaccctgactaccagcaggac

SEQ ID NO: 8569 - DNA, 23 bp, Artificial Sequence
  epidermal growth factor receptor (EGFR), ERBB1 phosphotyrosine kinase siRNA
caaccctgactaccagcaggact

SEQ ID NO: 8570 - DNA, 23 bp, Artificial Sequence
  epidermal growth factor receptor (EGFR), ERBB1 phosphotyrosine kinase siRNA
aaccctgactaccagcaggactt

SEQ ID NO: 8571 - DNA, 23 bp, Artificial Sequence
  epidermal growth factor receptor (EGFR), ERBB1 phosphotyrosine kinase siRNA
accctgactaccagcaggacttc

SEQ ID NO: 8572 - DNA, 23 bp, Artificial Sequence
  epidermal growth factor receptor (EGFR), ERBB1 phosphotyrosine kinase siRNA
ccctgactaccagcaggacttct

SEQ ID NO: 8573 - DNA, 23 bp, Artificial Sequence
  epidermal growth factor receptor (EGFR), ERBB1 phosphotyrosine kinase siRNA
cctgactaccagcaggacttctt

SEQ ID NO: 8574 - DNA, 23 bp, Artificial Sequence
  epidermal growth factor receptor (EGFR), ERBB1 phosphotyrosine kinase siRNA
ctgactaccagcaggacttcttt

SEQ ID NO: 8575 - DNA, 23 bp, Artificial Sequence
  epidermal growth factor receptor (EGFR), ERBB1 phosphotyrosine kinase siRNA
tgactaccagcaggacttctttc

SEQ ID NO: 8576 - DNA, 23 bp, Artificial Sequence
  epidermal growth factor receptor (EGFR), ERBB1 phosphotyrosine kinase siRNA
gactaccagcaggacttctttcc

SEQ ID NO: 8577 - DNA, 23 bp, Artificial Sequence
  epidermal growth factor receptor (EGFR), ERBB1 phosphotyrosine kinase siRNA
actaccagcaggacttctttccc

SEQ ID NO: 8578 - DNA, 23 bp, Artificial Sequence
  epidermal growth factor receptor (EGFR), ERBB1 phosphotyrosine kinase siRNA
ctaccagcaggacttctttccca

SEQ ID NO: 8579 - DNA, 23 bp, Artificial Sequence
  epidermal growth factor receptor (EGFR), ERBB1 phosphotyrosine kinase siRNA
taccagcaggacttctttcccaa

SEQ ID NO: 8580 - DNA, 23 bp, Artificial Sequence
  epidermal growth factor receptor (EGFR), ERBB1 phosphotyrosine kinase siRNA
accagcaggacttctttcccaag

SEQ ID NO: 8581 - DNA, 23 bp, Artificial Sequence
  epidermal growth factor receptor (EGFR), ERBB1 phosphotyrosine kinase siRNA
ccagcaggacttctttcccaagg

SEQ ID NO: 8582 - DNA, 23 bp, Artificial Sequence
  epidermal growth factor receptor (EGFR), ERBB1 phosphotyrosine kinase siRNA
cagcaggacttctttcccaagga

SEQ ID NO: 8583 - DNA, 23 bp, Artificial Sequence
  epidermal growth factor receptor (EGFR), ERBB1 phosphotyrosine kinase siRNA
agcaggacttctttcccaaggaa

SEQ ID NO: 8584 - DNA, 23 bp, Artificial Sequence
  epidermal growth factor receptor (EGFR), ERBB1 phosphotyrosine kinase siRNA
gcaggacttctttcccaaggaag

SEQ ID NO: 8585 - DNA, 23 bp, Artificial Sequence
  epidermal growth factor receptor (EGFR), ERBB1 phosphotyrosine kinase siRNA
caggacttctttcccaaggaagc

SEQ ID NO: 8586 - DNA, 23 bp, Artificial Sequence
  epidermal growth factor receptor (EGFR), ERBB1 phosphotyrosine kinase siRNA
aggacttctttcccaaggaagcc

SEQ ID NO: 8587 - DNA, 23 bp, Artificial Sequence
  epidermal growth factor receptor (EGFR), ERBB1 phosphotyrosine kinase siRNA
ggacttctttcccaaggaagcca

SEQ ID NO: 8588 - DNA, 23 bp, Artificial Sequence
  epidermal growth factor receptor (EGFR), ERBB1 phosphotyrosine kinase siRNA
gacttctttcccaaggaagccaa

SEQ ID NO: 8589 - DNA, 23 bp, Artificial Sequence
  epidermal growth factor receptor (EGFR), ERBB1 phosphotyrosine kinase siRNA
acttctttcccaaggaagccaag

SEQ ID NO: 8590 - DNA, 23 bp, Artificial Sequence
  epidermal growth factor receptor (EGFR), ERBB1 phosphotyrosine kinase siRNA
cttctttcccaaggaagccaagc

SEQ ID NO: 8591 - DNA, 23 bp, Artificial Sequence
  epidermal growth factor receptor (EGFR), ERBB1 phosphotyrosine kinase siRNA
ttctttcccaaggaagccaagcc

SEQ ID NO: 8592 - DNA, 23 bp, Artificial Sequence
  epidermal growth factor receptor (EGFR), ERBB1 phosphotyrosine kinase siRNA
tctttcccaaggaagccaagcca

SEQ ID NO: 8593 - DNA, 23 bp, Artificial Sequence
  epidermal growth factor receptor (EGFR), ERBB1 phosphotyrosine kinase siRNA
ctttcccaaggaagccaagccaa

SEQ ID NO: 8594 - DNA, 23 bp, Artificial Sequence
  epidermal growth factor receptor (EGFR), ERBB1 phosphotyrosine kinase siRNA
tttcccaaggaagccaagccaaa

SEQ ID NO: 8595 - DNA, 23 bp, Artificial Sequence
  epidermal growth factor receptor (EGFR), ERBB1 phosphotyrosine kinase siRNA
ttcccaaggaagccaagccaaat

SEQ ID NO: 8596 - DNA, 23 bp, Artificial Sequence
  epidermal growth factor receptor (EGFR), ERBB1 phosphotyrosine kinase siRNA
tcccaaggaagccaagccaaatg

SEQ ID NO: 8597 - DNA, 23 bp, Artificial Sequence
  epidermal growth factor receptor (EGFR), ERBB1 phosphotyrosine kinase siRNA
cccaaggaagccaagccaaatgg

SEQ ID NO: 8598 - DNA, 23 bp, Artificial Sequence
  epidermal growth factor receptor (EGFR), ERBB1 phosphotyrosine kinase siRNA
ccaaggaagccaagccaaatggc

SEQ ID NO: 8599 - DNA, 23 bp, Artificial Sequence
  epidermal growth factor receptor (EGFR), ERBB1 phosphotyrosine kinase siRNA
caaggaagccaagccaaatggca

SEQ ID NO: 8600 - DNA, 23 bp, Artificial Sequence
  epidermal growth factor receptor (EGFR), ERBB1 phosphotyrosine kinase siRNA
aaggaagccaagccaaatggcat

SEQ ID NO: 8601 - DNA, 23 bp, Artificial Sequence
  epidermal growth factor receptor (EGFR), ERBB1 phosphotyrosine kinase siRNA
aggaagccaagccaaatggcatc

SEQ ID NO: 8602 - DNA, 23 bp, Artificial Sequence
  epidermal growth factor receptor (EGFR), ERBB1 phosphotyrosine kinase siRNA
ggaagccaagccaaatggcatct

SEQ ID NO: 8603 - DNA, 23 bp, Artificial Sequence
  epidermal growth factor receptor (EGFR), ERBB1 phosphotyrosine kinase siRNA
gaagccaagccaaatggcatctt

SEQ ID NO: 8604 - DNA, 23 bp, Artificial Sequence
  epidermal growth factor receptor (EGFR), ERBB1 phosphotyrosine kinase siRNA
aagccaagccaaatggcatcttt

SEQ ID NO: 8605 - DNA, 23 bp, Artificial Sequence
  epidermal growth factor receptor (EGFR), ERBB1 phosphotyrosine kinase siRNA
agccaagccaaatggcatcttta

SEQ ID NO: 8606 - DNA, 23 bp, Artificial Sequence
  epidermal growth factor receptor (EGFR), ERBB1 phosphotyrosine kinase siRNA
gccaagccaaatggcatctttaa

SEQ ID NO: 8607 - DNA, 23 bp, Artificial Sequence
  epidermal growth factor receptor (EGFR), ERBB1 phosphotyrosine kinase siRNA
ccaagccaaatggcatctttaag

SEQ ID NO: 8608 - DNA, 23 bp, Artificial Sequence
  epidermal growth factor receptor (EGFR), ERBB1 phosphotyrosine kinase siRNA
caagccaaatggcatctttaagg

SEQ ID NO: 8609 - DNA, 23 bp, Artificial Sequence
  epidermal growth factor receptor (EGFR), ERBB1 phosphotyrosine kinase siRNA
aagccaaatggcatctttaaggg

SEQ ID NO: 8610 - DNA, 23 bp, Artificial Sequence
  epidermal growth factor receptor (EGFR), ERBB1 phosphotyrosine kinase siRNA
agccaaatggcatctttaagggc

SEQ ID NO: 8611 - DNA, 23 bp, Artificial Sequence
  epidermal growth factor receptor (EGFR), ERBB1 phosphotyrosine kinase siRNA
gccaaatggcatctttaagggct

SEQ ID NO: 8612 - DNA, 23 bp, Artificial Sequence
  epidermal growth factor receptor (EGFR), ERBB1 phosphotyrosine kinase siRNA
ccaaatggcatctttaagggctc

SEQ ID NO: 8613 - DNA, 23 bp, Artificial Sequence
  epidermal growth factor receptor (EGFR), ERBB1 phosphotyrosine kinase siRNA
caaatggcatctttaagggctcc

SEQ ID NO: 8614 - DNA, 23 bp, Artificial Sequence
  epidermal growth factor receptor (EGFR), ERBB1 phosphotyrosine kinase siRNA
aaatggcatctttaagggctcca

SEQ ID NO: 8615 - DNA, 23 bp, Artificial Sequence
  epidermal growth factor receptor (EGFR), ERBB1 phosphotyrosine kinase siRNA
aatggcatctttaagggctccac

SEQ ID NO: 8616 - DNA, 23 bp, Artificial Sequence
  epidermal growth factor receptor (EGFR), ERBB1 phosphotyrosine kinase siRNA
atggcatctttaagggctccaca

SEQ ID NO: 8617 - DNA, 23 bp, Artificial Sequence
  epidermal growth factor receptor (EGFR), ERBB1 phosphotyrosine kinase siRNA
tggcatctttaagggctccacag

SEQ ID NO: 8618 - DNA, 23 bp, Artificial Sequence
  epidermal growth factor receptor (EGFR), ERBB1 phosphotyrosine kinase siRNA
ggcatctttaagggctccacagc

SEQ ID NO: 8619 - DNA, 23 bp, Artificial Sequence
  epidermal growth factor receptor (EGFR), ERBB1 phosphotyrosine kinase siRNA
gcatctttaagggctccacagct

SEQ ID NO: 8620 - DNA, 23 bp, Artificial Sequence
  epidermal growth factor receptor (EGFR), ERBB1 phosphotyrosine kinase siRNA
catctttaagggctccacagctg

SEQ ID NO: 8621 - DNA, 23 bp, Artificial Sequence
  epidermal growth factor receptor (EGFR), ERBB1 phosphotyrosine kinase siRNA
atctttaagggctccacagctga

SEQ ID NO: 8622 - DNA, 23 bp, Artificial Sequence
  epidermal growth factor receptor (EGFR), ERBB1 phosphotyrosine kinase siRNA
tctttaagggctccacagctgaa

SEQ ID NO: 8623 - DNA, 23 bp, Artificial Sequence
  epidermal growth factor receptor (EGFR), ERBB1 phosphotyrosine kinase siRNA
ctttaagggctccacagctgaaa

SEQ ID NO: 8624 - DNA, 23 bp, Artificial Sequence
  epidermal growth factor receptor (EGFR), ERBB1 phosphotyrosine kinase siRNA
tttaagggctccacagctgaaaa

SEQ ID NO: 8625 - DNA, 23 bp, Artificial Sequence
  epidermal growth factor receptor (EGFR), ERBB1 phosphotyrosine kinase siRNA
ttaagggctccacagctgaaaat

SEQ ID NO: 8626 - DNA, 23 bp, Artificial Sequence
  epidermal growth factor receptor (EGFR), ERBB1 phosphotyrosine kinase siRNA
taagggctccacagctgaaaatg

SEQ ID NO: 8627 - DNA, 23 bp, Artificial Sequence
  epidermal growth factor receptor (EGFR), ERBB1 phosphotyrosine kinase siRNA
aagggctccacagctgaaaatgc

SEQ ID NO: 8628 - DNA, 23 bp, Artificial Sequence
  epidermal growth factor receptor (EGFR), ERBB1 phosphotyrosine kinase siRNA
agggctccacagctgaaaatgca

SEQ ID NO: 8629 - DNA, 23 bp, Artificial Sequence
  epidermal growth factor receptor (EGFR), ERBB1 phosphotyrosine kinase siRNA
gggctccacagctgaaaatgcag

SEQ ID NO: 8630 - DNA, 23 bp, Artificial Sequence
  epidermal growth factor receptor (EGFR), ERBB1 phosphotyrosine kinase siRNA
ggctccacagctgaaaatgcaga

SEQ ID NO: 8631 - DNA, 23 bp, Artificial Sequence
  epidermal growth factor receptor (EGFR), ERBB1 phosphotyrosine kinase siRNA
gctccacagctgaaaatgcagaa

SEQ ID NO: 8632 - DNA, 23 bp, Artificial Sequence
  epidermal growth factor receptor (EGFR), ERBB1 phosphotyrosine kinase siRNA
ctccacagctgaaaatgcagaat

SEQ ID NO: 8633 - DNA, 23 bp, Artificial Sequence
  epidermal growth factor receptor (EGFR), ERBB1 phosphotyrosine kinase siRNA
tccacagctgaaaatgcagaata

SEQ ID NO: 8634 - DNA, 23 bp, Artificial Sequence
  epidermal growth factor receptor (EGFR), ERBB1 phosphotyrosine kinase siRNA
ccacagctgaaaatgcagaatac

SEQ ID NO: 8635 - DNA, 23 bp, Artificial Sequence
  epidermal growth factor receptor (EGFR), ERBB1 phosphotyrosine kinase siRNA
cacagctgaaaatgcagaatacc

SEQ ID NO: 8636 - DNA, 23 bp, Artificial Sequence
  epidermal growth factor receptor (EGFR), ERBB1 phosphotyrosine kinase siRNA
acagctgaaaatgcagaatacct

SEQ ID NO: 8637 - DNA, 23 bp, Artificial Sequence
  epidermal growth factor receptor (EGFR), ERBB1 phosphotyrosine kinase siRNA
cagctgaaaatgcagaataccta

SEQ ID NO: 8638 - DNA, 23 bp, Artificial Sequence
  epidermal growth factor receptor (EGFR), ERBB1 phosphotyrosine kinase siRNA
agctgaaaatgcagaatacctaa

SEQ ID NO: 8639 - DNA, 23 bp, Artificial Sequence
  epidermal growth factor receptor (EGFR), ERBB1 phosphotyrosine kinase siRNA
gctgaaaatgcagaatacctaag

SEQ ID NO: 8640 - DNA, 23 bp, Artificial Sequence
  epidermal growth factor receptor (EGFR), ERBB1 phosphotyrosine kinase siRNA
ctgaaaatgcagaatacctaagg

SEQ ID NO: 8641 - DNA, 23 bp, Artificial Sequence
  epidermal growth factor receptor (EGFR), ERBB1 phosphotyrosine kinase siRNA
tgaaaatgcagaatacctaaggg

SEQ ID NO: 8642 - DNA, 23 bp, Artificial Sequence
  epidermal growth factor receptor (EGFR), ERBB1 phosphotyrosine kinase siRNA
gaaaatgcagaatacctaagggt

SEQ ID NO: 8643 - DNA, 23 bp, Artificial Sequence
  epidermal growth factor receptor (EGFR), ERBB1 phosphotyrosine kinase siRNA
aaaatgcagaatacctaagggtc

SEQ ID NO: 8644 - DNA, 23 bp, Artificial Sequence
  epidermal growth factor receptor (EGFR), ERBB1 phosphotyrosine kinase siRNA
aaatgcagaatacctaagggtcg

SEQ ID NO: 8645 - DNA, 23 bp, Artificial Sequence
  epidermal growth factor receptor (EGFR), ERBB1 phosphotyrosine kinase siRNA
aatgcagaatacctaagggtcgc

SEQ ID NO: 8646 - DNA, 23 bp, Artificial Sequence
  epidermal growth factor receptor (EGFR), ERBB1 phosphotyrosine kinase siRNA
atgcagaatacctaagggtcgcg

SEQ ID NO: 8647 - DNA, 23 bp, Artificial Sequence
  epidermal growth factor receptor (EGFR), ERBB1 phosphotyrosine kinase siRNA
tgcagaatacctaagggtcgcgc

SEQ ID NO: 8648 - DNA, 23 bp, Artificial Sequence
  epidermal growth factor receptor (EGFR), ERBB1 phosphotyrosine kinase siRNA
gcagaatacctaagggtcgcgcc

SEQ ID NO: 8649 - DNA, 23 bp, Artificial Sequence
  epidermal growth factor receptor (EGFR), ERBB1 phosphotyrosine kinase siRNA
cagaatacctaagggtcgcgcca

SEQ ID NO: 8650 - DNA, 23 bp, Artificial Sequence
  epidermal growth factor receptor (EGFR), ERBB1 phosphotyrosine kinase siRNA
agaatacctaagggtcgcgccac

SEQ ID NO: 8651 - DNA, 23 bp, Artificial Sequence
  epidermal growth factor receptor (EGFR), ERBB1 phosphotyrosine kinase siRNA
gaatacctaagggtcgcgccaca

SEQ ID NO: 8652 - DNA, 23 bp, Artificial Sequence
  epidermal growth factor receptor (EGFR), ERBB1 phosphotyrosine kinase siRNA
aatacctaagggtcgcgccacaa

SEQ ID NO: 8653 - DNA, 23 bp, Artificial Sequence
  epidermal growth factor receptor (EGFR), ERBB1 phosphotyrosine kinase siRNA
atacctaagggtcgcgccacaaa

SEQ ID NO: 8654 - DNA, 23 bp, Artificial Sequence
  epidermal growth factor receptor (EGFR), ERBB1 phosphotyrosine kinase siRNA
tacctaagggtcgcgccacaaag

SEQ ID NO: 8655 - DNA, 23 bp, Artificial Sequence
  epidermal growth factor receptor (EGFR), ERBB1 phosphotyrosine kinase siRNA
acctaagggtcgcgccacaaagc

SEQ ID NO: 8656 - DNA, 23 bp, Artificial Sequence
  epidermal growth factor receptor (EGFR), ERBB1 phosphotyrosine kinase siRNA
cctaagggtcgcgccacaaagca

SEQ ID NO: 8657 - DNA, 23 bp, Artificial Sequence
  epidermal growth factor receptor (EGFR), ERBB1 phosphotyrosine kinase siRNA
ctaagggtcgcgccacaaagcag

SEQ ID NO: 8658 - DNA, 23 bp, Artificial Sequence
  epidermal growth factor receptor (EGFR), ERBB1 phosphotyrosine kinase siRNA
taagggtcgcgccacaaagcagt

SEQ ID NO: 8659 - DNA, 23 bp, Artificial Sequence
  epidermal growth factor receptor (EGFR), ERBB1 phosphotyrosine kinase siRNA
aagggtcgcgccacaaagcagtg

SEQ ID NO: 8660 - DNA, 23 bp, Artificial Sequence
  epidermal growth factor receptor (EGFR), ERBB1 phosphotyrosine kinase siRNA
agggtcgcgccacaaagcagtga

SEQ ID NO: 8661 - DNA, 23 bp, Artificial Sequence
  epidermal growth factor receptor (EGFR), ERBB1 phosphotyrosine kinase siRNA
gggtcgcgccacaaagcagtgaa

SEQ ID NO: 8662 - DNA, 23 bp, Artificial Sequence
  epidermal growth factor receptor (EGFR), ERBB1 phosphotyrosine kinase siRNA
ggtcgcgccacaaagcagtgaat

SEQ ID NO: 8663 - DNA, 23 bp, Artificial Sequence
  epidermal growth factor receptor (EGFR), ERBB1 phosphotyrosine kinase siRNA
gtcgcgccacaaagcagtgaatt

SEQ ID NO: 8664 - DNA, 23 bp, Artificial Sequence
  epidermal growth factor receptor (EGFR), ERBB1 phosphotyrosine kinase siRNA
tcgcgccacaaagcagtgaattt

SEQ ID NO: 8665 - DNA, 23 bp, Artificial Sequence
  epidermal growth factor receptor (EGFR), ERBB1 phosphotyrosine kinase siRNA
cgcgccacaaagcagtgaattta

SEQ ID NO: 8666 - DNA, 23 bp, Artificial Sequence
  epidermal growth factor receptor (EGFR), ERBB1 phosphotyrosine kinase siRNA
gcgccacaaagcagtgaatttat

SEQ ID NO: 8667 - DNA, 23 bp, Artificial Sequence
  epidermal growth factor receptor (EGFR), ERBB1 phosphotyrosine kinase siRNA
cgccacaaagcagtgaatttatt

SEQ ID NO: 8668 - DNA, 23 bp, Artificial Sequence
  epidermal growth factor receptor (EGFR), ERBB1 phosphotyrosine kinase siRNA
gccacaaagcagtgaatttattg

SEQ ID NO: 8669 - DNA, 23 bp, Artificial Sequence
  epidermal growth factor receptor (EGFR), ERBB1 phosphotyrosine kinase siRNA
ccacaaagcagtgaatttattgg

SEQ ID NO: 8670 - DNA, 23 bp, Artificial Sequence
  epidermal growth factor receptor (EGFR), ERBB1 phosphotyrosine kinase siRNA
cacaaagcagtgaatttattgga

SEQ ID NO: 8671 - DNA, 23 bp, Artificial Sequence
  epidermal growth factor receptor (EGFR), ERBB1 phosphotyrosine kinase siRNA
acaaagcagtgaatttattggag

SEQ ID NO: 8672 - DNA, 23 bp, Artificial Sequence
  epidermal growth factor receptor (EGFR), ERBB1 phosphotyrosine kinase siRNA
caaagcagtgaatttattggagc

SEQ ID NO: 8673 - DNA, 23 bp, Artificial Sequence
  epidermal growth factor receptor (EGFR), ERBB1 phosphotyrosine kinase siRNA
aaagcagtgaatttattggagca

SEQ ID NO: 8674 - DNA, 23 bp, Artificial Sequence
  epidermal growth factor receptor (EGFR), ERBB1 phosphotyrosine kinase siRNA
aagcagtgaatttattggagcat

SEQ ID NO: 8675 - DNA, 23 bp, Artificial Sequence
  epidermal growth factor receptor (EGFR), ERBB1 phosphotyrosine kinase siRNA
agcagtgaatttattggagcatg

SEQ ID NO: 8676 - DNA, 23 bp, Artificial Sequence
  epidermal growth factor receptor (EGFR), ERBB1 phosphotyrosine kinase siRNA
ccacggaggatagtatgagccct

SEQ ID NO: 8677 - DNA, 23 bp, Artificial Sequence
  epidermal growth factor receptor (EGFR), ERBB1 phosphotyrosine kinase siRNA
cacggaggatagtatgagcccta

SEQ ID NO: 8678 - DNA, 23 bp, Artificial Sequence
  epidermal growth factor receptor (EGFR), ERBB1 phosphotyrosine kinase siRNA
acggaggatagtatgagccctaa

SEQ ID NO: 8679 - DNA, 23 bp, Artificial Sequence
  epidermal growth factor receptor (EGFR), ERBB1 phosphotyrosine kinase siRNA
cggaggatagtatgagccctaaa

SEQ ID NO: 8680 - DNA, 23 bp, Artificial Sequence
  epidermal growth factor receptor (EGFR), ERBB1 phosphotyrosine kinase siRNA
ggaggatagtatgagccctaaaa

SEQ ID NO: 8681 - DNA, 23 bp, Artificial Sequence
  epidermal growth factor receptor (EGFR), ERBB1 phosphotyrosine kinase siRNA
gaggatagtatgagccctaaaaa

SEQ ID NO: 8682 - DNA, 23 bp, Artificial Sequence
  epidermal growth factor receptor (EGFR), ERBB1 phosphotyrosine kinase siRNA
aggatagtatgagccctaaaaat

SEQ ID NO: 8683 - DNA, 23 bp, Artificial Sequence
  epidermal growth factor receptor (EGFR), ERBB1 phosphotyrosine kinase siRNA
ggatagtatgagccctaaaaatc

SEQ ID NO: 8684 - DNA, 23 bp, Artificial Sequence
  epidermal growth factor receptor (EGFR), ERBB1 phosphotyrosine kinase siRNA
gatagtatgagccctaaaaatcc

SEQ ID NO: 8685 - DNA, 23 bp, Artificial Sequence
  epidermal growth factor receptor (EGFR), ERBB1 phosphotyrosine kinase siRNA
atagtatgagccctaaaaatcca

SEQ ID NO: 8686 - DNA, 23 bp, Artificial Sequence
  epidermal growth factor receptor (EGFR), ERBB1 phosphotyrosine kinase siRNA
tagtatgagccctaaaaatccag

SEQ ID NO: 8687 - DNA, 23 bp, Artificial Sequence
  epidermal growth factor receptor (EGFR), ERBB1 phosphotyrosine kinase siRNA
agtatgagccctaaaaatccaga

SEQ ID NO: 8688 - DNA, 23 bp, Artificial Sequence
  epidermal growth factor receptor (EGFR), ERBB1 phosphotyrosine kinase siRNA
gtatgagccctaaaaatccagac

SEQ ID NO: 8689 - DNA, 23 bp, Artificial Sequence
  epidermal growth factor receptor (EGFR), ERBB1 phosphotyrosine kinase siRNA
tatgagccctaaaaatccagact

SEQ ID NO: 8690 - DNA, 23 bp, Artificial Sequence
  epidermal growth factor receptor (EGFR), ERBB1 phosphotyrosine kinase siRNA
atgagccctaaaaatccagactc

SEQ ID NO: 8691 - DNA, 23 bp, Artificial Sequence
  epidermal growth factor receptor (EGFR), ERBB1 phosphotyrosine kinase siRNA
tgagccctaaaaatccagactct

SEQ ID NO: 8692 - DNA, 23 bp, Artificial Sequence
  epidermal growth factor receptor (EGFR), ERBB1 phosphotyrosine kinase siRNA
gagccctaaaaatccagactctt

SEQ ID NO: 8693 - DNA, 23 bp, Artificial Sequence
  epidermal growth factor receptor (EGFR), ERBB1 phosphotyrosine kinase siRNA
agccctaaaaatccagactcttt

SEQ ID NO: 8694 - DNA, 23 bp, Artificial Sequence
  epidermal growth factor receptor (EGFR), ERBB1 phosphotyrosine kinase siRNA
gccctaaaaatccagactctttc

SEQ ID NO: 8695 - DNA, 23 bp, Artificial Sequence
  epidermal growth factor receptor (EGFR), ERBB1 phosphotyrosine kinase siRNA
ccctaaaaatccagactctttcg

SEQ ID NO: 8696 - DNA, 23 bp, Artificial Sequence
  epidermal growth factor receptor (EGFR), ERBB1 phosphotyrosine kinase siRNA
cctaaaaatccagactctttcga

SEQ ID NO: 8697 - DNA, 23 bp, Artificial Sequence
  epidermal growth factor receptor (EGFR), ERBB1 phosphotyrosine kinase siRNA
ctaaaaatccagactctttcgat

SEQ ID NO: 8698 - DNA, 23 bp, Artificial Sequence
  epidermal growth factor receptor (EGFR), ERBB1 phosphotyrosine kinase siRNA
taaaaatccagactctttcgata

SEQ ID NO: 8699 - DNA, 23 bp, Artificial Sequence
  epidermal growth factor receptor (EGFR), ERBB1 phosphotyrosine kinase siRNA
aaaaatccagactctttcgatac

SEQ ID NO: 8700 - DNA, 23 bp, Artificial Sequence
  epidermal growth factor receptor (EGFR), ERBB1 phosphotyrosine kinase siRNA
aaaatccagactctttcgatacc

SEQ ID NO: 8701 - DNA, 23 bp, Artificial Sequence
  epidermal growth factor receptor (EGFR), ERBB1 phosphotyrosine kinase siRNA
aaatccagactctttcgataccc

SEQ ID NO: 8702 - DNA, 23 bp, Artificial Sequence
  epidermal growth factor receptor (EGFR), ERBB1 phosphotyrosine kinase siRNA
aatccagactctttcgataccca

SEQ ID NO: 8703 - DNA, 23 bp, Artificial Sequence
  epidermal growth factor receptor (EGFR), ERBB1 phosphotyrosine kinase siRNA
atccagactctttcgatacccag

SEQ ID NO: 8704 - DNA, 23 bp, Artificial Sequence
  epidermal growth factor receptor (EGFR), ERBB1 phosphotyrosine kinase siRNA
tccagactctttcgatacccagg

SEQ ID NO: 8705 - DNA, 23 bp, Artificial Sequence
  epidermal growth factor receptor (EGFR), ERBB1 phosphotyrosine kinase siRNA
ccagactctttcgatacccagga

SEQ ID NO: 8706 - DNA, 23 bp, Artificial Sequence
  epidermal growth factor receptor (EGFR), ERBB1 phosphotyrosine kinase siRNA
cagactctttcgatacccaggac

SEQ ID NO: 8707 - DNA, 23 bp, Artificial Sequence
  epidermal growth factor receptor (EGFR), ERBB1 phosphotyrosine kinase siRNA
agactctttcgatacccaggacc

SEQ ID NO: 8708 - DNA, 23 bp, Artificial Sequence
  epidermal growth factor receptor (EGFR), ERBB1 phosphotyrosine kinase siRNA
gactctttcgatacccaggacca

SEQ ID NO: 8709 - DNA, 23 bp, Artificial Sequence
  epidermal growth factor receptor (EGFR), ERBB1 phosphotyrosine kinase siRNA
actctttcgatacccaggaccaa

SEQ ID NO: 8710 - DNA, 23 bp, Artificial Sequence
  epidermal growth factor receptor (EGFR), ERBB1 phosphotyrosine kinase siRNA
ctctttcgatacccaggaccaag

SEQ ID NO: 8711 - DNA, 23 bp, Artificial Sequence
  epidermal growth factor receptor (EGFR), ERBB1 phosphotyrosine kinase siRNA
tctttcgatacccaggaccaagc

SEQ ID NO: 8712 - DNA, 23 bp, Artificial Sequence
  epidermal growth factor receptor (EGFR), ERBB1 phosphotyrosine kinase siRNA
ctttcgatacccaggaccaagcc

SEQ ID NO: 8713 - DNA, 23 bp, Artificial Sequence
  epidermal growth factor receptor (EGFR), ERBB1 phosphotyrosine kinase siRNA
tttcgatacccaggaccaagcca

SEQ ID NO: 8714 - DNA, 23 bp, Artificial Sequence
  epidermal growth factor receptor (EGFR), ERBB1 phosphotyrosine kinase siRNA
ttcgatacccaggaccaagccac

SEQ ID NO: 8715 - DNA, 23 bp, Artificial Sequence
  epidermal growth factor receptor (EGFR), ERBB1 phosphotyrosine kinase siRNA
tcgatacccaggaccaagccaca

SEQ ID NO: 8716 - DNA, 23 bp, Artificial Sequence
  epidermal growth factor receptor (EGFR), ERBB1 phosphotyrosine kinase siRNA
cgatacccaggaccaagccacag

SEQ ID NO: 8717 - DNA, 23 bp, Artificial Sequence
  epidermal growth factor receptor (EGFR), ERBB1 phosphotyrosine kinase siRNA
gatacccaggaccaagccacagc

SEQ ID NO: 8718 - DNA, 23 bp, Artificial Sequence
  epidermal growth factor receptor (EGFR), ERBB1 phosphotyrosine kinase siRNA
atacccaggaccaagccacagca

SEQ ID NO: 8719 - DNA, 23 bp, Artificial Sequence
  epidermal growth factor receptor (EGFR), ERBB1 phosphotyrosine kinase siRNA
tacccaggaccaagccacagcag

SEQ ID NO: 8720 - DNA, 23 bp, Artificial Sequence
  epidermal growth factor receptor (EGFR), ERBB1 phosphotyrosine kinase siRNA
acccaggaccaagccacagcagg

SEQ ID NO: 8721 - DNA, 23 bp, Artificial Sequence
  epidermal growth factor receptor (EGFR), ERBB1 phosphotyrosine kinase siRNA
cccaggaccaagccacagcaggt

SEQ ID NO: 8722 - DNA, 23 bp, Artificial Sequence
  epidermal growth factor receptor (EGFR), ERBB1 phosphotyrosine kinase siRNA
ccaggaccaagccacagcaggtc

SEQ ID NO: 8723 - DNA, 23 bp, Artificial Sequence
  epidermal growth factor receptor (EGFR), ERBB1 phosphotyrosine kinase siRNA
caggaccaagccacagcaggtcc

SEQ ID NO: 8724 - DNA, 23 bp, Artificial Sequence
  epidermal growth factor receptor (EGFR), ERBB1 phosphotyrosine kinase siRNA
aggaccaagccacagcaggtcct

SEQ ID NO: 8725 - DNA, 23 bp, Artificial Sequence
  epidermal growth factor receptor (EGFR), ERBB1 phosphotyrosine kinase siRNA
ggaccaagccacagcaggtcctc

SEQ ID NO: 8726 - DNA, 23 bp, Artificial Sequence
  epidermal growth factor receptor (EGFR), ERBB1 phosphotyrosine kinase siRNA
gaccaagccacagcaggtcctcc

SEQ ID NO: 8727 - DNA, 23 bp, Artificial Sequence
  epidermal growth factor receptor (EGFR), ERBB1 phosphotyrosine kinase siRNA
accaagccacagcaggtcctcca

SEQ ID NO: 8728 - DNA, 23 bp, Artificial Sequence
  epidermal growth factor receptor (EGFR), ERBB1 phosphotyrosine kinase siRNA
ccaagccacagcaggtcctccat

SEQ ID NO: 8729 - DNA, 23 bp, Artificial Sequence
  epidermal growth factor receptor (EGFR), ERBB1 phosphotyrosine kinase siRNA
caagccacagcaggtcctccatc

SEQ ID NO: 8730 - DNA, 23 bp, Artificial Sequence
  epidermal growth factor receptor (EGFR), ERBB1 phosphotyrosine kinase siRNA
aagccacagcaggtcctccatcc

SEQ ID NO: 8731 - DNA, 23 bp, Artificial Sequence
  epidermal growth factor receptor (EGFR), ERBB1 phosphotyrosine kinase siRNA
agccacagcaggtcctccatccc

SEQ ID NO: 8732 - DNA, 23 bp, Artificial Sequence
  epidermal growth factor receptor (EGFR), ERBB1 phosphotyrosine kinase siRNA
gccacagcaggtcctccatccca

SEQ ID NO: 8733 - DNA, 23 bp, Artificial Sequence
  epidermal growth factor receptor (EGFR), ERBB1 phosphotyrosine kinase siRNA
ccacagcaggtcctccatcccaa

SEQ ID NO: 8734 - DNA, 23 bp, Artificial Sequence
  epidermal growth factor receptor (EGFR), ERBB1 phosphotyrosine kinase siRNA
cacagcaggtcctccatcccaac

SEQ ID NO: 8735 - DNA, 23 bp, Artificial Sequence
  epidermal growth factor receptor (EGFR), ERBB1 phosphotyrosine kinase siRNA
acagcaggtcctccatcccaaca

SEQ ID NO: 8736 - DNA, 23 bp, Artificial Sequence
  epidermal growth factor receptor (EGFR), ERBB1 phosphotyrosine kinase siRNA
cagcaggtcctccatcccaacag

SEQ ID NO: 8737 - DNA, 23 bp, Artificial Sequence
  epidermal growth factor receptor (EGFR), ERBB1 phosphotyrosine kinase siRNA
agcaggtcctccatcccaacagc

SEQ ID NO: 8738 - DNA, 23 bp, Artificial Sequence
  epidermal growth factor receptor (EGFR), ERBB1 phosphotyrosine kinase siRNA
gcaggtcctccatcccaacagcc

SEQ ID NO: 8739 - DNA, 23 bp, Artificial Sequence
  epidermal growth factor receptor (EGFR), ERBB1 phosphotyrosine kinase siRNA
caggtcctccatcccaacagcca

SEQ ID NO: 8740 - DNA, 23 bp, Artificial Sequence
  epidermal growth factor receptor (EGFR), ERBB1 phosphotyrosine kinase siRNA
aggtcctccatcccaacagccat

SEQ ID NO: 8741 - DNA, 23 bp, Artificial Sequence
  epidermal growth factor receptor (EGFR), ERBB1 phosphotyrosine kinase siRNA
ggtcctccatcccaacagccatg

SEQ ID NO: 8742 - DNA, 23 bp, Artificial Sequence
  epidermal growth factor receptor (EGFR), ERBB1 phosphotyrosine kinase siRNA
gtcctccatcccaacagccatgc

SEQ ID NO: 8743 - DNA, 23 bp, Artificial Sequence
  epidermal growth factor receptor (EGFR), ERBB1 phosphotyrosine kinase siRNA
tcctccatcccaacagccatgcc

SEQ ID NO: 8744 - DNA, 23 bp, Artificial Sequence
  epidermal growth factor receptor (EGFR), ERBB1 phosphotyrosine kinase siRNA
cctccatcccaacagccatgccc

SEQ ID NO: 8745 - DNA, 23 bp, Artificial Sequence
  epidermal growth factor receptor (EGFR), ERBB1 phosphotyrosine kinase siRNA
ctccatcccaacagccatgcccg

SEQ ID NO: 8746 - DNA, 23 bp, Artificial Sequence
  epidermal growth factor receptor (EGFR), ERBB1 phosphotyrosine kinase siRNA
tccatcccaacagccatgcccgc

SEQ ID NO: 8747 - DNA, 23 bp, Artificial Sequence
  epidermal growth factor receptor (EGFR), ERBB1 phosphotyrosine kinase siRNA
ccatcccaacagccatgcccgca

SEQ ID NO: 8748 - DNA, 23 bp, Artificial Sequence
  epidermal growth factor receptor (EGFR), ERBB1 phosphotyrosine kinase siRNA
catcccaacagccatgcccgcat

SEQ ID NO: 8749 - DNA, 23 bp, Artificial Sequence
  epidermal growth factor receptor (EGFR), ERBB1 phosphotyrosine kinase siRNA
atcccaacagccatgcccgcatt

SEQ ID NO: 8750 - DNA, 23 bp, Artificial Sequence
  epidermal growth factor receptor (EGFR), ERBB1 phosphotyrosine kinase siRNA
tcccaacagccatgcccgcatta

SEQ ID NO: 8751 - DNA, 23 bp, Artificial Sequence
  epidermal growth factor receptor (EGFR), ERBB1 phosphotyrosine kinase siRNA
cccaacagccatgcccgcattag

SEQ ID NO: 8752 - DNA, 23 bp, Artificial Sequence
  epidermal growth factor receptor (EGFR), ERBB1 phosphotyrosine kinase siRNA
ccaacagccatgcccgcattagc

SEQ ID NO: 8753 - DNA, 23 bp, Artificial Sequence
  epidermal growth factor receptor (EGFR), ERBB1 phosphotyrosine kinase siRNA
caacagccatgcccgcattagct

SEQ ID NO: 8754 - DNA, 23 bp, Artificial Sequence
  epidermal growth factor receptor (EGFR), ERBB1 phosphotyrosine kinase siRNA
aacagccatgcccgcattagctc

SEQ ID NO: 8755 - DNA, 23 bp, Artificial Sequence
  epidermal growth factor receptor (EGFR), ERBB1 phosphotyrosine kinase siRNA
acagccatgcccgcattagctct

SEQ ID NO: 8756 - DNA, 23 bp, Artificial Sequence
  epidermal growth factor receptor (EGFR), ERBB1 phosphotyrosine kinase siRNA
cagccatgcccgcattagctctt

SEQ ID NO: 8757 - DNA, 23 bp, Artificial Sequence
  epidermal growth factor receptor (EGFR), ERBB1 phosphotyrosine kinase siRNA
agccatgcccgcattagctctta

SEQ ID NO: 8758 - DNA, 23 bp, Artificial Sequence
  epidermal growth factor receptor (EGFR), ERBB1 phosphotyrosine kinase siRNA
gccatgcccgcattagctcttag

SEQ ID NO: 8759 - DNA, 23 bp, Artificial Sequence
  epidermal growth factor receptor (EGFR), ERBB1 phosphotyrosine kinase siRNA
ccatgcccgcattagctcttaga

SEQ ID NO: 8760 - DNA, 23 bp, Artificial Sequence
  epidermal growth factor receptor (EGFR), ERBB1 phosphotyrosine kinase siRNA
catgcccgcattagctcttagac

SEQ ID NO: 8761 - DNA, 23 bp, Artificial Sequence
  epidermal growth factor receptor (EGFR), ERBB1 phosphotyrosine kinase siRNA
atgcccgcattagctcttagacc

SEQ ID NO: 8762 - DNA, 23 bp, Artificial Sequence
  epidermal growth factor receptor (EGFR), ERBB1 phosphotyrosine kinase siRNA
tgcccgcattagctcttagaccc

SEQ ID NO: 8763 - DNA, 23 bp, Artificial Sequence
  epidermal growth factor receptor (EGFR), ERBB1 phosphotyrosine kinase siRNA
gcccgcattagctcttagaccca

SEQ ID NO: 8764 - DNA, 23 bp, Artificial Sequence
  epidermal growth factor receptor (EGFR), ERBB1 phosphotyrosine kinase siRNA
cccgcattagctcttagacccac

SEQ ID NO: 8765 - DNA, 23 bp, Artificial Sequence
  epidermal growth factor receptor (EGFR), ERBB1 phosphotyrosine kinase siRNA
ccgcattagctcttagacccaca

SEQ ID NO: 8766 - DNA, 23 bp, Artificial Sequence
  epidermal growth factor receptor (EGFR), ERBB1 phosphotyrosine kinase siRNA
cgcattagctcttagacccacag

SEQ ID NO: 8767 - DNA, 23 bp, Artificial Sequence
  epidermal growth factor receptor (EGFR), ERBB1 phosphotyrosine kinase siRNA
gcattagctcttagacccacaga

SEQ ID NO: 8768 - DNA, 23 bp, Artificial Sequence
  epidermal growth factor receptor (EGFR), ERBB1 phosphotyrosine kinase siRNA
cattagctcttagacccacagac

SEQ ID NO: 8769 - DNA, 23 bp, Artificial Sequence
  epidermal growth factor receptor (EGFR), ERBB1 phosphotyrosine kinase siRNA
attagctcttagacccacagact

SEQ ID NO: 8770 - DNA, 23 bp, Artificial Sequence
  epidermal growth factor receptor (EGFR), ERBB1 phosphotyrosine kinase siRNA
ttagctcttagacccacagactg

SEQ ID NO: 8771 - DNA, 23 bp, Artificial Sequence
  epidermal growth factor receptor (EGFR), ERBB1 phosphotyrosine kinase siRNA
tagctcttagacccacagactgg

SEQ ID NO: 8772 - DNA, 23 bp, Artificial Sequence
  epidermal growth factor receptor (EGFR), ERBB1 phosphotyrosine kinase siRNA
agctcttagacccacagactggt

SEQ ID NO: 8773 - DNA, 23 bp, Artificial Sequence
  epidermal growth factor receptor (EGFR), ERBB1 phosphotyrosine kinase siRNA
gctcttagacccacagactggtt

SEQ ID NO: 8774 - DNA, 23 bp, Artificial Sequence
  epidermal growth factor receptor (EGFR), ERBB1 phosphotyrosine kinase siRNA
ctcttagacccacagactggttt

SEQ ID NO: 8775 - DNA, 23 bp, Artificial Sequence
  epidermal growth factor receptor (EGFR), ERBB1 phosphotyrosine kinase siRNA
tcttagacccacagactggtttt

SEQ ID NO: 8776 - DNA, 23 bp, Artificial Sequence
  epidermal growth factor receptor (EGFR), ERBB1 phosphotyrosine kinase siRNA
cttagacccacagactggttttg

SEQ ID NO: 8777 - DNA, 23 bp, Artificial Sequence
  epidermal growth factor receptor (EGFR), ERBB1 phosphotyrosine kinase siRNA
ttagacccacagactggttttgc

SEQ ID NO: 8778 - DNA, 23 bp, Artificial Sequence
  epidermal growth factor receptor (EGFR), ERBB1 phosphotyrosine kinase siRNA
tagacccacagactggttttgca

SEQ ID NO: 8779 - DNA, 23 bp, Artificial Sequence
  epidermal growth factor receptor (EGFR), ERBB1 phosphotyrosine kinase siRNA
agacccacagactggttttgcaa

SEQ ID NO: 8780 - DNA, 23 bp, Artificial Sequence
  epidermal growth factor receptor (EGFR), ERBB1 phosphotyrosine kinase siRNA
gacccacagactggttttgcaac

SEQ ID NO: 8781 - DNA, 23 bp, Artificial Sequence
  epidermal growth factor receptor (EGFR), ERBB1 phosphotyrosine kinase siRNA
acccacagactggttttgcaacg

SEQ ID NO: 8782 - DNA, 23 bp, Artificial Sequence
  epidermal growth factor receptor (EGFR), ERBB1 phosphotyrosine kinase siRNA
cccacagactggttttgcaacgt

SEQ ID NO: 8783 - DNA, 23 bp, Artificial Sequence
  epidermal growth factor receptor (EGFR), ERBB1 phosphotyrosine kinase siRNA
ccacagactggttttgcaacgtt

SEQ ID NO: 8784 - DNA, 23 bp, Artificial Sequence
  epidermal growth factor receptor (EGFR), ERBB1 phosphotyrosine kinase siRNA
cacagactggttttgcaacgttt

SEQ ID NO: 8785 - DNA, 23 bp, Artificial Sequence
  epidermal growth factor receptor (EGFR), ERBB1 phosphotyrosine kinase siRNA
acagactggttttgcaacgttta

SEQ ID NO: 8786 - DNA, 23 bp, Artificial Sequence
  epidermal growth factor receptor (EGFR), ERBB1 phosphotyrosine kinase siRNA
cagactggttttgcaacgtttac

SEQ ID NO: 8787 - DNA, 23 bp, Artificial Sequence
  epidermal growth factor receptor (EGFR), ERBB1 phosphotyrosine kinase siRNA
agactggttttgcaacgtttaca

SEQ ID NO: 8788 - DNA, 23 bp, Artificial Sequence
  epidermal growth factor receptor (EGFR), ERBB1 phosphotyrosine kinase siRNA
gactggttttgcaacgtttacac

SEQ ID NO: 8789 - DNA, 23 bp, Artificial Sequence
  epidermal growth factor receptor (EGFR), ERBB1 phosphotyrosine kinase siRNA
actggttttgcaacgtttacacc

SEQ ID NO: 8790 - DNA, 23 bp, Artificial Sequence
  epidermal growth factor receptor (EGFR), ERBB1 phosphotyrosine kinase siRNA
ctggttttgcaacgtttacaccg

SEQ ID NO: 8791 - DNA, 23 bp, Artificial Sequence
  epidermal growth factor receptor (EGFR), ERBB1 phosphotyrosine kinase siRNA
tggttttgcaacgtttacaccga

SEQ ID NO: 8792 - DNA, 23 bp, Artificial Sequence
  epidermal growth factor receptor (EGFR), ERBB1 phosphotyrosine kinase siRNA
ggttttgcaacgtttacaccgac

SEQ ID NO: 8793 - DNA, 23 bp, Artificial Sequence
  epidermal growth factor receptor (EGFR), ERBB1 phosphotyrosine kinase siRNA
gttttgcaacgtttacaccgact

SEQ ID NO: 8794 - DNA, 23 bp, Artificial Sequence
  epidermal growth factor receptor (EGFR), ERBB1 phosphotyrosine kinase siRNA
ttttgcaacgtttacaccgacta

SEQ ID NO: 8795 - DNA, 23 bp, Artificial Sequence
  epidermal growth factor receptor (EGFR), ERBB1 phosphotyrosine kinase siRNA
tttgcaacgtttacaccgactag

SEQ ID NO: 8796 - DNA, 23 bp, Artificial Sequence
  epidermal growth factor receptor (EGFR), ERBB1 phosphotyrosine kinase siRNA
ttgcaacgtttacaccgactagc

SEQ ID NO: 8797 - DNA, 23 bp, Artificial Sequence
  epidermal growth factor receptor (EGFR), ERBB1 phosphotyrosine kinase siRNA
tgcaacgtttacaccgactagcc

SEQ ID NO: 8798 - DNA, 23 bp, Artificial Sequence
  epidermal growth factor receptor (EGFR), ERBB1 phosphotyrosine kinase siRNA
gcaacgtttacaccgactagcca

SEQ ID NO: 8799 - DNA, 23 bp, Artificial Sequence
  epidermal growth factor receptor (EGFR), ERBB1 phosphotyrosine kinase siRNA
caacgtttacaccgactagccag

SEQ ID NO: 8800 - DNA, 23 bp, Artificial Sequence
  epidermal growth factor receptor (EGFR), ERBB1 phosphotyrosine kinase siRNA
aacgtttacaccgactagccagg

SEQ ID NO: 8801 - DNA, 23 bp, Artificial Sequence
  epidermal growth factor receptor (EGFR), ERBB1 phosphotyrosine kinase siRNA
acgtttacaccgactagccagga

SEQ ID NO: 8802 - DNA, 23 bp, Artificial Sequence
  epidermal growth factor receptor (EGFR), ERBB1 phosphotyrosine kinase siRNA
cgtttacaccgactagccaggaa

SEQ ID NO: 8803 - DNA, 23 bp, Artificial Sequence
  epidermal growth factor receptor (EGFR), ERBB1 phosphotyrosine kinase siRNA
gtttacaccgactagccaggaag

SEQ ID NO: 8804 - DNA, 23 bp, Artificial Sequence
  epidermal growth factor receptor (EGFR), ERBB1 phosphotyrosine kinase siRNA
tttacaccgactagccaggaagt

SEQ ID NO: 8805 - DNA, 23 bp, Artificial Sequence
  epidermal growth factor receptor (EGFR), ERBB1 phosphotyrosine kinase siRNA
ttacaccgactagccaggaagta

SEQ ID NO: 8806 - DNA, 23 bp, Artificial Sequence
  epidermal growth factor receptor (EGFR), ERBB1 phosphotyrosine kinase siRNA
tacaccgactagccaggaagtac

SEQ ID NO: 8807 - DNA, 23 bp, Artificial Sequence
  epidermal growth factor receptor (EGFR), ERBB1 phosphotyrosine kinase siRNA
acaccgactagccaggaagtact

SEQ ID NO: 8808 - DNA, 23 bp, Artificial Sequence
  epidermal growth factor receptor (EGFR), ERBB1 phosphotyrosine kinase siRNA
caccgactagccaggaagtactt

SEQ ID NO: 8809 - DNA, 23 bp, Artificial Sequence
  epidermal growth factor receptor (EGFR), ERBB1 phosphotyrosine kinase siRNA
accgactagccaggaagtacttc

SEQ ID NO: 8810 - DNA, 23 bp, Artificial Sequence
  epidermal growth factor receptor (EGFR), ERBB1 phosphotyrosine kinase siRNA
ccgactagccaggaagtacttcc

SEQ ID NO: 8811 - DNA, 23 bp, Artificial Sequence
  epidermal growth factor receptor (EGFR), ERBB1 phosphotyrosine kinase siRNA
cgactagccaggaagtacttcca

SEQ ID NO: 8812 - DNA, 23 bp, Artificial Sequence
  epidermal growth factor receptor (EGFR), ERBB1 phosphotyrosine kinase siRNA
gactagccaggaagtacttccac

SEQ ID NO: 8813 - DNA, 23 bp, Artificial Sequence
  epidermal growth factor receptor (EGFR), ERBB1 phosphotyrosine kinase siRNA
actagccaggaagtacttccacc

SEQ ID NO: 8814 - DNA, 23 bp, Artificial Sequence
  epidermal growth factor receptor (EGFR), ERBB1 phosphotyrosine kinase siRNA
ctagccaggaagtacttccacct

SEQ ID NO: 8815 - DNA, 23 bp, Artificial Sequence
  epidermal growth factor receptor (EGFR), ERBB1 phosphotyrosine kinase siRNA
tagccaggaagtacttccacctc

SEQ ID NO: 8816 - DNA, 23 bp, Artificial Sequence
  epidermal growth factor receptor (EGFR), ERBB1 phosphotyrosine kinase siRNA
agccaggaagtacttccacctcg

SEQ ID NO: 8817 - DNA, 23 bp, Artificial Sequence
  epidermal growth factor receptor (EGFR), ERBB1 phosphotyrosine kinase siRNA
gccaggaagtacttccacctcgg

SEQ ID NO: 8818 - DNA, 23 bp, Artificial Sequence
  epidermal growth factor receptor (EGFR), ERBB1 phosphotyrosine kinase siRNA
ccaggaagtacttccacctcggg

SEQ ID NO: 8819 - DNA, 23 bp, Artificial Sequence
  epidermal growth factor receptor (EGFR), ERBB1 phosphotyrosine kinase siRNA
caggaagtacttccacctcgggc

SEQ ID NO: 8820 - DNA, 23 bp, Artificial Sequence
  epidermal growth factor receptor (EGFR), ERBB1 phosphotyrosine kinase siRNA
aggaagtacttccacctcgggca

SEQ ID NO: 8821 - DNA, 23 bp, Artificial Sequence
  epidermal growth factor receptor (EGFR), ERBB1 phosphotyrosine kinase siRNA
ggaagtacttccacctcgggcac

SEQ ID NO: 8822 - DNA, 23 bp, Artificial Sequence
  epidermal growth factor receptor (EGFR), ERBB1 phosphotyrosine kinase siRNA
gaagtacttccacctcgggcaca

SEQ ID NO: 8823 - DNA, 23 bp, Artificial Sequence
  epidermal growth factor receptor (EGFR), ERBB1 phosphotyrosine kinase siRNA
aagtacttccacctcgggcacat

SEQ ID NO: 8824 - DNA, 23 bp, Artificial Sequence
  epidermal growth factor receptor (EGFR), ERBB1 phosphotyrosine kinase siRNA
agtacttccacctcgggcacatt

SEQ ID NO: 8825 - DNA, 23 bp, Artificial Sequence
  epidermal growth factor receptor (EGFR), ERBB1 phosphotyrosine kinase siRNA
gtacttccacctcgggcacattt

SEQ ID NO: 8826 - DNA, 23 bp, Artificial Sequence
  epidermal growth factor receptor (EGFR), ERBB1 phosphotyrosine kinase siRNA
tacttccacctcgggcacatttt

SEQ ID NO: 8827 - DNA, 23 bp, Artificial Sequence
  epidermal growth factor receptor (EGFR), ERBB1 phosphotyrosine kinase siRNA
acttccacctcgggcacattttg

SEQ ID NO: 8828 - DNA, 23 bp, Artificial Sequence
  epidermal growth factor receptor (EGFR), ERBB1 phosphotyrosine kinase siRNA
cttccacctcgggcacattttgg

SEQ ID NO: 8829 - DNA, 23 bp, Artificial Sequence
  epidermal growth factor receptor (EGFR), ERBB1 phosphotyrosine kinase siRNA
ttccacctcgggcacattttggg

SEQ ID NO: 8830 - DNA, 23 bp, Artificial Sequence
  epidermal growth factor receptor (EGFR), ERBB1 phosphotyrosine kinase siRNA
tccacctcgggcacattttggga

SEQ ID NO: 8831 - DNA, 23 bp, Artificial Sequence
  epidermal growth factor receptor (EGFR), ERBB1 phosphotyrosine kinase siRNA
ccacctcgggcacattttgggaa

SEQ ID NO: 8832 - DNA, 23 bp, Artificial Sequence
  epidermal growth factor receptor (EGFR), ERBB1 phosphotyrosine kinase siRNA
cacctcgggcacattttgggaag

SEQ ID NO: 8833 - DNA, 23 bp, Artificial Sequence
  epidermal growth factor receptor (EGFR), ERBB1 phosphotyrosine kinase siRNA
acctcgggcacattttgggaagt

SEQ ID NO: 8834 - DNA, 23 bp, Artificial Sequence
  epidermal growth factor receptor (EGFR), ERBB1 phosphotyrosine kinase siRNA
cctcgggcacattttgggaagtt

SEQ ID NO: 8835 - DNA, 23 bp, Artificial Sequence
  epidermal growth factor receptor (EGFR), ERBB1 phosphotyrosine kinase siRNA
ctcgggcacattttgggaagttg

SEQ ID NO: 8836 - DNA, 23 bp, Artificial Sequence
  epidermal growth factor receptor (EGFR), ERBB1 phosphotyrosine kinase siRNA
tcgggcacattttgggaagttgc

SEQ ID NO: 8837 - DNA, 23 bp, Artificial Sequence
  epidermal growth factor receptor (EGFR), ERBB1 phosphotyrosine kinase siRNA
cgggcacattttgggaagttgca

SEQ ID NO: 8838 - DNA, 23 bp, Artificial Sequence
  epidermal growth factor receptor (EGFR), ERBB1 phosphotyrosine kinase siRNA
gggcacattttgggaagttgcat

SEQ ID NO: 8839 - DNA, 23 bp, Artificial Sequence
  epidermal growth factor receptor (EGFR), ERBB1 phosphotyrosine kinase siRNA
ggcacattttgggaagttgcatt

SEQ ID NO: 8840 - DNA, 23 bp, Artificial Sequence
  epidermal growth factor receptor (EGFR), ERBB1 phosphotyrosine kinase siRNA
gcacattttgggaagttgcattc

SEQ ID NO: 8841 - DNA, 23 bp, Artificial Sequence
  epidermal growth factor receptor (EGFR), ERBB1 phosphotyrosine kinase siRNA
cacattttgggaagttgcattcc

SEQ ID NO: 8842 - DNA, 23 bp, Artificial Sequence
  epidermal growth factor receptor (EGFR), ERBB1 phosphotyrosine kinase siRNA
acattttgggaagttgcattcct

SEQ ID NO: 8843 - DNA, 23 bp, Artificial Sequence
  epidermal growth factor receptor (EGFR), ERBB1 phosphotyrosine kinase siRNA
cattttgggaagttgcattcctt

SEQ ID NO: 8844 - DNA, 23 bp, Artificial Sequence
  epidermal growth factor receptor (EGFR), ERBB1 phosphotyrosine kinase siRNA
attttgggaagttgcattccttt

SEQ ID NO: 8845 - DNA, 23 bp, Artificial Sequence
  epidermal growth factor receptor (EGFR), ERBB1 phosphotyrosine kinase siRNA
ttttgggaagttgcattcctttg

SEQ ID NO: 8846 - DNA, 23 bp, Artificial Sequence
  epidermal growth factor receptor (EGFR), ERBB1 phosphotyrosine kinase siRNA
tttgggaagttgcattcctttgt

SEQ ID NO: 8847 - DNA, 23 bp, Artificial Sequence
  epidermal growth factor receptor (EGFR), ERBB1 phosphotyrosine kinase siRNA
ttgggaagttgcattcctttgtc

SEQ ID NO: 8848 - DNA, 23 bp, Artificial Sequence
  epidermal growth factor receptor (EGFR), ERBB1 phosphotyrosine kinase siRNA
tgggaagttgcattcctttgtct

SEQ ID NO: 8849 - DNA, 23 bp, Artificial Sequence
  epidermal growth factor receptor (EGFR), ERBB1 phosphotyrosine kinase siRNA
gggaagttgcattcctttgtctt

SEQ ID NO: 8850 - DNA, 23 bp, Artificial Sequence
  epidermal growth factor receptor (EGFR), ERBB1 phosphotyrosine kinase siRNA
ggaagttgcattcctttgtcttc

SEQ ID NO: 8851 - DNA, 23 bp, Artificial Sequence
  epidermal growth factor receptor (EGFR), ERBB1 phosphotyrosine kinase siRNA
gaagttgcattcctttgtcttca

SEQ ID NO: 8852 - DNA, 23 bp, Artificial Sequence
  epidermal growth factor receptor (EGFR), ERBB1 phosphotyrosine kinase siRNA
aagttgcattcctttgtcttcaa

SEQ ID NO: 8853 - DNA, 23 bp, Artificial Sequence
  epidermal growth factor receptor (EGFR), ERBB1 phosphotyrosine kinase siRNA
agttgcattcctttgtcttcaaa

SEQ ID NO: 8854 - DNA, 23 bp, Artificial Sequence
  epidermal growth factor receptor (EGFR), ERBB1 phosphotyrosine kinase siRNA
gttgcattcctttgtcttcaaac

SEQ ID NO: 8855 - DNA, 23 bp, Artificial Sequence
  epidermal growth factor receptor (EGFR), ERBB1 phosphotyrosine kinase siRNA
ttgcattcctttgtcttcaaact

SEQ ID NO: 8856 - DNA, 23 bp, Artificial Sequence
  epidermal growth factor receptor (EGFR), ERBB1 phosphotyrosine kinase siRNA
tgcattcctttgtcttcaaactg

SEQ ID NO: 8857 - DNA, 23 bp, Artificial Sequence
  epidermal growth factor receptor (EGFR), ERBB1 phosphotyrosine kinase siRNA
gcattcctttgtcttcaaactgt

SEQ ID NO: 8858 - DNA, 23 bp, Artificial Sequence
  epidermal growth factor receptor (EGFR), ERBB1 phosphotyrosine kinase siRNA
cattcctttgtcttcaaactgtg

SEQ ID NO: 8859 - DNA, 23 bp, Artificial Sequence
  epidermal growth factor receptor (EGFR), ERBB1 phosphotyrosine kinase siRNA
attcctttgtcttcaaactgtga

SEQ ID NO: 8860 - DNA, 23 bp, Artificial Sequence
  epidermal growth factor receptor (EGFR), ERBB1 phosphotyrosine kinase siRNA
ttcctttgtcttcaaactgtgaa

SEQ ID NO: 8861 - DNA, 23 bp, Artificial Sequence
  epidermal growth factor receptor (EGFR), ERBB1 phosphotyrosine kinase siRNA
tcctttgtcttcaaactgtgaag

SEQ ID NO: 8862 - DNA, 23 bp, Artificial Sequence
  epidermal growth factor receptor (EGFR), ERBB1 phosphotyrosine kinase siRNA
cctttgtcttcaaactgtgaagc

SEQ ID NO: 8863 - DNA, 23 bp, Artificial Sequence
  epidermal growth factor receptor (EGFR), ERBB1 phosphotyrosine kinase siRNA
ctttgtcttcaaactgtgaagca

SEQ ID NO: 8864 - DNA, 23 bp, Artificial Sequence
  epidermal growth factor receptor (EGFR), ERBB1 phosphotyrosine kinase siRNA
tttgtcttcaaactgtgaagcat

SEQ ID NO: 8865 - DNA, 23 bp, Artificial Sequence
  epidermal growth factor receptor (EGFR), ERBB1 phosphotyrosine kinase siRNA
ttgtcttcaaactgtgaagcatt

SEQ ID NO: 8866 - DNA, 23 bp, Artificial Sequence
  epidermal growth factor receptor (EGFR), ERBB1 phosphotyrosine kinase siRNA
tgtcttcaaactgtgaagcattt

SEQ ID NO: 8867 - DNA, 23 bp, Artificial Sequence
  epidermal growth factor receptor (EGFR), ERBB1 phosphotyrosine kinase siRNA
gtcttcaaactgtgaagcattta

SEQ ID NO: 8868 - DNA, 23 bp, Artificial Sequence
  epidermal growth factor receptor (EGFR), ERBB1 phosphotyrosine kinase siRNA
tcttcaaactgtgaagcatttac

SEQ ID NO: 8869 - DNA, 23 bp, Artificial Sequence
  epidermal growth factor receptor (EGFR), ERBB1 phosphotyrosine kinase siRNA
cttcaaactgtgaagcatttaca

SEQ ID NO: 8870 - DNA, 23 bp, Artificial Sequence
  epidermal growth factor receptor (EGFR), ERBB1 phosphotyrosine kinase siRNA
ttcaaactgtgaagcatttacag

SEQ ID NO: 8871 - DNA, 23 bp, Artificial Sequence
  epidermal growth factor receptor (EGFR), ERBB1 phosphotyrosine kinase siRNA
tcaaactgtgaagcatttacaga

SEQ ID NO: 8872 - DNA, 23 bp, Artificial Sequence
  epidermal growth factor receptor (EGFR), ERBB1 phosphotyrosine kinase siRNA
caaactgtgaagcatttacagaa

SEQ ID NO: 8873 - DNA, 23 bp, Artificial Sequence
  epidermal growth factor receptor (EGFR), ERBB1 phosphotyrosine kinase siRNA
aaactgtgaagcatttacagaaa

SEQ ID NO: 8874 - DNA, 23 bp, Artificial Sequence
  epidermal growth factor receptor (EGFR), ERBB1 phosphotyrosine kinase siRNA
aactgtgaagcatttacagaaac

SEQ ID NO: 8875 - DNA, 23 bp, Artificial Sequence
  epidermal growth factor receptor (EGFR), ERBB1 phosphotyrosine kinase siRNA
actgtgaagcatttacagaaacg

SEQ ID NO: 8876 - DNA, 23 bp, Artificial Sequence
  epidermal growth factor receptor (EGFR), ERBB1 phosphotyrosine kinase siRNA
ctgtgaagcatttacagaaacgc

SEQ ID NO: 8877 - DNA, 23 bp, Artificial Sequence
  epidermal growth factor receptor (EGFR), ERBB1 phosphotyrosine kinase siRNA
tgtgaagcatttacagaaacgca

SEQ ID NO: 8878 - DNA, 23 bp, Artificial Sequence
  epidermal growth factor receptor (EGFR), ERBB1 phosphotyrosine kinase siRNA
gtgaagcatttacagaaacgcat

SEQ ID NO: 8879 - DNA, 23 bp, Artificial Sequence
  epidermal growth factor receptor (EGFR), ERBB1 phosphotyrosine kinase siRNA
tgaagcatttacagaaacgcatc

SEQ ID NO: 8880 - DNA, 23 bp, Artificial Sequence
  epidermal growth factor receptor (EGFR), ERBB1 phosphotyrosine kinase siRNA
gaagcatttacagaaacgcatcc

SEQ ID NO: 8881 - DNA, 23 bp, Artificial Sequence
  epidermal growth factor receptor (EGFR), ERBB1 phosphotyrosine kinase siRNA
aagcatttacagaaacgcatcca

SEQ ID NO: 8882 - DNA, 23 bp, Artificial Sequence
  epidermal growth factor receptor (EGFR), ERBB1 phosphotyrosine kinase siRNA
agcatttacagaaacgcatccag

SEQ ID NO: 8883 - DNA, 23 bp, Artificial Sequence
  epidermal growth factor receptor (EGFR), ERBB1 phosphotyrosine kinase siRNA
gcatttacagaaacgcatccagc

SEQ ID NO: 8884 - DNA, 23 bp, Artificial Sequence
  epidermal growth factor receptor (EGFR), ERBB1 phosphotyrosine kinase siRNA
catttacagaaacgcatccagca

SEQ ID NO: 8885 - DNA, 23 bp, Artificial Sequence
  epidermal growth factor receptor (EGFR), ERBB1 phosphotyrosine kinase siRNA
atttacagaaacgcatccagcaa

SEQ ID NO: 8886 - DNA, 23 bp, Artificial Sequence
  epidermal growth factor receptor (EGFR), ERBB1 phosphotyrosine kinase siRNA
tttacagaaacgcatccagcaag

SEQ ID NO: 8887 - DNA, 23 bp, Artificial Sequence
  epidermal growth factor receptor (EGFR), ERBB1 phosphotyrosine kinase siRNA
ttacagaaacgcatccagcaaga

SEQ ID NO: 8888 - DNA, 23 bp, Artificial Sequence
  epidermal growth factor receptor (EGFR), ERBB1 phosphotyrosine kinase siRNA
tacagaaacgcatccagcaagaa

SEQ ID NO: 8889 - DNA, 23 bp, Artificial Sequence
  epidermal growth factor receptor (EGFR), ERBB1 phosphotyrosine kinase siRNA
acagaaacgcatccagcaagaat

SEQ ID NO: 8890 - DNA, 23 bp, Artificial Sequence
  epidermal growth factor receptor (EGFR), ERBB1 phosphotyrosine kinase siRNA
cagaaacgcatccagcaagaata

SEQ ID NO: 8891 - DNA, 23 bp, Artificial Sequence
  epidermal growth factor receptor (EGFR), ERBB1 phosphotyrosine kinase siRNA
agaaacgcatccagcaagaatat

SEQ ID NO: 8892 - DNA, 23 bp, Artificial Sequence
  epidermal growth factor receptor (EGFR), ERBB1 phosphotyrosine kinase siRNA
gaaacgcatccagcaagaatatt

SEQ ID NO: 8893 - DNA, 23 bp, Artificial Sequence
  epidermal growth factor receptor (EGFR), ERBB1 phosphotyrosine kinase siRNA
aaacgcatccagcaagaatattg

SEQ ID NO: 8894 - DNA, 23 bp, Artificial Sequence
  epidermal growth factor receptor (EGFR), ERBB1 phosphotyrosine kinase siRNA
aacgcatccagcaagaatattgt

SEQ ID NO: 8895 - DNA, 23 bp, Artificial Sequence
  epidermal growth factor receptor (EGFR), ERBB1 phosphotyrosine kinase siRNA
acgcatccagcaagaatattgtc

SEQ ID NO: 8896 - DNA, 23 bp, Artificial Sequence
  epidermal growth factor receptor (EGFR), ERBB1 phosphotyrosine kinase siRNA
cgcatccagcaagaatattgtcc

SEQ ID NO: 8897 - DNA, 23 bp, Artificial Sequence
  epidermal growth factor receptor (EGFR), ERBB1 phosphotyrosine kinase siRNA
gcatccagcaagaatattgtccc

SEQ ID NO: 8898 - DNA, 23 bp, Artificial Sequence
  epidermal growth factor receptor (EGFR), ERBB1 phosphotyrosine kinase siRNA
catccagcaagaatattgtccct

SEQ ID NO: 8899 - DNA, 23 bp, Artificial Sequence
  epidermal growth factor receptor (EGFR), ERBB1 phosphotyrosine kinase siRNA
atccagcaagaatattgtccctt

SEQ ID NO: 8900 - DNA, 23 bp, Artificial Sequence
  epidermal growth factor receptor (EGFR), ERBB1 phosphotyrosine kinase siRNA
tccagcaagaatattgtcccttt

SEQ ID NO: 8901 - DNA, 23 bp, Artificial Sequence
  epidermal growth factor receptor (EGFR), ERBB1 phosphotyrosine kinase siRNA
ccagcaagaatattgtccctttg

SEQ ID NO: 8902 - DNA, 23 bp, Artificial Sequence
  epidermal growth factor receptor (EGFR), ERBB1 phosphotyrosine kinase siRNA
cagcaagaatattgtccctttga

SEQ ID NO: 8903 - DNA, 23 bp, Artificial Sequence
  epidermal growth factor receptor (EGFR), ERBB1 phosphotyrosine kinase siRNA
agcaagaatattgtccctttgag

SEQ ID NO: 8904 - DNA, 23 bp, Artificial Sequence
  epidermal growth factor receptor (EGFR), ERBB1 phosphotyrosine kinase siRNA
gcaagaatattgtccctttgagc

SEQ ID NO: 8905 - DNA, 23 bp, Artificial Sequence
  epidermal growth factor receptor (EGFR), ERBB1 phosphotyrosine kinase siRNA
caagaatattgtccctttgagca

SEQ ID NO: 8906 - DNA, 23 bp, Artificial Sequence
  epidermal growth factor receptor (EGFR), ERBB1 phosphotyrosine kinase siRNA
aagaatattgtccctttgagcag

SEQ ID NO: 8907 - DNA, 23 bp, Artificial Sequence
  epidermal growth factor receptor (EGFR), ERBB1 phosphotyrosine kinase siRNA
agaatattgtccctttgagcaga

SEQ ID NO: 8908 - DNA, 23 bp, Artificial Sequence
  epidermal growth factor receptor (EGFR), ERBB1 phosphotyrosine kinase siRNA
gaatattgtccctttgagcagaa

SEQ ID NO: 8909 - DNA, 23 bp, Artificial Sequence
  epidermal growth factor receptor (EGFR), ERBB1 phosphotyrosine kinase siRNA
aatattgtccctttgagcagaaa

SEQ ID NO: 8910 - DNA, 23 bp, Artificial Sequence
  epidermal growth factor receptor (EGFR), ERBB1 phosphotyrosine kinase siRNA
atattgtccctttgagcagaaat

SEQ ID NO: 8911 - DNA, 23 bp, Artificial Sequence
  epidermal growth factor receptor (EGFR), ERBB1 phosphotyrosine kinase siRNA
tattgtccctttgagcagaaatt

SEQ ID NO: 8912 - DNA, 23 bp, Artificial Sequence
  epidermal growth factor receptor (EGFR), ERBB1 phosphotyrosine kinase siRNA
attgtccctttgagcagaaattt

SEQ ID NO: 8913 - DNA, 23 bp, Artificial Sequence
  epidermal growth factor receptor (EGFR), ERBB1 phosphotyrosine kinase siRNA
ttgtccctttgagcagaaattta

SEQ ID NO: 8914 - DNA, 23 bp, Artificial Sequence
  epidermal growth factor receptor (EGFR), ERBB1 phosphotyrosine kinase siRNA
tgtccctttgagcagaaatttat

SEQ ID NO: 8915 - DNA, 23 bp, Artificial Sequence
  epidermal growth factor receptor (EGFR), ERBB1 phosphotyrosine kinase siRNA
gtccctttgagcagaaatttatc

SEQ ID NO: 8916 - DNA, 23 bp, Artificial Sequence
  epidermal growth factor receptor (EGFR), ERBB1 phosphotyrosine kinase siRNA
tccctttgagcagaaatttatct

SEQ ID NO: 8917 - DNA, 23 bp, Artificial Sequence
  epidermal growth factor receptor (EGFR), ERBB1 phosphotyrosine kinase siRNA
ccctttgagcagaaatttatctt

SEQ ID NO: 8918 - DNA, 23 bp, Artificial Sequence
  epidermal growth factor receptor (EGFR), ERBB1 phosphotyrosine kinase siRNA
cctttgagcagaaatttatcttt

SEQ ID NO: 8919 - DNA, 23 bp, Artificial Sequence
  epidermal growth factor receptor (EGFR), ERBB1 phosphotyrosine kinase siRNA
ctttgagcagaaatttatctttc

SEQ ID NO: 8920 - DNA, 23 bp, Artificial Sequence
  epidermal growth factor receptor (EGFR), ERBB1 phosphotyrosine kinase siRNA
tttgagcagaaatttatctttca

SEQ ID NO: 8921 - DNA, 23 bp, Artificial Sequence
  epidermal growth factor receptor (EGFR), ERBB1 phosphotyrosine kinase siRNA
ttgagcagaaatttatctttcaa

SEQ ID NO: 8922 - DNA, 23 bp, Artificial Sequence
  epidermal growth factor receptor (EGFR), ERBB1 phosphotyrosine kinase siRNA
tgagcagaaatttatctttcaaa

SEQ ID NO: 8923 - DNA, 23 bp, Artificial Sequence
  epidermal growth factor receptor (EGFR), ERBB1 phosphotyrosine kinase siRNA
gagcagaaatttatctttcaaag

SEQ ID NO: 8924 - DNA, 23 bp, Artificial Sequence
  epidermal growth factor receptor (EGFR), ERBB1 phosphotyrosine kinase siRNA
agcagaaatttatctttcaaaga

SEQ ID NO: 8925 - DNA, 23 bp, Artificial Sequence
  epidermal growth factor receptor (EGFR), ERBB1 phosphotyrosine kinase siRNA
gcagaaatttatctttcaaagag

SEQ ID NO: 8926 - DNA, 23 bp, Artificial Sequence
  epidermal growth factor receptor (EGFR), ERBB1 phosphotyrosine kinase siRNA
cagaaatttatctttcaaagagg

SEQ ID NO: 8927 - DNA, 23 bp, Artificial Sequence
  epidermal growth factor receptor (EGFR), ERBB1 phosphotyrosine kinase siRNA
agaaatttatctttcaaagaggt

SEQ ID NO: 8928 - DNA, 23 bp, Artificial Sequence
  epidermal growth factor receptor (EGFR), ERBB1 phosphotyrosine kinase siRNA
gaaatttatctttcaaagaggta

SEQ ID NO: 8929 - DNA, 23 bp, Artificial Sequence
  epidermal growth factor receptor (EGFR), ERBB1 phosphotyrosine kinase siRNA
aaatttatctttcaaagaggtat

SEQ ID NO: 8930 - DNA, 23 bp, Artificial Sequence
  epidermal growth factor receptor (EGFR), ERBB1 phosphotyrosine kinase siRNA
aatttatctttcaaagaggtata

SEQ ID NO: 8931 - DNA, 23 bp, Artificial Sequence
  epidermal growth factor receptor (EGFR), ERBB1 phosphotyrosine kinase siRNA
atttatctttcaaagaggtatat

SEQ ID NO: 8932 - DNA, 23 bp, Artificial Sequence
  epidermal growth factor receptor (EGFR), ERBB1 phosphotyrosine kinase siRNA
tttatctttcaaagaggtatatt

SEQ ID NO: 8933 - DNA, 23 bp, Artificial Sequence
  epidermal growth factor receptor (EGFR), ERBB1 phosphotyrosine kinase siRNA
ttatctttcaaagaggtatattt

SEQ ID NO: 8934 - DNA, 23 bp, Artificial Sequence
  epidermal growth factor receptor (EGFR), ERBB1 phosphotyrosine kinase siRNA
tatctttcaaagaggtatatttg

SEQ ID NO: 8935 - DNA, 23 bp, Artificial Sequence
  epidermal growth factor receptor (EGFR), ERBB1 phosphotyrosine kinase siRNA
atctttcaaagaggtatatttga

SEQ ID NO: 8936 - DNA, 23 bp, Artificial Sequence
  epidermal growth factor receptor (EGFR), ERBB1 phosphotyrosine kinase siRNA
tctttcaaagaggtatatttgaa

SEQ ID NO: 8937 - DNA, 23 bp, Artificial Sequence
  epidermal growth factor receptor (EGFR), ERBB1 phosphotyrosine kinase siRNA
ctttcaaagaggtatatttgaaa

SEQ ID NO: 8938 - DNA, 23 bp, Artificial Sequence
  epidermal growth factor receptor (EGFR), ERBB1 phosphotyrosine kinase siRNA
tttcaaagaggtatatttgaaaa

SEQ ID NO: 8939 - DNA, 23 bp, Artificial Sequence
  epidermal growth factor receptor (EGFR), ERBB1 phosphotyrosine kinase siRNA
ttcaaagaggtatatttgaaaaa

SEQ ID NO: 8940 - DNA, 23 bp, Artificial Sequence
  epidermal growth factor receptor (EGFR), ERBB1 phosphotyrosine kinase siRNA
tcaaagaggtatatttgaaaaaa

SEQ ID NO: 8941 - DNA, 23 bp, Artificial Sequence
  epidermal growth factor receptor (EGFR), ERBB1 phosphotyrosine kinase siRNA
caaagaggtatatttgaaaaaaa

SEQ ID NO: 8942 - DNA, 23 bp, Artificial Sequence
  epidermal growth factor receptor (EGFR), ERBB1 phosphotyrosine kinase siRNA
aaagaggtatatttgaaaaaaaa

SEQ ID NO: 8943 - DNA, 23 bp, Artificial Sequence
  epidermal growth factor receptor (EGFR), ERBB1 phosphotyrosine kinase siRNA
aaaaaaaagtatatgtgaggatt

SEQ ID NO: 8944 - DNA, 23 bp, Artificial Sequence
  epidermal growth factor receptor (EGFR), ERBB1 phosphotyrosine kinase siRNA
aaaaaaagtatatgtgaggattt

SEQ ID NO: 8945 - DNA, 23 bp, Artificial Sequence
  epidermal growth factor receptor (EGFR), ERBB1 phosphotyrosine kinase siRNA
aaaaaagtatatgtgaggatttt

SEQ ID NO: 8946 - DNA, 23 bp, Artificial Sequence
  epidermal growth factor receptor (EGFR), ERBB1 phosphotyrosine kinase siRNA
aaaaagtatatgtgaggattttt

SEQ ID NO: 8947 - DNA, 23 bp, Artificial Sequence
  epidermal growth factor receptor (EGFR), ERBB1 phosphotyrosine kinase siRNA
aaaagtatatgtgaggattttta

SEQ ID NO: 8948 - DNA, 23 bp, Artificial Sequence
  epidermal growth factor receptor (EGFR), ERBB1 phosphotyrosine kinase siRNA
aaagtatatgtgaggatttttat

SEQ ID NO: 8949 - DNA, 23 bp, Artificial Sequence
  epidermal growth factor receptor (EGFR), ERBB1 phosphotyrosine kinase siRNA
aagtatatgtgaggatttttatt

SEQ ID NO: 8950 - DNA, 23 bp, Artificial Sequence
  epidermal growth factor receptor (EGFR), ERBB1 phosphotyrosine kinase siRNA
agtatatgtgaggatttttattg

SEQ ID NO: 8951 - DNA, 23 bp, Artificial Sequence
  epidermal growth factor receptor (EGFR), ERBB1 phosphotyrosine kinase siRNA
gtatatgtgaggatttttattga

SEQ ID NO: 8952 - DNA, 23 bp, Artificial Sequence
  epidermal growth factor receptor (EGFR), ERBB1 phosphotyrosine kinase siRNA
tatatgtgaggatttttattgat

SEQ ID NO: 8953 - DNA, 23 bp, Artificial Sequence
  epidermal growth factor receptor (EGFR), ERBB1 phosphotyrosine kinase siRNA
atatgtgaggatttttattgatt

SEQ ID NO: 8954 - DNA, 23 bp, Artificial Sequence
  epidermal growth factor receptor (EGFR), ERBB1 phosphotyrosine kinase siRNA
tatgtgaggatttttattgattg

SEQ ID NO: 8955 - DNA, 23 bp, Artificial Sequence
  epidermal growth factor receptor (EGFR), ERBB1 phosphotyrosine kinase siRNA
atgtgaggatttttattgattgg

SEQ ID NO: 8956 - DNA, 23 bp, Artificial Sequence
  epidermal growth factor receptor (EGFR), ERBB1 phosphotyrosine kinase siRNA
tgtgaggatttttattgattggg

SEQ ID NO: 8957 - DNA, 23 bp, Artificial Sequence
  epidermal growth factor receptor (EGFR), ERBB1 phosphotyrosine kinase siRNA
gtgaggatttttattgattgggg

SEQ ID NO: 8958 - DNA, 23 bp, Artificial Sequence
  epidermal growth factor receptor (EGFR), ERBB1 phosphotyrosine kinase siRNA
tgaggatttttattgattgggga

SEQ ID NO: 8959 - DNA, 23 bp, Artificial Sequence
  epidermal growth factor receptor (EGFR), ERBB1 phosphotyrosine kinase siRNA
gaggatttttattgattggggat

SEQ ID NO: 8960 - DNA, 23 bp, Artificial Sequence
  epidermal growth factor receptor (EGFR), ERBB1 phosphotyrosine kinase siRNA
aggatttttattgattggggatc

SEQ ID NO: 8961 - DNA, 23 bp, Artificial Sequence
  epidermal growth factor receptor (EGFR), ERBB1 phosphotyrosine kinase siRNA
ggatttttattgattggggatct

SEQ ID NO: 8962 - DNA, 23 bp, Artificial Sequence
  epidermal growth factor receptor (EGFR), ERBB1 phosphotyrosine kinase siRNA
gatttttattgattggggatctt

SEQ ID NO: 8963 - DNA, 23 bp, Artificial Sequence
  epidermal growth factor receptor (EGFR), ERBB1 phosphotyrosine kinase siRNA
atttttattgattggggatcttg

SEQ ID NO: 8964 - DNA, 23 bp, Artificial Sequence
  epidermal growth factor receptor (EGFR), ERBB1 phosphotyrosine kinase siRNA
tttttattgattggggatcttgg

SEQ ID NO: 8965 - DNA, 23 bp, Artificial Sequence
  epidermal growth factor receptor (EGFR), ERBB1 phosphotyrosine kinase siRNA
ttttattgattggggatcttgga

SEQ ID NO: 8966 - DNA, 23 bp, Artificial Sequence
  epidermal growth factor receptor (EGFR), ERBB1 phosphotyrosine kinase siRNA
tttattgattggggatcttggag

SEQ ID NO: 8967 - DNA, 23 bp, Artificial Sequence
  epidermal growth factor receptor (EGFR), ERBB1 phosphotyrosine kinase siRNA
ttattgattggggatcttggagt

SEQ ID NO: 8968 - DNA, 23 bp, Artificial Sequence
  epidermal growth factor receptor (EGFR), ERBB1 phosphotyrosine kinase siRNA
tattgattggggatcttggagtt

SEQ ID NO: 8969 - DNA, 23 bp, Artificial Sequence
  epidermal growth factor receptor (EGFR), ERBB1 phosphotyrosine kinase siRNA
attgattggggatcttggagttt

SEQ ID NO: 8970 - DNA, 23 bp, Artificial Sequence
  epidermal growth factor receptor (EGFR), ERBB1 phosphotyrosine kinase siRNA
ttgattggggatcttggagtttt

SEQ ID NO: 8971 - DNA, 23 bp, Artificial Sequence
  epidermal growth factor receptor (EGFR), ERBB1 phosphotyrosine kinase siRNA
tgattggggatcttggagttttt

SEQ ID NO: 8972 - DNA, 23 bp, Artificial Sequence
  epidermal growth factor receptor (EGFR), ERBB1 phosphotyrosine kinase siRNA
gattggggatcttggagtttttc

SEQ ID NO: 8973 - DNA, 23 bp, Artificial Sequence
  epidermal growth factor receptor (EGFR), ERBB1 phosphotyrosine kinase siRNA
attggggatcttggagtttttca

SEQ ID NO: 8974 - DNA, 23 bp, Artificial Sequence
  epidermal growth factor receptor (EGFR), ERBB1 phosphotyrosine kinase siRNA
ttggggatcttggagtttttcat

SEQ ID NO: 8975 - DNA, 23 bp, Artificial Sequence
  epidermal growth factor receptor (EGFR), ERBB1 phosphotyrosine kinase siRNA
tggggatcttggagtttttcatt

SEQ ID NO: 8976 - DNA, 23 bp, Artificial Sequence
  epidermal growth factor receptor (EGFR), ERBB1 phosphotyrosine kinase siRNA
ggggatcttggagtttttcattg

SEQ ID NO: 8977 - DNA, 23 bp, Artificial Sequence
  epidermal growth factor receptor (EGFR), ERBB1 phosphotyrosine kinase siRNA
gggatcttggagtttttcattgt

SEQ ID NO: 8978 - DNA, 23 bp, Artificial Sequence
  epidermal growth factor receptor (EGFR), ERBB1 phosphotyrosine kinase siRNA
ggatcttggagtttttcattgtc

SEQ ID NO: 8979 - DNA, 23 bp, Artificial Sequence
  epidermal growth factor receptor (EGFR), ERBB1 phosphotyrosine kinase siRNA
gatcttggagtttttcattgtcg

SEQ ID NO: 8980 - DNA, 23 bp, Artificial Sequence
  epidermal growth factor receptor (EGFR), ERBB1 phosphotyrosine kinase siRNA
atcttggagtttttcattgtcgc

SEQ ID NO: 8981 - DNA, 23 bp, Artificial Sequence
  epidermal growth factor receptor (EGFR), ERBB1 phosphotyrosine kinase siRNA
tcttggagtttttcattgtcgct

SEQ ID NO: 8982 - DNA, 23 bp, Artificial Sequence
  epidermal growth factor receptor (EGFR), ERBB1 phosphotyrosine kinase siRNA
cttggagtttttcattgtcgcta

SEQ ID NO: 8983 - DNA, 23 bp, Artificial Sequence
  epidermal growth factor receptor (EGFR), ERBB1 phosphotyrosine kinase siRNA
ttggagtttttcattgtcgctat

SEQ ID NO: 8984 - DNA, 23 bp, Artificial Sequence
  epidermal growth factor receptor (EGFR), ERBB1 phosphotyrosine kinase siRNA
tggagtttttcattgtcgctatt

SEQ ID NO: 8985 - DNA, 23 bp, Artificial Sequence
  epidermal growth factor receptor (EGFR), ERBB1 phosphotyrosine kinase siRNA
ggagtttttcattgtcgctattg

SEQ ID NO: 8986 - DNA, 23 bp, Artificial Sequence
  epidermal growth factor receptor (EGFR), ERBB1 phosphotyrosine kinase siRNA
gagtttttcattgtcgctattga

SEQ ID NO: 8987 - DNA, 23 bp, Artificial Sequence
  epidermal growth factor receptor (EGFR), ERBB1 phosphotyrosine kinase siRNA
agtttttcattgtcgctattgat

SEQ ID NO: 8988 - DNA, 23 bp, Artificial Sequence
  epidermal growth factor receptor (EGFR), ERBB1 phosphotyrosine kinase siRNA
gtttttcattgtcgctattgatt

SEQ ID NO: 8989 - DNA, 23 bp, Artificial Sequence
  epidermal growth factor receptor (EGFR), ERBB1 phosphotyrosine kinase siRNA
tttttcattgtcgctattgattt

SEQ ID NO: 8990 - DNA, 23 bp, Artificial Sequence
  epidermal growth factor receptor (EGFR), ERBB1 phosphotyrosine kinase siRNA
ttttcattgtcgctattgatttt

SEQ ID NO: 8991 - DNA, 23 bp, Artificial Sequence
  epidermal growth factor receptor (EGFR), ERBB1 phosphotyrosine kinase siRNA
tttcattgtcgctattgattttt

SEQ ID NO: 8992 - DNA, 23 bp, Artificial Sequence
  epidermal growth factor receptor (EGFR), ERBB1 phosphotyrosine kinase siRNA
ttcattgtcgctattgattttta

SEQ ID NO: 8993 - DNA, 23 bp, Artificial Sequence
  epidermal growth factor receptor (EGFR), ERBB1 phosphotyrosine kinase siRNA
tcattgtcgctattgatttttac

SEQ ID NO: 8994 - DNA, 23 bp, Artificial Sequence
  epidermal growth factor receptor (EGFR), ERBB1 phosphotyrosine kinase siRNA
cattgtcgctattgatttttact

SEQ ID NO: 8995 - DNA, 23 bp, Artificial Sequence
  epidermal growth factor receptor (EGFR), ERBB1 phosphotyrosine kinase siRNA
attgtcgctattgatttttactt

SEQ ID NO: 8996 - DNA, 23 bp, Artificial Sequence
  epidermal growth factor receptor (EGFR), ERBB1 phosphotyrosine kinase siRNA
ttgtcgctattgatttttacttc

SEQ ID NO: 8997 - DNA, 23 bp, Artificial Sequence
  epidermal growth factor receptor (EGFR), ERBB1 phosphotyrosine kinase siRNA
tgtcgctattgatttttacttca

SEQ ID NO: 8998 - DNA, 23 bp, Artificial Sequence
  epidermal growth factor receptor (EGFR), ERBB1 phosphotyrosine kinase siRNA
gtcgctattgatttttacttcaa

SEQ ID NO: 8999 - DNA, 23 bp, Artificial Sequence
  epidermal growth factor receptor (EGFR), ERBB1 phosphotyrosine kinase siRNA
tcgctattgatttttacttcaat

SEQ ID NO: 9000 - DNA, 23 bp, Artificial Sequence
  epidermal growth factor receptor (EGFR), ERBB1 phosphotyrosine kinase siRNA
cgctattgatttttacttcaatg

SEQ ID NO: 9001 - DNA, 23 bp, Artificial Sequence
  epidermal growth factor receptor (EGFR), ERBB1 phosphotyrosine kinase siRNA
gctattgatttttacttcaatgg

SEQ ID NO: 9002 - DNA, 23 bp, Artificial Sequence
  epidermal growth factor receptor (EGFR), ERBB1 phosphotyrosine kinase siRNA
ctattgatttttacttcaatggg

SEQ ID NO: 9003 - DNA, 23 bp, Artificial Sequence
  epidermal growth factor receptor (EGFR), ERBB1 phosphotyrosine kinase siRNA
tattgatttttacttcaatgggc

SEQ ID NO: 9004 - DNA, 23 bp, Artificial Sequence
  epidermal growth factor receptor (EGFR), ERBB1 phosphotyrosine kinase siRNA
attgatttttacttcaatgggct

SEQ ID NO: 9005 - DNA, 23 bp, Artificial Sequence
  epidermal growth factor receptor (EGFR), ERBB1 phosphotyrosine kinase siRNA
ttgatttttacttcaatgggctc

SEQ ID NO: 9006 - DNA, 23 bp, Artificial Sequence
  epidermal growth factor receptor (EGFR), ERBB1 phosphotyrosine kinase siRNA
tgatttttacttcaatgggctct

SEQ ID NO: 9007 - DNA, 23 bp, Artificial Sequence
  epidermal growth factor receptor (EGFR), ERBB1 phosphotyrosine kinase siRNA
gatttttacttcaatgggctctt

SEQ ID NO: 9008 - DNA, 23 bp, Artificial Sequence
  epidermal growth factor receptor (EGFR), ERBB1 phosphotyrosine kinase siRNA
atttttacttcaatgggctcttc

SEQ ID NO: 9009 - DNA, 23 bp, Artificial Sequence
  epidermal growth factor receptor (EGFR), ERBB1 phosphotyrosine kinase siRNA
tttttacttcaatgggctcttcc

SEQ ID NO: 9010 - DNA, 23 bp, Artificial Sequence
  epidermal growth factor receptor (EGFR), ERBB1 phosphotyrosine kinase siRNA
ttttacttcaatgggctcttcca

SEQ ID NO: 9011 - DNA, 23 bp, Artificial Sequence
  epidermal growth factor receptor (EGFR), ERBB1 phosphotyrosine kinase siRNA
tttacttcaatgggctcttccaa

SEQ ID NO: 9012 - DNA, 23 bp, Artificial Sequence
  epidermal growth factor receptor (EGFR), ERBB1 phosphotyrosine kinase siRNA
ttacttcaatgggctcttccaac

SEQ ID NO: 9013 - DNA, 23 bp, Artificial Sequence
  epidermal growth factor receptor (EGFR), ERBB1 phosphotyrosine kinase siRNA
tacttcaatgggctcttccaaca

SEQ ID NO: 9014 - DNA, 23 bp, Artificial Sequence
  epidermal growth factor receptor (EGFR), ERBB1 phosphotyrosine kinase siRNA
acttcaatgggctcttccaacaa

SEQ ID NO: 9015 - DNA, 23 bp, Artificial Sequence
  epidermal growth factor receptor (EGFR), ERBB1 phosphotyrosine kinase siRNA
cttcaatgggctcttccaacaag

SEQ ID NO: 9016 - DNA, 23 bp, Artificial Sequence
  epidermal growth factor receptor (EGFR), ERBB1 phosphotyrosine kinase siRNA
ttcaatgggctcttccaacaagg

SEQ ID NO: 9017 - DNA, 23 bp, Artificial Sequence
  epidermal growth factor receptor (EGFR), ERBB1 phosphotyrosine kinase siRNA
tcaatgggctcttccaacaagga

SEQ ID NO: 9018 - DNA, 23 bp, Artificial Sequence
  epidermal growth factor receptor (EGFR), ERBB1 phosphotyrosine kinase siRNA
caatgggctcttccaacaaggaa

SEQ ID NO: 9019 - DNA, 23 bp, Artificial Sequence
  epidermal growth factor receptor (EGFR), ERBB1 phosphotyrosine kinase siRNA
aatgggctcttccaacaaggaag

SEQ ID NO: 9020 - DNA, 23 bp, Artificial Sequence
  epidermal growth factor receptor (EGFR), ERBB1 phosphotyrosine kinase siRNA
atgggctcttccaacaaggaaga

SEQ ID NO: 9021 - DNA, 23 bp, Artificial Sequence
  epidermal growth factor receptor (EGFR), ERBB1 phosphotyrosine kinase siRNA
tgggctcttccaacaaggaagaa

SEQ ID NO: 9022 - DNA, 23 bp, Artificial Sequence
  epidermal growth factor receptor (EGFR), ERBB1 phosphotyrosine kinase siRNA
gggctcttccaacaaggaagaag

SEQ ID NO: 9023 - DNA, 23 bp, Artificial Sequence
  epidermal growth factor receptor (EGFR), ERBB1 phosphotyrosine kinase siRNA
ggctcttccaacaaggaagaagc

SEQ ID NO: 9024 - DNA, 23 bp, Artificial Sequence
  epidermal growth factor receptor (EGFR), ERBB1 phosphotyrosine kinase siRNA
gctcttccaacaaggaagaagct

SEQ ID NO: 9025 - DNA, 23 bp, Artificial Sequence
  epidermal growth factor receptor (EGFR), ERBB1 phosphotyrosine kinase siRNA
ctcttccaacaaggaagaagctt

SEQ ID NO: 9026 - DNA, 23 bp, Artificial Sequence
  epidermal growth factor receptor (EGFR), ERBB1 phosphotyrosine kinase siRNA
tcttccaacaaggaagaagcttg

SEQ ID NO: 9027 - DNA, 23 bp, Artificial Sequence
  epidermal growth factor receptor (EGFR), ERBB1 phosphotyrosine kinase siRNA
cttccaacaaggaagaagcttgc

SEQ ID NO: 9028 - DNA, 23 bp, Artificial Sequence
  epidermal growth factor receptor (EGFR), ERBB1 phosphotyrosine kinase siRNA
ttccaacaaggaagaagcttgct

SEQ ID NO: 9029 - DNA, 23 bp, Artificial Sequence
  epidermal growth factor receptor (EGFR), ERBB1 phosphotyrosine kinase siRNA
tccaacaaggaagaagcttgctg

SEQ ID NO: 9030 - DNA, 23 bp, Artificial Sequence
  epidermal growth factor receptor (EGFR), ERBB1 phosphotyrosine kinase siRNA
ccaacaaggaagaagcttgctgg

SEQ ID NO: 9031 - DNA, 23 bp, Artificial Sequence
  epidermal growth factor receptor (EGFR), ERBB1 phosphotyrosine kinase siRNA
caacaaggaagaagcttgctggt

SEQ ID NO: 9032 - DNA, 23 bp, Artificial Sequence
  epidermal growth factor receptor (EGFR), ERBB1 phosphotyrosine kinase siRNA
aacaaggaagaagcttgctggta

SEQ ID NO: 9033 - DNA, 23 bp, Artificial Sequence
  epidermal growth factor receptor (EGFR), ERBB1 phosphotyrosine kinase siRNA
acaaggaagaagcttgctggtag

SEQ ID NO: 9034 - DNA, 23 bp, Artificial Sequence
  epidermal growth factor receptor (EGFR), ERBB1 phosphotyrosine kinase siRNA
caaggaagaagcttgctggtagc

SEQ ID NO: 9035 - DNA, 23 bp, Artificial Sequence
  epidermal growth factor receptor (EGFR), ERBB1 phosphotyrosine kinase siRNA
aaggaagaagcttgctggtagca

SEQ ID NO: 9036 - DNA, 23 bp, Artificial Sequence
  epidermal growth factor receptor (EGFR), ERBB1 phosphotyrosine kinase siRNA
aggaagaagcttgctggtagcac

SEQ ID NO: 9037 - DNA, 23 bp, Artificial Sequence
  epidermal growth factor receptor (EGFR), ERBB1 phosphotyrosine kinase siRNA
ggaagaagcttgctggtagcact

SEQ ID NO: 9038 - DNA, 23 bp, Artificial Sequence
  epidermal growth factor receptor (EGFR), ERBB1 phosphotyrosine kinase siRNA
gaagaagcttgctggtagcactt

SEQ ID NO: 9039 - DNA, 23 bp, Artificial Sequence
  epidermal growth factor receptor (EGFR), ERBB1 phosphotyrosine kinase siRNA
aagaagcttgctggtagcacttg

SEQ ID NO: 9040 - DNA, 23 bp, Artificial Sequence
  epidermal growth factor receptor (EGFR), ERBB1 phosphotyrosine kinase siRNA
agaagcttgctggtagcacttgc

SEQ ID NO: 9041 - DNA, 23 bp, Artificial Sequence
  epidermal growth factor receptor (EGFR), ERBB1 phosphotyrosine kinase siRNA
gaagcttgctggtagcacttgct

SEQ ID NO: 9042 - DNA, 23 bp, Artificial Sequence
  epidermal growth factor receptor (EGFR), ERBB1 phosphotyrosine kinase siRNA
aagcttgctggtagcacttgcta

SEQ ID NO: 9043 - DNA, 23 bp, Artificial Sequence
  epidermal growth factor receptor (EGFR), ERBB1 phosphotyrosine kinase siRNA
agcttgctggtagcacttgctac

SEQ ID NO: 9044 - DNA, 23 bp, Artificial Sequence
  epidermal growth factor receptor (EGFR), ERBB1 phosphotyrosine kinase siRNA
gcttgctggtagcacttgctacc

SEQ ID NO: 9045 - DNA, 23 bp, Artificial Sequence
  epidermal growth factor receptor (EGFR), ERBB1 phosphotyrosine kinase siRNA
cttgctggtagcacttgctaccc

SEQ ID NO: 9046 - DNA, 23 bp, Artificial Sequence
  epidermal growth factor receptor (EGFR), ERBB1 phosphotyrosine kinase siRNA
ttgctggtagcacttgctaccct

SEQ ID NO: 9047 - DNA, 23 bp, Artificial Sequence
  epidermal growth factor receptor (EGFR), ERBB1 phosphotyrosine kinase siRNA
tgctggtagcacttgctaccctg

SEQ ID NO: 9048 - DNA, 23 bp, Artificial Sequence
  epidermal growth factor receptor (EGFR), ERBB1 phosphotyrosine kinase siRNA
gctggtagcacttgctaccctga

SEQ ID NO: 9049 - DNA, 23 bp, Artificial Sequence
  epidermal growth factor receptor (EGFR), ERBB1 phosphotyrosine kinase siRNA
ctggtagcacttgctaccctgag

SEQ ID NO: 9050 - DNA, 23 bp, Artificial Sequence
  epidermal growth factor receptor (EGFR), ERBB1 phosphotyrosine kinase siRNA
tggtagcacttgctaccctgagt

SEQ ID NO: 9051 - DNA, 23 bp, Artificial Sequence
  epidermal growth factor receptor (EGFR), ERBB1 phosphotyrosine kinase siRNA
ggtagcacttgctaccctgagtt

SEQ ID NO: 9052 - DNA, 23 bp, Artificial Sequence
  epidermal growth factor receptor (EGFR), ERBB1 phosphotyrosine kinase siRNA
gtagcacttgctaccctgagttc

SEQ ID NO: 9053 - DNA, 23 bp, Artificial Sequence
  epidermal growth factor receptor (EGFR), ERBB1 phosphotyrosine kinase siRNA
tagcacttgctaccctgagttca

SEQ ID NO: 9054 - DNA, 23 bp, Artificial Sequence
  epidermal growth factor receptor (EGFR), ERBB1 phosphotyrosine kinase siRNA
agcacttgctaccctgagttcat

SEQ ID NO: 9055 - DNA, 23 bp, Artificial Sequence
  epidermal growth factor receptor (EGFR), ERBB1 phosphotyrosine kinase siRNA
gcacttgctaccctgagttcatc

SEQ ID NO: 9056 - DNA, 23 bp, Artificial Sequence
  epidermal growth factor receptor (EGFR), ERBB1 phosphotyrosine kinase siRNA
cacttgctaccctgagttcatcc

SEQ ID NO: 9057 - DNA, 23 bp, Artificial Sequence
  epidermal growth factor receptor (EGFR), ERBB1 phosphotyrosine kinase siRNA
acttgctaccctgagttcatcca

SEQ ID NO: 9058 - DNA, 23 bp, Artificial Sequence
  epidermal growth factor receptor (EGFR), ERBB1 phosphotyrosine kinase siRNA
cttgctaccctgagttcatccag

SEQ ID NO: 9059 - DNA, 23 bp, Artificial Sequence
  epidermal growth factor receptor (EGFR), ERBB1 phosphotyrosine kinase siRNA
ttgctaccctgagttcatccagg

SEQ ID NO: 9060 - DNA, 23 bp, Artificial Sequence
  epidermal growth factor receptor (EGFR), ERBB1 phosphotyrosine kinase siRNA
tgctaccctgagttcatccaggc

SEQ ID NO: 9061 - DNA, 23 bp, Artificial Sequence
  epidermal growth factor receptor (EGFR), ERBB1 phosphotyrosine kinase siRNA
gctaccctgagttcatccaggcc

SEQ ID NO: 9062 - DNA, 23 bp, Artificial Sequence
  epidermal growth factor receptor (EGFR), ERBB1 phosphotyrosine kinase siRNA
ctaccctgagttcatccaggccc

SEQ ID NO: 9063 - DNA, 23 bp, Artificial Sequence
  epidermal growth factor receptor (EGFR), ERBB1 phosphotyrosine kinase siRNA
taccctgagttcatccaggccca

SEQ ID NO: 9064 - DNA, 23 bp, Artificial Sequence
  epidermal growth factor receptor (EGFR), ERBB1 phosphotyrosine kinase siRNA
accctgagttcatccaggcccaa

SEQ ID NO: 9065 - DNA, 23 bp, Artificial Sequence
  epidermal growth factor receptor (EGFR), ERBB1 phosphotyrosine kinase siRNA
ccctgagttcatccaggcccaac

SEQ ID NO: 9066 - DNA, 23 bp, Artificial Sequence
  epidermal growth factor receptor (EGFR), ERBB1 phosphotyrosine kinase siRNA
cctgagttcatccaggcccaact

SEQ ID NO: 9067 - DNA, 23 bp, Artificial Sequence
  epidermal growth factor receptor (EGFR), ERBB1 phosphotyrosine kinase siRNA
ctgagttcatccaggcccaactg

SEQ ID NO: 9068 - DNA, 23 bp, Artificial Sequence
  epidermal growth factor receptor (EGFR), ERBB1 phosphotyrosine kinase siRNA
tgagttcatccaggcccaactgt

SEQ ID NO: 9069 - DNA, 23 bp, Artificial Sequence
  epidermal growth factor receptor (EGFR), ERBB1 phosphotyrosine kinase siRNA
gagttcatccaggcccaactgtg

SEQ ID NO: 9070 - DNA, 23 bp, Artificial Sequence
  epidermal growth factor receptor (EGFR), ERBB1 phosphotyrosine kinase siRNA
agttcatccaggcccaactgtga

SEQ ID NO: 9071 - DNA, 23 bp, Artificial Sequence
  epidermal growth factor receptor (EGFR), ERBB1 phosphotyrosine kinase siRNA
gttcatccaggcccaactgtgag

SEQ ID NO: 9072 - DNA, 23 bp, Artificial Sequence
  epidermal growth factor receptor (EGFR), ERBB1 phosphotyrosine kinase siRNA
ttcatccaggcccaactgtgagc

SEQ ID NO: 9073 - DNA, 23 bp, Artificial Sequence
  epidermal growth factor receptor (EGFR), ERBB1 phosphotyrosine kinase siRNA
tcatccaggcccaactgtgagca

SEQ ID NO: 9074 - DNA, 23 bp, Artificial Sequence
  epidermal growth factor receptor (EGFR), ERBB1 phosphotyrosine kinase siRNA
catccaggcccaactgtgagcaa

SEQ ID NO: 9075 - DNA, 23 bp, Artificial Sequence
  epidermal growth factor receptor (EGFR), ERBB1 phosphotyrosine kinase siRNA
atccaggcccaactgtgagcaag

SEQ ID NO: 9076 - DNA, 23 bp, Artificial Sequence
  epidermal growth factor receptor (EGFR), ERBB1 phosphotyrosine kinase siRNA
tccaggcccaactgtgagcaagg

SEQ ID NO: 9077 - DNA, 23 bp, Artificial Sequence
  epidermal growth factor receptor (EGFR), ERBB1 phosphotyrosine kinase siRNA
ccaggcccaactgtgagcaagga

SEQ ID NO: 9078 - DNA, 23 bp, Artificial Sequence
  epidermal growth factor receptor (EGFR), ERBB1 phosphotyrosine kinase siRNA
caggcccaactgtgagcaaggag

SEQ ID NO: 9079 - DNA, 23 bp, Artificial Sequence
  epidermal growth factor receptor (EGFR), ERBB1 phosphotyrosine kinase siRNA
aggcccaactgtgagcaaggagc

SEQ ID NO: 9080 - DNA, 23 bp, Artificial Sequence
  epidermal growth factor receptor (EGFR), ERBB1 phosphotyrosine kinase siRNA
ggcccaactgtgagcaaggagca

SEQ ID NO: 9081 - DNA, 23 bp, Artificial Sequence
  epidermal growth factor receptor (EGFR), ERBB1 phosphotyrosine kinase siRNA
gcccaactgtgagcaaggagcac

SEQ ID NO: 9082 - DNA, 23 bp, Artificial Sequence
  epidermal growth factor receptor (EGFR), ERBB1 phosphotyrosine kinase siRNA
cccaactgtgagcaaggagcaca

SEQ ID NO: 9083 - DNA, 23 bp, Artificial Sequence
  epidermal growth factor receptor (EGFR), ERBB1 phosphotyrosine kinase siRNA
ccaactgtgagcaaggagcacaa

SEQ ID NO: 9084 - DNA, 23 bp, Artificial Sequence
  epidermal growth factor receptor (EGFR), ERBB1 phosphotyrosine kinase siRNA
caactgtgagcaaggagcacaag

SEQ ID NO: 9085 - DNA, 23 bp, Artificial Sequence
  epidermal growth factor receptor (EGFR), ERBB1 phosphotyrosine kinase siRNA
aactgtgagcaaggagcacaagc

SEQ ID NO: 9086 - DNA, 23 bp, Artificial Sequence
  epidermal growth factor receptor (EGFR), ERBB1 phosphotyrosine kinase siRNA
actgtgagcaaggagcacaagcc

SEQ ID NO: 9087 - DNA, 23 bp, Artificial Sequence
  epidermal growth factor receptor (EGFR), ERBB1 phosphotyrosine kinase siRNA
ctgtgagcaaggagcacaagcca

SEQ ID NO: 9088 - DNA, 23 bp, Artificial Sequence
  epidermal growth factor receptor (EGFR), ERBB1 phosphotyrosine kinase siRNA
tgtgagcaaggagcacaagccac

SEQ ID NO: 9089 - DNA, 23 bp, Artificial Sequence
  epidermal growth factor receptor (EGFR), ERBB1 phosphotyrosine kinase siRNA
gtgagcaaggagcacaagccaca

SEQ ID NO: 9090 - DNA, 23 bp, Artificial Sequence
  epidermal growth factor receptor (EGFR), ERBB1 phosphotyrosine kinase siRNA
tgagcaaggagcacaagccacaa

SEQ ID NO: 9091 - DNA, 23 bp, Artificial Sequence
  epidermal growth factor receptor (EGFR), ERBB1 phosphotyrosine kinase siRNA
gagcaaggagcacaagccacaag

SEQ ID NO: 9092 - DNA, 23 bp, Artificial Sequence
  epidermal growth factor receptor (EGFR), ERBB1 phosphotyrosine kinase siRNA
agcaaggagcacaagccacaagt

SEQ ID NO: 9093 - DNA, 23 bp, Artificial Sequence
  epidermal growth factor receptor (EGFR), ERBB1 phosphotyrosine kinase siRNA
gcaaggagcacaagccacaagtc

SEQ ID NO: 9094 - DNA, 23 bp, Artificial Sequence
  epidermal growth factor receptor (EGFR), ERBB1 phosphotyrosine kinase siRNA
caaggagcacaagccacaagtct

SEQ ID NO: 9095 - DNA, 23 bp, Artificial Sequence
  epidermal growth factor receptor (EGFR), ERBB1 phosphotyrosine kinase siRNA
aaggagcacaagccacaagtctt

SEQ ID NO: 9096 - DNA, 23 bp, Artificial Sequence
  epidermal growth factor receptor (EGFR), ERBB1 phosphotyrosine kinase siRNA
aggagcacaagccacaagtcttc

SEQ ID NO: 9097 - DNA, 23 bp, Artificial Sequence
  epidermal growth factor receptor (EGFR), ERBB1 phosphotyrosine kinase siRNA
ggagcacaagccacaagtcttcc

SEQ ID NO: 9098 - DNA, 23 bp, Artificial Sequence
  epidermal growth factor receptor (EGFR), ERBB1 phosphotyrosine kinase siRNA
gagcacaagccacaagtcttcca

SEQ ID NO: 9099 - DNA, 23 bp, Artificial Sequence
  epidermal growth factor receptor (EGFR), ERBB1 phosphotyrosine kinase siRNA
agcacaagccacaagtcttccag

SEQ ID NO: 9100 - DNA, 23 bp, Artificial Sequence
  epidermal growth factor receptor (EGFR), ERBB1 phosphotyrosine kinase siRNA
gcacaagccacaagtcttccaga

SEQ ID NO: 9101 - DNA, 23 bp, Artificial Sequence
  epidermal growth factor receptor (EGFR), ERBB1 phosphotyrosine kinase siRNA
cacaagccacaagtcttccagag

SEQ ID NO: 9102 - DNA, 23 bp, Artificial Sequence
  epidermal growth factor receptor (EGFR), ERBB1 phosphotyrosine kinase siRNA
acaagccacaagtcttccagagg

SEQ ID NO: 9103 - DNA, 23 bp, Artificial Sequence
  epidermal growth factor receptor (EGFR), ERBB1 phosphotyrosine kinase siRNA
caagccacaagtcttccagagga

SEQ ID NO: 9104 - DNA, 23 bp, Artificial Sequence
  epidermal growth factor receptor (EGFR), ERBB1 phosphotyrosine kinase siRNA
aagccacaagtcttccagaggat

SEQ ID NO: 9105 - DNA, 23 bp, Artificial Sequence
  epidermal growth factor receptor (EGFR), ERBB1 phosphotyrosine kinase siRNA
agccacaagtcttccagaggatg

SEQ ID NO: 9106 - DNA, 23 bp, Artificial Sequence
  epidermal growth factor receptor (EGFR), ERBB1 phosphotyrosine kinase siRNA
gccacaagtcttccagaggatgc

SEQ ID NO: 9107 - DNA, 23 bp, Artificial Sequence
  epidermal growth factor receptor (EGFR), ERBB1 phosphotyrosine kinase siRNA
ccacaagtcttccagaggatgct

SEQ ID NO: 9108 - DNA, 23 bp, Artificial Sequence
  epidermal growth factor receptor (EGFR), ERBB1 phosphotyrosine kinase siRNA
cacaagtcttccagaggatgctt

SEQ ID NO: 9109 - DNA, 23 bp, Artificial Sequence
  epidermal growth factor receptor (EGFR), ERBB1 phosphotyrosine kinase siRNA
acaagtcttccagaggatgcttg

SEQ ID NO: 9110 - DNA, 23 bp, Artificial Sequence
  epidermal growth factor receptor (EGFR), ERBB1 phosphotyrosine kinase siRNA
caagtcttccagaggatgcttga

SEQ ID NO: 9111 - DNA, 23 bp, Artificial Sequence
  epidermal growth factor receptor (EGFR), ERBB1 phosphotyrosine kinase siRNA
aagtcttccagaggatgcttgat

SEQ ID NO: 9112 - DNA, 23 bp, Artificial Sequence
  epidermal growth factor receptor (EGFR), ERBB1 phosphotyrosine kinase siRNA
agtcttccagaggatgcttgatt

SEQ ID NO: 9113 - DNA, 23 bp, Artificial Sequence
  epidermal growth factor receptor (EGFR), ERBB1 phosphotyrosine kinase siRNA
gtcttccagaggatgcttgattc

SEQ ID NO: 9114 - DNA, 23 bp, Artificial Sequence
  epidermal growth factor receptor (EGFR), ERBB1 phosphotyrosine kinase siRNA
tcttccagaggatgcttgattcc

SEQ ID NO: 9115 - DNA, 23 bp, Artificial Sequence
  epidermal growth factor receptor (EGFR), ERBB1 phosphotyrosine kinase siRNA
cttccagaggatgcttgattcca

SEQ ID NO: 9116 - DNA, 23 bp, Artificial Sequence
  epidermal growth factor receptor (EGFR), ERBB1 phosphotyrosine kinase siRNA
ttccagaggatgcttgattccag

SEQ ID NO: 9117 - DNA, 23 bp, Artificial Sequence
  epidermal growth factor receptor (EGFR), ERBB1 phosphotyrosine kinase siRNA
tccagaggatgcttgattccagt

SEQ ID NO: 9118 - DNA, 23 bp, Artificial Sequence
  epidermal growth factor receptor (EGFR), ERBB1 phosphotyrosine kinase siRNA
ccagaggatgcttgattccagtg

SEQ ID NO: 9119 - DNA, 23 bp, Artificial Sequence
  epidermal growth factor receptor (EGFR), ERBB1 phosphotyrosine kinase siRNA
cagaggatgcttgattccagtgg

SEQ ID NO: 9120 - DNA, 23 bp, Artificial Sequence
  epidermal growth factor receptor (EGFR), ERBB1 phosphotyrosine kinase siRNA
agaggatgcttgattccagtggt

SEQ ID NO: 9121 - DNA, 23 bp, Artificial Sequence
  epidermal growth factor receptor (EGFR), ERBB1 phosphotyrosine kinase siRNA
gaggatgcttgattccagtggtt

SEQ ID NO: 9122 - DNA, 23 bp, Artificial Sequence
  epidermal growth factor receptor (EGFR), ERBB1 phosphotyrosine kinase siRNA
aggatgcttgattccagtggttc

SEQ ID NO: 9123 - DNA, 23 bp, Artificial Sequence
  epidermal growth factor receptor (EGFR), ERBB1 phosphotyrosine kinase siRNA
ggatgcttgattccagtggttct

SEQ ID NO: 9124 - DNA, 23 bp, Artificial Sequence
  epidermal growth factor receptor (EGFR), ERBB1 phosphotyrosine kinase siRNA
gatgcttgattccagtggttctg

SEQ ID NO: 9125 - DNA, 23 bp, Artificial Sequence
  epidermal growth factor receptor (EGFR), ERBB1 phosphotyrosine kinase siRNA
atgcttgattccagtggttctgc

SEQ ID NO: 9126 - DNA, 23 bp, Artificial Sequence
  epidermal growth factor receptor (EGFR), ERBB1 phosphotyrosine kinase siRNA
tgcttgattccagtggttctgct

SEQ ID NO: 9127 - DNA, 23 bp, Artificial Sequence
  epidermal growth factor receptor (EGFR), ERBB1 phosphotyrosine kinase siRNA
gcttgattccagtggttctgctt

SEQ ID NO: 9128 - DNA, 23 bp, Artificial Sequence
  epidermal growth factor receptor (EGFR), ERBB1 phosphotyrosine kinase siRNA
cttgattccagtggttctgcttc

SEQ ID NO: 9129 - DNA, 23 bp, Artificial Sequence
  epidermal growth factor receptor (EGFR), ERBB1 phosphotyrosine kinase siRNA
ttgattccagtggttctgcttca

SEQ ID NO: 9130 - DNA, 23 bp, Artificial Sequence
  epidermal growth factor receptor (EGFR), ERBB1 phosphotyrosine kinase siRNA
tgattccagtggttctgcttcaa

SEQ ID NO: 9131 - DNA, 23 bp, Artificial Sequence
  epidermal growth factor receptor (EGFR), ERBB1 phosphotyrosine kinase siRNA
gattccagtggttctgcttcaag

SEQ ID NO: 9132 - DNA, 23 bp, Artificial Sequence
  epidermal growth factor receptor (EGFR), ERBB1 phosphotyrosine kinase siRNA
attccagtggttctgcttcaagg

SEQ ID NO: 9133 - DNA, 23 bp, Artificial Sequence
  epidermal growth factor receptor (EGFR), ERBB1 phosphotyrosine kinase siRNA
ttccagtggttctgcttcaaggc

SEQ ID NO: 9134 - DNA, 23 bp, Artificial Sequence
  epidermal growth factor receptor (EGFR), ERBB1 phosphotyrosine kinase siRNA
tccagtggttctgcttcaaggct

SEQ ID NO: 9135 - DNA, 23 bp, Artificial Sequence
  epidermal growth factor receptor (EGFR), ERBB1 phosphotyrosine kinase siRNA
ccagtggttctgcttcaaggctt

SEQ ID NO: 9136 - DNA, 23 bp, Artificial Sequence
  epidermal growth factor receptor (EGFR), ERBB1 phosphotyrosine kinase siRNA
cagtggttctgcttcaaggcttc

SEQ ID NO: 9137 - DNA, 23 bp, Artificial Sequence
  epidermal growth factor receptor (EGFR), ERBB1 phosphotyrosine kinase siRNA
agtggttctgcttcaaggcttcc

SEQ ID NO: 9138 - DNA, 23 bp, Artificial Sequence
  epidermal growth factor receptor (EGFR), ERBB1 phosphotyrosine kinase siRNA
gtggttctgcttcaaggcttcca

SEQ ID NO: 9139 - DNA, 23 bp, Artificial Sequence
  epidermal growth factor receptor (EGFR), ERBB1 phosphotyrosine kinase siRNA
tggttctgcttcaaggcttccac

SEQ ID NO: 9140 - DNA, 23 bp, Artificial Sequence
  epidermal growth factor receptor (EGFR), ERBB1 phosphotyrosine kinase siRNA
ggttctgcttcaaggcttccact

SEQ ID NO: 9141 - DNA, 23 bp, Artificial Sequence
  epidermal growth factor receptor (EGFR), ERBB1 phosphotyrosine kinase siRNA
gttctgcttcaaggcttccactg

SEQ ID NO: 9142 - DNA, 23 bp, Artificial Sequence
  epidermal growth factor receptor (EGFR), ERBB1 phosphotyrosine kinase siRNA
ttctgcttcaaggcttccactgc

SEQ ID NO: 9143 - DNA, 23 bp, Artificial Sequence
  epidermal growth factor receptor (EGFR), ERBB1 phosphotyrosine kinase siRNA
tctgcttcaaggcttccactgca

SEQ ID NO: 9144 - DNA, 23 bp, Artificial Sequence
  epidermal growth factor receptor (EGFR), ERBB1 phosphotyrosine kinase siRNA
ctgcttcaaggcttccactgcaa

SEQ ID NO: 9145 - DNA, 23 bp, Artificial Sequence
  epidermal growth factor receptor (EGFR), ERBB1 phosphotyrosine kinase siRNA
tgcttcaaggcttccactgcaaa

SEQ ID NO: 9146 - DNA, 23 bp, Artificial Sequence
  epidermal growth factor receptor (EGFR), ERBB1 phosphotyrosine kinase siRNA
gcttcaaggcttccactgcaaaa

SEQ ID NO: 9147 - DNA, 23 bp, Artificial Sequence
  epidermal growth factor receptor (EGFR), ERBB1 phosphotyrosine kinase siRNA
cttcaaggcttccactgcaaaac

SEQ ID NO: 9148 - DNA, 23 bp, Artificial Sequence
  epidermal growth factor receptor (EGFR), ERBB1 phosphotyrosine kinase siRNA
ttcaaggcttccactgcaaaaca

SEQ ID NO: 9149 - DNA, 23 bp, Artificial Sequence
  epidermal growth factor receptor (EGFR), ERBB1 phosphotyrosine kinase siRNA
tcaaggcttccactgcaaaacac

SEQ ID NO: 9150 - DNA, 23 bp, Artificial Sequence
  epidermal growth factor receptor (EGFR), ERBB1 phosphotyrosine kinase siRNA
caaggcttccactgcaaaacact

SEQ ID NO: 9151 - DNA, 23 bp, Artificial Sequence
  epidermal growth factor receptor (EGFR), ERBB1 phosphotyrosine kinase siRNA
aaggcttccactgcaaaacacta

SEQ ID NO: 9152 - DNA, 23 bp, Artificial Sequence
  epidermal growth factor receptor (EGFR), ERBB1 phosphotyrosine kinase siRNA
aggcttccactgcaaaacactaa

SEQ ID NO: 9153 - DNA, 23 bp, Artificial Sequence
  epidermal growth factor receptor (EGFR), ERBB1 phosphotyrosine kinase siRNA
ggcttccactgcaaaacactaaa

SEQ ID NO: 9154 - DNA, 23 bp, Artificial Sequence
  epidermal growth factor receptor (EGFR), ERBB1 phosphotyrosine kinase siRNA
gcttccactgcaaaacactaaag

SEQ ID NO: 9155 - DNA, 23 bp, Artificial Sequence
  epidermal growth factor receptor (EGFR), ERBB1 phosphotyrosine kinase siRNA
cttccactgcaaaacactaaaga

SEQ ID NO: 9156 - DNA, 23 bp, Artificial Sequence
  epidermal growth factor receptor (EGFR), ERBB1 phosphotyrosine kinase siRNA
ttccactgcaaaacactaaagat

SEQ ID NO: 9157 - DNA, 23 bp, Artificial Sequence
  epidermal growth factor receptor (EGFR), ERBB1 phosphotyrosine kinase siRNA
tccactgcaaaacactaaagatc

SEQ ID NO: 9158 - DNA, 23 bp, Artificial Sequence
  epidermal growth factor receptor (EGFR), ERBB1 phosphotyrosine kinase siRNA
ccactgcaaaacactaaagatcc

SEQ ID NO: 9159 - DNA, 23 bp, Artificial Sequence
  epidermal growth factor receptor (EGFR), ERBB1 phosphotyrosine kinase siRNA
cactgcaaaacactaaagatcca

SEQ ID NO: 9160 - DNA, 23 bp, Artificial Sequence
  epidermal growth factor receptor (EGFR), ERBB1 phosphotyrosine kinase siRNA
actgcaaaacactaaagatccaa

SEQ ID NO: 9161 - DNA, 23 bp, Artificial Sequence
  epidermal growth factor receptor (EGFR), ERBB1 phosphotyrosine kinase siRNA
ctgcaaaacactaaagatccaag

SEQ ID NO: 9162 - DNA, 23 bp, Artificial Sequence
  epidermal growth factor receptor (EGFR), ERBB1 phosphotyrosine kinase siRNA
tgcaaaacactaaagatccaaga

SEQ ID NO: 9163 - DNA, 23 bp, Artificial Sequence
  epidermal growth factor receptor (EGFR), ERBB1 phosphotyrosine kinase siRNA
gcaaaacactaaagatccaagaa

SEQ ID NO: 9164 - DNA, 23 bp, Artificial Sequence
  epidermal growth factor receptor (EGFR), ERBB1 phosphotyrosine kinase siRNA
caaaacactaaagatccaagaag

SEQ ID NO: 9165 - DNA, 23 bp, Artificial Sequence
  epidermal growth factor receptor (EGFR), ERBB1 phosphotyrosine kinase siRNA
aaaacactaaagatccaagaagg

SEQ ID NO: 9166 - DNA, 23 bp, Artificial Sequence
  epidermal growth factor receptor (EGFR), ERBB1 phosphotyrosine kinase siRNA
aaacactaaagatccaagaaggc

SEQ ID NO: 9167 - DNA, 23 bp, Artificial Sequence
  epidermal growth factor receptor (EGFR), ERBB1 phosphotyrosine kinase siRNA
aacactaaagatccaagaaggcc

SEQ ID NO: 9168 - DNA, 23 bp, Artificial Sequence
  epidermal growth factor receptor (EGFR), ERBB1 phosphotyrosine kinase siRNA
acactaaagatccaagaaggcct

SEQ ID NO: 9169 - DNA, 23 bp, Artificial Sequence
  epidermal growth factor receptor (EGFR), ERBB1 phosphotyrosine kinase siRNA
cactaaagatccaagaaggcctt

SEQ ID NO: 9170 - DNA, 23 bp, Artificial Sequence
  epidermal growth factor receptor (EGFR), ERBB1 phosphotyrosine kinase siRNA
actaaagatccaagaaggccttc

SEQ ID NO: 9171 - DNA, 23 bp, Artificial Sequence
  epidermal growth factor receptor (EGFR), ERBB1 phosphotyrosine kinase siRNA
ctaaagatccaagaaggccttca

SEQ ID NO: 9172 - DNA, 23 bp, Artificial Sequence
  epidermal growth factor receptor (EGFR), ERBB1 phosphotyrosine kinase siRNA
taaagatccaagaaggccttcat

SEQ ID NO: 9173 - DNA, 23 bp, Artificial Sequence
  epidermal growth factor receptor (EGFR), ERBB1 phosphotyrosine kinase siRNA
aaagatccaagaaggccttcatg

SEQ ID NO: 9174 - DNA, 23 bp, Artificial Sequence
  epidermal growth factor receptor (EGFR), ERBB1 phosphotyrosine kinase siRNA
aagatccaagaaggccttcatgg

SEQ ID NO: 9175 - DNA, 23 bp, Artificial Sequence
  epidermal growth factor receptor (EGFR), ERBB1 phosphotyrosine kinase siRNA
agatccaagaaggccttcatggc

SEQ ID NO: 9176 - DNA, 23 bp, Artificial Sequence
  epidermal growth factor receptor (EGFR), ERBB1 phosphotyrosine kinase siRNA
gatccaagaaggccttcatggcc

SEQ ID NO: 9177 - DNA, 23 bp, Artificial Sequence
  epidermal growth factor receptor (EGFR), ERBB1 phosphotyrosine kinase siRNA
atccaagaaggccttcatggccc

SEQ ID NO: 9178 - DNA, 23 bp, Artificial Sequence
  epidermal growth factor receptor (EGFR), ERBB1 phosphotyrosine kinase siRNA
tccaagaaggccttcatggcccc

SEQ ID NO: 9179 - DNA, 23 bp, Artificial Sequence
  epidermal growth factor receptor (EGFR), ERBB1 phosphotyrosine kinase siRNA
ccaagaaggccttcatggcccca

SEQ ID NO: 9180 - DNA, 23 bp, Artificial Sequence
  epidermal growth factor receptor (EGFR), ERBB1 phosphotyrosine kinase siRNA
caagaaggccttcatggccccag

SEQ ID NO: 9181 - DNA, 23 bp, Artificial Sequence
  epidermal growth factor receptor (EGFR), ERBB1 phosphotyrosine kinase siRNA
aagaaggccttcatggccccagc

SEQ ID NO: 9182 - DNA, 23 bp, Artificial Sequence
  epidermal growth factor receptor (EGFR), ERBB1 phosphotyrosine kinase siRNA
agaaggccttcatggccccagca

SEQ ID NO: 9183 - DNA, 23 bp, Artificial Sequence
  epidermal growth factor receptor (EGFR), ERBB1 phosphotyrosine kinase siRNA
gaaggccttcatggccccagcag

SEQ ID NO: 9184 - DNA, 23 bp, Artificial Sequence
  epidermal growth factor receptor (EGFR), ERBB1 phosphotyrosine kinase siRNA
aaggccttcatggccccagcagg

SEQ ID NO: 9185 - DNA, 23 bp, Artificial Sequence
  epidermal growth factor receptor (EGFR), ERBB1 phosphotyrosine kinase siRNA
aggccttcatggccccagcaggc

SEQ ID NO: 9186 - DNA, 23 bp, Artificial Sequence
  epidermal growth factor receptor (EGFR), ERBB1 phosphotyrosine kinase siRNA
ggccttcatggccccagcaggcc

SEQ ID NO: 9187 - DNA, 23 bp, Artificial Sequence
  epidermal growth factor receptor (EGFR), ERBB1 phosphotyrosine kinase siRNA
gccttcatggccccagcaggccg

SEQ ID NO: 9188 - DNA, 23 bp, Artificial Sequence
  epidermal growth factor receptor (EGFR), ERBB1 phosphotyrosine kinase siRNA
ccttcatggccccagcaggccgg

SEQ ID NO: 9189 - DNA, 23 bp, Artificial Sequence
  epidermal growth factor receptor (EGFR), ERBB1 phosphotyrosine kinase siRNA
cttcatggccccagcaggccgga

SEQ ID NO: 9190 - DNA, 23 bp, Artificial Sequence
  epidermal growth factor receptor (EGFR), ERBB1 phosphotyrosine kinase siRNA
ttcatggccccagcaggccggat

SEQ ID NO: 9191 - DNA, 23 bp, Artificial Sequence
  epidermal growth factor receptor (EGFR), ERBB1 phosphotyrosine kinase siRNA
tcatggccccagcaggccggatc

SEQ ID NO: 9192 - DNA, 23 bp, Artificial Sequence
  epidermal growth factor receptor (EGFR), ERBB1 phosphotyrosine kinase siRNA
catggccccagcaggccggatcg

SEQ ID NO: 9193 - DNA, 23 bp, Artificial Sequence
  epidermal growth factor receptor (EGFR), ERBB1 phosphotyrosine kinase siRNA
atggccccagcaggccggatcgg

SEQ ID NO: 9194 - DNA, 23 bp, Artificial Sequence
  epidermal growth factor receptor (EGFR), ERBB1 phosphotyrosine kinase siRNA
tggccccagcaggccggatcggt

SEQ ID NO: 9195 - DNA, 23 bp, Artificial Sequence
  epidermal growth factor receptor (EGFR), ERBB1 phosphotyrosine kinase siRNA
ggccccagcaggccggatcggta

SEQ ID NO: 9196 - DNA, 23 bp, Artificial Sequence
  epidermal growth factor receptor (EGFR), ERBB1 phosphotyrosine kinase siRNA
gccccagcaggccggatcggtac

SEQ ID NO: 9197 - DNA, 23 bp, Artificial Sequence
  epidermal growth factor receptor (EGFR), ERBB1 phosphotyrosine kinase siRNA
ccccagcaggccggatcggtact

SEQ ID NO: 9198 - DNA, 23 bp, Artificial Sequence
  epidermal growth factor receptor (EGFR), ERBB1 phosphotyrosine kinase siRNA
cccagcaggccggatcggtactg

SEQ ID NO: 9199 - DNA, 23 bp, Artificial Sequence
  epidermal growth factor receptor (EGFR), ERBB1 phosphotyrosine kinase siRNA
ccagcaggccggatcggtactgt

SEQ ID NO: 9200 - DNA, 23 bp, Artificial Sequence
  epidermal growth factor receptor (EGFR), ERBB1 phosphotyrosine kinase siRNA
cagcaggccggatcggtactgta

SEQ ID NO: 9201 - DNA, 23 bp, Artificial Sequence
  epidermal growth factor receptor (EGFR), ERBB1 phosphotyrosine kinase siRNA
agcaggccggatcggtactgtat

SEQ ID NO: 9202 - DNA, 23 bp, Artificial Sequence
  epidermal growth factor receptor (EGFR), ERBB1 phosphotyrosine kinase siRNA
gcaggccggatcggtactgtatc

SEQ ID NO: 9203 - DNA, 23 bp, Artificial Sequence
  epidermal growth factor receptor (EGFR), ERBB1 phosphotyrosine kinase siRNA
caggccggatcggtactgtatca

SEQ ID NO: 9204 - DNA, 23 bp, Artificial Sequence
  epidermal growth factor receptor (EGFR), ERBB1 phosphotyrosine kinase siRNA
aggccggatcggtactgtatcaa

SEQ ID NO: 9205 - DNA, 23 bp, Artificial Sequence
  epidermal growth factor receptor (EGFR), ERBB1 phosphotyrosine kinase siRNA
ggccggatcggtactgtatcaag

SEQ ID NO: 9206 - DNA, 23 bp, Artificial Sequence
  epidermal growth factor receptor (EGFR), ERBB1 phosphotyrosine kinase siRNA
gccggatcggtactgtatcaagt

SEQ ID NO: 9207 - DNA, 23 bp, Artificial Sequence
  epidermal growth factor receptor (EGFR), ERBB1 phosphotyrosine kinase siRNA
ccggatcggtactgtatcaagtc

SEQ ID NO: 9208 - DNA, 23 bp, Artificial Sequence
  epidermal growth factor receptor (EGFR), ERBB1 phosphotyrosine kinase siRNA
cggatcggtactgtatcaagtca

SEQ ID NO: 9209 - DNA, 23 bp, Artificial Sequence
  epidermal growth factor receptor (EGFR), ERBB1 phosphotyrosine kinase siRNA
ggatcggtactgtatcaagtcat

SEQ ID NO: 9210 - DNA, 23 bp, Artificial Sequence
  epidermal growth factor receptor (EGFR), ERBB1 phosphotyrosine kinase siRNA
gatcggtactgtatcaagtcatg

SEQ ID NO: 9211 - DNA, 23 bp, Artificial Sequence
  epidermal growth factor receptor (EGFR), ERBB1 phosphotyrosine kinase siRNA
atcggtactgtatcaagtcatgg

SEQ ID NO: 9212 - DNA, 23 bp, Artificial Sequence
  epidermal growth factor receptor (EGFR), ERBB1 phosphotyrosine kinase siRNA
tcggtactgtatcaagtcatggc

SEQ ID NO: 9213 - DNA, 23 bp, Artificial Sequence
  epidermal growth factor receptor (EGFR), ERBB1 phosphotyrosine kinase siRNA
cggtactgtatcaagtcatggca

SEQ ID NO: 9214 - DNA, 23 bp, Artificial Sequence
  epidermal growth factor receptor (EGFR), ERBB1 phosphotyrosine kinase siRNA
ggtactgtatcaagtcatggcag

SEQ ID NO: 9215 - DNA, 23 bp, Artificial Sequence
  epidermal growth factor receptor (EGFR), ERBB1 phosphotyrosine kinase siRNA
gtactgtatcaagtcatggcagg

SEQ ID NO: 9216 - DNA, 23 bp, Artificial Sequence
  epidermal growth factor receptor (EGFR), ERBB1 phosphotyrosine kinase siRNA
tactgtatcaagtcatggcaggt

SEQ ID NO: 9217 - DNA, 23 bp, Artificial Sequence
  epidermal growth factor receptor (EGFR), ERBB1 phosphotyrosine kinase siRNA
actgtatcaagtcatggcaggta

SEQ ID NO: 9218 - DNA, 23 bp, Artificial Sequence
  epidermal growth factor receptor (EGFR), ERBB1 phosphotyrosine kinase siRNA
ctgtatcaagtcatggcaggtac

SEQ ID NO: 9219 - DNA, 23 bp, Artificial Sequence
  epidermal growth factor receptor (EGFR), ERBB1 phosphotyrosine kinase siRNA
tgtatcaagtcatggcaggtaca

SEQ ID NO: 9220 - DNA, 23 bp, Artificial Sequence
  epidermal growth factor receptor (EGFR), ERBB1 phosphotyrosine kinase siRNA
gtatcaagtcatggcaggtacag

SEQ ID NO: 9221 - DNA, 23 bp, Artificial Sequence
  epidermal growth factor receptor (EGFR), ERBB1 phosphotyrosine kinase siRNA
tatcaagtcatggcaggtacagt

SEQ ID NO: 9222 - DNA, 23 bp, Artificial Sequence
  epidermal growth factor receptor (EGFR), ERBB1 phosphotyrosine kinase siRNA
atcaagtcatggcaggtacagta

SEQ ID NO: 9223 - DNA, 23 bp, Artificial Sequence
  epidermal growth factor receptor (EGFR), ERBB1 phosphotyrosine kinase siRNA
tcaagtcatggcaggtacagtag

SEQ ID NO: 9224 - DNA, 23 bp, Artificial Sequence
  epidermal growth factor receptor (EGFR), ERBB1 phosphotyrosine kinase siRNA
caagtcatggcaggtacagtagg

SEQ ID NO: 9225 - DNA, 23 bp, Artificial Sequence
  epidermal growth factor receptor (EGFR), ERBB1 phosphotyrosine kinase siRNA
aagtcatggcaggtacagtagga

SEQ ID NO: 9226 - DNA, 23 bp, Artificial Sequence
  epidermal growth factor receptor (EGFR), ERBB1 phosphotyrosine kinase siRNA
agtcatggcaggtacagtaggat

SEQ ID NO: 9227 - DNA, 23 bp, Artificial Sequence
  epidermal growth factor receptor (EGFR), ERBB1 phosphotyrosine kinase siRNA
gtcatggcaggtacagtaggata

SEQ ID NO: 9228 - DNA, 23 bp, Artificial Sequence
  epidermal growth factor receptor (EGFR), ERBB1 phosphotyrosine kinase siRNA
tcatggcaggtacagtaggataa

SEQ ID NO: 9229 - DNA, 23 bp, Artificial Sequence
  epidermal growth factor receptor (EGFR), ERBB1 phosphotyrosine kinase siRNA
catggcaggtacagtaggataag

SEQ ID NO: 9230 - DNA, 23 bp, Artificial Sequence
  epidermal growth factor receptor (EGFR), ERBB1 phosphotyrosine kinase siRNA
atggcaggtacagtaggataagc

SEQ ID NO: 9231 - DNA, 23 bp, Artificial Sequence
  epidermal growth factor receptor (EGFR), ERBB1 phosphotyrosine kinase siRNA
tggcaggtacagtaggataagcc

SEQ ID NO: 9232 - DNA, 23 bp, Artificial Sequence
  epidermal growth factor receptor (EGFR), ERBB1 phosphotyrosine kinase siRNA
ggcaggtacagtaggataagcca

SEQ ID NO: 9233 - DNA, 23 bp, Artificial Sequence
  epidermal growth factor receptor (EGFR), ERBB1 phosphotyrosine kinase siRNA
gcaggtacagtaggataagccac

SEQ ID NO: 9234 - DNA, 23 bp, Artificial Sequence
  epidermal growth factor receptor (EGFR), ERBB1 phosphotyrosine kinase siRNA
caggtacagtaggataagccact

SEQ ID NO: 9235 - DNA, 23 bp, Artificial Sequence
  epidermal growth factor receptor (EGFR), ERBB1 phosphotyrosine kinase siRNA
aggtacagtaggataagccactc

SEQ ID NO: 9236 - DNA, 23 bp, Artificial Sequence
  epidermal growth factor receptor (EGFR), ERBB1 phosphotyrosine kinase siRNA
ggtacagtaggataagccactct

SEQ ID NO: 9237 - DNA, 23 bp, Artificial Sequence
  epidermal growth factor receptor (EGFR), ERBB1 phosphotyrosine kinase siRNA
gtacagtaggataagccactctg

SEQ ID NO: 9238 - DNA, 23 bp, Artificial Sequence
  epidermal growth factor receptor (EGFR), ERBB1 phosphotyrosine kinase siRNA
tacagtaggataagccactctgt

SEQ ID NO: 9239 - DNA, 23 bp, Artificial Sequence
  epidermal growth factor receptor (EGFR), ERBB1 phosphotyrosine kinase siRNA
acagtaggataagccactctgtc

SEQ ID NO: 9240 - DNA, 23 bp, Artificial Sequence
  epidermal growth factor receptor (EGFR), ERBB1 phosphotyrosine kinase siRNA
cagtaggataagccactctgtcc

SEQ ID NO: 9241 - DNA, 23 bp, Artificial Sequence
  epidermal growth factor receptor (EGFR), ERBB1 phosphotyrosine kinase siRNA
agtaggataagccactctgtccc

SEQ ID NO: 9242 - DNA, 23 bp, Artificial Sequence
  epidermal growth factor receptor (EGFR), ERBB1 phosphotyrosine kinase siRNA
gtaggataagccactctgtccct

SEQ ID NO: 9243 - DNA, 23 bp, Artificial Sequence
  epidermal growth factor receptor (EGFR), ERBB1 phosphotyrosine kinase siRNA
taggataagccactctgtccctt

SEQ ID NO: 9244 - DNA, 23 bp, Artificial Sequence
  epidermal growth factor receptor (EGFR), ERBB1 phosphotyrosine kinase siRNA
aggataagccactctgtcccttc

SEQ ID NO: 9245 - DNA, 23 bp, Artificial Sequence
  epidermal growth factor receptor (EGFR), ERBB1 phosphotyrosine kinase siRNA
ggataagccactctgtcccttcc

SEQ ID NO: 9246 - DNA, 23 bp, Artificial Sequence
  epidermal growth factor receptor (EGFR), ERBB1 phosphotyrosine kinase siRNA
gataagccactctgtcccttcct

SEQ ID NO: 9247 - DNA, 23 bp, Artificial Sequence
  epidermal growth factor receptor (EGFR), ERBB1 phosphotyrosine kinase siRNA
ataagccactctgtcccttcctg

SEQ ID NO: 9248 - DNA, 23 bp, Artificial Sequence
  epidermal growth factor receptor (EGFR), ERBB1 phosphotyrosine kinase siRNA
taagccactctgtcccttcctgg

SEQ ID NO: 9249 - DNA, 23 bp, Artificial Sequence
  epidermal growth factor receptor (EGFR), ERBB1 phosphotyrosine kinase siRNA
aagccactctgtcccttcctggg

SEQ ID NO: 9250 - DNA, 23 bp, Artificial Sequence
  epidermal growth factor receptor (EGFR), ERBB1 phosphotyrosine kinase siRNA
agccactctgtcccttcctgggc

SEQ ID NO: 9251 - DNA, 23 bp, Artificial Sequence
  epidermal growth factor receptor (EGFR), ERBB1 phosphotyrosine kinase siRNA
gccactctgtcccttcctgggca

SEQ ID NO: 9252 - DNA, 23 bp, Artificial Sequence
  epidermal growth factor receptor (EGFR), ERBB1 phosphotyrosine kinase siRNA
ccactctgtcccttcctgggcaa

SEQ ID NO: 9253 - DNA, 23 bp, Artificial Sequence
  epidermal growth factor receptor (EGFR), ERBB1 phosphotyrosine kinase siRNA
cactctgtcccttcctgggcaaa

SEQ ID NO: 9254 - DNA, 23 bp, Artificial Sequence
  epidermal growth factor receptor (EGFR), ERBB1 phosphotyrosine kinase siRNA
actctgtcccttcctgggcaaag

SEQ ID NO: 9255 - DNA, 23 bp, Artificial Sequence
  epidermal growth factor receptor (EGFR), ERBB1 phosphotyrosine kinase siRNA
ctctgtcccttcctgggcaaaga

SEQ ID NO: 9256 - DNA, 23 bp, Artificial Sequence
  epidermal growth factor receptor (EGFR), ERBB1 phosphotyrosine kinase siRNA
tctgtcccttcctgggcaaagaa

SEQ ID NO: 9257 - DNA, 23 bp, Artificial Sequence
  epidermal growth factor receptor (EGFR), ERBB1 phosphotyrosine kinase siRNA
ctgtcccttcctgggcaaagaag

SEQ ID NO: 9258 - DNA, 23 bp, Artificial Sequence
  epidermal growth factor receptor (EGFR), ERBB1 phosphotyrosine kinase siRNA
tgtcccttcctgggcaaagaaga

SEQ ID NO: 9259 - DNA, 23 bp, Artificial Sequence
  epidermal growth factor receptor (EGFR), ERBB1 phosphotyrosine kinase siRNA
gtcccttcctgggcaaagaagaa

SEQ ID NO: 9260 - DNA, 23 bp, Artificial Sequence
  epidermal growth factor receptor (EGFR), ERBB1 phosphotyrosine kinase siRNA
tcccttcctgggcaaagaagaaa

SEQ ID NO: 9261 - DNA, 23 bp, Artificial Sequence
  epidermal growth factor receptor (EGFR), ERBB1 phosphotyrosine kinase siRNA
cccttcctgggcaaagaagaaac

SEQ ID NO: 9262 - DNA, 23 bp, Artificial Sequence
  epidermal growth factor receptor (EGFR), ERBB1 phosphotyrosine kinase siRNA
ccttcctgggcaaagaagaaacg

SEQ ID NO: 9263 - DNA, 23 bp, Artificial Sequence
  epidermal growth factor receptor (EGFR), ERBB1 phosphotyrosine kinase siRNA
cttcctgggcaaagaagaaacgg

SEQ ID NO: 9264 - DNA, 23 bp, Artificial Sequence
  epidermal growth factor receptor (EGFR), ERBB1 phosphotyrosine kinase siRNA
ttcctgggcaaagaagaaacgga

SEQ ID NO: 9265 - DNA, 23 bp, Artificial Sequence
  epidermal growth factor receptor (EGFR), ERBB1 phosphotyrosine kinase siRNA
tcctgggcaaagaagaaacggag

SEQ ID NO: 9266 - DNA, 23 bp, Artificial Sequence
  epidermal growth factor receptor (EGFR), ERBB1 phosphotyrosine kinase siRNA
cctgggcaaagaagaaacggagg

SEQ ID NO: 9267 - DNA, 23 bp, Artificial Sequence
  epidermal growth factor receptor (EGFR), ERBB1 phosphotyrosine kinase siRNA
ctgggcaaagaagaaacggaggg

SEQ ID NO: 9268 - DNA, 23 bp, Artificial Sequence
  epidermal growth factor receptor (EGFR), ERBB1 phosphotyrosine kinase siRNA
tgggcaaagaagaaacggagggg

SEQ ID NO: 9269 - DNA, 23 bp, Artificial Sequence
  epidermal growth factor receptor (EGFR), ERBB1 phosphotyrosine kinase siRNA
gggcaaagaagaaacggagggga

SEQ ID NO: 9270 - DNA, 23 bp, Artificial Sequence
  epidermal growth factor receptor (EGFR), ERBB1 phosphotyrosine kinase siRNA
ggcaaagaagaaacggaggggat

SEQ ID NO: 9271 - DNA, 23 bp, Artificial Sequence
  epidermal growth factor receptor (EGFR), ERBB1 phosphotyrosine kinase siRNA
gcaaagaagaaacggaggggatg

SEQ ID NO: 9272 - DNA, 23 bp, Artificial Sequence
  epidermal growth factor receptor (EGFR), ERBB1 phosphotyrosine kinase siRNA
caaagaagaaacggaggggatgg

SEQ ID NO: 9273 - DNA, 23 bp, Artificial Sequence
  epidermal growth factor receptor (EGFR), ERBB1 phosphotyrosine kinase siRNA
aaagaagaaacggaggggatgga

SEQ ID NO: 9274 - DNA, 23 bp, Artificial Sequence
  epidermal growth factor receptor (EGFR), ERBB1 phosphotyrosine kinase siRNA
aagaagaaacggaggggatggaa

SEQ ID NO: 9275 - DNA, 23 bp, Artificial Sequence
  epidermal growth factor receptor (EGFR), ERBB1 phosphotyrosine kinase siRNA
agaagaaacggaggggatggaat

SEQ ID NO: 9276 - DNA, 23 bp, Artificial Sequence
  epidermal growth factor receptor (EGFR), ERBB1 phosphotyrosine kinase siRNA
gaagaaacggaggggatggaatt

SEQ ID NO: 9277 - DNA, 23 bp, Artificial Sequence
  epidermal growth factor receptor (EGFR), ERBB1 phosphotyrosine kinase siRNA
aagaaacggaggggatggaattc

SEQ ID NO: 9278 - DNA, 23 bp, Artificial Sequence
  epidermal growth factor receptor (EGFR), ERBB1 phosphotyrosine kinase siRNA
agaaacggaggggatggaattct

SEQ ID NO: 9279 - DNA, 23 bp, Artificial Sequence
  epidermal growth factor receptor (EGFR), ERBB1 phosphotyrosine kinase siRNA
gaaacggaggggatggaattctt

SEQ ID NO: 9280 - DNA, 23 bp, Artificial Sequence
  epidermal growth factor receptor (EGFR), ERBB1 phosphotyrosine kinase siRNA
aaacggaggggatggaattcttc

SEQ ID NO: 9281 - DNA, 23 bp, Artificial Sequence
  epidermal growth factor receptor (EGFR), ERBB1 phosphotyrosine kinase siRNA
aacggaggggatggaattcttcc

SEQ ID NO: 9282 - DNA, 23 bp, Artificial Sequence
  epidermal growth factor receptor (EGFR), ERBB1 phosphotyrosine kinase siRNA
acggaggggatggaattcttcct

SEQ ID NO: 9283 - DNA, 23 bp, Artificial Sequence
  epidermal growth factor receptor (EGFR), ERBB1 phosphotyrosine kinase siRNA
cggaggggatggaattcttcctt

SEQ ID NO: 9284 - DNA, 23 bp, Artificial Sequence
  epidermal growth factor receptor (EGFR), ERBB1 phosphotyrosine kinase siRNA
ggaggggatggaattcttcctta

SEQ ID NO: 9285 - DNA, 23 bp, Artificial Sequence
  epidermal growth factor receptor (EGFR), ERBB1 phosphotyrosine kinase siRNA
gaggggatggaattcttccttag

SEQ ID NO: 9286 - DNA, 23 bp, Artificial Sequence
  epidermal growth factor receptor (EGFR), ERBB1 phosphotyrosine kinase siRNA
aggggatggaattcttccttaga

SEQ ID NO: 9287 - DNA, 23 bp, Artificial Sequence
  epidermal growth factor receptor (EGFR), ERBB1 phosphotyrosine kinase siRNA
ggggatggaattcttccttagac

SEQ ID NO: 9288 - DNA, 23 bp, Artificial Sequence
  epidermal growth factor receptor (EGFR), ERBB1 phosphotyrosine kinase siRNA
gggatggaattcttccttagact

SEQ ID NO: 9289 - DNA, 23 bp, Artificial Sequence
  epidermal growth factor receptor (EGFR), ERBB1 phosphotyrosine kinase siRNA
ggatggaattcttccttagactt

SEQ ID NO: 9290 - DNA, 23 bp, Artificial Sequence
  epidermal growth factor receptor (EGFR), ERBB1 phosphotyrosine kinase siRNA
gatggaattcttccttagactta

SEQ ID NO: 9291 - DNA, 23 bp, Artificial Sequence
  epidermal growth factor receptor (EGFR), ERBB1 phosphotyrosine kinase siRNA
atggaattcttccttagacttac

SEQ ID NO: 9292 - DNA, 23 bp, Artificial Sequence
  epidermal growth factor receptor (EGFR), ERBB1 phosphotyrosine kinase siRNA
tggaattcttccttagacttact

SEQ ID NO: 9293 - DNA, 23 bp, Artificial Sequence
  epidermal growth factor receptor (EGFR), ERBB1 phosphotyrosine kinase siRNA
ggaattcttccttagacttactt

SEQ ID NO: 9294 - DNA, 23 bp, Artificial Sequence
  epidermal growth factor receptor (EGFR), ERBB1 phosphotyrosine kinase siRNA
gaattcttccttagacttacttt

SEQ ID NO: 9295 - DNA, 23 bp, Artificial Sequence
  epidermal growth factor receptor (EGFR), ERBB1 phosphotyrosine kinase siRNA
aattcttccttagacttactttt

SEQ ID NO: 9296 - DNA, 23 bp, Artificial Sequence
  epidermal growth factor receptor (EGFR), ERBB1 phosphotyrosine kinase siRNA
attcttccttagacttacttttg

SEQ ID NO: 9297 - DNA, 23 bp, Artificial Sequence
  epidermal growth factor receptor (EGFR), ERBB1 phosphotyrosine kinase siRNA
ttcttccttagacttacttttgt

SEQ ID NO: 9298 - DNA, 23 bp, Artificial Sequence
  epidermal growth factor receptor (EGFR), ERBB1 phosphotyrosine kinase siRNA
tcttccttagacttacttttgta

SEQ ID NO: 9299 - DNA, 23 bp, Artificial Sequence
  epidermal growth factor receptor (EGFR), ERBB1 phosphotyrosine kinase siRNA
cttccttagacttacttttgtaa

SEQ ID NO: 9300 - DNA, 23 bp, Artificial Sequence
  epidermal growth factor receptor (EGFR), ERBB1 phosphotyrosine kinase siRNA
ttccttagacttacttttgtaaa

SEQ ID NO: 9301 - DNA, 23 bp, Artificial Sequence
  epidermal growth factor receptor (EGFR), ERBB1 phosphotyrosine kinase siRNA
tccttagacttacttttgtaaaa

SEQ ID NO: 9302 - DNA, 23 bp, Artificial Sequence
  epidermal growth factor receptor (EGFR), ERBB1 phosphotyrosine kinase siRNA
ccttagacttacttttgtaaaaa

SEQ ID NO: 9303 - DNA, 23 bp, Artificial Sequence
  epidermal growth factor receptor (EGFR), ERBB1 phosphotyrosine kinase siRNA
cttagacttacttttgtaaaaat

SEQ ID NO: 9304 - DNA, 23 bp, Artificial Sequence
  epidermal growth factor receptor (EGFR), ERBB1 phosphotyrosine kinase siRNA
ttagacttacttttgtaaaaatg

SEQ ID NO: 9305 - DNA, 23 bp, Artificial Sequence
  epidermal growth factor receptor (EGFR), ERBB1 phosphotyrosine kinase siRNA
tagacttacttttgtaaaaatgt

SEQ ID NO: 9306 - DNA, 23 bp, Artificial Sequence
  epidermal growth factor receptor (EGFR), ERBB1 phosphotyrosine kinase siRNA
agacttacttttgtaaaaatgtc

SEQ ID NO: 9307 - DNA, 23 bp, Artificial Sequence
  epidermal growth factor receptor (EGFR), ERBB1 phosphotyrosine kinase siRNA
gacttacttttgtaaaaatgtcc

SEQ ID NO: 9308 - DNA, 23 bp, Artificial Sequence
  epidermal growth factor receptor (EGFR), ERBB1 phosphotyrosine kinase siRNA
acttacttttgtaaaaatgtccc

SEQ ID NO: 9309 - DNA, 23 bp, Artificial Sequence
  epidermal growth factor receptor (EGFR), ERBB1 phosphotyrosine kinase siRNA
cttacttttgtaaaaatgtcccc

SEQ ID NO: 9310 - DNA, 23 bp, Artificial Sequence
  epidermal growth factor receptor (EGFR), ERBB1 phosphotyrosine kinase siRNA
ttacttttgtaaaaatgtcccca

SEQ ID NO: 9311 - DNA, 23 bp, Artificial Sequence
  epidermal growth factor receptor (EGFR), ERBB1 phosphotyrosine kinase siRNA
tacttttgtaaaaatgtccccac

SEQ ID NO: 9312 - DNA, 23 bp, Artificial Sequence
  epidermal growth factor receptor (EGFR), ERBB1 phosphotyrosine kinase siRNA
acttttgtaaaaatgtccccacg

SEQ ID NO: 9313 - DNA, 23 bp, Artificial Sequence
  epidermal growth factor receptor (EGFR), ERBB1 phosphotyrosine kinase siRNA
cttttgtaaaaatgtccccacgg

SEQ ID NO: 9314 - DNA, 23 bp, Artificial Sequence
  epidermal growth factor receptor (EGFR), ERBB1 phosphotyrosine kinase siRNA
ttttgtaaaaatgtccccacggt

SEQ ID NO: 9315 - DNA, 23 bp, Artificial Sequence
  epidermal growth factor receptor (EGFR), ERBB1 phosphotyrosine kinase siRNA
tttgtaaaaatgtccccacggta

SEQ ID NO: 9316 - DNA, 23 bp, Artificial Sequence
  epidermal growth factor receptor (EGFR), ERBB1 phosphotyrosine kinase siRNA
ttgtaaaaatgtccccacggtac

SEQ ID NO: 9317 - DNA, 23 bp, Artificial Sequence
  epidermal growth factor receptor (EGFR), ERBB1 phosphotyrosine kinase siRNA
tgtaaaaatgtccccacggtact

SEQ ID NO: 9318 - DNA, 23 bp, Artificial Sequence
  epidermal growth factor receptor (EGFR), ERBB1 phosphotyrosine kinase siRNA
gtaaaaatgtccccacggtactt

SEQ ID NO: 9319 - DNA, 23 bp, Artificial Sequence
  epidermal growth factor receptor (EGFR), ERBB1 phosphotyrosine kinase siRNA
taaaaatgtccccacggtactta

SEQ ID NO: 9320 - DNA, 23 bp, Artificial Sequence
  epidermal growth factor receptor (EGFR), ERBB1 phosphotyrosine kinase siRNA
aaaaatgtccccacggtacttac

SEQ ID NO: 9321 - DNA, 23 bp, Artificial Sequence
  epidermal growth factor receptor (EGFR), ERBB1 phosphotyrosine kinase siRNA
aaaatgtccccacggtacttact

SEQ ID NO: 9322 - DNA, 23 bp, Artificial Sequence
  epidermal growth factor receptor (EGFR), ERBB1 phosphotyrosine kinase siRNA
aaatgtccccacggtacttactc

SEQ ID NO: 9323 - DNA, 23 bp, Artificial Sequence
  epidermal growth factor receptor (EGFR), ERBB1 phosphotyrosine kinase siRNA
aatgtccccacggtacttactcc

SEQ ID NO: 9324 - DNA, 23 bp, Artificial Sequence
  epidermal growth factor receptor (EGFR), ERBB1 phosphotyrosine kinase siRNA
atgtccccacggtacttactccc

SEQ ID NO: 9325 - DNA, 23 bp, Artificial Sequence
  epidermal growth factor receptor (EGFR), ERBB1 phosphotyrosine kinase siRNA
tgtccccacggtacttactcccc

SEQ ID NO: 9326 - DNA, 23 bp, Artificial Sequence
  epidermal growth factor receptor (EGFR), ERBB1 phosphotyrosine kinase siRNA
gtccccacggtacttactcccca

SEQ ID NO: 9327 - DNA, 23 bp, Artificial Sequence
  epidermal growth factor receptor (EGFR), ERBB1 phosphotyrosine kinase siRNA
tccccacggtacttactccccac

SEQ ID NO: 9328 - DNA, 23 bp, Artificial Sequence
  epidermal growth factor receptor (EGFR), ERBB1 phosphotyrosine kinase siRNA
ccccacggtacttactccccact

SEQ ID NO: 9329 - DNA, 23 bp, Artificial Sequence
  epidermal growth factor receptor (EGFR), ERBB1 phosphotyrosine kinase siRNA
cccacggtacttactccccactg

SEQ ID NO: 9330 - DNA, 23 bp, Artificial Sequence
  epidermal growth factor receptor (EGFR), ERBB1 phosphotyrosine kinase siRNA
ccacggtacttactccccactga

SEQ ID NO: 9331 - DNA, 23 bp, Artificial Sequence
  epidermal growth factor receptor (EGFR), ERBB1 phosphotyrosine kinase siRNA
cacggtacttactccccactgat

SEQ ID NO: 9332 - DNA, 23 bp, Artificial Sequence
  epidermal growth factor receptor (EGFR), ERBB1 phosphotyrosine kinase siRNA
acggtacttactccccactgatg

SEQ ID NO: 9333 - DNA, 23 bp, Artificial Sequence
  epidermal growth factor receptor (EGFR), ERBB1 phosphotyrosine kinase siRNA
cggtacttactccccactgatgg

SEQ ID NO: 9334 - DNA, 23 bp, Artificial Sequence
  epidermal growth factor receptor (EGFR), ERBB1 phosphotyrosine kinase siRNA
ggtacttactccccactgatgga

SEQ ID NO: 9335 - DNA, 23 bp, Artificial Sequence
  epidermal growth factor receptor (EGFR), ERBB1 phosphotyrosine kinase siRNA
gtacttactccccactgatggac

SEQ ID NO: 9336 - DNA, 23 bp, Artificial Sequence
  epidermal growth factor receptor (EGFR), ERBB1 phosphotyrosine kinase siRNA
tacttactccccactgatggacc

SEQ ID NO: 9337 - DNA, 23 bp, Artificial Sequence
  epidermal growth factor receptor (EGFR), ERBB1 phosphotyrosine kinase siRNA
acttactccccactgatggacca

SEQ ID NO: 9338 - DNA, 23 bp, Artificial Sequence
  epidermal growth factor receptor (EGFR), ERBB1 phosphotyrosine kinase siRNA
cttactccccactgatggaccag

SEQ ID NO: 9339 - DNA, 23 bp, Artificial Sequence
  epidermal growth factor receptor (EGFR), ERBB1 phosphotyrosine kinase siRNA
ttactccccactgatggaccagt

SEQ ID NO: 9340 - DNA, 23 bp, Artificial Sequence
  epidermal growth factor receptor (EGFR), ERBB1 phosphotyrosine kinase siRNA
tactccccactgatggaccagtg

SEQ ID NO: 9341 - DNA, 23 bp, Artificial Sequence
  epidermal growth factor receptor (EGFR), ERBB1 phosphotyrosine kinase siRNA
actccccactgatggaccagtgg

SEQ ID NO: 9342 - DNA, 23 bp, Artificial Sequence
  epidermal growth factor receptor (EGFR), ERBB1 phosphotyrosine kinase siRNA
ctccccactgatggaccagtggt

SEQ ID NO: 9343 - DNA, 23 bp, Artificial Sequence
  epidermal growth factor receptor (EGFR), ERBB1 phosphotyrosine kinase siRNA
tccccactgatggaccagtggtt

SEQ ID NO: 9344 - DNA, 23 bp, Artificial Sequence
  epidermal growth factor receptor (EGFR), ERBB1 phosphotyrosine kinase siRNA
ccccactgatggaccagtggttt

SEQ ID NO: 9345 - DNA, 23 bp, Artificial Sequence
  epidermal growth factor receptor (EGFR), ERBB1 phosphotyrosine kinase siRNA
cccactgatggaccagtggtttc

SEQ ID NO: 9346 - DNA, 23 bp, Artificial Sequence
  epidermal growth factor receptor (EGFR), ERBB1 phosphotyrosine kinase siRNA
ccactgatggaccagtggtttcc

SEQ ID NO: 9347 - DNA, 23 bp, Artificial Sequence
  epidermal growth factor receptor (EGFR), ERBB1 phosphotyrosine kinase siRNA
cactgatggaccagtggtttcca

SEQ ID NO: 9348 - DNA, 23 bp, Artificial Sequence
  epidermal growth factor receptor (EGFR), ERBB1 phosphotyrosine kinase siRNA
actgatggaccagtggtttccag

SEQ ID NO: 9349 - DNA, 23 bp, Artificial Sequence
  epidermal growth factor receptor (EGFR), ERBB1 phosphotyrosine kinase siRNA
ctgatggaccagtggtttccagt

SEQ ID NO: 9350 - DNA, 23 bp, Artificial Sequence
  epidermal growth factor receptor (EGFR), ERBB1 phosphotyrosine kinase siRNA
tgatggaccagtggtttccagtc

SEQ ID NO: 9351 - DNA, 23 bp, Artificial Sequence
  epidermal growth factor receptor (EGFR), ERBB1 phosphotyrosine kinase siRNA
gatggaccagtggtttccagtca

SEQ ID NO: 9352 - DNA, 23 bp, Artificial Sequence
  epidermal growth factor receptor (EGFR), ERBB1 phosphotyrosine kinase siRNA
atggaccagtggtttccagtcat

SEQ ID NO: 9353 - DNA, 23 bp, Artificial Sequence
  epidermal growth factor receptor (EGFR), ERBB1 phosphotyrosine kinase siRNA
tggaccagtggtttccagtcatg

SEQ ID NO: 9354 - DNA, 23 bp, Artificial Sequence
  epidermal growth factor receptor (EGFR), ERBB1 phosphotyrosine kinase siRNA
ggaccagtggtttccagtcatga

SEQ ID NO: 9355 - DNA, 23 bp, Artificial Sequence
  epidermal growth factor receptor (EGFR), ERBB1 phosphotyrosine kinase siRNA
gaccagtggtttccagtcatgag

SEQ ID NO: 9356 - DNA, 23 bp, Artificial Sequence
  epidermal growth factor receptor (EGFR), ERBB1 phosphotyrosine kinase siRNA
accagtggtttccagtcatgagc

SEQ ID NO: 9357 - DNA, 23 bp, Artificial Sequence
  epidermal growth factor receptor (EGFR), ERBB1 phosphotyrosine kinase siRNA
ccagtggtttccagtcatgagcg

SEQ ID NO: 9358 - DNA, 23 bp, Artificial Sequence
  epidermal growth factor receptor (EGFR), ERBB1 phosphotyrosine kinase siRNA
cagtggtttccagtcatgagcgt

SEQ ID NO: 9359 - DNA, 23 bp, Artificial Sequence
  epidermal growth factor receptor (EGFR), ERBB1 phosphotyrosine kinase siRNA
agtggtttccagtcatgagcgtt

SEQ ID NO: 9360 - DNA, 23 bp, Artificial Sequence
  epidermal growth factor receptor (EGFR), ERBB1 phosphotyrosine kinase siRNA
gtggtttccagtcatgagcgtta

SEQ ID NO: 9361 - DNA, 23 bp, Artificial Sequence
  epidermal growth factor receptor (EGFR), ERBB1 phosphotyrosine kinase siRNA
tggtttccagtcatgagcgttag

SEQ ID NO: 9362 - DNA, 23 bp, Artificial Sequence
  epidermal growth factor receptor (EGFR), ERBB1 phosphotyrosine kinase siRNA
ggtttccagtcatgagcgttaga

SEQ ID NO: 9363 - DNA, 23 bp, Artificial Sequence
  epidermal growth factor receptor (EGFR), ERBB1 phosphotyrosine kinase siRNA
gtttccagtcatgagcgttagac

SEQ ID NO: 9364 - DNA, 23 bp, Artificial Sequence
  epidermal growth factor receptor (EGFR), ERBB1 phosphotyrosine kinase siRNA
tttccagtcatgagcgttagact

SEQ ID NO: 9365 - DNA, 23 bp, Artificial Sequence
  epidermal growth factor receptor (EGFR), ERBB1 phosphotyrosine kinase siRNA
ttccagtcatgagcgttagactg

SEQ ID NO: 9366 - DNA, 23 bp, Artificial Sequence
  epidermal growth factor receptor (EGFR), ERBB1 phosphotyrosine kinase siRNA
tccagtcatgagcgttagactga

SEQ ID NO: 9367 - DNA, 23 bp, Artificial Sequence
  epidermal growth factor receptor (EGFR), ERBB1 phosphotyrosine kinase siRNA
ccagtcatgagcgttagactgac

SEQ ID NO: 9368 - DNA, 23 bp, Artificial Sequence
  epidermal growth factor receptor (EGFR), ERBB1 phosphotyrosine kinase siRNA
cagtcatgagcgttagactgact

SEQ ID NO: 9369 - DNA, 23 bp, Artificial Sequence
  epidermal growth factor receptor (EGFR), ERBB1 phosphotyrosine kinase siRNA
agtcatgagcgttagactgactt

SEQ ID NO: 9370 - DNA, 23 bp, Artificial Sequence
  epidermal growth factor receptor (EGFR), ERBB1 phosphotyrosine kinase siRNA
gtcatgagcgttagactgacttg

SEQ ID NO: 9371 - DNA, 23 bp, Artificial Sequence
  epidermal growth factor receptor (EGFR), ERBB1 phosphotyrosine kinase siRNA
tcatgagcgttagactgacttgt

SEQ ID NO: 9372 - DNA, 23 bp, Artificial Sequence
  epidermal growth factor receptor (EGFR), ERBB1 phosphotyrosine kinase siRNA
catgagcgttagactgacttgtt

SEQ ID NO: 9373 - DNA, 23 bp, Artificial Sequence
  epidermal growth factor receptor (EGFR), ERBB1 phosphotyrosine kinase siRNA
atgagcgttagactgacttgttt

SEQ ID NO: 9374 - DNA, 23 bp, Artificial Sequence
  epidermal growth factor receptor (EGFR), ERBB1 phosphotyrosine kinase siRNA
tgagcgttagactgacttgtttg

SEQ ID NO: 9375 - DNA, 23 bp, Artificial Sequence
  epidermal growth factor receptor (EGFR), ERBB1 phosphotyrosine kinase siRNA
gagcgttagactgacttgtttgt

SEQ ID NO: 9376 - DNA, 23 bp, Artificial Sequence
  epidermal growth factor receptor (EGFR), ERBB1 phosphotyrosine kinase siRNA
agcgttagactgacttgtttgtc

SEQ ID NO: 9377 - DNA, 23 bp, Artificial Sequence
  epidermal growth factor receptor (EGFR), ERBB1 phosphotyrosine kinase siRNA
gcgttagactgacttgtttgtct

SEQ ID NO: 9378 - DNA, 23 bp, Artificial Sequence
  epidermal growth factor receptor (EGFR), ERBB1 phosphotyrosine kinase siRNA
cgttagactgacttgtttgtctt

SEQ ID NO: 9379 - DNA, 23 bp, Artificial Sequence
  epidermal growth factor receptor (EGFR), ERBB1 phosphotyrosine kinase siRNA
gttagactgacttgtttgtcttc

SEQ ID NO: 9380 - DNA, 23 bp, Artificial Sequence
  epidermal growth factor receptor (EGFR), ERBB1 phosphotyrosine kinase siRNA
ttagactgacttgtttgtcttcc

SEQ ID NO: 9381 - DNA, 23 bp, Artificial Sequence
  epidermal growth factor receptor (EGFR), ERBB1 phosphotyrosine kinase siRNA
tagactgacttgtttgtcttcca

SEQ ID NO: 9382 - DNA, 23 bp, Artificial Sequence
  epidermal growth factor receptor (EGFR), ERBB1 phosphotyrosine kinase siRNA
agactgacttgtttgtcttccat

SEQ ID NO: 9383 - DNA, 23 bp, Artificial Sequence
  epidermal growth factor receptor (EGFR), ERBB1 phosphotyrosine kinase siRNA
gactgacttgtttgtcttccatt

SEQ ID NO: 9384 - DNA, 23 bp, Artificial Sequence
  epidermal growth factor receptor (EGFR), ERBB1 phosphotyrosine kinase siRNA
actgacttgtttgtcttccattc

SEQ ID NO: 9385 - DNA, 23 bp, Artificial Sequence
  epidermal growth factor receptor (EGFR), ERBB1 phosphotyrosine kinase siRNA
ctgacttgtttgtcttccattcc

SEQ ID NO: 9386 - DNA, 23 bp, Artificial Sequence
  epidermal growth factor receptor (EGFR), ERBB1 phosphotyrosine kinase siRNA
tgacttgtttgtcttccattcca

SEQ ID NO: 9387 - DNA, 23 bp, Artificial Sequence
  epidermal growth factor receptor (EGFR), ERBB1 phosphotyrosine kinase siRNA
gacttgtttgtcttccattccat

SEQ ID NO: 9388 - DNA, 23 bp, Artificial Sequence
  epidermal growth factor receptor (EGFR), ERBB1 phosphotyrosine kinase siRNA
acttgtttgtcttccattccatt

SEQ ID NO: 9389 - DNA, 23 bp, Artificial Sequence
  epidermal growth factor receptor (EGFR), ERBB1 phosphotyrosine kinase siRNA
cttgtttgtcttccattccattg

SEQ ID NO: 9390 - DNA, 23 bp, Artificial Sequence
  epidermal growth factor receptor (EGFR), ERBB1 phosphotyrosine kinase siRNA
ttgtttgtcttccattccattgt

SEQ ID NO: 9391 - DNA, 23 bp, Artificial Sequence
  epidermal growth factor receptor (EGFR), ERBB1 phosphotyrosine kinase siRNA
tgtttgtcttccattccattgtt

SEQ ID NO: 9392 - DNA, 23 bp, Artificial Sequence
  epidermal growth factor receptor (EGFR), ERBB1 phosphotyrosine kinase siRNA
gtttgtcttccattccattgttt

SEQ ID NO: 9393 - DNA, 23 bp, Artificial Sequence
  epidermal growth factor receptor (EGFR), ERBB1 phosphotyrosine kinase siRNA
tttgtcttccattccattgtttt

SEQ ID NO: 9394 - DNA, 23 bp, Artificial Sequence
  epidermal growth factor receptor (EGFR), ERBB1 phosphotyrosine kinase siRNA
ttgtcttccattccattgttttg

SEQ ID NO: 9395 - DNA, 23 bp, Artificial Sequence
  epidermal growth factor receptor (EGFR), ERBB1 phosphotyrosine kinase siRNA
tgtcttccattccattgttttga

SEQ ID NO: 9396 - DNA, 23 bp, Artificial Sequence
  epidermal growth factor receptor (EGFR), ERBB1 phosphotyrosine kinase siRNA
gtcttccattccattgttttgaa

SEQ ID NO: 9397 - DNA, 23 bp, Artificial Sequence
  epidermal growth factor receptor (EGFR), ERBB1 phosphotyrosine kinase siRNA
tcttccattccattgttttgaaa

SEQ ID NO: 9398 - DNA, 23 bp, Artificial Sequence
  epidermal growth factor receptor (EGFR), ERBB1 phosphotyrosine kinase siRNA
cttccattccattgttttgaaac

SEQ ID NO: 9399 - DNA, 23 bp, Artificial Sequence
  epidermal growth factor receptor (EGFR), ERBB1 phosphotyrosine kinase siRNA
ttccattccattgttttgaaact

SEQ ID NO: 9400 - DNA, 23 bp, Artificial Sequence
  epidermal growth factor receptor (EGFR), ERBB1 phosphotyrosine kinase siRNA
tccattccattgttttgaaactc

SEQ ID NO: 9401 - DNA, 23 bp, Artificial Sequence
  epidermal growth factor receptor (EGFR), ERBB1 phosphotyrosine kinase siRNA
ccattccattgttttgaaactca

SEQ ID NO: 9402 - DNA, 23 bp, Artificial Sequence
  epidermal growth factor receptor (EGFR), ERBB1 phosphotyrosine kinase siRNA
cattccattgttttgaaactcag

SEQ ID NO: 9403 - DNA, 23 bp, Artificial Sequence
  epidermal growth factor receptor (EGFR), ERBB1 phosphotyrosine kinase siRNA
attccattgttttgaaactcagt

SEQ ID NO: 9404 - DNA, 23 bp, Artificial Sequence
  epidermal growth factor receptor (EGFR), ERBB1 phosphotyrosine kinase siRNA
ttccattgttttgaaactcagta

SEQ ID NO: 9405 - DNA, 23 bp, Artificial Sequence
  epidermal growth factor receptor (EGFR), ERBB1 phosphotyrosine kinase siRNA
tccattgttttgaaactcagtat

SEQ ID NO: 9406 - DNA, 23 bp, Artificial Sequence
  epidermal growth factor receptor (EGFR), ERBB1 phosphotyrosine kinase siRNA
ccattgttttgaaactcagtatg

SEQ ID NO: 9407 - DNA, 23 bp, Artificial Sequence
  epidermal growth factor receptor (EGFR), ERBB1 phosphotyrosine kinase siRNA
cattgttttgaaactcagtatgc

SEQ ID NO: 9408 - DNA, 23 bp, Artificial Sequence
  epidermal growth factor receptor (EGFR), ERBB1 phosphotyrosine kinase siRNA
attgttttgaaactcagtatgct

SEQ ID NO: 9409 - DNA, 23 bp, Artificial Sequence
  epidermal growth factor receptor (EGFR), ERBB1 phosphotyrosine kinase siRNA
ttgttttgaaactcagtatgctg

SEQ ID NO: 9410 - DNA, 23 bp, Artificial Sequence
  epidermal growth factor receptor (EGFR), ERBB1 phosphotyrosine kinase siRNA
tgttttgaaactcagtatgctgc

SEQ ID NO: 9411 - DNA, 23 bp, Artificial Sequence
  epidermal growth factor receptor (EGFR), ERBB1 phosphotyrosine kinase siRNA
gttttgaaactcagtatgctgcc

SEQ ID NO: 9412 - DNA, 23 bp, Artificial Sequence
  epidermal growth factor receptor (EGFR), ERBB1 phosphotyrosine kinase siRNA
ttttgaaactcagtatgctgccc

SEQ ID NO: 9413 - DNA, 23 bp, Artificial Sequence
  epidermal growth factor receptor (EGFR), ERBB1 phosphotyrosine kinase siRNA
tttgaaactcagtatgctgcccc

SEQ ID NO: 9414 - DNA, 23 bp, Artificial Sequence
  epidermal growth factor receptor (EGFR), ERBB1 phosphotyrosine kinase siRNA
ttgaaactcagtatgctgcccct

SEQ ID NO: 9415 - DNA, 23 bp, Artificial Sequence
  epidermal growth factor receptor (EGFR), ERBB1 phosphotyrosine kinase siRNA
tgaaactcagtatgctgcccctg

SEQ ID NO: 9416 - DNA, 23 bp, Artificial Sequence
  epidermal growth factor receptor (EGFR), ERBB1 phosphotyrosine kinase siRNA
gaaactcagtatgctgcccctgt

SEQ ID NO: 9417 - DNA, 23 bp, Artificial Sequence
  epidermal growth factor receptor (EGFR), ERBB1 phosphotyrosine kinase siRNA
aaactcagtatgctgcccctgtc

SEQ ID NO: 9418 - DNA, 23 bp, Artificial Sequence
  epidermal growth factor receptor (EGFR), ERBB1 phosphotyrosine kinase siRNA
aactcagtatgctgcccctgtct

SEQ ID NO: 9419 - DNA, 23 bp, Artificial Sequence
  epidermal growth factor receptor (EGFR), ERBB1 phosphotyrosine kinase siRNA
actcagtatgctgcccctgtctt

SEQ ID NO: 9420 - DNA, 23 bp, Artificial Sequence
  epidermal growth factor receptor (EGFR), ERBB1 phosphotyrosine kinase siRNA
ctcagtatgctgcccctgtcttg

SEQ ID NO: 9421 - DNA, 23 bp, Artificial Sequence
  epidermal growth factor receptor (EGFR), ERBB1 phosphotyrosine kinase siRNA
tcagtatgctgcccctgtcttgc

SEQ ID NO: 9422 - DNA, 23 bp, Artificial Sequence
  epidermal growth factor receptor (EGFR), ERBB1 phosphotyrosine kinase siRNA
cagtatgctgcccctgtcttgct

SEQ ID NO: 9423 - DNA, 23 bp, Artificial Sequence
  epidermal growth factor receptor (EGFR), ERBB1 phosphotyrosine kinase siRNA
agtatgctgcccctgtcttgctg

SEQ ID NO: 9424 - DNA, 23 bp, Artificial Sequence
  epidermal growth factor receptor (EGFR), ERBB1 phosphotyrosine kinase siRNA
gtatgctgcccctgtcttgctgt

SEQ ID NO: 9425 - DNA, 23 bp, Artificial Sequence
  epidermal growth factor receptor (EGFR), ERBB1 phosphotyrosine kinase siRNA
tatgctgcccctgtcttgctgtc

SEQ ID NO: 9426 - DNA, 23 bp, Artificial Sequence
  epidermal growth factor receptor (EGFR), ERBB1 phosphotyrosine kinase siRNA
atgctgcccctgtcttgctgtca

SEQ ID NO: 9427 - DNA, 23 bp, Artificial Sequence
  epidermal growth factor receptor (EGFR), ERBB1 phosphotyrosine kinase siRNA
tgctgcccctgtcttgctgtcat

SEQ ID NO: 9428 - DNA, 23 bp, Artificial Sequence
  epidermal growth factor receptor (EGFR), ERBB1 phosphotyrosine kinase siRNA
gctgcccctgtcttgctgtcatg

SEQ ID NO: 9429 - DNA, 23 bp, Artificial Sequence
  epidermal growth factor receptor (EGFR), ERBB1 phosphotyrosine kinase siRNA
ctgcccctgtcttgctgtcatga

SEQ ID NO: 9430 - DNA, 23 bp, Artificial Sequence
  epidermal growth factor receptor (EGFR), ERBB1 phosphotyrosine kinase siRNA
tgcccctgtcttgctgtcatgaa

SEQ ID NO: 9431 - DNA, 23 bp, Artificial Sequence
  epidermal growth factor receptor (EGFR), ERBB1 phosphotyrosine kinase siRNA
gcccctgtcttgctgtcatgaaa

SEQ ID NO: 9432 - DNA, 23 bp, Artificial Sequence
  epidermal growth factor receptor (EGFR), ERBB1 phosphotyrosine kinase siRNA
cccctgtcttgctgtcatgaaat

SEQ ID NO: 9433 - DNA, 23 bp, Artificial Sequence
  epidermal growth factor receptor (EGFR), ERBB1 phosphotyrosine kinase siRNA
ccctgtcttgctgtcatgaaatc

SEQ ID NO: 9434 - DNA, 23 bp, Artificial Sequence
  epidermal growth factor receptor (EGFR), ERBB1 phosphotyrosine kinase siRNA
cctgtcttgctgtcatgaaatca

SEQ ID NO: 9435 - DNA, 23 bp, Artificial Sequence
  epidermal growth factor receptor (EGFR), ERBB1 phosphotyrosine kinase siRNA
ctgtcttgctgtcatgaaatcag

SEQ ID NO: 9436 - DNA, 23 bp, Artificial Sequence
  epidermal growth factor receptor (EGFR), ERBB1 phosphotyrosine kinase siRNA
tgtcttgctgtcatgaaatcagc

SEQ ID NO: 9437 - DNA, 23 bp, Artificial Sequence
  epidermal growth factor receptor (EGFR), ERBB1 phosphotyrosine kinase siRNA
gtcttgctgtcatgaaatcagca

SEQ ID NO: 9438 - DNA, 23 bp, Artificial Sequence
  epidermal growth factor receptor (EGFR), ERBB1 phosphotyrosine kinase siRNA
tcttgctgtcatgaaatcagcaa

SEQ ID NO: 9439 - DNA, 23 bp, Artificial Sequence
  epidermal growth factor receptor (EGFR), ERBB1 phosphotyrosine kinase siRNA
cttgctgtcatgaaatcagcaag

SEQ ID NO: 9440 - DNA, 23 bp, Artificial Sequence
  epidermal growth factor receptor (EGFR), ERBB1 phosphotyrosine kinase siRNA
ttgctgtcatgaaatcagcaaga

SEQ ID NO: 9441 - DNA, 23 bp, Artificial Sequence
  epidermal growth factor receptor (EGFR), ERBB1 phosphotyrosine kinase siRNA
tgctgtcatgaaatcagcaagag

SEQ ID NO: 9442 - DNA, 23 bp, Artificial Sequence
  epidermal growth factor receptor (EGFR), ERBB1 phosphotyrosine kinase siRNA
gctgtcatgaaatcagcaagaga

SEQ ID NO: 9443 - DNA, 23 bp, Artificial Sequence
  epidermal growth factor receptor (EGFR), ERBB1 phosphotyrosine kinase siRNA
ctgtcatgaaatcagcaagagag

SEQ ID NO: 9444 - DNA, 23 bp, Artificial Sequence
  epidermal growth factor receptor (EGFR), ERBB1 phosphotyrosine kinase siRNA
tgtcatgaaatcagcaagagagg

SEQ ID NO: 9445 - DNA, 23 bp, Artificial Sequence
  epidermal growth factor receptor (EGFR), ERBB1 phosphotyrosine kinase siRNA
gtcatgaaatcagcaagagagga

SEQ ID NO: 9446 - DNA, 23 bp, Artificial Sequence
  epidermal growth factor receptor (EGFR), ERBB1 phosphotyrosine kinase siRNA
tcatgaaatcagcaagagaggat

SEQ ID NO: 9447 - DNA, 23 bp, Artificial Sequence
  epidermal growth factor receptor (EGFR), ERBB1 phosphotyrosine kinase siRNA
catgaaatcagcaagagaggatg

SEQ ID NO: 9448 - DNA, 23 bp, Artificial Sequence
  epidermal growth factor receptor (EGFR), ERBB1 phosphotyrosine kinase siRNA
atgaaatcagcaagagaggatga

SEQ ID NO: 9449 - DNA, 23 bp, Artificial Sequence
  epidermal growth factor receptor (EGFR), ERBB1 phosphotyrosine kinase siRNA
tgaaatcagcaagagaggatgac

SEQ ID NO: 9450 - DNA, 23 bp, Artificial Sequence
  epidermal growth factor receptor (EGFR), ERBB1 phosphotyrosine kinase siRNA
gaaatcagcaagagaggatgaca

SEQ ID NO: 9451 - DNA, 23 bp, Artificial Sequence
  epidermal growth factor receptor (EGFR), ERBB1 phosphotyrosine kinase siRNA
aaatcagcaagagaggatgacac

SEQ ID NO: 9452 - DNA, 23 bp, Artificial Sequence
  epidermal growth factor receptor (EGFR), ERBB1 phosphotyrosine kinase siRNA
aatcagcaagagaggatgacaca

SEQ ID NO: 9453 - DNA, 23 bp, Artificial Sequence
  epidermal growth factor receptor (EGFR), ERBB1 phosphotyrosine kinase siRNA
atcagcaagagaggatgacacat

SEQ ID NO: 9454 - DNA, 23 bp, Artificial Sequence
  epidermal growth factor receptor (EGFR), ERBB1 phosphotyrosine kinase siRNA
tcagcaagagaggatgacacatc

SEQ ID NO: 9455 - DNA, 23 bp, Artificial Sequence
  epidermal growth factor receptor (EGFR), ERBB1 phosphotyrosine kinase siRNA
cagcaagagaggatgacacatca

SEQ ID NO: 9456 - DNA, 23 bp, Artificial Sequence
  epidermal growth factor receptor (EGFR), ERBB1 phosphotyrosine kinase siRNA
agcaagagaggatgacacatcaa

SEQ ID NO: 9457 - DNA, 23 bp, Artificial Sequence
  epidermal growth factor receptor (EGFR), ERBB1 phosphotyrosine kinase siRNA
gcaagagaggatgacacatcaaa

SEQ ID NO: 9458 - DNA, 23 bp, Artificial Sequence
  epidermal growth factor receptor (EGFR), ERBB1 phosphotyrosine kinase siRNA
caagagaggatgacacatcaaat

SEQ ID NO: 9459 - DNA, 23 bp, Artificial Sequence
  epidermal growth factor receptor (EGFR), ERBB1 phosphotyrosine kinase siRNA
aagagaggatgacacatcaaata

SEQ ID NO: 9460 - DNA, 23 bp, Artificial Sequence
  epidermal growth factor receptor (EGFR), ERBB1 phosphotyrosine kinase siRNA
agagaggatgacacatcaaataa

SEQ ID NO: 9461 - DNA, 23 bp, Artificial Sequence
  epidermal growth factor receptor (EGFR), ERBB1 phosphotyrosine kinase siRNA
gagaggatgacacatcaaataat

SEQ ID NO: 9462 - DNA, 23 bp, Artificial Sequence
  epidermal growth factor receptor (EGFR), ERBB1 phosphotyrosine kinase siRNA
agaggatgacacatcaaataata

SEQ ID NO: 9463 - DNA, 23 bp, Artificial Sequence
  epidermal growth factor receptor (EGFR), ERBB1 phosphotyrosine kinase siRNA
gaggatgacacatcaaataataa

SEQ ID NO: 9464 - DNA, 23 bp, Artificial Sequence
  epidermal growth factor receptor (EGFR), ERBB1 phosphotyrosine kinase siRNA
aggatgacacatcaaataataac

SEQ ID NO: 9465 - DNA, 23 bp, Artificial Sequence
  epidermal growth factor receptor (EGFR), ERBB1 phosphotyrosine kinase siRNA
ggatgacacatcaaataataact

SEQ ID NO: 9466 - DNA, 23 bp, Artificial Sequence
  epidermal growth factor receptor (EGFR), ERBB1 phosphotyrosine kinase siRNA
gatgacacatcaaataataactc

SEQ ID NO: 9467 - DNA, 23 bp, Artificial Sequence
  epidermal growth factor receptor (EGFR), ERBB1 phosphotyrosine kinase siRNA
atgacacatcaaataataactcg

SEQ ID NO: 9468 - DNA, 23 bp, Artificial Sequence
  epidermal growth factor receptor (EGFR), ERBB1 phosphotyrosine kinase siRNA
tgacacatcaaataataactcgg

SEQ ID NO: 9469 - DNA, 23 bp, Artificial Sequence
  epidermal growth factor receptor (EGFR), ERBB1 phosphotyrosine kinase siRNA
gacacatcaaataataactcgga

SEQ ID NO: 9470 - DNA, 23 bp, Artificial Sequence
  epidermal growth factor receptor (EGFR), ERBB1 phosphotyrosine kinase siRNA
acacatcaaataataactcggat

SEQ ID NO: 9471 - DNA, 23 bp, Artificial Sequence
  epidermal growth factor receptor (EGFR), ERBB1 phosphotyrosine kinase siRNA
cacatcaaataataactcggatt

SEQ ID NO: 9472 - DNA, 23 bp, Artificial Sequence
  epidermal growth factor receptor (EGFR), ERBB1 phosphotyrosine kinase siRNA
acatcaaataataactcggattc

SEQ ID NO: 9473 - DNA, 23 bp, Artificial Sequence
  epidermal growth factor receptor (EGFR), ERBB1 phosphotyrosine kinase siRNA
catcaaataataactcggattcc

SEQ ID NO: 9474 - DNA, 23 bp, Artificial Sequence
  epidermal growth factor receptor (EGFR), ERBB1 phosphotyrosine kinase siRNA
atcaaataataactcggattcca

SEQ ID NO: 9475 - DNA, 23 bp, Artificial Sequence
  epidermal growth factor receptor (EGFR), ERBB1 phosphotyrosine kinase siRNA
tcaaataataactcggattccag

SEQ ID NO: 9476 - DNA, 23 bp, Artificial Sequence
  epidermal growth factor receptor (EGFR), ERBB1 phosphotyrosine kinase siRNA
caaataataactcggattccagc

SEQ ID NO: 9477 - DNA, 23 bp, Artificial Sequence
  epidermal growth factor receptor (EGFR), ERBB1 phosphotyrosine kinase siRNA
aaataataactcggattccagcc

SEQ ID NO: 9478 - DNA, 23 bp, Artificial Sequence
  epidermal growth factor receptor (EGFR), ERBB1 phosphotyrosine kinase siRNA
aataataactcggattccagccc

SEQ ID NO: 9479 - DNA, 23 bp, Artificial Sequence
  epidermal growth factor receptor (EGFR), ERBB1 phosphotyrosine kinase siRNA
ataataactcggattccagccca

SEQ ID NO: 9480 - DNA, 23 bp, Artificial Sequence
  epidermal growth factor receptor (EGFR), ERBB1 phosphotyrosine kinase siRNA
taataactcggattccagcccac

SEQ ID NO: 9481 - DNA, 23 bp, Artificial Sequence
  epidermal growth factor receptor (EGFR), ERBB1 phosphotyrosine kinase siRNA
aataactcggattccagcccaca

SEQ ID NO: 9482 - DNA, 23 bp, Artificial Sequence
  epidermal growth factor receptor (EGFR), ERBB1 phosphotyrosine kinase siRNA
ataactcggattccagcccacat

SEQ ID NO: 9483 - DNA, 23 bp, Artificial Sequence
  epidermal growth factor receptor (EGFR), ERBB1 phosphotyrosine kinase siRNA
taactcggattccagcccacatt

SEQ ID NO: 9484 - DNA, 23 bp, Artificial Sequence
  epidermal growth factor receptor (EGFR), ERBB1 phosphotyrosine kinase siRNA
aactcggattccagcccacattg

SEQ ID NO: 9485 - DNA, 23 bp, Artificial Sequence
  epidermal growth factor receptor (EGFR), ERBB1 phosphotyrosine kinase siRNA
actcggattccagcccacattgg

SEQ ID NO: 9486 - DNA, 23 bp, Artificial Sequence
  epidermal growth factor receptor (EGFR), ERBB1 phosphotyrosine kinase siRNA
ctcggattccagcccacattgga

SEQ ID NO: 9487 - DNA, 23 bp, Artificial Sequence
  epidermal growth factor receptor (EGFR), ERBB1 phosphotyrosine kinase siRNA
tcggattccagcccacattggat

SEQ ID NO: 9488 - DNA, 23 bp, Artificial Sequence
  epidermal growth factor receptor (EGFR), ERBB1 phosphotyrosine kinase siRNA
cggattccagcccacattggatt

SEQ ID NO: 9489 - DNA, 23 bp, Artificial Sequence
  epidermal growth factor receptor (EGFR), ERBB1 phosphotyrosine kinase siRNA
ggattccagcccacattggattc

SEQ ID NO: 9490 - DNA, 23 bp, Artificial Sequence
  epidermal growth factor receptor (EGFR), ERBB1 phosphotyrosine kinase siRNA
gattccagcccacattggattca

SEQ ID NO: 9491 - DNA, 23 bp, Artificial Sequence
  epidermal growth factor receptor (EGFR), ERBB1 phosphotyrosine kinase siRNA
attccagcccacattggattcat

SEQ ID NO: 9492 - DNA, 23 bp, Artificial Sequence
  epidermal growth factor receptor (EGFR), ERBB1 phosphotyrosine kinase siRNA
ttccagcccacattggattcatc

SEQ ID NO: 9493 - DNA, 23 bp, Artificial Sequence
  epidermal growth factor receptor (EGFR), ERBB1 phosphotyrosine kinase siRNA
tccagcccacattggattcatca

SEQ ID NO: 9494 - DNA, 23 bp, Artificial Sequence
  epidermal growth factor receptor (EGFR), ERBB1 phosphotyrosine kinase siRNA
ccagcccacattggattcatcag

SEQ ID NO: 9495 - DNA, 23 bp, Artificial Sequence
  epidermal growth factor receptor (EGFR), ERBB1 phosphotyrosine kinase siRNA
cagcccacattggattcatcagc

SEQ ID NO: 9496 - DNA, 23 bp, Artificial Sequence
  epidermal growth factor receptor (EGFR), ERBB1 phosphotyrosine kinase siRNA
agcccacattggattcatcagca

SEQ ID NO: 9497 - DNA, 23 bp, Artificial Sequence
  epidermal growth factor receptor (EGFR), ERBB1 phosphotyrosine kinase siRNA
gcccacattggattcatcagcat

SEQ ID NO: 9498 - DNA, 23 bp, Artificial Sequence
  epidermal growth factor receptor (EGFR), ERBB1 phosphotyrosine kinase siRNA
cccacattggattcatcagcatt

SEQ ID NO: 9499 - DNA, 23 bp, Artificial Sequence
  epidermal growth factor receptor (EGFR), ERBB1 phosphotyrosine kinase siRNA
ccacattggattcatcagcattt

SEQ ID NO: 9500 - DNA, 23 bp, Artificial Sequence
  epidermal growth factor receptor (EGFR), ERBB1 phosphotyrosine kinase siRNA
cacattggattcatcagcatttg

SEQ ID NO: 9501 - DNA, 23 bp, Artificial Sequence
  epidermal growth factor receptor (EGFR), ERBB1 phosphotyrosine kinase siRNA
acattggattcatcagcatttgg

SEQ ID NO: 9502 - DNA, 23 bp, Artificial Sequence
  epidermal growth factor receptor (EGFR), ERBB1 phosphotyrosine kinase siRNA
cattggattcatcagcatttgga

SEQ ID NO: 9503 - DNA, 23 bp, Artificial Sequence
  epidermal growth factor receptor (EGFR), ERBB1 phosphotyrosine kinase siRNA
attggattcatcagcatttggac

SEQ ID NO: 9504 - DNA, 23 bp, Artificial Sequence
  epidermal growth factor receptor (EGFR), ERBB1 phosphotyrosine kinase siRNA
ttggattcatcagcatttggacc

SEQ ID NO: 9505 - DNA, 23 bp, Artificial Sequence
  epidermal growth factor receptor (EGFR), ERBB1 phosphotyrosine kinase siRNA
tggattcatcagcatttggacca

SEQ ID NO: 9506 - DNA, 23 bp, Artificial Sequence
  epidermal growth factor receptor (EGFR), ERBB1 phosphotyrosine kinase siRNA
ggattcatcagcatttggaccaa

SEQ ID NO: 9507 - DNA, 23 bp, Artificial Sequence
  epidermal growth factor receptor (EGFR), ERBB1 phosphotyrosine kinase siRNA
gattcatcagcatttggaccaat

SEQ ID NO: 9508 - DNA, 23 bp, Artificial Sequence
  epidermal growth factor receptor (EGFR), ERBB1 phosphotyrosine kinase siRNA
attcatcagcatttggaccaata

SEQ ID NO: 9509 - DNA, 23 bp, Artificial Sequence
  epidermal growth factor receptor (EGFR), ERBB1 phosphotyrosine kinase siRNA
ttcatcagcatttggaccaatag

SEQ ID NO: 9510 - DNA, 23 bp, Artificial Sequence
  epidermal growth factor receptor (EGFR), ERBB1 phosphotyrosine kinase siRNA
tcatcagcatttggaccaatagc

SEQ ID NO: 9511 - DNA, 23 bp, Artificial Sequence
  epidermal growth factor receptor (EGFR), ERBB1 phosphotyrosine kinase siRNA
catcagcatttggaccaatagcc

SEQ ID NO: 9512 - DNA, 23 bp, Artificial Sequence
  epidermal growth factor receptor (EGFR), ERBB1 phosphotyrosine kinase siRNA
atcagcatttggaccaatagccc

SEQ ID NO: 9513 - DNA, 23 bp, Artificial Sequence
  epidermal growth factor receptor (EGFR), ERBB1 phosphotyrosine kinase siRNA
tcagcatttggaccaatagccca

SEQ ID NO: 9514 - DNA, 23 bp, Artificial Sequence
  epidermal growth factor receptor (EGFR), ERBB1 phosphotyrosine kinase siRNA
cagcatttggaccaatagcccac

SEQ ID NO: 9515 - DNA, 23 bp, Artificial Sequence
  epidermal growth factor receptor (EGFR), ERBB1 phosphotyrosine kinase siRNA
agcatttggaccaatagcccaca

SEQ ID NO: 9516 - DNA, 23 bp, Artificial Sequence
  epidermal growth factor receptor (EGFR), ERBB1 phosphotyrosine kinase siRNA
gcatttggaccaatagcccacag

SEQ ID NO: 9517 - DNA, 23 bp, Artificial Sequence
  epidermal growth factor receptor (EGFR), ERBB1 phosphotyrosine kinase siRNA
catttggaccaatagcccacagc

SEQ ID NO: 9518 - DNA, 23 bp, Artificial Sequence
  epidermal growth factor receptor (EGFR), ERBB1 phosphotyrosine kinase siRNA
atttggaccaatagcccacagct

SEQ ID NO: 9519 - DNA, 23 bp, Artificial Sequence
  epidermal growth factor receptor (EGFR), ERBB1 phosphotyrosine kinase siRNA
tttggaccaatagcccacagctg

SEQ ID NO: 9520 - DNA, 23 bp, Artificial Sequence
  epidermal growth factor receptor (EGFR), ERBB1 phosphotyrosine kinase siRNA
ttggaccaatagcccacagctga

SEQ ID NO: 9521 - DNA, 23 bp, Artificial Sequence
  epidermal growth factor receptor (EGFR), ERBB1 phosphotyrosine kinase siRNA
tggaccaatagcccacagctgag

SEQ ID NO: 9522 - DNA, 23 bp, Artificial Sequence
  epidermal growth factor receptor (EGFR), ERBB1 phosphotyrosine kinase siRNA
ggaccaatagcccacagctgaga

SEQ ID NO: 9523 - DNA, 23 bp, Artificial Sequence
  epidermal growth factor receptor (EGFR), ERBB1 phosphotyrosine kinase siRNA
gaccaatagcccacagctgagaa

SEQ ID NO: 9524 - DNA, 23 bp, Artificial Sequence
  epidermal growth factor receptor (EGFR), ERBB1 phosphotyrosine kinase siRNA
accaatagcccacagctgagaat

SEQ ID NO: 9525 - DNA, 23 bp, Artificial Sequence
  epidermal growth factor receptor (EGFR), ERBB1 phosphotyrosine kinase siRNA
ccaatagcccacagctgagaatg

SEQ ID NO: 9526 - DNA, 23 bp, Artificial Sequence
  epidermal growth factor receptor (EGFR), ERBB1 phosphotyrosine kinase siRNA
caatagcccacagctgagaatgt

SEQ ID NO: 9527 - DNA, 23 bp, Artificial Sequence
  epidermal growth factor receptor (EGFR), ERBB1 phosphotyrosine kinase siRNA
aatagcccacagctgagaatgtg

SEQ ID NO: 9528 - DNA, 23 bp, Artificial Sequence
  epidermal growth factor receptor (EGFR), ERBB1 phosphotyrosine kinase siRNA
atagcccacagctgagaatgtgg

SEQ ID NO: 9529 - DNA, 23 bp, Artificial Sequence
  epidermal growth factor receptor (EGFR), ERBB1 phosphotyrosine kinase siRNA
tagcccacagctgagaatgtgga

SEQ ID NO: 9530 - DNA, 23 bp, Artificial Sequence
  epidermal growth factor receptor (EGFR), ERBB1 phosphotyrosine kinase siRNA
agcccacagctgagaatgtggaa

SEQ ID NO: 9531 - DNA, 23 bp, Artificial Sequence
  epidermal growth factor receptor (EGFR), ERBB1 phosphotyrosine kinase siRNA
gcccacagctgagaatgtggaat

SEQ ID NO: 9532 - DNA, 23 bp, Artificial Sequence
  epidermal growth factor receptor (EGFR), ERBB1 phosphotyrosine kinase siRNA
cccacagctgagaatgtggaata

SEQ ID NO: 9533 - DNA, 23 bp, Artificial Sequence
  epidermal growth factor receptor (EGFR), ERBB1 phosphotyrosine kinase siRNA
ccacagctgagaatgtggaatac

SEQ ID NO: 9534 - DNA, 23 bp, Artificial Sequence
  epidermal growth factor receptor (EGFR), ERBB1 phosphotyrosine kinase siRNA
cacagctgagaatgtggaatacc

SEQ ID NO: 9535 - DNA, 23 bp, Artificial Sequence
  epidermal growth factor receptor (EGFR), ERBB1 phosphotyrosine kinase siRNA
acagctgagaatgtggaatacct

SEQ ID NO: 9536 - DNA, 23 bp, Artificial Sequence
  epidermal growth factor receptor (EGFR), ERBB1 phosphotyrosine kinase siRNA
cagctgagaatgtggaataccta

SEQ ID NO: 9537 - DNA, 23 bp, Artificial Sequence
  epidermal growth factor receptor (EGFR), ERBB1 phosphotyrosine kinase siRNA
agctgagaatgtggaatacctaa

SEQ ID NO: 9538 - DNA, 23 bp, Artificial Sequence
  epidermal growth factor receptor (EGFR), ERBB1 phosphotyrosine kinase siRNA
gctgagaatgtggaatacctaag

SEQ ID NO: 9539 - DNA, 23 bp, Artificial Sequence
  epidermal growth factor receptor (EGFR), ERBB1 phosphotyrosine kinase siRNA
ctgagaatgtggaatacctaagg

SEQ ID NO: 9540 - DNA, 23 bp, Artificial Sequence
  epidermal growth factor receptor (EGFR), ERBB1 phosphotyrosine kinase siRNA
tgagaatgtggaatacctaagga

SEQ ID NO: 9541 - DNA, 23 bp, Artificial Sequence
  epidermal growth factor receptor (EGFR), ERBB1 phosphotyrosine kinase siRNA
gagaatgtggaatacctaaggat

SEQ ID NO: 9542 - DNA, 23 bp, Artificial Sequence
  epidermal growth factor receptor (EGFR), ERBB1 phosphotyrosine kinase siRNA
agaatgtggaatacctaaggata

SEQ ID NO: 9543 - DNA, 23 bp, Artificial Sequence
  epidermal growth factor receptor (EGFR), ERBB1 phosphotyrosine kinase siRNA
gaatgtggaatacctaaggatag

SEQ ID NO: 9544 - DNA, 23 bp, Artificial Sequence
  epidermal growth factor receptor (EGFR), ERBB1 phosphotyrosine kinase siRNA
aatgtggaatacctaaggatagc

SEQ ID NO: 9545 - DNA, 23 bp, Artificial Sequence
  epidermal growth factor receptor (EGFR), ERBB1 phosphotyrosine kinase siRNA
atgtggaatacctaaggatagca

SEQ ID NO: 9546 - DNA, 23 bp, Artificial Sequence
  epidermal growth factor receptor (EGFR), ERBB1 phosphotyrosine kinase siRNA
tgtggaatacctaaggatagcac

SEQ ID NO: 9547 - DNA, 23 bp, Artificial Sequence
  epidermal growth factor receptor (EGFR), ERBB1 phosphotyrosine kinase siRNA
gtggaatacctaaggatagcacc

SEQ ID NO: 9548 - DNA, 23 bp, Artificial Sequence
  epidermal growth factor receptor (EGFR), ERBB1 phosphotyrosine kinase siRNA
tggaatacctaaggatagcaccg

SEQ ID NO: 9549 - DNA, 23 bp, Artificial Sequence
  epidermal growth factor receptor (EGFR), ERBB1 phosphotyrosine kinase siRNA
ggaatacctaaggatagcaccgc

SEQ ID NO: 9550 - DNA, 23 bp, Artificial Sequence
  epidermal growth factor receptor (EGFR), ERBB1 phosphotyrosine kinase siRNA
gaatacctaaggatagcaccgct

SEQ ID NO: 9551 - DNA, 23 bp, Artificial Sequence
  epidermal growth factor receptor (EGFR), ERBB1 phosphotyrosine kinase siRNA
aatacctaaggatagcaccgctt

SEQ ID NO: 9552 - DNA, 23 bp, Artificial Sequence
  epidermal growth factor receptor (EGFR), ERBB1 phosphotyrosine kinase siRNA
atacctaaggatagcaccgcttt

SEQ ID NO: 9553 - DNA, 23 bp, Artificial Sequence
  epidermal growth factor receptor (EGFR), ERBB1 phosphotyrosine kinase siRNA
tacctaaggatagcaccgctttt

SEQ ID NO: 9554 - DNA, 23 bp, Artificial Sequence
  epidermal growth factor receptor (EGFR), ERBB1 phosphotyrosine kinase siRNA
acctaaggatagcaccgcttttg

SEQ ID NO: 9555 - DNA, 23 bp, Artificial Sequence
  epidermal growth factor receptor (EGFR), ERBB1 phosphotyrosine kinase siRNA
cctaaggatagcaccgcttttgt

SEQ ID NO: 9556 - DNA, 23 bp, Artificial Sequence
  epidermal growth factor receptor (EGFR), ERBB1 phosphotyrosine kinase siRNA
ctaaggatagcaccgcttttgtt

SEQ ID NO: 9557 - DNA, 23 bp, Artificial Sequence
  epidermal growth factor receptor (EGFR), ERBB1 phosphotyrosine kinase siRNA
taaggatagcaccgcttttgttc

SEQ ID NO: 9558 - DNA, 23 bp, Artificial Sequence
  epidermal growth factor receptor (EGFR), ERBB1 phosphotyrosine kinase siRNA
aaggatagcaccgcttttgttct

SEQ ID NO: 9559 - DNA, 23 bp, Artificial Sequence
  epidermal growth factor receptor (EGFR), ERBB1 phosphotyrosine kinase siRNA
aggatagcaccgcttttgttctc

SEQ ID NO: 9560 - DNA, 23 bp, Artificial Sequence
  epidermal growth factor receptor (EGFR), ERBB1 phosphotyrosine kinase siRNA
ggatagcaccgcttttgttctcg

SEQ ID NO: 9561 - DNA, 23 bp, Artificial Sequence
  epidermal growth factor receptor (EGFR), ERBB1 phosphotyrosine kinase siRNA
gatagcaccgcttttgttctcgc

SEQ ID NO: 9562 - DNA, 23 bp, Artificial Sequence
  epidermal growth factor receptor (EGFR), ERBB1 phosphotyrosine kinase siRNA
atagcaccgcttttgttctcgca

SEQ ID NO: 9563 - DNA, 23 bp, Artificial Sequence
  epidermal growth factor receptor (EGFR), ERBB1 phosphotyrosine kinase siRNA
tagcaccgcttttgttctcgcaa

SEQ ID NO: 9564 - DNA, 23 bp, Artificial Sequence
  epidermal growth factor receptor (EGFR), ERBB1 phosphotyrosine kinase siRNA
agcaccgcttttgttctcgcaaa

SEQ ID NO: 9565 - DNA, 23 bp, Artificial Sequence
  epidermal growth factor receptor (EGFR), ERBB1 phosphotyrosine kinase siRNA
gcaccgcttttgttctcgcaaaa

SEQ ID NO: 9566 - DNA, 23 bp, Artificial Sequence
  epidermal growth factor receptor (EGFR), ERBB1 phosphotyrosine kinase siRNA
caccgcttttgttctcgcaaaaa

SEQ ID NO: 9567 - DNA, 23 bp, Artificial Sequence
  epidermal growth factor receptor (EGFR), ERBB1 phosphotyrosine kinase siRNA
accgcttttgttctcgcaaaaac

SEQ ID NO: 9568 - DNA, 23 bp, Artificial Sequence
  epidermal growth factor receptor (EGFR), ERBB1 phosphotyrosine kinase siRNA
ccgcttttgttctcgcaaaaacg

SEQ ID NO: 9569 - DNA, 23 bp, Artificial Sequence
  epidermal growth factor receptor (EGFR), ERBB1 phosphotyrosine kinase siRNA
cgcttttgttctcgcaaaaacgt

SEQ ID NO: 9570 - DNA, 23 bp, Artificial Sequence
  epidermal growth factor receptor (EGFR), ERBB1 phosphotyrosine kinase siRNA
gcttttgttctcgcaaaaacgta

SEQ ID NO: 9571 - DNA, 23 bp, Artificial Sequence
  epidermal growth factor receptor (EGFR), ERBB1 phosphotyrosine kinase siRNA
cttttgttctcgcaaaaacgtat

SEQ ID NO: 9572 - DNA, 23 bp, Artificial Sequence
  epidermal growth factor receptor (EGFR), ERBB1 phosphotyrosine kinase siRNA
ttttgttctcgcaaaaacgtatc

SEQ ID NO: 9573 - DNA, 23 bp, Artificial Sequence
  epidermal growth factor receptor (EGFR), ERBB1 phosphotyrosine kinase siRNA
tttgttctcgcaaaaacgtatct

SEQ ID NO: 9574 - DNA, 23 bp, Artificial Sequence
  epidermal growth factor receptor (EGFR), ERBB1 phosphotyrosine kinase siRNA
ttgttctcgcaaaaacgtatctc

SEQ ID NO: 9575 - DNA, 23 bp, Artificial Sequence
  epidermal growth factor receptor (EGFR), ERBB1 phosphotyrosine kinase siRNA
tgttctcgcaaaaacgtatctcc

SEQ ID NO: 9576 - DNA, 23 bp, Artificial Sequence
  epidermal growth factor receptor (EGFR), ERBB1 phosphotyrosine kinase siRNA
gttctcgcaaaaacgtatctcct

SEQ ID NO: 9577 - DNA, 23 bp, Artificial Sequence
  epidermal growth factor receptor (EGFR), ERBB1 phosphotyrosine kinase siRNA
ttctcgcaaaaacgtatctccta

SEQ ID NO: 9578 - DNA, 23 bp, Artificial Sequence
  epidermal growth factor receptor (EGFR), ERBB1 phosphotyrosine kinase siRNA
tctcgcaaaaacgtatctcctaa

SEQ ID NO: 9579 - DNA, 23 bp, Artificial Sequence
  epidermal growth factor receptor (EGFR), ERBB1 phosphotyrosine kinase siRNA
ctcgcaaaaacgtatctcctaat

SEQ ID NO: 9580 - DNA, 23 bp, Artificial Sequence
  epidermal growth factor receptor (EGFR), ERBB1 phosphotyrosine kinase siRNA
tcgcaaaaacgtatctcctaatt

SEQ ID NO: 9581 - DNA, 23 bp, Artificial Sequence
  epidermal growth factor receptor (EGFR), ERBB1 phosphotyrosine kinase siRNA
cgcaaaaacgtatctcctaattt

SEQ ID NO: 9582 - DNA, 23 bp, Artificial Sequence
  epidermal growth factor receptor (EGFR), ERBB1 phosphotyrosine kinase siRNA
gcaaaaacgtatctcctaatttg

SEQ ID NO: 9583 - DNA, 23 bp, Artificial Sequence
  epidermal growth factor receptor (EGFR), ERBB1 phosphotyrosine kinase siRNA
caaaaacgtatctcctaatttga

SEQ ID NO: 9584 - DNA, 23 bp, Artificial Sequence
  epidermal growth factor receptor (EGFR), ERBB1 phosphotyrosine kinase siRNA
aaaaacgtatctcctaatttgag

SEQ ID NO: 9585 - DNA, 23 bp, Artificial Sequence
  epidermal growth factor receptor (EGFR), ERBB1 phosphotyrosine kinase siRNA
aaaacgtatctcctaatttgagg

SEQ ID NO: 9586 - DNA, 23 bp, Artificial Sequence
  epidermal growth factor receptor (EGFR), ERBB1 phosphotyrosine kinase siRNA
aaacgtatctcctaatttgaggc

SEQ ID NO: 9587 - DNA, 23 bp, Artificial Sequence
  epidermal growth factor receptor (EGFR), ERBB1 phosphotyrosine kinase siRNA
aacgtatctcctaatttgaggct

SEQ ID NO: 9588 - DNA, 23 bp, Artificial Sequence
  epidermal growth factor receptor (EGFR), ERBB1 phosphotyrosine kinase siRNA
acgtatctcctaatttgaggctc

SEQ ID NO: 9589 - DNA, 23 bp, Artificial Sequence
  epidermal growth factor receptor (EGFR), ERBB1 phosphotyrosine kinase siRNA
cgtatctcctaatttgaggctca

SEQ ID NO: 9590 - DNA, 23 bp, Artificial Sequence
  epidermal growth factor receptor (EGFR), ERBB1 phosphotyrosine kinase siRNA
gtatctcctaatttgaggctcag

SEQ ID NO: 9591 - DNA, 23 bp, Artificial Sequence
  epidermal growth factor receptor (EGFR), ERBB1 phosphotyrosine kinase siRNA
tatctcctaatttgaggctcaga

SEQ ID NO: 9592 - DNA, 23 bp, Artificial Sequence
  epidermal growth factor receptor (EGFR), ERBB1 phosphotyrosine kinase siRNA
atctcctaatttgaggctcagat

SEQ ID NO: 9593 - DNA, 23 bp, Artificial Sequence
  epidermal growth factor receptor (EGFR), ERBB1 phosphotyrosine kinase siRNA
tctcctaatttgaggctcagatg

SEQ ID NO: 9594 - DNA, 23 bp, Artificial Sequence
  epidermal growth factor receptor (EGFR), ERBB1 phosphotyrosine kinase siRNA
ctcctaatttgaggctcagatga

SEQ ID NO: 9595 - DNA, 23 bp, Artificial Sequence
  epidermal growth factor receptor (EGFR), ERBB1 phosphotyrosine kinase siRNA
tcctaatttgaggctcagatgaa

SEQ ID NO: 9596 - DNA, 23 bp, Artificial Sequence
  epidermal growth factor receptor (EGFR), ERBB1 phosphotyrosine kinase siRNA
cctaatttgaggctcagatgaaa

SEQ ID NO: 9597 - DNA, 23 bp, Artificial Sequence
  epidermal growth factor receptor (EGFR), ERBB1 phosphotyrosine kinase siRNA
ctaatttgaggctcagatgaaat

SEQ ID NO: 9598 - DNA, 23 bp, Artificial Sequence
  epidermal growth factor receptor (EGFR), ERBB1 phosphotyrosine kinase siRNA
taatttgaggctcagatgaaatg

SEQ ID NO: 9599 - DNA, 23 bp, Artificial Sequence
  epidermal growth factor receptor (EGFR), ERBB1 phosphotyrosine kinase siRNA
aatttgaggctcagatgaaatgc

SEQ ID NO: 9600 - DNA, 23 bp, Artificial Sequence
  epidermal growth factor receptor (EGFR), ERBB1 phosphotyrosine kinase siRNA
atttgaggctcagatgaaatgca

SEQ ID NO: 9601 - DNA, 23 bp, Artificial Sequence
  epidermal growth factor receptor (EGFR), ERBB1 phosphotyrosine kinase siRNA
tttgaggctcagatgaaatgcat

SEQ ID NO: 9602 - DNA, 23 bp, Artificial Sequence
  epidermal growth factor receptor (EGFR), ERBB1 phosphotyrosine kinase siRNA
ttgaggctcagatgaaatgcatc

SEQ ID NO: 9603 - DNA, 23 bp, Artificial Sequence
  epidermal growth factor receptor (EGFR), ERBB1 phosphotyrosine kinase siRNA
tgaggctcagatgaaatgcatca

SEQ ID NO: 9604 - DNA, 23 bp, Artificial Sequence
  epidermal growth factor receptor (EGFR), ERBB1 phosphotyrosine kinase siRNA
gaggctcagatgaaatgcatcag

SEQ ID NO: 9605 - DNA, 23 bp, Artificial Sequence
  epidermal growth factor receptor (EGFR), ERBB1 phosphotyrosine kinase siRNA
aggctcagatgaaatgcatcagg

SEQ ID NO: 9606 - DNA, 23 bp, Artificial Sequence
  epidermal growth factor receptor (EGFR), ERBB1 phosphotyrosine kinase siRNA
ggctcagatgaaatgcatcaggt

SEQ ID NO: 9607 - DNA, 23 bp, Artificial Sequence
  epidermal growth factor receptor (EGFR), ERBB1 phosphotyrosine kinase siRNA
gctcagatgaaatgcatcaggtc

SEQ ID NO: 9608 - DNA, 23 bp, Artificial Sequence
  epidermal growth factor receptor (EGFR), ERBB1 phosphotyrosine kinase siRNA
ctcagatgaaatgcatcaggtcc

SEQ ID NO: 9609 - DNA, 23 bp, Artificial Sequence
  epidermal growth factor receptor (EGFR), ERBB1 phosphotyrosine kinase siRNA
tcagatgaaatgcatcaggtcct

SEQ ID NO: 9610 - DNA, 23 bp, Artificial Sequence
  epidermal growth factor receptor (EGFR), ERBB1 phosphotyrosine kinase siRNA
cagatgaaatgcatcaggtcctt

SEQ ID NO: 9611 - DNA, 23 bp, Artificial Sequence
  epidermal growth factor receptor (EGFR), ERBB1 phosphotyrosine kinase siRNA
agatgaaatgcatcaggtccttt

SEQ ID NO: 9612 - DNA, 23 bp, Artificial Sequence
  epidermal growth factor receptor (EGFR), ERBB1 phosphotyrosine kinase siRNA
gatgaaatgcatcaggtcctttg

SEQ ID NO: 9613 - DNA, 23 bp, Artificial Sequence
  epidermal growth factor receptor (EGFR), ERBB1 phosphotyrosine kinase siRNA
atgaaatgcatcaggtcctttgg

SEQ ID NO: 9614 - DNA, 23 bp, Artificial Sequence
  epidermal growth factor receptor (EGFR), ERBB1 phosphotyrosine kinase siRNA
tgaaatgcatcaggtcctttggg

SEQ ID NO: 9615 - DNA, 23 bp, Artificial Sequence
  epidermal growth factor receptor (EGFR), ERBB1 phosphotyrosine kinase siRNA
gaaatgcatcaggtcctttgggg

SEQ ID NO: 9616 - DNA, 23 bp, Artificial Sequence
  epidermal growth factor receptor (EGFR), ERBB1 phosphotyrosine kinase siRNA
aaatgcatcaggtcctttggggc

SEQ ID NO: 9617 - DNA, 23 bp, Artificial Sequence
  epidermal growth factor receptor (EGFR), ERBB1 phosphotyrosine kinase siRNA
aatgcatcaggtcctttggggca

SEQ ID NO: 9618 - DNA, 23 bp, Artificial Sequence
  epidermal growth factor receptor (EGFR), ERBB1 phosphotyrosine kinase siRNA
atgcatcaggtcctttggggcat

SEQ ID NO: 9619 - DNA, 23 bp, Artificial Sequence
  epidermal growth factor receptor (EGFR), ERBB1 phosphotyrosine kinase siRNA
tgcatcaggtcctttggggcata

SEQ ID NO: 9620 - DNA, 23 bp, Artificial Sequence
  epidermal growth factor receptor (EGFR), ERBB1 phosphotyrosine kinase siRNA
gcatcaggtcctttggggcatag

SEQ ID NO: 9621 - DNA, 23 bp, Artificial Sequence
  epidermal growth factor receptor (EGFR), ERBB1 phosphotyrosine kinase siRNA
catcaggtcctttggggcataga

SEQ ID NO: 9622 - DNA, 23 bp, Artificial Sequence
  epidermal growth factor receptor (EGFR), ERBB1 phosphotyrosine kinase siRNA
atcaggtcctttggggcatagat

SEQ ID NO: 9623 - DNA, 23 bp, Artificial Sequence
  epidermal growth factor receptor (EGFR), ERBB1 phosphotyrosine kinase siRNA
tcaggtcctttggggcatagatc

SEQ ID NO: 9624 - DNA, 23 bp, Artificial Sequence
  epidermal growth factor receptor (EGFR), ERBB1 phosphotyrosine kinase siRNA
caggtcctttggggcatagatca

SEQ ID NO: 9625 - DNA, 23 bp, Artificial Sequence
  epidermal growth factor receptor (EGFR), ERBB1 phosphotyrosine kinase siRNA
aggtcctttggggcatagatcag

SEQ ID NO: 9626 - DNA, 23 bp, Artificial Sequence
  epidermal growth factor receptor (EGFR), ERBB1 phosphotyrosine kinase siRNA
ggtcctttggggcatagatcaga

SEQ ID NO: 9627 - DNA, 23 bp, Artificial Sequence
  epidermal growth factor receptor (EGFR), ERBB1 phosphotyrosine kinase siRNA
gtcctttggggcatagatcagaa

SEQ ID NO: 9628 - DNA, 23 bp, Artificial Sequence
  epidermal growth factor receptor (EGFR), ERBB1 phosphotyrosine kinase siRNA
tcctttggggcatagatcagaag

SEQ ID NO: 9629 - DNA, 23 bp, Artificial Sequence
  epidermal growth factor receptor (EGFR), ERBB1 phosphotyrosine kinase siRNA
cctttggggcatagatcagaaga

SEQ ID NO: 9630 - DNA, 23 bp, Artificial Sequence
  epidermal growth factor receptor (EGFR), ERBB1 phosphotyrosine kinase siRNA
ctttggggcatagatcagaagac

SEQ ID NO: 9631 - DNA, 23 bp, Artificial Sequence
  epidermal growth factor receptor (EGFR), ERBB1 phosphotyrosine kinase siRNA
tttggggcatagatcagaagact

SEQ ID NO: 9632 - DNA, 23 bp, Artificial Sequence
  epidermal growth factor receptor (EGFR), ERBB1 phosphotyrosine kinase siRNA
ttggggcatagatcagaagacta

SEQ ID NO: 9633 - DNA, 23 bp, Artificial Sequence
  epidermal growth factor receptor (EGFR), ERBB1 phosphotyrosine kinase siRNA
tggggcatagatcagaagactac

SEQ ID NO: 9634 - DNA, 23 bp, Artificial Sequence
  epidermal growth factor receptor (EGFR), ERBB1 phosphotyrosine kinase siRNA
ggggcatagatcagaagactaca

SEQ ID NO: 9635 - DNA, 23 bp, Artificial Sequence
  epidermal growth factor receptor (EGFR), ERBB1 phosphotyrosine kinase siRNA
gggcatagatcagaagactacaa

SEQ ID NO: 9636 - DNA, 23 bp, Artificial Sequence
  epidermal growth factor receptor (EGFR), ERBB1 phosphotyrosine kinase siRNA
ggcatagatcagaagactacaaa

SEQ ID NO: 9637 - DNA, 23 bp, Artificial Sequence
  epidermal growth factor receptor (EGFR), ERBB1 phosphotyrosine kinase siRNA
gcatagatcagaagactacaaaa

SEQ ID NO: 9638 - DNA, 23 bp, Artificial Sequence
  epidermal growth factor receptor (EGFR), ERBB1 phosphotyrosine kinase siRNA
catagatcagaagactacaaaaa

SEQ ID NO: 9639 - DNA, 23 bp, Artificial Sequence
  epidermal growth factor receptor (EGFR), ERBB1 phosphotyrosine kinase siRNA
atagatcagaagactacaaaaat

SEQ ID NO: 9640 - DNA, 23 bp, Artificial Sequence
  epidermal growth factor receptor (EGFR), ERBB1 phosphotyrosine kinase siRNA
tagatcagaagactacaaaaatg

SEQ ID NO: 9641 - DNA, 23 bp, Artificial Sequence
  epidermal growth factor receptor (EGFR), ERBB1 phosphotyrosine kinase siRNA
agatcagaagactacaaaaatga

SEQ ID NO: 9642 - DNA, 23 bp, Artificial Sequence
  epidermal growth factor receptor (EGFR), ERBB1 phosphotyrosine kinase siRNA
gatcagaagactacaaaaatgaa

SEQ ID NO: 9643 - DNA, 23 bp, Artificial Sequence
  epidermal growth factor receptor (EGFR), ERBB1 phosphotyrosine kinase siRNA
atcagaagactacaaaaatgaag

SEQ ID NO: 9644 - DNA, 23 bp, Artificial Sequence
  epidermal growth factor receptor (EGFR), ERBB1 phosphotyrosine kinase siRNA
tcagaagactacaaaaatgaagc

SEQ ID NO: 9645 - DNA, 23 bp, Artificial Sequence
  epidermal growth factor receptor (EGFR), ERBB1 phosphotyrosine kinase siRNA
cagaagactacaaaaatgaagct

SEQ ID NO: 9646 - DNA, 23 bp, Artificial Sequence
  epidermal growth factor receptor (EGFR), ERBB1 phosphotyrosine kinase siRNA
agaagactacaaaaatgaagctg

SEQ ID NO: 9647 - DNA, 23 bp, Artificial Sequence
  epidermal growth factor receptor (EGFR), ERBB1 phosphotyrosine kinase siRNA
gaagactacaaaaatgaagctgc

SEQ ID NO: 9648 - DNA, 23 bp, Artificial Sequence
  epidermal growth factor receptor (EGFR), ERBB1 phosphotyrosine kinase siRNA
aagactacaaaaatgaagctgct

SEQ ID NO: 9649 - DNA, 23 bp, Artificial Sequence
  epidermal growth factor receptor (EGFR), ERBB1 phosphotyrosine kinase siRNA
agactacaaaaatgaagctgctc

SEQ ID NO: 9650 - DNA, 23 bp, Artificial Sequence
  epidermal growth factor receptor (EGFR), ERBB1 phosphotyrosine kinase siRNA
gactacaaaaatgaagctgctct

SEQ ID NO: 9651 - DNA, 23 bp, Artificial Sequence
  epidermal growth factor receptor (EGFR), ERBB1 phosphotyrosine kinase siRNA
actacaaaaatgaagctgctctg

SEQ ID NO: 9652 - DNA, 23 bp, Artificial Sequence
  epidermal growth factor receptor (EGFR), ERBB1 phosphotyrosine kinase siRNA
ctacaaaaatgaagctgctctga

SEQ ID NO: 9653 - DNA, 23 bp, Artificial Sequence
  epidermal growth factor receptor (EGFR), ERBB1 phosphotyrosine kinase siRNA
tacaaaaatgaagctgctctgaa

SEQ ID NO: 9654 - DNA, 23 bp, Artificial Sequence
  epidermal growth factor receptor (EGFR), ERBB1 phosphotyrosine kinase siRNA
acaaaaatgaagctgctctgaaa

SEQ ID NO: 9655 - DNA, 23 bp, Artificial Sequence
  epidermal growth factor receptor (EGFR), ERBB1 phosphotyrosine kinase siRNA
caaaaatgaagctgctctgaaat

SEQ ID NO: 9656 - DNA, 23 bp, Artificial Sequence
  epidermal growth factor receptor (EGFR), ERBB1 phosphotyrosine kinase siRNA
aaaaatgaagctgctctgaaatc

SEQ ID NO: 9657 - DNA, 23 bp, Artificial Sequence
  epidermal growth factor receptor (EGFR), ERBB1 phosphotyrosine kinase siRNA
aaaatgaagctgctctgaaatct

SEQ ID NO: 9658 - DNA, 23 bp, Artificial Sequence
  epidermal growth factor receptor (EGFR), ERBB1 phosphotyrosine kinase siRNA
aaatgaagctgctctgaaatctc

SEQ ID NO: 9659 - DNA, 23 bp, Artificial Sequence
  epidermal growth factor receptor (EGFR), ERBB1 phosphotyrosine kinase siRNA
aatgaagctgctctgaaatctcc

SEQ ID NO: 9660 - DNA, 23 bp, Artificial Sequence
  epidermal growth factor receptor (EGFR), ERBB1 phosphotyrosine kinase siRNA
atgaagctgctctgaaatctcct

SEQ ID NO: 9661 - DNA, 23 bp, Artificial Sequence
  epidermal growth factor receptor (EGFR), ERBB1 phosphotyrosine kinase siRNA
tgaagctgctctgaaatctcctt

SEQ ID NO: 9662 - DNA, 23 bp, Artificial Sequence
  epidermal growth factor receptor (EGFR), ERBB1 phosphotyrosine kinase siRNA
gaagctgctctgaaatctccttt

SEQ ID NO: 9663 - DNA, 23 bp, Artificial Sequence
  epidermal growth factor receptor (EGFR), ERBB1 phosphotyrosine kinase siRNA
aagctgctctgaaatctccttta

SEQ ID NO: 9664 - DNA, 23 bp, Artificial Sequence
  epidermal growth factor receptor (EGFR), ERBB1 phosphotyrosine kinase siRNA
agctgctctgaaatctcctttag

SEQ ID NO: 9665 - DNA, 23 bp, Artificial Sequence
  epidermal growth factor receptor (EGFR), ERBB1 phosphotyrosine kinase siRNA
gctgctctgaaatctcctttagc

SEQ ID NO: 9666 - DNA, 23 bp, Artificial Sequence
  epidermal growth factor receptor (EGFR), ERBB1 phosphotyrosine kinase siRNA
ctgctctgaaatctcctttagcc

SEQ ID NO: 9667 - DNA, 23 bp, Artificial Sequence
  epidermal growth factor receptor (EGFR), ERBB1 phosphotyrosine kinase siRNA
tgctctgaaatctcctttagcca

SEQ ID NO: 9668 - DNA, 23 bp, Artificial Sequence
  epidermal growth factor receptor (EGFR), ERBB1 phosphotyrosine kinase siRNA
gctctgaaatctcctttagccat

SEQ ID NO: 9669 - DNA, 23 bp, Artificial Sequence
  epidermal growth factor receptor (EGFR), ERBB1 phosphotyrosine kinase siRNA
ctctgaaatctcctttagccatc

SEQ ID NO: 9670 - DNA, 23 bp, Artificial Sequence
  epidermal growth factor receptor (EGFR), ERBB1 phosphotyrosine kinase siRNA
tctgaaatctcctttagccatca

SEQ ID NO: 9671 - DNA, 23 bp, Artificial Sequence
  epidermal growth factor receptor (EGFR), ERBB1 phosphotyrosine kinase siRNA
ctgaaatctcctttagccatcac

SEQ ID NO: 9672 - DNA, 23 bp, Artificial Sequence
  epidermal growth factor receptor (EGFR), ERBB1 phosphotyrosine kinase siRNA
tgaaatctcctttagccatcacc

SEQ ID NO: 9673 - DNA, 23 bp, Artificial Sequence
  epidermal growth factor receptor (EGFR), ERBB1 phosphotyrosine kinase siRNA
gaaatctcctttagccatcaccc

SEQ ID NO: 9674 - DNA, 23 bp, Artificial Sequence
  epidermal growth factor receptor (EGFR), ERBB1 phosphotyrosine kinase siRNA
aaatctcctttagccatcacccc

SEQ ID NO: 9675 - DNA, 23 bp, Artificial Sequence
  epidermal growth factor receptor (EGFR), ERBB1 phosphotyrosine kinase siRNA
aatctcctttagccatcacccca

SEQ ID NO: 9676 - DNA, 23 bp, Artificial Sequence
  epidermal growth factor receptor (EGFR), ERBB1 phosphotyrosine kinase siRNA
atctcctttagccatcaccccaa

SEQ ID NO: 9677 - DNA, 23 bp, Artificial Sequence
  epidermal growth factor receptor (EGFR), ERBB1 phosphotyrosine kinase siRNA
tctcctttagccatcaccccaac

SEQ ID NO: 9678 - DNA, 23 bp, Artificial Sequence
  epidermal growth factor receptor (EGFR), ERBB1 phosphotyrosine kinase siRNA
ctcctttagccatcaccccaacc

SEQ ID NO: 9679 - DNA, 23 bp, Artificial Sequence
  epidermal growth factor receptor (EGFR), ERBB1 phosphotyrosine kinase siRNA
tcctttagccatcaccccaaccc

SEQ ID NO: 9680 - DNA, 23 bp, Artificial Sequence
  epidermal growth factor receptor (EGFR), ERBB1 phosphotyrosine kinase siRNA
cctttagccatcaccccaacccc

SEQ ID NO: 9681 - DNA, 23 bp, Artificial Sequence
  epidermal growth factor receptor (EGFR), ERBB1 phosphotyrosine kinase siRNA
ctttagccatcaccccaaccccc

SEQ ID NO: 9682 - DNA, 23 bp, Artificial Sequence
  epidermal growth factor receptor (EGFR), ERBB1 phosphotyrosine kinase siRNA
tttagccatcaccccaacccccc

SEQ ID NO: 9683 - DNA, 23 bp, Artificial Sequence
  epidermal growth factor receptor (EGFR), ERBB1 phosphotyrosine kinase siRNA
ttagccatcaccccaacccccca

SEQ ID NO: 9684 - DNA, 23 bp, Artificial Sequence
  epidermal growth factor receptor (EGFR), ERBB1 phosphotyrosine kinase siRNA
tagccatcaccccaaccccccaa

SEQ ID NO: 9685 - DNA, 23 bp, Artificial Sequence
  epidermal growth factor receptor (EGFR), ERBB1 phosphotyrosine kinase siRNA
agccatcaccccaaccccccaaa

SEQ ID NO: 9686 - DNA, 23 bp, Artificial Sequence
  epidermal growth factor receptor (EGFR), ERBB1 phosphotyrosine kinase siRNA
gccatcaccccaaccccccaaaa

SEQ ID NO: 9687 - DNA, 23 bp, Artificial Sequence
  epidermal growth factor receptor (EGFR), ERBB1 phosphotyrosine kinase siRNA
ccatcaccccaaccccccaaaat

SEQ ID NO: 9688 - DNA, 23 bp, Artificial Sequence
  epidermal growth factor receptor (EGFR), ERBB1 phosphotyrosine kinase siRNA
catcaccccaaccccccaaaatt

SEQ ID NO: 9689 - DNA, 23 bp, Artificial Sequence
  epidermal growth factor receptor (EGFR), ERBB1 phosphotyrosine kinase siRNA
atcaccccaaccccccaaaatta

SEQ ID NO: 9690 - DNA, 23 bp, Artificial Sequence
  epidermal growth factor receptor (EGFR), ERBB1 phosphotyrosine kinase siRNA
tcaccccaaccccccaaaattag

SEQ ID NO: 9691 - DNA, 23 bp, Artificial Sequence
  epidermal growth factor receptor (EGFR), ERBB1 phosphotyrosine kinase siRNA
caccccaaccccccaaaattagt

SEQ ID NO: 9692 - DNA, 23 bp, Artificial Sequence
  epidermal growth factor receptor (EGFR), ERBB1 phosphotyrosine kinase siRNA
accccaaccccccaaaattagtt

SEQ ID NO: 9693 - DNA, 23 bp, Artificial Sequence
  epidermal growth factor receptor (EGFR), ERBB1 phosphotyrosine kinase siRNA
ccccaaccccccaaaattagttt

SEQ ID NO: 9694 - DNA, 23 bp, Artificial Sequence
  epidermal growth factor receptor (EGFR), ERBB1 phosphotyrosine kinase siRNA
cccaaccccccaaaattagtttg

SEQ ID NO: 9695 - DNA, 23 bp, Artificial Sequence
  epidermal growth factor receptor (EGFR), ERBB1 phosphotyrosine kinase siRNA
ccaaccccccaaaattagtttgt

SEQ ID NO: 9696 - DNA, 23 bp, Artificial Sequence
  epidermal growth factor receptor (EGFR), ERBB1 phosphotyrosine kinase siRNA
caaccccccaaaattagtttgtg

SEQ ID NO: 9697 - DNA, 23 bp, Artificial Sequence
  epidermal growth factor receptor (EGFR), ERBB1 phosphotyrosine kinase siRNA
aaccccccaaaattagtttgtgt

SEQ ID NO: 9698 - DNA, 23 bp, Artificial Sequence
  epidermal growth factor receptor (EGFR), ERBB1 phosphotyrosine kinase siRNA
accccccaaaattagtttgtgtt

SEQ ID NO: 9699 - DNA, 23 bp, Artificial Sequence
  epidermal growth factor receptor (EGFR), ERBB1 phosphotyrosine kinase siRNA
ccccccaaaattagtttgtgtta

SEQ ID NO: 9700 - DNA, 23 bp, Artificial Sequence
  epidermal growth factor receptor (EGFR), ERBB1 phosphotyrosine kinase siRNA
cccccaaaattagtttgtgttac

SEQ ID NO: 9701 - DNA, 23 bp, Artificial Sequence
  epidermal growth factor receptor (EGFR), ERBB1 phosphotyrosine kinase siRNA
ccccaaaattagtttgtgttact

SEQ ID NO: 9702 - DNA, 23 bp, Artificial Sequence
  epidermal growth factor receptor (EGFR), ERBB1 phosphotyrosine kinase siRNA
cccaaaattagtttgtgttactt

SEQ ID NO: 9703 - DNA, 23 bp, Artificial Sequence
  epidermal growth factor receptor (EGFR), ERBB1 phosphotyrosine kinase siRNA
ccaaaattagtttgtgttactta

SEQ ID NO: 9704 - DNA, 23 bp, Artificial Sequence
  epidermal growth factor receptor (EGFR), ERBB1 phosphotyrosine kinase siRNA
caaaattagtttgtgttacttat

SEQ ID NO: 9705 - DNA, 23 bp, Artificial Sequence
  epidermal growth factor receptor (EGFR), ERBB1 phosphotyrosine kinase siRNA
aaaattagtttgtgttacttatg

SEQ ID NO: 9706 - DNA, 23 bp, Artificial Sequence
  epidermal growth factor receptor (EGFR), ERBB1 phosphotyrosine kinase siRNA
aaattagtttgtgttacttatgg

SEQ ID NO: 9707 - DNA, 23 bp, Artificial Sequence
  epidermal growth factor receptor (EGFR), ERBB1 phosphotyrosine kinase siRNA
aattagtttgtgttacttatgga

SEQ ID NO: 9708 - DNA, 23 bp, Artificial Sequence
  epidermal growth factor receptor (EGFR), ERBB1 phosphotyrosine kinase siRNA
attagtttgtgttacttatggaa

SEQ ID NO: 9709 - DNA, 23 bp, Artificial Sequence
  epidermal growth factor receptor (EGFR), ERBB1 phosphotyrosine kinase siRNA
ttagtttgtgttacttatggaag

SEQ ID NO: 9710 - DNA, 23 bp, Artificial Sequence
  epidermal growth factor receptor (EGFR), ERBB1 phosphotyrosine kinase siRNA
tagtttgtgttacttatggaaga

SEQ ID NO: 9711 - DNA, 23 bp, Artificial Sequence
  epidermal growth factor receptor (EGFR), ERBB1 phosphotyrosine kinase siRNA
agtttgtgttacttatggaagat

SEQ ID NO: 9712 - DNA, 23 bp, Artificial Sequence
  epidermal growth factor receptor (EGFR), ERBB1 phosphotyrosine kinase siRNA
gtttgtgttacttatggaagata

SEQ ID NO: 9713 - DNA, 23 bp, Artificial Sequence
  epidermal growth factor receptor (EGFR), ERBB1 phosphotyrosine kinase siRNA
tttgtgttacttatggaagatag

SEQ ID NO: 9714 - DNA, 23 bp, Artificial Sequence
  epidermal growth factor receptor (EGFR), ERBB1 phosphotyrosine kinase siRNA
ttgtgttacttatggaagatagt

SEQ ID NO: 9715 - DNA, 23 bp, Artificial Sequence
  epidermal growth factor receptor (EGFR), ERBB1 phosphotyrosine kinase siRNA
tgtgttacttatggaagatagtt

SEQ ID NO: 9716 - DNA, 23 bp, Artificial Sequence
  epidermal growth factor receptor (EGFR), ERBB1 phosphotyrosine kinase siRNA
gtgttacttatggaagatagttt

SEQ ID NO: 9717 - DNA, 23 bp, Artificial Sequence
  epidermal growth factor receptor (EGFR), ERBB1 phosphotyrosine kinase siRNA
tgttacttatggaagatagtttt

SEQ ID NO: 9718 - DNA, 23 bp, Artificial Sequence
  epidermal growth factor receptor (EGFR), ERBB1 phosphotyrosine kinase siRNA
gttacttatggaagatagttttc

SEQ ID NO: 9719 - DNA, 23 bp, Artificial Sequence
  epidermal growth factor receptor (EGFR), ERBB1 phosphotyrosine kinase siRNA
ttacttatggaagatagttttct

SEQ ID NO: 9720 - DNA, 23 bp, Artificial Sequence
  epidermal growth factor receptor (EGFR), ERBB1 phosphotyrosine kinase siRNA
tacttatggaagatagttttctc

SEQ ID NO: 9721 - DNA, 23 bp, Artificial Sequence
  epidermal growth factor receptor (EGFR), ERBB1 phosphotyrosine kinase siRNA
acttatggaagatagttttctcc

SEQ ID NO: 9722 - DNA, 23 bp, Artificial Sequence
  epidermal growth factor receptor (EGFR), ERBB1 phosphotyrosine kinase siRNA
cttatggaagatagttttctcct

SEQ ID NO: 9723 - DNA, 23 bp, Artificial Sequence
  epidermal growth factor receptor (EGFR), ERBB1 phosphotyrosine kinase siRNA
ttatggaagatagttttctcctt

SEQ ID NO: 9724 - DNA, 23 bp, Artificial Sequence
  epidermal growth factor receptor (EGFR), ERBB1 phosphotyrosine kinase siRNA
tatggaagatagttttctccttt

SEQ ID NO: 9725 - DNA, 23 bp, Artificial Sequence
  epidermal growth factor receptor (EGFR), ERBB1 phosphotyrosine kinase siRNA
atggaagatagttttctcctttt

SEQ ID NO: 9726 - DNA, 23 bp, Artificial Sequence
  epidermal growth factor receptor (EGFR), ERBB1 phosphotyrosine kinase siRNA
tggaagatagttttctcctttta

SEQ ID NO: 9727 - DNA, 23 bp, Artificial Sequence
  epidermal growth factor receptor (EGFR), ERBB1 phosphotyrosine kinase siRNA
ggaagatagttttctccttttac

SEQ ID NO: 9728 - DNA, 23 bp, Artificial Sequence
  epidermal growth factor receptor (EGFR), ERBB1 phosphotyrosine kinase siRNA
gaagatagttttctccttttact

SEQ ID NO: 9729 - DNA, 23 bp, Artificial Sequence
  epidermal growth factor receptor (EGFR), ERBB1 phosphotyrosine kinase siRNA
aagatagttttctccttttactt

SEQ ID NO: 9730 - DNA, 23 bp, Artificial Sequence
  epidermal growth factor receptor (EGFR), ERBB1 phosphotyrosine kinase siRNA
agatagttttctccttttacttc

SEQ ID NO: 9731 - DNA, 23 bp, Artificial Sequence
  epidermal growth factor receptor (EGFR), ERBB1 phosphotyrosine kinase siRNA
gatagttttctccttttacttca

SEQ ID NO: 9732 - DNA, 23 bp, Artificial Sequence
  epidermal growth factor receptor (EGFR), ERBB1 phosphotyrosine kinase siRNA
atagttttctccttttacttcac

SEQ ID NO: 9733 - DNA, 23 bp, Artificial Sequence
  epidermal growth factor receptor (EGFR), ERBB1 phosphotyrosine kinase siRNA
tagttttctccttttacttcact

SEQ ID NO: 9734 - DNA, 23 bp, Artificial Sequence
  epidermal growth factor receptor (EGFR), ERBB1 phosphotyrosine kinase siRNA
agttttctccttttacttcactt

SEQ ID NO: 9735 - DNA, 23 bp, Artificial Sequence
  epidermal growth factor receptor (EGFR), ERBB1 phosphotyrosine kinase siRNA
gttttctccttttacttcacttc

SEQ ID NO: 9736 - DNA, 23 bp, Artificial Sequence
  epidermal growth factor receptor (EGFR), ERBB1 phosphotyrosine kinase siRNA
ttttctccttttacttcacttca

SEQ ID NO: 9737 - DNA, 23 bp, Artificial Sequence
  epidermal growth factor receptor (EGFR), ERBB1 phosphotyrosine kinase siRNA
tttctccttttacttcacttcaa

SEQ ID NO: 9738 - DNA, 23 bp, Artificial Sequence
  epidermal growth factor receptor (EGFR), ERBB1 phosphotyrosine kinase siRNA
ttctccttttacttcacttcaaa

SEQ ID NO: 9739 - DNA, 23 bp, Artificial Sequence
  epidermal growth factor receptor (EGFR), ERBB1 phosphotyrosine kinase siRNA
tctccttttacttcacttcaaaa

SEQ ID NO: 9740 - DNA, 23 bp, Artificial Sequence
  epidermal growth factor receptor (EGFR), ERBB1 phosphotyrosine kinase siRNA
ctccttttacttcacttcaaaag

SEQ ID NO: 9741 - DNA, 23 bp, Artificial Sequence
  epidermal growth factor receptor (EGFR), ERBB1 phosphotyrosine kinase siRNA
tccttttacttcacttcaaaagc

SEQ ID NO: 9742 - DNA, 23 bp, Artificial Sequence
  epidermal growth factor receptor (EGFR), ERBB1 phosphotyrosine kinase siRNA
ccttttacttcacttcaaaagct

SEQ ID NO: 9743 - DNA, 23 bp, Artificial Sequence
  epidermal growth factor receptor (EGFR), ERBB1 phosphotyrosine kinase siRNA
cttttacttcacttcaaaagctt

SEQ ID NO: 9744 - DNA, 23 bp, Artificial Sequence
  epidermal growth factor receptor (EGFR), ERBB1 phosphotyrosine kinase siRNA
ttttacttcacttcaaaagcttt

SEQ ID NO: 9745 - DNA, 23 bp, Artificial Sequence
  epidermal growth factor receptor (EGFR), ERBB1 phosphotyrosine kinase siRNA
tttacttcacttcaaaagctttt

SEQ ID NO: 9746 - DNA, 23 bp, Artificial Sequence
  epidermal growth factor receptor (EGFR), ERBB1 phosphotyrosine kinase siRNA
ttacttcacttcaaaagcttttt

SEQ ID NO: 9747 - DNA, 23 bp, Artificial Sequence
  epidermal growth factor receptor (EGFR), ERBB1 phosphotyrosine kinase siRNA
tacttcacttcaaaagcttttta

SEQ ID NO: 9748 - DNA, 23 bp, Artificial Sequence
  epidermal growth factor receptor (EGFR), ERBB1 phosphotyrosine kinase siRNA
acttcacttcaaaagctttttac

SEQ ID NO: 9749 - DNA, 23 bp, Artificial Sequence
  epidermal growth factor receptor (EGFR), ERBB1 phosphotyrosine kinase siRNA
cttcacttcaaaagctttttact

SEQ ID NO: 9750 - DNA, 23 bp, Artificial Sequence
  epidermal growth factor receptor (EGFR), ERBB1 phosphotyrosine kinase siRNA
ttcacttcaaaagctttttactc

SEQ ID NO: 9751 - DNA, 23 bp, Artificial Sequence
  epidermal growth factor receptor (EGFR), ERBB1 phosphotyrosine kinase siRNA
tcacttcaaaagctttttactca

SEQ ID NO: 9752 - DNA, 23 bp, Artificial Sequence
  epidermal growth factor receptor (EGFR), ERBB1 phosphotyrosine kinase siRNA
cacttcaaaagctttttactcaa

SEQ ID NO: 9753 - DNA, 23 bp, Artificial Sequence
  epidermal growth factor receptor (EGFR), ERBB1 phosphotyrosine kinase siRNA
acttcaaaagctttttactcaaa

SEQ ID NO: 9754 - DNA, 23 bp, Artificial Sequence
  epidermal growth factor receptor (EGFR), ERBB1 phosphotyrosine kinase siRNA
cttcaaaagctttttactcaaag

SEQ ID NO: 9755 - DNA, 23 bp, Artificial Sequence
  epidermal growth factor receptor (EGFR), ERBB1 phosphotyrosine kinase siRNA
ttcaaaagctttttactcaaaga

SEQ ID NO: 9756 - DNA, 23 bp, Artificial Sequence
  epidermal growth factor receptor (EGFR), ERBB1 phosphotyrosine kinase siRNA
tcaaaagctttttactcaaagag

SEQ ID NO: 9757 - DNA, 23 bp, Artificial Sequence
  epidermal growth factor receptor (EGFR), ERBB1 phosphotyrosine kinase siRNA
caaaagctttttactcaaagagt

SEQ ID NO: 9758 - DNA, 23 bp, Artificial Sequence
  epidermal growth factor receptor (EGFR), ERBB1 phosphotyrosine kinase siRNA
aaaagctttttactcaaagagta

SEQ ID NO: 9759 - DNA, 23 bp, Artificial Sequence
  epidermal growth factor receptor (EGFR), ERBB1 phosphotyrosine kinase siRNA
aaagctttttactcaaagagtat

SEQ ID NO: 9760 - DNA, 23 bp, Artificial Sequence
  epidermal growth factor receptor (EGFR), ERBB1 phosphotyrosine kinase siRNA
aagctttttactcaaagagtata

SEQ ID NO: 9761 - DNA, 23 bp, Artificial Sequence
  epidermal growth factor receptor (EGFR), ERBB1 phosphotyrosine kinase siRNA
agctttttactcaaagagtatat

SEQ ID NO: 9762 - DNA, 23 bp, Artificial Sequence
  epidermal growth factor receptor (EGFR), ERBB1 phosphotyrosine kinase siRNA
gctttttactcaaagagtatatg

SEQ ID NO: 9763 - DNA, 23 bp, Artificial Sequence
  epidermal growth factor receptor (EGFR), ERBB1 phosphotyrosine kinase siRNA
ctttttactcaaagagtatatgt

SEQ ID NO: 9764 - DNA, 23 bp, Artificial Sequence
  epidermal growth factor receptor (EGFR), ERBB1 phosphotyrosine kinase siRNA
tttttactcaaagagtatatgtt

SEQ ID NO: 9765 - DNA, 23 bp, Artificial Sequence
  epidermal growth factor receptor (EGFR), ERBB1 phosphotyrosine kinase siRNA
ttttactcaaagagtatatgttc

SEQ ID NO: 9766 - DNA, 23 bp, Artificial Sequence
  epidermal growth factor receptor (EGFR), ERBB1 phosphotyrosine kinase siRNA
tttactcaaagagtatatgttcc

SEQ ID NO: 9767 - DNA, 23 bp, Artificial Sequence
  epidermal growth factor receptor (EGFR), ERBB1 phosphotyrosine kinase siRNA
ttactcaaagagtatatgttccc

SEQ ID NO: 9768 - DNA, 23 bp, Artificial Sequence
  epidermal growth factor receptor (EGFR), ERBB1 phosphotyrosine kinase siRNA
tactcaaagagtatatgttccct

SEQ ID NO: 9769 - DNA, 23 bp, Artificial Sequence
  epidermal growth factor receptor (EGFR), ERBB1 phosphotyrosine kinase siRNA
actcaaagagtatatgttccctc

SEQ ID NO: 9770 - DNA, 23 bp, Artificial Sequence
  epidermal growth factor receptor (EGFR), ERBB1 phosphotyrosine kinase siRNA
ctcaaagagtatatgttccctcc

SEQ ID NO: 9771 - DNA, 23 bp, Artificial Sequence
  epidermal growth factor receptor (EGFR), ERBB1 phosphotyrosine kinase siRNA
tcaaagagtatatgttccctcca

SEQ ID NO: 9772 - DNA, 23 bp, Artificial Sequence
  epidermal growth factor receptor (EGFR), ERBB1 phosphotyrosine kinase siRNA
caaagagtatatgttccctccag

SEQ ID NO: 9773 - DNA, 23 bp, Artificial Sequence
  epidermal growth factor receptor (EGFR), ERBB1 phosphotyrosine kinase siRNA
aaagagtatatgttccctccagg

SEQ ID NO: 9774 - DNA, 23 bp, Artificial Sequence
  epidermal growth factor receptor (EGFR), ERBB1 phosphotyrosine kinase siRNA
aagagtatatgttccctccaggt

SEQ ID NO: 9775 - DNA, 23 bp, Artificial Sequence
  epidermal growth factor receptor (EGFR), ERBB1 phosphotyrosine kinase siRNA
agagtatatgttccctccaggtc

SEQ ID NO: 9776 - DNA, 23 bp, Artificial Sequence
  epidermal growth factor receptor (EGFR), ERBB1 phosphotyrosine kinase siRNA
gagtatatgttccctccaggtca

SEQ ID NO: 9777 - DNA, 23 bp, Artificial Sequence
  epidermal growth factor receptor (EGFR), ERBB1 phosphotyrosine kinase siRNA
agtatatgttccctccaggtcag

SEQ ID NO: 9778 - DNA, 23 bp, Artificial Sequence
  epidermal growth factor receptor (EGFR), ERBB1 phosphotyrosine kinase siRNA
gtatatgttccctccaggtcagc

SEQ ID NO: 9779 - DNA, 23 bp, Artificial Sequence
  epidermal growth factor receptor (EGFR), ERBB1 phosphotyrosine kinase siRNA
tatatgttccctccaggtcagct

SEQ ID NO: 9780 - DNA, 23 bp, Artificial Sequence
  epidermal growth factor receptor (EGFR), ERBB1 phosphotyrosine kinase siRNA
atatgttccctccaggtcagctg

SEQ ID NO: 9781 - DNA, 23 bp, Artificial Sequence
  epidermal growth factor receptor (EGFR), ERBB1 phosphotyrosine kinase siRNA
tatgttccctccaggtcagctgc

SEQ ID NO: 9782 - DNA, 23 bp, Artificial Sequence
  epidermal growth factor receptor (EGFR), ERBB1 phosphotyrosine kinase siRNA
atgttccctccaggtcagctgcc

SEQ ID NO: 9783 - DNA, 23 bp, Artificial Sequence
  epidermal growth factor receptor (EGFR), ERBB1 phosphotyrosine kinase siRNA
tgttccctccaggtcagctgccc

SEQ ID NO: 9784 - DNA, 23 bp, Artificial Sequence
  epidermal growth factor receptor (EGFR), ERBB1 phosphotyrosine kinase siRNA
gttccctccaggtcagctgcccc

SEQ ID NO: 9785 - DNA, 23 bp, Artificial Sequence
  epidermal growth factor receptor (EGFR), ERBB1 phosphotyrosine kinase siRNA
ttccctccaggtcagctgccccc

SEQ ID NO: 9786 - DNA, 23 bp, Artificial Sequence
  epidermal growth factor receptor (EGFR), ERBB1 phosphotyrosine kinase siRNA
tccctccaggtcagctgccccca

SEQ ID NO: 9787 - DNA, 23 bp, Artificial Sequence
  epidermal growth factor receptor (EGFR), ERBB1 phosphotyrosine kinase siRNA
ccctccaggtcagctgcccccaa

SEQ ID NO: 9788 - DNA, 23 bp, Artificial Sequence
  epidermal growth factor receptor (EGFR), ERBB1 phosphotyrosine kinase siRNA
cctccaggtcagctgcccccaaa

SEQ ID NO: 9789 - DNA, 23 bp, Artificial Sequence
  epidermal growth factor receptor (EGFR), ERBB1 phosphotyrosine kinase siRNA
ctccaggtcagctgcccccaaac

SEQ ID NO: 9790 - DNA, 23 bp, Artificial Sequence
  epidermal growth factor receptor (EGFR), ERBB1 phosphotyrosine kinase siRNA
tccaggtcagctgcccccaaacc

SEQ ID NO: 9791 - DNA, 23 bp, Artificial Sequence
  epidermal growth factor receptor (EGFR), ERBB1 phosphotyrosine kinase siRNA
ccaggtcagctgcccccaaaccc

SEQ ID NO: 9792 - DNA, 23 bp, Artificial Sequence
  epidermal growth factor receptor (EGFR), ERBB1 phosphotyrosine kinase siRNA
caggtcagctgcccccaaacccc

SEQ ID NO: 9793 - DNA, 23 bp, Artificial Sequence
  epidermal growth factor receptor (EGFR), ERBB1 phosphotyrosine kinase siRNA
aggtcagctgcccccaaaccccc

SEQ ID NO: 9794 - DNA, 23 bp, Artificial Sequence
  epidermal growth factor receptor (EGFR), ERBB1 phosphotyrosine kinase siRNA
ggtcagctgcccccaaaccccct

SEQ ID NO: 9795 - DNA, 23 bp, Artificial Sequence
  epidermal growth factor receptor (EGFR), ERBB1 phosphotyrosine kinase siRNA
gtcagctgcccccaaaccccctc

SEQ ID NO: 9796 - DNA, 23 bp, Artificial Sequence
  epidermal growth factor receptor (EGFR), ERBB1 phosphotyrosine kinase siRNA
tcagctgcccccaaaccccctcc

SEQ ID NO: 9797 - DNA, 23 bp, Artificial Sequence
  epidermal growth factor receptor (EGFR), ERBB1 phosphotyrosine kinase siRNA
cagctgcccccaaaccccctcct

SEQ ID NO: 9798 - DNA, 23 bp, Artificial Sequence
  epidermal growth factor receptor (EGFR), ERBB1 phosphotyrosine kinase siRNA
agctgcccccaaaccccctcctt

SEQ ID NO: 9799 - DNA, 23 bp, Artificial Sequence
  epidermal growth factor receptor (EGFR), ERBB1 phosphotyrosine kinase siRNA
gctgcccccaaaccccctcctta

SEQ ID NO: 9800 - DNA, 23 bp, Artificial Sequence
  epidermal growth factor receptor (EGFR), ERBB1 phosphotyrosine kinase siRNA
ctgcccccaaaccccctccttac

SEQ ID NO: 9801 - DNA, 23 bp, Artificial Sequence
  epidermal growth factor receptor (EGFR), ERBB1 phosphotyrosine kinase siRNA
tgcccccaaaccccctccttacg

SEQ ID NO: 9802 - DNA, 23 bp, Artificial Sequence
  epidermal growth factor receptor (EGFR), ERBB1 phosphotyrosine kinase siRNA
gcccccaaaccccctccttacgc

SEQ ID NO: 9803 - DNA, 23 bp, Artificial Sequence
  epidermal growth factor receptor (EGFR), ERBB1 phosphotyrosine kinase siRNA
cccccaaaccccctccttacgct

SEQ ID NO: 9804 - DNA, 23 bp, Artificial Sequence
  epidermal growth factor receptor (EGFR), ERBB1 phosphotyrosine kinase siRNA
ccccaaaccccctccttacgctt

SEQ ID NO: 9805 - DNA, 23 bp, Artificial Sequence
  epidermal growth factor receptor (EGFR), ERBB1 phosphotyrosine kinase siRNA
cccaaaccccctccttacgcttt

SEQ ID NO: 9806 - DNA, 23 bp, Artificial Sequence
  epidermal growth factor receptor (EGFR), ERBB1 phosphotyrosine kinase siRNA
ccaaaccccctccttacgctttg

SEQ ID NO: 9807 - DNA, 23 bp, Artificial Sequence
  epidermal growth factor receptor (EGFR), ERBB1 phosphotyrosine kinase siRNA
caaaccccctccttacgctttgt

SEQ ID NO: 9808 - DNA, 23 bp, Artificial Sequence
  epidermal growth factor receptor (EGFR), ERBB1 phosphotyrosine kinase siRNA
aaaccccctccttacgctttgtc

SEQ ID NO: 9809 - DNA, 23 bp, Artificial Sequence
  epidermal growth factor receptor (EGFR), ERBB1 phosphotyrosine kinase siRNA
aaccccctccttacgctttgtca

SEQ ID NO: 9810 - DNA, 23 bp, Artificial Sequence
  epidermal growth factor receptor (EGFR), ERBB1 phosphotyrosine kinase siRNA
accccctccttacgctttgtcac

SEQ ID NO: 9811 - DNA, 23 bp, Artificial Sequence
  epidermal growth factor receptor (EGFR), ERBB1 phosphotyrosine kinase siRNA
ccccctccttacgctttgtcaca

SEQ ID NO: 9812 - DNA, 23 bp, Artificial Sequence
  epidermal growth factor receptor (EGFR), ERBB1 phosphotyrosine kinase siRNA
cccctccttacgctttgtcacac

SEQ ID NO: 9813 - DNA, 23 bp, Artificial Sequence
  epidermal growth factor receptor (EGFR), ERBB1 phosphotyrosine kinase siRNA
ccctccttacgctttgtcacaca

SEQ ID NO: 9814 - DNA, 23 bp, Artificial Sequence
  epidermal growth factor receptor (EGFR), ERBB1 phosphotyrosine kinase siRNA
cctccttacgctttgtcacacaa

SEQ ID NO: 9815 - DNA, 23 bp, Artificial Sequence
  epidermal growth factor receptor (EGFR), ERBB1 phosphotyrosine kinase siRNA
ctccttacgctttgtcacacaaa

SEQ ID NO: 9816 - DNA, 23 bp, Artificial Sequence
  epidermal growth factor receptor (EGFR), ERBB1 phosphotyrosine kinase siRNA
tccttacgctttgtcacacaaaa

SEQ ID NO: 9817 - DNA, 23 bp, Artificial Sequence
  epidermal growth factor receptor (EGFR), ERBB1 phosphotyrosine kinase siRNA
ccttacgctttgtcacacaaaaa

SEQ ID NO: 9818 - DNA, 23 bp, Artificial Sequence
  epidermal growth factor receptor (EGFR), ERBB1 phosphotyrosine kinase siRNA
cttacgctttgtcacacaaaaag

SEQ ID NO: 9819 - DNA, 23 bp, Artificial Sequence
  epidermal growth factor receptor (EGFR), ERBB1 phosphotyrosine kinase siRNA
ttacgctttgtcacacaaaaagt

SEQ ID NO: 9820 - DNA, 23 bp, Artificial Sequence
  epidermal growth factor receptor (EGFR), ERBB1 phosphotyrosine kinase siRNA
tacgctttgtcacacaaaaagtg

SEQ ID NO: 9821 - DNA, 23 bp, Artificial Sequence
  epidermal growth factor receptor (EGFR), ERBB1 phosphotyrosine kinase siRNA
acgctttgtcacacaaaaagtgt

SEQ ID NO: 9822 - DNA, 23 bp, Artificial Sequence
  epidermal growth factor receptor (EGFR), ERBB1 phosphotyrosine kinase siRNA
cgctttgtcacacaaaaagtgtc

SEQ ID NO: 9823 - DNA, 23 bp, Artificial Sequence
  epidermal growth factor receptor (EGFR), ERBB1 phosphotyrosine kinase siRNA
gctttgtcacacaaaaagtgtct

SEQ ID NO: 9824 - DNA, 23 bp, Artificial Sequence
  epidermal growth factor receptor (EGFR), ERBB1 phosphotyrosine kinase siRNA
ctttgtcacacaaaaagtgtctc

SEQ ID NO: 9825 - DNA, 23 bp, Artificial Sequence
  epidermal growth factor receptor (EGFR), ERBB1 phosphotyrosine kinase siRNA
tttgtcacacaaaaagtgtctct

SEQ ID NO: 9826 - DNA, 23 bp, Artificial Sequence
  epidermal growth factor receptor (EGFR), ERBB1 phosphotyrosine kinase siRNA
ttgtcacacaaaaagtgtctctg

SEQ ID NO: 9827 - DNA, 23 bp, Artificial Sequence
  epidermal growth factor receptor (EGFR), ERBB1 phosphotyrosine kinase siRNA
tgtcacacaaaaagtgtctctgc

SEQ ID NO: 9828 - DNA, 23 bp, Artificial Sequence
  epidermal growth factor receptor (EGFR), ERBB1 phosphotyrosine kinase siRNA
gtcacacaaaaagtgtctctgcc

SEQ ID NO: 9829 - DNA, 23 bp, Artificial Sequence
  epidermal growth factor receptor (EGFR), ERBB1 phosphotyrosine kinase siRNA
tcacacaaaaagtgtctctgcct

SEQ ID NO: 9830 - DNA, 23 bp, Artificial Sequence
  epidermal growth factor receptor (EGFR), ERBB1 phosphotyrosine kinase siRNA
cacacaaaaagtgtctctgcctt

SEQ ID NO: 9831 - DNA, 23 bp, Artificial Sequence
  epidermal growth factor receptor (EGFR), ERBB1 phosphotyrosine kinase siRNA
acacaaaaagtgtctctgccttg

SEQ ID NO: 9832 - DNA, 23 bp, Artificial Sequence
  epidermal growth factor receptor (EGFR), ERBB1 phosphotyrosine kinase siRNA
cacaaaaagtgtctctgccttga

SEQ ID NO: 9833 - DNA, 23 bp, Artificial Sequence
  epidermal growth factor receptor (EGFR), ERBB1 phosphotyrosine kinase siRNA
acaaaaagtgtctctgccttgag

SEQ ID NO: 9834 - DNA, 23 bp, Artificial Sequence
  epidermal growth factor receptor (EGFR), ERBB1 phosphotyrosine kinase siRNA
caaaaagtgtctctgccttgagt

SEQ ID NO: 9835 - DNA, 23 bp, Artificial Sequence
  epidermal growth factor receptor (EGFR), ERBB1 phosphotyrosine kinase siRNA
aaaaagtgtctctgccttgagtc

SEQ ID NO: 9836 - DNA, 23 bp, Artificial Sequence
  epidermal growth factor receptor (EGFR), ERBB1 phosphotyrosine kinase siRNA
aaaagtgtctctgccttgagtca

SEQ ID NO: 9837 - DNA, 23 bp, Artificial Sequence
  epidermal growth factor receptor (EGFR), ERBB1 phosphotyrosine kinase siRNA
aaagtgtctctgccttgagtcat

SEQ ID NO: 9838 - DNA, 23 bp, Artificial Sequence
  epidermal growth factor receptor (EGFR), ERBB1 phosphotyrosine kinase siRNA
aagtgtctctgccttgagtcatc

SEQ ID NO: 9839 - DNA, 23 bp, Artificial Sequence
  epidermal growth factor receptor (EGFR), ERBB1 phosphotyrosine kinase siRNA
agtgtctctgccttgagtcatct

SEQ ID NO: 9840 - DNA, 23 bp, Artificial Sequence
  epidermal growth factor receptor (EGFR), ERBB1 phosphotyrosine kinase siRNA
gtgtctctgccttgagtcatcta

SEQ ID NO: 9841 - DNA, 23 bp, Artificial Sequence
  epidermal growth factor receptor (EGFR), ERBB1 phosphotyrosine kinase siRNA
tgtctctgccttgagtcatctat

SEQ ID NO: 9842 - DNA, 23 bp, Artificial Sequence
  epidermal growth factor receptor (EGFR), ERBB1 phosphotyrosine kinase siRNA
gtctctgccttgagtcatctatt

SEQ ID NO: 9843 - DNA, 23 bp, Artificial Sequence
  epidermal growth factor receptor (EGFR), ERBB1 phosphotyrosine kinase siRNA
tctctgccttgagtcatctattc

SEQ ID NO: 9844 - DNA, 23 bp, Artificial Sequence
  epidermal growth factor receptor (EGFR), ERBB1 phosphotyrosine kinase siRNA
ctctgccttgagtcatctattca

SEQ ID NO: 9845 - DNA, 23 bp, Artificial Sequence
  epidermal growth factor receptor (EGFR), ERBB1 phosphotyrosine kinase siRNA
tctgccttgagtcatctattcaa

SEQ ID NO: 9846 - DNA, 23 bp, Artificial Sequence
  epidermal growth factor receptor (EGFR), ERBB1 phosphotyrosine kinase siRNA
ctgccttgagtcatctattcaag

SEQ ID NO: 9847 - DNA, 23 bp, Artificial Sequence
  epidermal growth factor receptor (EGFR), ERBB1 phosphotyrosine kinase siRNA
tgccttgagtcatctattcaagc

SEQ ID NO: 9848 - DNA, 23 bp, Artificial Sequence
  epidermal growth factor receptor (EGFR), ERBB1 phosphotyrosine kinase siRNA
gccttgagtcatctattcaagca

SEQ ID NO: 9849 - DNA, 23 bp, Artificial Sequence
  epidermal growth factor receptor (EGFR), ERBB1 phosphotyrosine kinase siRNA
ccttgagtcatctattcaagcac

SEQ ID NO: 9850 - DNA, 23 bp, Artificial Sequence
  epidermal growth factor receptor (EGFR), ERBB1 phosphotyrosine kinase siRNA
cttgagtcatctattcaagcact

SEQ ID NO: 9851 - DNA, 23 bp, Artificial Sequence
  epidermal growth factor receptor (EGFR), ERBB1 phosphotyrosine kinase siRNA
ttgagtcatctattcaagcactt

SEQ ID NO: 9852 - DNA, 23 bp, Artificial Sequence
  epidermal growth factor receptor (EGFR), ERBB1 phosphotyrosine kinase siRNA
tgagtcatctattcaagcactta

SEQ ID NO: 9853 - DNA, 23 bp, Artificial Sequence
  epidermal growth factor receptor (EGFR), ERBB1 phosphotyrosine kinase siRNA
gagtcatctattcaagcacttac

SEQ ID NO: 9854 - DNA, 23 bp, Artificial Sequence
  epidermal growth factor receptor (EGFR), ERBB1 phosphotyrosine kinase siRNA
agtcatctattcaagcacttaca

SEQ ID NO: 9855 - DNA, 23 bp, Artificial Sequence
  epidermal growth factor receptor (EGFR), ERBB1 phosphotyrosine kinase siRNA
gtcatctattcaagcacttacag

SEQ ID NO: 9856 - DNA, 23 bp, Artificial Sequence
  epidermal growth factor receptor (EGFR), ERBB1 phosphotyrosine kinase siRNA
tcatctattcaagcacttacagc

SEQ ID NO: 9857 - DNA, 23 bp, Artificial Sequence
  epidermal growth factor receptor (EGFR), ERBB1 phosphotyrosine kinase siRNA
catctattcaagcacttacagct

SEQ ID NO: 9858 - DNA, 23 bp, Artificial Sequence
  epidermal growth factor receptor (EGFR), ERBB1 phosphotyrosine kinase siRNA
atctattcaagcacttacagctc

SEQ ID NO: 9859 - DNA, 23 bp, Artificial Sequence
  epidermal growth factor receptor (EGFR), ERBB1 phosphotyrosine kinase siRNA
tctattcaagcacttacagctct

SEQ ID NO: 9860 - DNA, 23 bp, Artificial Sequence
  epidermal growth factor receptor (EGFR), ERBB1 phosphotyrosine kinase siRNA
ctattcaagcacttacagctctg

SEQ ID NO: 9861 - DNA, 23 bp, Artificial Sequence
  epidermal growth factor receptor (EGFR), ERBB1 phosphotyrosine kinase siRNA
tattcaagcacttacagctctgg

SEQ ID NO: 9862 - DNA, 23 bp, Artificial Sequence
  epidermal growth factor receptor (EGFR), ERBB1 phosphotyrosine kinase siRNA
attcaagcacttacagctctggc

SEQ ID NO: 9863 - DNA, 23 bp, Artificial Sequence
  epidermal growth factor receptor (EGFR), ERBB1 phosphotyrosine kinase siRNA
ttcaagcacttacagctctggcc

SEQ ID NO: 9864 - DNA, 23 bp, Artificial Sequence
  epidermal growth factor receptor (EGFR), ERBB1 phosphotyrosine kinase siRNA
tcaagcacttacagctctggcca

SEQ ID NO: 9865 - DNA, 23 bp, Artificial Sequence
  epidermal growth factor receptor (EGFR), ERBB1 phosphotyrosine kinase siRNA
caagcacttacagctctggccac

SEQ ID NO: 9866 - DNA, 23 bp, Artificial Sequence
  epidermal growth factor receptor (EGFR), ERBB1 phosphotyrosine kinase siRNA
aagcacttacagctctggccaca

SEQ ID NO: 9867 - DNA, 23 bp, Artificial Sequence
  epidermal growth factor receptor (EGFR), ERBB1 phosphotyrosine kinase siRNA
agcacttacagctctggccacaa

SEQ ID NO: 9868 - DNA, 23 bp, Artificial Sequence
  epidermal growth factor receptor (EGFR), ERBB1 phosphotyrosine kinase siRNA
gcacttacagctctggccacaac

SEQ ID NO: 9869 - DNA, 23 bp, Artificial Sequence
  epidermal growth factor receptor (EGFR), ERBB1 phosphotyrosine kinase siRNA
cacttacagctctggccacaaca

SEQ ID NO: 9870 - DNA, 23 bp, Artificial Sequence
  epidermal growth factor receptor (EGFR), ERBB1 phosphotyrosine kinase siRNA
acttacagctctggccacaacag

SEQ ID NO: 9871 - DNA, 23 bp, Artificial Sequence
  epidermal growth factor receptor (EGFR), ERBB1 phosphotyrosine kinase siRNA
cttacagctctggccacaacagg

SEQ ID NO: 9872 - DNA, 23 bp, Artificial Sequence
  epidermal growth factor receptor (EGFR), ERBB1 phosphotyrosine kinase siRNA
ttacagctctggccacaacaggg

SEQ ID NO: 9873 - DNA, 23 bp, Artificial Sequence
  epidermal growth factor receptor (EGFR), ERBB1 phosphotyrosine kinase siRNA
tacagctctggccacaacagggc

SEQ ID NO: 9874 - DNA, 23 bp, Artificial Sequence
  epidermal growth factor receptor (EGFR), ERBB1 phosphotyrosine kinase siRNA
acagctctggccacaacagggca

SEQ ID NO: 9875 - DNA, 23 bp, Artificial Sequence
  epidermal growth factor receptor (EGFR), ERBB1 phosphotyrosine kinase siRNA
cagctctggccacaacagggcat

SEQ ID NO: 9876 - DNA, 23 bp, Artificial Sequence
  epidermal growth factor receptor (EGFR), ERBB1 phosphotyrosine kinase siRNA
agctctggccacaacagggcatt

SEQ ID NO: 9877 - DNA, 23 bp, Artificial Sequence
  epidermal growth factor receptor (EGFR), ERBB1 phosphotyrosine kinase siRNA
gctctggccacaacagggcattt

SEQ ID NO: 9878 - DNA, 23 bp, Artificial Sequence
  epidermal growth factor receptor (EGFR), ERBB1 phosphotyrosine kinase siRNA
ctctggccacaacagggcatttt

SEQ ID NO: 9879 - DNA, 23 bp, Artificial Sequence
  epidermal growth factor receptor (EGFR), ERBB1 phosphotyrosine kinase siRNA
tctggccacaacagggcatttta

SEQ ID NO: 9880 - DNA, 23 bp, Artificial Sequence
  epidermal growth factor receptor (EGFR), ERBB1 phosphotyrosine kinase siRNA
ctggccacaacagggcattttac

SEQ ID NO: 9881 - DNA, 23 bp, Artificial Sequence
  epidermal growth factor receptor (EGFR), ERBB1 phosphotyrosine kinase siRNA
tggccacaacagggcattttaca

SEQ ID NO: 9882 - DNA, 23 bp, Artificial Sequence
  epidermal growth factor receptor (EGFR), ERBB1 phosphotyrosine kinase siRNA
ggccacaacagggcattttacag

SEQ ID NO: 9883 - DNA, 23 bp, Artificial Sequence
  epidermal growth factor receptor (EGFR), ERBB1 phosphotyrosine kinase siRNA
gccacaacagggcattttacagg

SEQ ID NO: 9884 - DNA, 23 bp, Artificial Sequence
  epidermal growth factor receptor (EGFR), ERBB1 phosphotyrosine kinase siRNA
ccacaacagggcattttacaggt

SEQ ID NO: 9885 - DNA, 23 bp, Artificial Sequence
  epidermal growth factor receptor (EGFR), ERBB1 phosphotyrosine kinase siRNA
cacaacagggcattttacaggtg

SEQ ID NO: 9886 - DNA, 23 bp, Artificial Sequence
  epidermal growth factor receptor (EGFR), ERBB1 phosphotyrosine kinase siRNA
acaacagggcattttacaggtgc

SEQ ID NO: 9887 - DNA, 23 bp, Artificial Sequence
  epidermal growth factor receptor (EGFR), ERBB1 phosphotyrosine kinase siRNA
caacagggcattttacaggtgcg

SEQ ID NO: 9888 - DNA, 23 bp, Artificial Sequence
  epidermal growth factor receptor (EGFR), ERBB1 phosphotyrosine kinase siRNA
aacagggcattttacaggtgcga

SEQ ID NO: 9889 - DNA, 23 bp, Artificial Sequence
  epidermal growth factor receptor (EGFR), ERBB1 phosphotyrosine kinase siRNA
acagggcattttacaggtgcgaa

SEQ ID NO: 9890 - DNA, 23 bp, Artificial Sequence
  epidermal growth factor receptor (EGFR), ERBB1 phosphotyrosine kinase siRNA
cagggcattttacaggtgcgaat

SEQ ID NO: 9891 - DNA, 23 bp, Artificial Sequence
  epidermal growth factor receptor (EGFR), ERBB1 phosphotyrosine kinase siRNA
agggcattttacaggtgcgaatg

SEQ ID NO: 9892 - DNA, 23 bp, Artificial Sequence
  epidermal growth factor receptor (EGFR), ERBB1 phosphotyrosine kinase siRNA
gggcattttacaggtgcgaatga

SEQ ID NO: 9893 - DNA, 23 bp, Artificial Sequence
  epidermal growth factor receptor (EGFR), ERBB1 phosphotyrosine kinase siRNA
ggcattttacaggtgcgaatgac

SEQ ID NO: 9894 - DNA, 23 bp, Artificial Sequence
  epidermal growth factor receptor (EGFR), ERBB1 phosphotyrosine kinase siRNA
gcattttacaggtgcgaatgaca

SEQ ID NO: 9895 - DNA, 23 bp, Artificial Sequence
  epidermal growth factor receptor (EGFR), ERBB1 phosphotyrosine kinase siRNA
cattttacaggtgcgaatgacag

SEQ ID NO: 9896 - DNA, 23 bp, Artificial Sequence
  epidermal growth factor receptor (EGFR), ERBB1 phosphotyrosine kinase siRNA
attttacaggtgcgaatgacagt

SEQ ID NO: 9897 - DNA, 23 bp, Artificial Sequence
  epidermal growth factor receptor (EGFR), ERBB1 phosphotyrosine kinase siRNA
ttttacaggtgcgaatgacagta

SEQ ID NO: 9898 - DNA, 23 bp, Artificial Sequence
  epidermal growth factor receptor (EGFR), ERBB1 phosphotyrosine kinase siRNA
tttacaggtgcgaatgacagtag

SEQ ID NO: 9899 - DNA, 23 bp, Artificial Sequence
  epidermal growth factor receptor (EGFR), ERBB1 phosphotyrosine kinase siRNA
ttacaggtgcgaatgacagtagc

SEQ ID NO: 9900 - DNA, 23 bp, Artificial Sequence
  epidermal growth factor receptor (EGFR), ERBB1 phosphotyrosine kinase siRNA
tacaggtgcgaatgacagtagca

SEQ ID NO: 9901 - DNA, 23 bp, Artificial Sequence
  epidermal growth factor receptor (EGFR), ERBB1 phosphotyrosine kinase siRNA
acaggtgcgaatgacagtagcat

SEQ ID NO: 9902 - DNA, 23 bp, Artificial Sequence
  epidermal growth factor receptor (EGFR), ERBB1 phosphotyrosine kinase siRNA
caggtgcgaatgacagtagcatt

SEQ ID NO: 9903 - DNA, 23 bp, Artificial Sequence
  epidermal growth factor receptor (EGFR), ERBB1 phosphotyrosine kinase siRNA
aggtgcgaatgacagtagcatta

SEQ ID NO: 9904 - DNA, 23 bp, Artificial Sequence
  epidermal growth factor receptor (EGFR), ERBB1 phosphotyrosine kinase siRNA
ggtgcgaatgacagtagcattat

SEQ ID NO: 9905 - DNA, 23 bp, Artificial Sequence
  epidermal growth factor receptor (EGFR), ERBB1 phosphotyrosine kinase siRNA
gtgcgaatgacagtagcattatg

SEQ ID NO: 9906 - DNA, 23 bp, Artificial Sequence
  epidermal growth factor receptor (EGFR), ERBB1 phosphotyrosine kinase siRNA
tgcgaatgacagtagcattatga

SEQ ID NO: 9907 - DNA, 23 bp, Artificial Sequence
  epidermal growth factor receptor (EGFR), ERBB1 phosphotyrosine kinase siRNA
gcgaatgacagtagcattatgag

SEQ ID NO: 9908 - DNA, 23 bp, Artificial Sequence
  epidermal growth factor receptor (EGFR), ERBB1 phosphotyrosine kinase siRNA
cgaatgacagtagcattatgagt

SEQ ID NO: 9909 - DNA, 23 bp, Artificial Sequence
  epidermal growth factor receptor (EGFR), ERBB1 phosphotyrosine kinase siRNA
gaatgacagtagcattatgagta

SEQ ID NO: 9910 - DNA, 23 bp, Artificial Sequence
  epidermal growth factor receptor (EGFR), ERBB1 phosphotyrosine kinase siRNA
aatgacagtagcattatgagtag

SEQ ID NO: 9911 - DNA, 23 bp, Artificial Sequence
  epidermal growth factor receptor (EGFR), ERBB1 phosphotyrosine kinase siRNA
atgacagtagcattatgagtagt

SEQ ID NO: 9912 - DNA, 23 bp, Artificial Sequence
  epidermal growth factor receptor (EGFR), ERBB1 phosphotyrosine kinase siRNA
tgacagtagcattatgagtagtg

SEQ ID NO: 9913 - DNA, 23 bp, Artificial Sequence
  epidermal growth factor receptor (EGFR), ERBB1 phosphotyrosine kinase siRNA
gacagtagcattatgagtagtgt

SEQ ID NO: 9914 - DNA, 23 bp, Artificial Sequence
  epidermal growth factor receptor (EGFR), ERBB1 phosphotyrosine kinase siRNA
acagtagcattatgagtagtgtg

SEQ ID NO: 9915 - DNA, 23 bp, Artificial Sequence
  epidermal growth factor receptor (EGFR), ERBB1 phosphotyrosine kinase siRNA
cagtagcattatgagtagtgtgg

SEQ ID NO: 9916 - DNA, 23 bp, Artificial Sequence
  epidermal growth factor receptor (EGFR), ERBB1 phosphotyrosine kinase siRNA
agtagcattatgagtagtgtgga

SEQ ID NO: 9917 - DNA, 23 bp, Artificial Sequence
  epidermal growth factor receptor (EGFR), ERBB1 phosphotyrosine kinase siRNA
gtagcattatgagtagtgtggaa

SEQ ID NO: 9918 - DNA, 23 bp, Artificial Sequence
  epidermal growth factor receptor (EGFR), ERBB1 phosphotyrosine kinase siRNA
tagcattatgagtagtgtggaat

SEQ ID NO: 9919 - DNA, 23 bp, Artificial Sequence
  epidermal growth factor receptor (EGFR), ERBB1 phosphotyrosine kinase siRNA
agcattatgagtagtgtggaatt

SEQ ID NO: 9920 - DNA, 23 bp, Artificial Sequence
  epidermal growth factor receptor (EGFR), ERBB1 phosphotyrosine kinase siRNA
gcattatgagtagtgtggaattc

SEQ ID NO: 9921 - DNA, 23 bp, Artificial Sequence
  epidermal growth factor receptor (EGFR), ERBB1 phosphotyrosine kinase siRNA
cattatgagtagtgtggaattca

SEQ ID NO: 9922 - DNA, 23 bp, Artificial Sequence
  epidermal growth factor receptor (EGFR), ERBB1 phosphotyrosine kinase siRNA
attatgagtagtgtggaattcag

SEQ ID NO: 9923 - DNA, 23 bp, Artificial Sequence
  epidermal growth factor receptor (EGFR), ERBB1 phosphotyrosine kinase siRNA
ttatgagtagtgtggaattcagg

SEQ ID NO: 9924 - DNA, 23 bp, Artificial Sequence
  epidermal growth factor receptor (EGFR), ERBB1 phosphotyrosine kinase siRNA
tatgagtagtgtggaattcaggt

SEQ ID NO: 9925 - DNA, 23 bp, Artificial Sequence
  epidermal growth factor receptor (EGFR), ERBB1 phosphotyrosine kinase siRNA
atgagtagtgtggaattcaggta

SEQ ID NO: 9926 - DNA, 23 bp, Artificial Sequence
  epidermal growth factor receptor (EGFR), ERBB1 phosphotyrosine kinase siRNA
tgagtagtgtggaattcaggtag

SEQ ID NO: 9927 - DNA, 23 bp, Artificial Sequence
  epidermal growth factor receptor (EGFR), ERBB1 phosphotyrosine kinase siRNA
gagtagtgtggaattcaggtagt

SEQ ID NO: 9928 - DNA, 23 bp, Artificial Sequence
  epidermal growth factor receptor (EGFR), ERBB1 phosphotyrosine kinase siRNA
agtagtgtggaattcaggtagta

SEQ ID NO: 9929 - DNA, 23 bp, Artificial Sequence
  epidermal growth factor receptor (EGFR), ERBB1 phosphotyrosine kinase siRNA
gtagtgtggaattcaggtagtaa

SEQ ID NO: 9930 - DNA, 23 bp, Artificial Sequence
  epidermal growth factor receptor (EGFR), ERBB1 phosphotyrosine kinase siRNA
tagtgtggaattcaggtagtaaa

SEQ ID NO: 9931 - DNA, 23 bp, Artificial Sequence
  epidermal growth factor receptor (EGFR), ERBB1 phosphotyrosine kinase siRNA
agtgtggaattcaggtagtaaat

SEQ ID NO: 9932 - DNA, 23 bp, Artificial Sequence
  epidermal growth factor receptor (EGFR), ERBB1 phosphotyrosine kinase siRNA
gtgtggaattcaggtagtaaata

SEQ ID NO: 9933 - DNA, 23 bp, Artificial Sequence
  epidermal growth factor receptor (EGFR), ERBB1 phosphotyrosine kinase siRNA
tgtggaattcaggtagtaaatat

SEQ ID NO: 9934 - DNA, 23 bp, Artificial Sequence
  epidermal growth factor receptor (EGFR), ERBB1 phosphotyrosine kinase siRNA
gtggaattcaggtagtaaatatg

SEQ ID NO: 9935 - DNA, 23 bp, Artificial Sequence
  epidermal growth factor receptor (EGFR), ERBB1 phosphotyrosine kinase siRNA
tggaattcaggtagtaaatatga

SEQ ID NO: 9936 - DNA, 23 bp, Artificial Sequence
  epidermal growth factor receptor (EGFR), ERBB1 phosphotyrosine kinase siRNA
ggaattcaggtagtaaatatgaa

SEQ ID NO: 9937 - DNA, 23 bp, Artificial Sequence
  epidermal growth factor receptor (EGFR), ERBB1 phosphotyrosine kinase siRNA
gaattcaggtagtaaatatgaaa

SEQ ID NO: 9938 - DNA, 23 bp, Artificial Sequence
  epidermal growth factor receptor (EGFR), ERBB1 phosphotyrosine kinase siRNA
aattcaggtagtaaatatgaaac

SEQ ID NO: 9939 - DNA, 23 bp, Artificial Sequence
  epidermal growth factor receptor (EGFR), ERBB1 phosphotyrosine kinase siRNA
attcaggtagtaaatatgaaact

SEQ ID NO: 9940 - DNA, 23 bp, Artificial Sequence
  epidermal growth factor receptor (EGFR), ERBB1 phosphotyrosine kinase siRNA
ttcaggtagtaaatatgaaacta

SEQ ID NO: 9941 - DNA, 23 bp, Artificial Sequence
  epidermal growth factor receptor (EGFR), ERBB1 phosphotyrosine kinase siRNA
tcaggtagtaaatatgaaactag

SEQ ID NO: 9942 - DNA, 23 bp, Artificial Sequence
  epidermal growth factor receptor (EGFR), ERBB1 phosphotyrosine kinase siRNA
caggtagtaaatatgaaactagg

SEQ ID NO: 9943 - DNA, 23 bp, Artificial Sequence
  epidermal growth factor receptor (EGFR), ERBB1 phosphotyrosine kinase siRNA
aggtagtaaatatgaaactaggg

SEQ ID NO: 9944 - DNA, 23 bp, Artificial Sequence
  epidermal growth factor receptor (EGFR), ERBB1 phosphotyrosine kinase siRNA
ggtagtaaatatgaaactagggt

SEQ ID NO: 9945 - DNA, 23 bp, Artificial Sequence
  epidermal growth factor receptor (EGFR), ERBB1 phosphotyrosine kinase siRNA
gtagtaaatatgaaactagggtt

SEQ ID NO: 9946 - DNA, 23 bp, Artificial Sequence
  epidermal growth factor receptor (EGFR), ERBB1 phosphotyrosine kinase siRNA
tagtaaatatgaaactagggttt

SEQ ID NO: 9947 - DNA, 23 bp, Artificial Sequence
  epidermal growth factor receptor (EGFR), ERBB1 phosphotyrosine kinase siRNA
agtaaatatgaaactagggtttg

SEQ ID NO: 9948 - DNA, 23 bp, Artificial Sequence
  epidermal growth factor receptor (EGFR), ERBB1 phosphotyrosine kinase siRNA
gtaaatatgaaactagggtttga

SEQ ID NO: 9949 - DNA, 23 bp, Artificial Sequence
  epidermal growth factor receptor (EGFR), ERBB1 phosphotyrosine kinase siRNA
taaatatgaaactagggtttgaa

SEQ ID NO: 9950 - DNA, 23 bp, Artificial Sequence
  epidermal growth factor receptor (EGFR), ERBB1 phosphotyrosine kinase siRNA
aaatatgaaactagggtttgaaa

SEQ ID NO: 9951 - DNA, 23 bp, Artificial Sequence
  epidermal growth factor receptor (EGFR), ERBB1 phosphotyrosine kinase siRNA
aatatgaaactagggtttgaaat

SEQ ID NO: 9952 - DNA, 23 bp, Artificial Sequence
  epidermal growth factor receptor (EGFR), ERBB1 phosphotyrosine kinase siRNA
atatgaaactagggtttgaaatt

SEQ ID NO: 9953 - DNA, 23 bp, Artificial Sequence
  epidermal growth factor receptor (EGFR), ERBB1 phosphotyrosine kinase siRNA
tatgaaactagggtttgaaattg

SEQ ID NO: 9954 - DNA, 23 bp, Artificial Sequence
  epidermal growth factor receptor (EGFR), ERBB1 phosphotyrosine kinase siRNA
atgaaactagggtttgaaattga

SEQ ID NO: 9955 - DNA, 23 bp, Artificial Sequence
  epidermal growth factor receptor (EGFR), ERBB1 phosphotyrosine kinase siRNA
tgaaactagggtttgaaattgat

SEQ ID NO: 9956 - DNA, 23 bp, Artificial Sequence
  epidermal growth factor receptor (EGFR), ERBB1 phosphotyrosine kinase siRNA
gaaactagggtttgaaattgata

SEQ ID NO: 9957 - DNA, 23 bp, Artificial Sequence
  epidermal growth factor receptor (EGFR), ERBB1 phosphotyrosine kinase siRNA
aaactagggtttgaaattgataa

SEQ ID NO: 9958 - DNA, 23 bp, Artificial Sequence
  epidermal growth factor receptor (EGFR), ERBB1 phosphotyrosine kinase siRNA
aactagggtttgaaattgataat

SEQ ID NO: 9959 - DNA, 23 bp, Artificial Sequence
  epidermal growth factor receptor (EGFR), ERBB1 phosphotyrosine kinase siRNA
actagggtttgaaattgataatg

SEQ ID NO: 9960 - DNA, 23 bp, Artificial Sequence
  epidermal growth factor receptor (EGFR), ERBB1 phosphotyrosine kinase siRNA
ctagggtttgaaattgataatgc

SEQ ID NO: 9961 - DNA, 23 bp, Artificial Sequence
  epidermal growth factor receptor (EGFR), ERBB1 phosphotyrosine kinase siRNA
tagggtttgaaattgataatgct

SEQ ID NO: 9962 - DNA, 23 bp, Artificial Sequence
  epidermal growth factor receptor (EGFR), ERBB1 phosphotyrosine kinase siRNA
agggtttgaaattgataatgctt

SEQ ID NO: 9963 - DNA, 23 bp, Artificial Sequence
  epidermal growth factor receptor (EGFR), ERBB1 phosphotyrosine kinase siRNA
gggtttgaaattgataatgcttt

SEQ ID NO: 9964 - DNA, 23 bp, Artificial Sequence
  epidermal growth factor receptor (EGFR), ERBB1 phosphotyrosine kinase siRNA
ggtttgaaattgataatgctttc

SEQ ID NO: 9965 - DNA, 23 bp, Artificial Sequence
  epidermal growth factor receptor (EGFR), ERBB1 phosphotyrosine kinase siRNA
gtttgaaattgataatgctttca

SEQ ID NO: 9966 - DNA, 23 bp, Artificial Sequence
  epidermal growth factor receptor (EGFR), ERBB1 phosphotyrosine kinase siRNA
tttgaaattgataatgctttcac

SEQ ID NO: 9967 - DNA, 23 bp, Artificial Sequence
  epidermal growth factor receptor (EGFR), ERBB1 phosphotyrosine kinase siRNA
ttgaaattgataatgctttcaca

SEQ ID NO: 9968 - DNA, 23 bp, Artificial Sequence
  epidermal growth factor receptor (EGFR), ERBB1 phosphotyrosine kinase siRNA
tgaaattgataatgctttcacaa

SEQ ID NO: 9969 - DNA, 23 bp, Artificial Sequence
  epidermal growth factor receptor (EGFR), ERBB1 phosphotyrosine kinase siRNA
gaaattgataatgctttcacaac

SEQ ID NO: 9970 - DNA, 23 bp, Artificial Sequence
  epidermal growth factor receptor (EGFR), ERBB1 phosphotyrosine kinase siRNA
aaattgataatgctttcacaaca

SEQ ID NO: 9971 - DNA, 23 bp, Artificial Sequence
  epidermal growth factor receptor (EGFR), ERBB1 phosphotyrosine kinase siRNA
aattgataatgctttcacaacat

SEQ ID NO: 9972 - DNA, 23 bp, Artificial Sequence
  epidermal growth factor receptor (EGFR), ERBB1 phosphotyrosine kinase siRNA
attgataatgctttcacaacatt

SEQ ID NO: 9973 - DNA, 23 bp, Artificial Sequence
  epidermal growth factor receptor (EGFR), ERBB1 phosphotyrosine kinase siRNA
ttgataatgctttcacaacattt

SEQ ID NO: 9974 - DNA, 23 bp, Artificial Sequence
  epidermal growth factor receptor (EGFR), ERBB1 phosphotyrosine kinase siRNA
tgataatgctttcacaacatttg

SEQ ID NO: 9975 - DNA, 23 bp, Artificial Sequence
  epidermal growth factor receptor (EGFR), ERBB1 phosphotyrosine kinase siRNA
gataatgctttcacaacatttgc

SEQ ID NO: 9976 - DNA, 23 bp, Artificial Sequence
  epidermal growth factor receptor (EGFR), ERBB1 phosphotyrosine kinase siRNA
ataatgctttcacaacatttgca

SEQ ID NO: 9977 - DNA, 23 bp, Artificial Sequence
  epidermal growth factor receptor (EGFR), ERBB1 phosphotyrosine kinase siRNA
taatgctttcacaacatttgcag

SEQ ID NO: 9978 - DNA, 23 bp, Artificial Sequence
  epidermal growth factor receptor (EGFR), ERBB1 phosphotyrosine kinase siRNA
aatgctttcacaacatttgcaga

SEQ ID NO: 9979 - DNA, 23 bp, Artificial Sequence
  epidermal growth factor receptor (EGFR), ERBB1 phosphotyrosine kinase siRNA
atgctttcacaacatttgcagat

SEQ ID NO: 9980 - DNA, 23 bp, Artificial Sequence
  epidermal growth factor receptor (EGFR), ERBB1 phosphotyrosine kinase siRNA
tgctttcacaacatttgcagatg

SEQ ID NO: 9981 - DNA, 23 bp, Artificial Sequence
  epidermal growth factor receptor (EGFR), ERBB1 phosphotyrosine kinase siRNA
gctttcacaacatttgcagatgt

SEQ ID NO: 9982 - DNA, 23 bp, Artificial Sequence
  epidermal growth factor receptor (EGFR), ERBB1 phosphotyrosine kinase siRNA
ctttcacaacatttgcagatgtt

SEQ ID NO: 9983 - DNA, 23 bp, Artificial Sequence
  epidermal growth factor receptor (EGFR), ERBB1 phosphotyrosine kinase siRNA
tttcacaacatttgcagatgttt

SEQ ID NO: 9984 - DNA, 23 bp, Artificial Sequence
  epidermal growth factor receptor (EGFR), ERBB1 phosphotyrosine kinase siRNA
ttcacaacatttgcagatgtttt

SEQ ID NO: 9985 - DNA, 23 bp, Artificial Sequence
  epidermal growth factor receptor (EGFR), ERBB1 phosphotyrosine kinase siRNA
tcacaacatttgcagatgtttta

SEQ ID NO: 9986 - DNA, 23 bp, Artificial Sequence
  epidermal growth factor receptor (EGFR), ERBB1 phosphotyrosine kinase siRNA
cacaacatttgcagatgttttag

SEQ ID NO: 9987 - DNA, 23 bp, Artificial Sequence
  epidermal growth factor receptor (EGFR), ERBB1 phosphotyrosine kinase siRNA
acaacatttgcagatgttttaga

SEQ ID NO: 9988 - DNA, 23 bp, Artificial Sequence
  epidermal growth factor receptor (EGFR), ERBB1 phosphotyrosine kinase siRNA
caacatttgcagatgttttagaa

SEQ ID NO: 9989 - DNA, 23 bp, Artificial Sequence
  epidermal growth factor receptor (EGFR), ERBB1 phosphotyrosine kinase siRNA
aacatttgcagatgttttagaag

SEQ ID NO: 9990 - DNA, 23 bp, Artificial Sequence
  epidermal growth factor receptor (EGFR), ERBB1 phosphotyrosine kinase siRNA
acatttgcagatgttttagaagg

SEQ ID NO: 9991 - DNA, 23 bp, Artificial Sequence
  epidermal growth factor receptor (EGFR), ERBB1 phosphotyrosine kinase siRNA
catttgcagatgttttagaagga

SEQ ID NO: 9992 - DNA, 23 bp, Artificial Sequence
  epidermal growth factor receptor (EGFR), ERBB1 phosphotyrosine kinase siRNA
atttgcagatgttttagaaggaa

SEQ ID NO: 9993 - DNA, 23 bp, Artificial Sequence
  epidermal growth factor receptor (EGFR), ERBB1 phosphotyrosine kinase siRNA
tttgcagatgttttagaaggaaa

SEQ ID NO: 9994 - DNA, 23 bp, Artificial Sequence
  epidermal growth factor receptor (EGFR), ERBB1 phosphotyrosine kinase siRNA
ttgcagatgttttagaaggaaaa

SEQ ID NO: 9995 - DNA, 23 bp, Artificial Sequence
  epidermal growth factor receptor (EGFR), ERBB1 phosphotyrosine kinase siRNA
tgcagatgttttagaaggaaaaa

SEQ ID NO: 9996 - DNA, 23 bp, Artificial Sequence
  epidermal growth factor receptor (EGFR), ERBB1 phosphotyrosine kinase siRNA
gcagatgttttagaaggaaaaaa

SEQ ID NO: 9997 - DNA, 23 bp, Artificial Sequence
  epidermal growth factor receptor (EGFR), ERBB1 phosphotyrosine kinase siRNA
cagatgttttagaaggaaaaaag

SEQ ID NO: 9998 - DNA, 23 bp, Artificial Sequence
  epidermal growth factor receptor (EGFR), ERBB1 phosphotyrosine kinase siRNA
agatgttttagaaggaaaaaagt

SEQ ID NO: 9999 - DNA, 23 bp, Artificial Sequence
  epidermal growth factor receptor (EGFR), ERBB1 phosphotyrosine kinase siRNA
gatgttttagaaggaaaaaagtt

SEQ ID NO: 10000 - DNA, 23 bp, Artificial Sequence
  epidermal growth factor receptor (EGFR), ERBB1 phosphotyrosine kinase siRNA
atgttttagaaggaaaaaagttc

SEQ ID NO: 10001 - DNA, 23 bp, Artificial Sequence
  epidermal growth factor receptor (EGFR), ERBB1 phosphotyrosine kinase siRNA
tgttttagaaggaaaaaagttcc

SEQ ID NO: 10002 - DNA, 23 bp, Artificial Sequence
  epidermal growth factor receptor (EGFR), ERBB1 phosphotyrosine kinase siRNA
gttttagaaggaaaaaagttcct

SEQ ID NO: 10003 - DNA, 23 bp, Artificial Sequence
  epidermal growth factor receptor (EGFR), ERBB1 phosphotyrosine kinase siRNA
ttttagaaggaaaaaagttcctt

SEQ ID NO: 10004 - DNA, 23 bp, Artificial Sequence
  epidermal growth factor receptor (EGFR), ERBB1 phosphotyrosine kinase siRNA
tttagaaggaaaaaagttccttc

SEQ ID NO: 10005 - DNA, 23 bp, Artificial Sequence
  epidermal growth factor receptor (EGFR), ERBB1 phosphotyrosine kinase siRNA
ttagaaggaaaaaagttccttcc

SEQ ID NO: 10006 - DNA, 23 bp, Artificial Sequence
  epidermal growth factor receptor (EGFR), ERBB1 phosphotyrosine kinase siRNA
tagaaggaaaaaagttccttcct

SEQ ID NO: 10007 - DNA, 23 bp, Artificial Sequence
  epidermal growth factor receptor (EGFR), ERBB1 phosphotyrosine kinase siRNA
agaaggaaaaaagttccttccta

SEQ ID NO: 10008 - DNA, 23 bp, Artificial Sequence
  epidermal growth factor receptor (EGFR), ERBB1 phosphotyrosine kinase siRNA
gaaggaaaaaagttccttcctaa

SEQ ID NO: 10009 - DNA, 23 bp, Artificial Sequence
  epidermal growth factor receptor (EGFR), ERBB1 phosphotyrosine kinase siRNA
aaggaaaaaagttccttcctaaa

SEQ ID NO: 10010 - DNA, 23 bp, Artificial Sequence
  epidermal growth factor receptor (EGFR), ERBB1 phosphotyrosine kinase siRNA
aggaaaaaagttccttcctaaaa

SEQ ID NO: 10011 - DNA, 23 bp, Artificial Sequence
  epidermal growth factor receptor (EGFR), ERBB1 phosphotyrosine kinase siRNA
ggaaaaaagttccttcctaaaat

SEQ ID NO: 10012 - DNA, 23 bp, Artificial Sequence
  epidermal growth factor receptor (EGFR), ERBB1 phosphotyrosine kinase siRNA
gaaaaaagttccttcctaaaata

SEQ ID NO: 10013 - DNA, 23 bp, Artificial Sequence
  epidermal growth factor receptor (EGFR), ERBB1 phosphotyrosine kinase siRNA
aaaaaagttccttcctaaaataa

SEQ ID NO: 10014 - DNA, 23 bp, Artificial Sequence
  epidermal growth factor receptor (EGFR), ERBB1 phosphotyrosine kinase siRNA
aaaaagttccttcctaaaataat

SEQ ID NO: 10015 - DNA, 23 bp, Artificial Sequence
  epidermal growth factor receptor (EGFR), ERBB1 phosphotyrosine kinase siRNA
aaaagttccttcctaaaataatt

SEQ ID NO: 10016 - DNA, 23 bp, Artificial Sequence
  epidermal growth factor receptor (EGFR), ERBB1 phosphotyrosine kinase siRNA
aaagttccttcctaaaataattt

SEQ ID NO: 10017 - DNA, 23 bp, Artificial Sequence
  epidermal growth factor receptor (EGFR), ERBB1 phosphotyrosine kinase siRNA
aagttccttcctaaaataatttc

SEQ ID NO: 10018 - DNA, 23 bp, Artificial Sequence
  epidermal growth factor receptor (EGFR), ERBB1 phosphotyrosine kinase siRNA
agttccttcctaaaataatttct

SEQ ID NO: 10019 - DNA, 23 bp, Artificial Sequence
  epidermal growth factor receptor (EGFR), ERBB1 phosphotyrosine kinase siRNA
gttccttcctaaaataatttctc

SEQ ID NO: 10020 - DNA, 23 bp, Artificial Sequence
  epidermal growth factor receptor (EGFR), ERBB1 phosphotyrosine kinase siRNA
ttccttcctaaaataatttctct

SEQ ID NO: 10021 - DNA, 23 bp, Artificial Sequence
  epidermal growth factor receptor (EGFR), ERBB1 phosphotyrosine kinase siRNA
tccttcctaaaataatttctcta

SEQ ID NO: 10022 - DNA, 23 bp, Artificial Sequence
  epidermal growth factor receptor (EGFR), ERBB1 phosphotyrosine kinase siRNA
ccttcctaaaataatttctctac

SEQ ID NO: 10023 - DNA, 23 bp, Artificial Sequence
  epidermal growth factor receptor (EGFR), ERBB1 phosphotyrosine kinase siRNA
cttcctaaaataatttctctaca

SEQ ID NO: 10024 - DNA, 23 bp, Artificial Sequence
  epidermal growth factor receptor (EGFR), ERBB1 phosphotyrosine kinase siRNA
ttcctaaaataatttctctacaa

SEQ ID NO: 10025 - DNA, 23 bp, Artificial Sequence
  epidermal growth factor receptor (EGFR), ERBB1 phosphotyrosine kinase siRNA
tcctaaaataatttctctacaat

SEQ ID NO: 10026 - DNA, 23 bp, Artificial Sequence
  epidermal growth factor receptor (EGFR), ERBB1 phosphotyrosine kinase siRNA
cctaaaataatttctctacaatt

SEQ ID NO: 10027 - DNA, 23 bp, Artificial Sequence
  epidermal growth factor receptor (EGFR), ERBB1 phosphotyrosine kinase siRNA
ctaaaataatttctctacaattg

SEQ ID NO: 10028 - DNA, 23 bp, Artificial Sequence
  epidermal growth factor receptor (EGFR), ERBB1 phosphotyrosine kinase siRNA
taaaataatttctctacaattgg

SEQ ID NO: 10029 - DNA, 23 bp, Artificial Sequence
  epidermal growth factor receptor (EGFR), ERBB1 phosphotyrosine kinase siRNA
aaaataatttctctacaattgga

SEQ ID NO: 10030 - DNA, 23 bp, Artificial Sequence
  epidermal growth factor receptor (EGFR), ERBB1 phosphotyrosine kinase siRNA
aaataatttctctacaattggaa

SEQ ID NO: 10031 - DNA, 23 bp, Artificial Sequence
  epidermal growth factor receptor (EGFR), ERBB1 phosphotyrosine kinase siRNA
aataatttctctacaattggaag

SEQ ID NO: 10032 - DNA, 23 bp, Artificial Sequence
  epidermal growth factor receptor (EGFR), ERBB1 phosphotyrosine kinase siRNA
ataatttctctacaattggaaga

SEQ ID NO: 10033 - DNA, 23 bp, Artificial Sequence
  epidermal growth factor receptor (EGFR), ERBB1 phosphotyrosine kinase siRNA
taatttctctacaattggaagat

SEQ ID NO: 10034 - DNA, 23 bp, Artificial Sequence
  epidermal growth factor receptor (EGFR), ERBB1 phosphotyrosine kinase siRNA
aatttctctacaattggaagatt

SEQ ID NO: 10035 - DNA, 23 bp, Artificial Sequence
  epidermal growth factor receptor (EGFR), ERBB1 phosphotyrosine kinase siRNA
atttctctacaattggaagattg

SEQ ID NO: 10036 - DNA, 23 bp, Artificial Sequence
  epidermal growth factor receptor (EGFR), ERBB1 phosphotyrosine kinase siRNA
tttctctacaattggaagattgg

SEQ ID NO: 10037 - DNA, 23 bp, Artificial Sequence
  epidermal growth factor receptor (EGFR), ERBB1 phosphotyrosine kinase siRNA
ttctctacaattggaagattgga

SEQ ID NO: 10038 - DNA, 23 bp, Artificial Sequence
  epidermal growth factor receptor (EGFR), ERBB1 phosphotyrosine kinase siRNA
tctctacaattggaagattggaa

SEQ ID NO: 10039 - DNA, 23 bp, Artificial Sequence
  epidermal growth factor receptor (EGFR), ERBB1 phosphotyrosine kinase siRNA
ctctacaattggaagattggaag

SEQ ID NO: 10040 - DNA, 23 bp, Artificial Sequence
  epidermal growth factor receptor (EGFR), ERBB1 phosphotyrosine kinase siRNA
tctacaattggaagattggaaga

SEQ ID NO: 10041 - DNA, 23 bp, Artificial Sequence
  epidermal growth factor receptor (EGFR), ERBB1 phosphotyrosine kinase siRNA
ctacaattggaagattggaagat

SEQ ID NO: 10042 - DNA, 23 bp, Artificial Sequence
  epidermal growth factor receptor (EGFR), ERBB1 phosphotyrosine kinase siRNA
tacaattggaagattggaagatt

SEQ ID NO: 10043 - DNA, 23 bp, Artificial Sequence
  epidermal growth factor receptor (EGFR), ERBB1 phosphotyrosine kinase siRNA
acaattggaagattggaagattc

SEQ ID NO: 10044 - DNA, 23 bp, Artificial Sequence
  epidermal growth factor receptor (EGFR), ERBB1 phosphotyrosine kinase siRNA
caattggaagattggaagattca

SEQ ID NO: 10045 - DNA, 23 bp, Artificial Sequence
  epidermal growth factor receptor (EGFR), ERBB1 phosphotyrosine kinase siRNA
aattggaagattggaagattcag

SEQ ID NO: 10046 - DNA, 23 bp, Artificial Sequence
  epidermal growth factor receptor (EGFR), ERBB1 phosphotyrosine kinase siRNA
attggaagattggaagattcagc

SEQ ID NO: 10047 - DNA, 23 bp, Artificial Sequence
  epidermal growth factor receptor (EGFR), ERBB1 phosphotyrosine kinase siRNA
ttggaagattggaagattcagct

SEQ ID NO: 10048 - DNA, 23 bp, Artificial Sequence
  epidermal growth factor receptor (EGFR), ERBB1 phosphotyrosine kinase siRNA
tggaagattggaagattcagcta

SEQ ID NO: 10049 - DNA, 23 bp, Artificial Sequence
  epidermal growth factor receptor (EGFR), ERBB1 phosphotyrosine kinase siRNA
ggaagattggaagattcagctag

SEQ ID NO: 10050 - DNA, 23 bp, Artificial Sequence
  epidermal growth factor receptor (EGFR), ERBB1 phosphotyrosine kinase siRNA
gaagattggaagattcagctagt

SEQ ID NO: 10051 - DNA, 23 bp, Artificial Sequence
  epidermal growth factor receptor (EGFR), ERBB1 phosphotyrosine kinase siRNA
aagattggaagattcagctagtt

SEQ ID NO: 10052 - DNA, 23 bp, Artificial Sequence
  epidermal growth factor receptor (EGFR), ERBB1 phosphotyrosine kinase siRNA
agattggaagattcagctagtta

SEQ ID NO: 10053 - DNA, 23 bp, Artificial Sequence
  epidermal growth factor receptor (EGFR), ERBB1 phosphotyrosine kinase siRNA
gattggaagattcagctagttag

SEQ ID NO: 10054 - DNA, 23 bp, Artificial Sequence
  epidermal growth factor receptor (EGFR), ERBB1 phosphotyrosine kinase siRNA
attggaagattcagctagttagg

SEQ ID NO: 10055 - DNA, 23 bp, Artificial Sequence
  epidermal growth factor receptor (EGFR), ERBB1 phosphotyrosine kinase siRNA
ttggaagattcagctagttagga

SEQ ID NO: 10056 - DNA, 23 bp, Artificial Sequence
  epidermal growth factor receptor (EGFR), ERBB1 phosphotyrosine kinase siRNA
tggaagattcagctagttaggag

SEQ ID NO: 10057 - DNA, 23 bp, Artificial Sequence
  epidermal growth factor receptor (EGFR), ERBB1 phosphotyrosine kinase siRNA
ggaagattcagctagttaggagc

SEQ ID NO: 10058 - DNA, 23 bp, Artificial Sequence
  epidermal growth factor receptor (EGFR), ERBB1 phosphotyrosine kinase siRNA
gaagattcagctagttaggagcc

SEQ ID NO: 10059 - DNA, 23 bp, Artificial Sequence
  epidermal growth factor receptor (EGFR), ERBB1 phosphotyrosine kinase siRNA
aagattcagctagttaggagccc

SEQ ID NO: 10060 - DNA, 23 bp, Artificial Sequence
  epidermal growth factor receptor (EGFR), ERBB1 phosphotyrosine kinase siRNA
agattcagctagttaggagccca

SEQ ID NO: 10061 - DNA, 23 bp, Artificial Sequence
  epidermal growth factor receptor (EGFR), ERBB1 phosphotyrosine kinase siRNA
gattcagctagttaggagcccac

SEQ ID NO: 10062 - DNA, 23 bp, Artificial Sequence
  epidermal growth factor receptor (EGFR), ERBB1 phosphotyrosine kinase siRNA
attcagctagttaggagcccacc

SEQ ID NO: 10063 - DNA, 23 bp, Artificial Sequence
  epidermal growth factor receptor (EGFR), ERBB1 phosphotyrosine kinase siRNA
ttcagctagttaggagcccacct

SEQ ID NO: 10064 - DNA, 23 bp, Artificial Sequence
  epidermal growth factor receptor (EGFR), ERBB1 phosphotyrosine kinase siRNA
tcagctagttaggagcccacctt

SEQ ID NO: 10065 - DNA, 23 bp, Artificial Sequence
  epidermal growth factor receptor (EGFR), ERBB1 phosphotyrosine kinase siRNA
cagctagttaggagcccaccttt

SEQ ID NO: 10066 - DNA, 23 bp, Artificial Sequence
  epidermal growth factor receptor (EGFR), ERBB1 phosphotyrosine kinase siRNA
agctagttaggagcccacctttt

SEQ ID NO: 10067 - DNA, 23 bp, Artificial Sequence
  epidermal growth factor receptor (EGFR), ERBB1 phosphotyrosine kinase siRNA
gctagttaggagcccaccttttt

SEQ ID NO: 10068 - DNA, 23 bp, Artificial Sequence
  epidermal growth factor receptor (EGFR), ERBB1 phosphotyrosine kinase siRNA
ctagttaggagcccacctttttt

SEQ ID NO: 10069 - DNA, 23 bp, Artificial Sequence
  epidermal growth factor receptor (EGFR), ERBB1 phosphotyrosine kinase siRNA
tagttaggagcccaccttttttc

SEQ ID NO: 10070 - DNA, 23 bp, Artificial Sequence
  epidermal growth factor receptor (EGFR), ERBB1 phosphotyrosine kinase siRNA
agttaggagcccaccttttttcc

SEQ ID NO: 10071 - DNA, 23 bp, Artificial Sequence
  epidermal growth factor receptor (EGFR), ERBB1 phosphotyrosine kinase siRNA
gttaggagcccaccttttttcct

SEQ ID NO: 10072 - DNA, 23 bp, Artificial Sequence
  epidermal growth factor receptor (EGFR), ERBB1 phosphotyrosine kinase siRNA
ttaggagcccaccttttttccta

SEQ ID NO: 10073 - DNA, 23 bp, Artificial Sequence
  epidermal growth factor receptor (EGFR), ERBB1 phosphotyrosine kinase siRNA
taggagcccaccttttttcctaa

SEQ ID NO: 10074 - DNA, 23 bp, Artificial Sequence
  epidermal growth factor receptor (EGFR), ERBB1 phosphotyrosine kinase siRNA
aggagcccaccttttttcctaat

SEQ ID NO: 10075 - DNA, 23 bp, Artificial Sequence
  epidermal growth factor receptor (EGFR), ERBB1 phosphotyrosine kinase siRNA
ggagcccaccttttttcctaatc

SEQ ID NO: 10076 - DNA, 23 bp, Artificial Sequence
  epidermal growth factor receptor (EGFR), ERBB1 phosphotyrosine kinase siRNA
gagcccaccttttttcctaatct

SEQ ID NO: 10077 - DNA, 23 bp, Artificial Sequence
  epidermal growth factor receptor (EGFR), ERBB1 phosphotyrosine kinase siRNA
agcccaccttttttcctaatctg

SEQ ID NO: 10078 - DNA, 23 bp, Artificial Sequence
  epidermal growth factor receptor (EGFR), ERBB1 phosphotyrosine kinase siRNA
gcccaccttttttcctaatctgt

SEQ ID NO: 10079 - DNA, 23 bp, Artificial Sequence
  epidermal growth factor receptor (EGFR), ERBB1 phosphotyrosine kinase siRNA
cccaccttttttcctaatctgtg

SEQ ID NO: 10080 - DNA, 23 bp, Artificial Sequence
  epidermal growth factor receptor (EGFR), ERBB1 phosphotyrosine kinase siRNA
ccaccttttttcctaatctgtgt

SEQ ID NO: 10081 - DNA, 23 bp, Artificial Sequence
  epidermal growth factor receptor (EGFR), ERBB1 phosphotyrosine kinase siRNA
caccttttttcctaatctgtgtg

SEQ ID NO: 10082 - DNA, 23 bp, Artificial Sequence
  epidermal growth factor receptor (EGFR), ERBB1 phosphotyrosine kinase siRNA
accttttttcctaatctgtgtgt

SEQ ID NO: 10083 - DNA, 23 bp, Artificial Sequence
  epidermal growth factor receptor (EGFR), ERBB1 phosphotyrosine kinase siRNA
ccttttttcctaatctgtgtgtg

SEQ ID NO: 10084 - DNA, 23 bp, Artificial Sequence
  epidermal growth factor receptor (EGFR), ERBB1 phosphotyrosine kinase siRNA
cttttttcctaatctgtgtgtgc

SEQ ID NO: 10085 - DNA, 23 bp, Artificial Sequence
  epidermal growth factor receptor (EGFR), ERBB1 phosphotyrosine kinase siRNA
ttttttcctaatctgtgtgtgcc

SEQ ID NO: 10086 - DNA, 23 bp, Artificial Sequence
  epidermal growth factor receptor (EGFR), ERBB1 phosphotyrosine kinase siRNA
tttttcctaatctgtgtgtgccc

SEQ ID NO: 10087 - DNA, 23 bp, Artificial Sequence
  epidermal growth factor receptor (EGFR), ERBB1 phosphotyrosine kinase siRNA
ttttcctaatctgtgtgtgccct

SEQ ID NO: 10088 - DNA, 23 bp, Artificial Sequence
  epidermal growth factor receptor (EGFR), ERBB1 phosphotyrosine kinase siRNA
tttcctaatctgtgtgtgccctg

SEQ ID NO: 10089 - DNA, 23 bp, Artificial Sequence
  epidermal growth factor receptor (EGFR), ERBB1 phosphotyrosine kinase siRNA
ttcctaatctgtgtgtgccctgt

SEQ ID NO: 10090 - DNA, 23 bp, Artificial Sequence
  epidermal growth factor receptor (EGFR), ERBB1 phosphotyrosine kinase siRNA
tcctaatctgtgtgtgccctgta

SEQ ID NO: 10091 - DNA, 23 bp, Artificial Sequence
  epidermal growth factor receptor (EGFR), ERBB1 phosphotyrosine kinase siRNA
cctaatctgtgtgtgccctgtaa

SEQ ID NO: 10092 - DNA, 23 bp, Artificial Sequence
  epidermal growth factor receptor (EGFR), ERBB1 phosphotyrosine kinase siRNA
ctaatctgtgtgtgccctgtaac

SEQ ID NO: 10093 - DNA, 23 bp, Artificial Sequence
  epidermal growth factor receptor (EGFR), ERBB1 phosphotyrosine kinase siRNA
taatctgtgtgtgccctgtaacc

SEQ ID NO: 10094 - DNA, 23 bp, Artificial Sequence
  epidermal growth factor receptor (EGFR), ERBB1 phosphotyrosine kinase siRNA
aatctgtgtgtgccctgtaacct

SEQ ID NO: 10095 - DNA, 23 bp, Artificial Sequence
  epidermal growth factor receptor (EGFR), ERBB1 phosphotyrosine kinase siRNA
atctgtgtgtgccctgtaacctg

SEQ ID NO: 10096 - DNA, 23 bp, Artificial Sequence
  epidermal growth factor receptor (EGFR), ERBB1 phosphotyrosine kinase siRNA
tctgtgtgtgccctgtaacctga

SEQ ID NO: 10097 - DNA, 23 bp, Artificial Sequence
  epidermal growth factor receptor (EGFR), ERBB1 phosphotyrosine kinase siRNA
ctgtgtgtgccctgtaacctgac

SEQ ID NO: 10098 - DNA, 23 bp, Artificial Sequence
  epidermal growth factor receptor (EGFR), ERBB1 phosphotyrosine kinase siRNA
tgtgtgtgccctgtaacctgact

SEQ ID NO: 10099 - DNA, 23 bp, Artificial Sequence
  epidermal growth factor receptor (EGFR), ERBB1 phosphotyrosine kinase siRNA
gtgtgtgccctgtaacctgactg

SEQ ID NO: 10100 - DNA, 23 bp, Artificial Sequence
  epidermal growth factor receptor (EGFR), ERBB1 phosphotyrosine kinase siRNA
tgtgtgccctgtaacctgactgg

SEQ ID NO: 10101 - DNA, 23 bp, Artificial Sequence
  epidermal growth factor receptor (EGFR), ERBB1 phosphotyrosine kinase siRNA
gtgtgccctgtaacctgactggt

SEQ ID NO: 10102 - DNA, 23 bp, Artificial Sequence
  epidermal growth factor receptor (EGFR), ERBB1 phosphotyrosine kinase siRNA
tgtgccctgtaacctgactggtt

SEQ ID NO: 10103 - DNA, 23 bp, Artificial Sequence
  epidermal growth factor receptor (EGFR), ERBB1 phosphotyrosine kinase siRNA
gtgccctgtaacctgactggtta

SEQ ID NO: 10104 - DNA, 23 bp, Artificial Sequence
  epidermal growth factor receptor (EGFR), ERBB1 phosphotyrosine kinase siRNA
tgccctgtaacctgactggttaa

SEQ ID NO: 10105 - DNA, 23 bp, Artificial Sequence
  epidermal growth factor receptor (EGFR), ERBB1 phosphotyrosine kinase siRNA
gccctgtaacctgactggttaac

SEQ ID NO: 10106 - DNA, 23 bp, Artificial Sequence
  epidermal growth factor receptor (EGFR), ERBB1 phosphotyrosine kinase siRNA
ccctgtaacctgactggttaaca

SEQ ID NO: 10107 - DNA, 23 bp, Artificial Sequence
  epidermal growth factor receptor (EGFR), ERBB1 phosphotyrosine kinase siRNA
cctgtaacctgactggttaacag

SEQ ID NO: 10108 - DNA, 23 bp, Artificial Sequence
  epidermal growth factor receptor (EGFR), ERBB1 phosphotyrosine kinase siRNA
ctgtaacctgactggttaacagc

SEQ ID NO: 10109 - DNA, 23 bp, Artificial Sequence
  epidermal growth factor receptor (EGFR), ERBB1 phosphotyrosine kinase siRNA
tgtaacctgactggttaacagca

SEQ ID NO: 10110 - DNA, 23 bp, Artificial Sequence
  epidermal growth factor receptor (EGFR), ERBB1 phosphotyrosine kinase siRNA
gtaacctgactggttaacagcag

SEQ ID NO: 10111 - DNA, 23 bp, Artificial Sequence
  epidermal growth factor receptor (EGFR), ERBB1 phosphotyrosine kinase siRNA
taacctgactggttaacagcagt

SEQ ID NO: 10112 - DNA, 23 bp, Artificial Sequence
  epidermal growth factor receptor (EGFR), ERBB1 phosphotyrosine kinase siRNA
aacctgactggttaacagcagtc

SEQ ID NO: 10113 - DNA, 23 bp, Artificial Sequence
  epidermal growth factor receptor (EGFR), ERBB1 phosphotyrosine kinase siRNA
acctgactggttaacagcagtcc

SEQ ID NO: 10114 - DNA, 23 bp, Artificial Sequence
  epidermal growth factor receptor (EGFR), ERBB1 phosphotyrosine kinase siRNA
cctgactggttaacagcagtcct

SEQ ID NO: 10115 - DNA, 23 bp, Artificial Sequence
  epidermal growth factor receptor (EGFR), ERBB1 phosphotyrosine kinase siRNA
ctgactggttaacagcagtcctt

SEQ ID NO: 10116 - DNA, 23 bp, Artificial Sequence
  epidermal growth factor receptor (EGFR), ERBB1 phosphotyrosine kinase siRNA
tgactggttaacagcagtccttt

SEQ ID NO: 10117 - DNA, 23 bp, Artificial Sequence
  epidermal growth factor receptor (EGFR), ERBB1 phosphotyrosine kinase siRNA
gactggttaacagcagtcctttg

SEQ ID NO: 10118 - DNA, 23 bp, Artificial Sequence
  epidermal growth factor receptor (EGFR), ERBB1 phosphotyrosine kinase siRNA
actggttaacagcagtcctttgt

SEQ ID NO: 10119 - DNA, 23 bp, Artificial Sequence
  epidermal growth factor receptor (EGFR), ERBB1 phosphotyrosine kinase siRNA
ctggttaacagcagtcctttgta

SEQ ID NO: 10120 - DNA, 23 bp, Artificial Sequence
  epidermal growth factor receptor (EGFR), ERBB1 phosphotyrosine kinase siRNA
tggttaacagcagtcctttgtaa

SEQ ID NO: 10121 - DNA, 23 bp, Artificial Sequence
  epidermal growth factor receptor (EGFR), ERBB1 phosphotyrosine kinase siRNA
ggttaacagcagtcctttgtaaa

SEQ ID NO: 10122 - DNA, 23 bp, Artificial Sequence
  epidermal growth factor receptor (EGFR), ERBB1 phosphotyrosine kinase siRNA
gttaacagcagtcctttgtaaac

SEQ ID NO: 10123 - DNA, 23 bp, Artificial Sequence
  epidermal growth factor receptor (EGFR), ERBB1 phosphotyrosine kinase siRNA
ttaacagcagtcctttgtaaaca

SEQ ID NO: 10124 - DNA, 23 bp, Artificial Sequence
  epidermal growth factor receptor (EGFR), ERBB1 phosphotyrosine kinase siRNA
taacagcagtcctttgtaaacag

SEQ ID NO: 10125 - DNA, 23 bp, Artificial Sequence
  epidermal growth factor receptor (EGFR), ERBB1 phosphotyrosine kinase siRNA
aacagcagtcctttgtaaacagt

SEQ ID NO: 10126 - DNA, 23 bp, Artificial Sequence
  epidermal growth factor receptor (EGFR), ERBB1 phosphotyrosine kinase siRNA
acagcagtcctttgtaaacagtg

SEQ ID NO: 10127 - DNA, 23 bp, Artificial Sequence
  epidermal growth factor receptor (EGFR), ERBB1 phosphotyrosine kinase siRNA
cagcagtcctttgtaaacagtgt

SEQ ID NO: 10128 - DNA, 23 bp, Artificial Sequence
  epidermal growth factor receptor (EGFR), ERBB1 phosphotyrosine kinase siRNA
agcagtcctttgtaaacagtgtt

SEQ ID NO: 10129 - DNA, 23 bp, Artificial Sequence
  epidermal growth factor receptor (EGFR), ERBB1 phosphotyrosine kinase siRNA
gcagtcctttgtaaacagtgttt

SEQ ID NO: 10130 - DNA, 23 bp, Artificial Sequence
  epidermal growth factor receptor (EGFR), ERBB1 phosphotyrosine kinase siRNA
cagtcctttgtaaacagtgtttt

SEQ ID NO: 10131 - DNA, 23 bp, Artificial Sequence
  epidermal growth factor receptor (EGFR), ERBB1 phosphotyrosine kinase siRNA
agtcctttgtaaacagtgtttta

SEQ ID NO: 10132 - DNA, 23 bp, Artificial Sequence
  epidermal growth factor receptor (EGFR), ERBB1 phosphotyrosine kinase siRNA
gtcctttgtaaacagtgttttaa

SEQ ID NO: 10133 - DNA, 23 bp, Artificial Sequence
  epidermal growth factor receptor (EGFR), ERBB1 phosphotyrosine kinase siRNA
tcctttgtaaacagtgttttaaa

SEQ ID NO: 10134 - DNA, 23 bp, Artificial Sequence
  epidermal growth factor receptor (EGFR), ERBB1 phosphotyrosine kinase siRNA
cctttgtaaacagtgttttaaac

SEQ ID NO: 10135 - DNA, 23 bp, Artificial Sequence
  epidermal growth factor receptor (EGFR), ERBB1 phosphotyrosine kinase siRNA
ctttgtaaacagtgttttaaact

SEQ ID NO: 10136 - DNA, 23 bp, Artificial Sequence
  epidermal growth factor receptor (EGFR), ERBB1 phosphotyrosine kinase siRNA
tttgtaaacagtgttttaaactc

SEQ ID NO: 10137 - DNA, 23 bp, Artificial Sequence
  epidermal growth factor receptor (EGFR), ERBB1 phosphotyrosine kinase siRNA
ttgtaaacagtgttttaaactct

SEQ ID NO: 10138 - DNA, 23 bp, Artificial Sequence
  epidermal growth factor receptor (EGFR), ERBB1 phosphotyrosine kinase siRNA
tgtaaacagtgttttaaactctc

SEQ ID NO: 10139 - DNA, 23 bp, Artificial Sequence
  epidermal growth factor receptor (EGFR), ERBB1 phosphotyrosine kinase siRNA
gtaaacagtgttttaaactctcc

SEQ ID NO: 10140 - DNA, 23 bp, Artificial Sequence
  epidermal growth factor receptor (EGFR), ERBB1 phosphotyrosine kinase siRNA
taaacagtgttttaaactctcct

SEQ ID NO: 10141 - DNA, 23 bp, Artificial Sequence
  epidermal growth factor receptor (EGFR), ERBB1 phosphotyrosine kinase siRNA
aaacagtgttttaaactctccta

SEQ ID NO: 10142 - DNA, 23 bp, Artificial Sequence
  epidermal growth factor receptor (EGFR), ERBB1 phosphotyrosine kinase siRNA
aacagtgttttaaactctcctag

SEQ ID NO: 10143 - DNA, 23 bp, Artificial Sequence
  epidermal growth factor receptor (EGFR), ERBB1 phosphotyrosine kinase siRNA
acagtgttttaaactctcctagt

SEQ ID NO: 10144 - DNA, 23 bp, Artificial Sequence
  epidermal growth factor receptor (EGFR), ERBB1 phosphotyrosine kinase siRNA
cagtgttttaaactctcctagtc

SEQ ID NO: 10145 - DNA, 23 bp, Artificial Sequence
  epidermal growth factor receptor (EGFR), ERBB1 phosphotyrosine kinase siRNA
agtgttttaaactctcctagtca

SEQ ID NO: 10146 - DNA, 23 bp, Artificial Sequence
  epidermal growth factor receptor (EGFR), ERBB1 phosphotyrosine kinase siRNA
gtgttttaaactctcctagtcaa

SEQ ID NO: 10147 - DNA, 23 bp, Artificial Sequence
  epidermal growth factor receptor (EGFR), ERBB1 phosphotyrosine kinase siRNA
tgttttaaactctcctagtcaat

SEQ ID NO: 10148 - DNA, 23 bp, Artificial Sequence
  epidermal growth factor receptor (EGFR), ERBB1 phosphotyrosine kinase siRNA
gttttaaactctcctagtcaata

SEQ ID NO: 10149 - DNA, 23 bp, Artificial Sequence
  epidermal growth factor receptor (EGFR), ERBB1 phosphotyrosine kinase siRNA
ttttaaactctcctagtcaatat

SEQ ID NO: 10150 - DNA, 23 bp, Artificial Sequence
  epidermal growth factor receptor (EGFR), ERBB1 phosphotyrosine kinase siRNA
tttaaactctcctagtcaatatc

SEQ ID NO: 10151 - DNA, 23 bp, Artificial Sequence
  epidermal growth factor receptor (EGFR), ERBB1 phosphotyrosine kinase siRNA
ttaaactctcctagtcaatatcc

SEQ ID NO: 10152 - DNA, 23 bp, Artificial Sequence
  epidermal growth factor receptor (EGFR), ERBB1 phosphotyrosine kinase siRNA
taaactctcctagtcaatatcca

SEQ ID NO: 10153 - DNA, 23 bp, Artificial Sequence
  epidermal growth factor receptor (EGFR), ERBB1 phosphotyrosine kinase siRNA
aaactctcctagtcaatatccac

SEQ ID NO: 10154 - DNA, 23 bp, Artificial Sequence
  epidermal growth factor receptor (EGFR), ERBB1 phosphotyrosine kinase siRNA
aactctcctagtcaatatccacc

SEQ ID NO: 10155 - DNA, 23 bp, Artificial Sequence
  epidermal growth factor receptor (EGFR), ERBB1 phosphotyrosine kinase siRNA
actctcctagtcaatatccaccc

SEQ ID NO: 10156 - DNA, 23 bp, Artificial Sequence
  epidermal growth factor receptor (EGFR), ERBB1 phosphotyrosine kinase siRNA
ctctcctagtcaatatccacccc

SEQ ID NO: 10157 - DNA, 23 bp, Artificial Sequence
  epidermal growth factor receptor (EGFR), ERBB1 phosphotyrosine kinase siRNA
tctcctagtcaatatccacccca

SEQ ID NO: 10158 - DNA, 23 bp, Artificial Sequence
  epidermal growth factor receptor (EGFR), ERBB1 phosphotyrosine kinase siRNA
ctcctagtcaatatccaccccat

SEQ ID NO: 10159 - DNA, 23 bp, Artificial Sequence
  epidermal growth factor receptor (EGFR), ERBB1 phosphotyrosine kinase siRNA
tcctagtcaatatccaccccatc

SEQ ID NO: 10160 - DNA, 23 bp, Artificial Sequence
  epidermal growth factor receptor (EGFR), ERBB1 phosphotyrosine kinase siRNA
cctagtcaatatccaccccatcc

SEQ ID NO: 10161 - DNA, 23 bp, Artificial Sequence
  epidermal growth factor receptor (EGFR), ERBB1 phosphotyrosine kinase siRNA
ctagtcaatatccaccccatcca

SEQ ID NO: 10162 - DNA, 23 bp, Artificial Sequence
  epidermal growth factor receptor (EGFR), ERBB1 phosphotyrosine kinase siRNA
tagtcaatatccaccccatccaa

SEQ ID NO: 10163 - DNA, 23 bp, Artificial Sequence
  epidermal growth factor receptor (EGFR), ERBB1 phosphotyrosine kinase siRNA
agtcaatatccaccccatccaat

SEQ ID NO: 10164 - DNA, 23 bp, Artificial Sequence
  epidermal growth factor receptor (EGFR), ERBB1 phosphotyrosine kinase siRNA
gtcaatatccaccccatccaatt

SEQ ID NO: 10165 - DNA, 23 bp, Artificial Sequence
  epidermal growth factor receptor (EGFR), ERBB1 phosphotyrosine kinase siRNA
tcaatatccaccccatccaattt

SEQ ID NO: 10166 - DNA, 23 bp, Artificial Sequence
  epidermal growth factor receptor (EGFR), ERBB1 phosphotyrosine kinase siRNA
caatatccaccccatccaattta

SEQ ID NO: 10167 - DNA, 23 bp, Artificial Sequence
  epidermal growth factor receptor (EGFR), ERBB1 phosphotyrosine kinase siRNA
aatatccaccccatccaatttat

SEQ ID NO: 10168 - DNA, 23 bp, Artificial Sequence
  epidermal growth factor receptor (EGFR), ERBB1 phosphotyrosine kinase siRNA
atatccaccccatccaatttatc

SEQ ID NO: 10169 - DNA, 23 bp, Artificial Sequence
  epidermal growth factor receptor (EGFR), ERBB1 phosphotyrosine kinase siRNA
tatccaccccatccaatttatca

SEQ ID NO: 10170 - DNA, 23 bp, Artificial Sequence
  epidermal growth factor receptor (EGFR), ERBB1 phosphotyrosine kinase siRNA
atccaccccatccaatttatcaa

SEQ ID NO: 10171 - DNA, 23 bp, Artificial Sequence
  epidermal growth factor receptor (EGFR), ERBB1 phosphotyrosine kinase siRNA
tccaccccatccaatttatcaag

SEQ ID NO: 10172 - DNA, 23 bp, Artificial Sequence
  epidermal growth factor receptor (EGFR), ERBB1 phosphotyrosine kinase siRNA
ccaccccatccaatttatcaagg

SEQ ID NO: 10173 - DNA, 23 bp, Artificial Sequence
  epidermal growth factor receptor (EGFR), ERBB1 phosphotyrosine kinase siRNA
caccccatccaatttatcaagga

SEQ ID NO: 10174 - DNA, 23 bp, Artificial Sequence
  epidermal growth factor receptor (EGFR), ERBB1 phosphotyrosine kinase siRNA
accccatccaatttatcaaggaa

SEQ ID NO: 10175 - DNA, 23 bp, Artificial Sequence
  epidermal growth factor receptor (EGFR), ERBB1 phosphotyrosine kinase siRNA
ccccatccaatttatcaaggaag

SEQ ID NO: 10176 - DNA, 23 bp, Artificial Sequence
  epidermal growth factor receptor (EGFR), ERBB1 phosphotyrosine kinase siRNA
cccatccaatttatcaaggaaga

SEQ ID NO: 10177 - DNA, 23 bp, Artificial Sequence
  epidermal growth factor receptor (EGFR), ERBB1 phosphotyrosine kinase siRNA
ccatccaatttatcaaggaagaa

SEQ ID NO: 10178 - DNA, 23 bp, Artificial Sequence
  epidermal growth factor receptor (EGFR), ERBB1 phosphotyrosine kinase siRNA
catccaatttatcaaggaagaaa

SEQ ID NO: 10179 - DNA, 23 bp, Artificial Sequence
  epidermal growth factor receptor (EGFR), ERBB1 phosphotyrosine kinase siRNA
atccaatttatcaaggaagaaat

SEQ ID NO: 10180 - DNA, 23 bp, Artificial Sequence
  epidermal growth factor receptor (EGFR), ERBB1 phosphotyrosine kinase siRNA
tccaatttatcaaggaagaaatg

SEQ ID NO: 10181 - DNA, 23 bp, Artificial Sequence
  epidermal growth factor receptor (EGFR), ERBB1 phosphotyrosine kinase siRNA
ccaatttatcaaggaagaaatgg

SEQ ID NO: 10182 - DNA, 23 bp, Artificial Sequence
  epidermal growth factor receptor (EGFR), ERBB1 phosphotyrosine kinase siRNA
caatttatcaaggaagaaatggt

SEQ ID NO: 10183 - DNA, 23 bp, Artificial Sequence
  epidermal growth factor receptor (EGFR), ERBB1 phosphotyrosine kinase siRNA
aatttatcaaggaagaaatggtt

SEQ ID NO: 10184 - DNA, 23 bp, Artificial Sequence
  epidermal growth factor receptor (EGFR), ERBB1 phosphotyrosine kinase siRNA
atttatcaaggaagaaatggttc

SEQ ID NO: 10185 - DNA, 23 bp, Artificial Sequence
  epidermal growth factor receptor (EGFR), ERBB1 phosphotyrosine kinase siRNA
tttatcaaggaagaaatggttca

SEQ ID NO: 10186 - DNA, 23 bp, Artificial Sequence
  epidermal growth factor receptor (EGFR), ERBB1 phosphotyrosine kinase siRNA
ttatcaaggaagaaatggttcag

SEQ ID NO: 10187 - DNA, 23 bp, Artificial Sequence
  epidermal growth factor receptor (EGFR), ERBB1 phosphotyrosine kinase siRNA
tatcaaggaagaaatggttcaga

SEQ ID NO: 10188 - DNA, 23 bp, Artificial Sequence
  epidermal growth factor receptor (EGFR), ERBB1 phosphotyrosine kinase siRNA
atcaaggaagaaatggttcagaa

SEQ ID NO: 10189 - DNA, 23 bp, Artificial Sequence
  epidermal growth factor receptor (EGFR), ERBB1 phosphotyrosine kinase siRNA
tcaaggaagaaatggttcagaaa

SEQ ID NO: 10190 - DNA, 23 bp, Artificial Sequence
  epidermal growth factor receptor (EGFR), ERBB1 phosphotyrosine kinase siRNA
caaggaagaaatggttcagaaaa

SEQ ID NO: 10191 - DNA, 23 bp, Artificial Sequence
  epidermal growth factor receptor (EGFR), ERBB1 phosphotyrosine kinase siRNA
aaggaagaaatggttcagaaaat

SEQ ID NO: 10192 - DNA, 23 bp, Artificial Sequence
  epidermal growth factor receptor (EGFR), ERBB1 phosphotyrosine kinase siRNA
aggaagaaatggttcagaaaata

SEQ ID NO: 10193 - DNA, 23 bp, Artificial Sequence
  epidermal growth factor receptor (EGFR), ERBB1 phosphotyrosine kinase siRNA
ggaagaaatggttcagaaaatat

SEQ ID NO: 10194 - DNA, 23 bp, Artificial Sequence
  epidermal growth factor receptor (EGFR), ERBB1 phosphotyrosine kinase siRNA
gaagaaatggttcagaaaatatt

SEQ ID NO: 10195 - DNA, 23 bp, Artificial Sequence
  epidermal growth factor receptor (EGFR), ERBB1 phosphotyrosine kinase siRNA
aagaaatggttcagaaaatattt

SEQ ID NO: 10196 - DNA, 23 bp, Artificial Sequence
  epidermal growth factor receptor (EGFR), ERBB1 phosphotyrosine kinase siRNA
agaaatggttcagaaaatatttt

SEQ ID NO: 10197 - DNA, 23 bp, Artificial Sequence
  epidermal growth factor receptor (EGFR), ERBB1 phosphotyrosine kinase siRNA
gaaatggttcagaaaatattttc

SEQ ID NO: 10198 - DNA, 23 bp, Artificial Sequence
  epidermal growth factor receptor (EGFR), ERBB1 phosphotyrosine kinase siRNA
aaatggttcagaaaatattttca

SEQ ID NO: 10199 - DNA, 23 bp, Artificial Sequence
  epidermal growth factor receptor (EGFR), ERBB1 phosphotyrosine kinase siRNA
aatggttcagaaaatattttcag

SEQ ID NO: 10200 - DNA, 23 bp, Artificial Sequence
  epidermal growth factor receptor (EGFR), ERBB1 phosphotyrosine kinase siRNA
atggttcagaaaatattttcagc

SEQ ID NO: 10201 - DNA, 23 bp, Artificial Sequence
  epidermal growth factor receptor (EGFR), ERBB1 phosphotyrosine kinase siRNA
tggttcagaaaatattttcagcc

SEQ ID NO: 10202 - DNA, 23 bp, Artificial Sequence
  epidermal growth factor receptor (EGFR), ERBB1 phosphotyrosine kinase siRNA
ggttcagaaaatattttcagcct

SEQ ID NO: 10203 - DNA, 23 bp, Artificial Sequence
  epidermal growth factor receptor (EGFR), ERBB1 phosphotyrosine kinase siRNA
gttcagaaaatattttcagccta

SEQ ID NO: 10204 - DNA, 23 bp, Artificial Sequence
  epidermal growth factor receptor (EGFR), ERBB1 phosphotyrosine kinase siRNA
ttcagaaaatattttcagcctac

SEQ ID NO: 10205 - DNA, 23 bp, Artificial Sequence
  epidermal growth factor receptor (EGFR), ERBB1 phosphotyrosine kinase siRNA
tcagaaaatattttcagcctaca

SEQ ID NO: 10206 - DNA, 23 bp, Artificial Sequence
  epidermal growth factor receptor (EGFR), ERBB1 phosphotyrosine kinase siRNA
cagaaaatattttcagcctacag

SEQ ID NO: 10207 - DNA, 23 bp, Artificial Sequence
  epidermal growth factor receptor (EGFR), ERBB1 phosphotyrosine kinase siRNA
agaaaatattttcagcctacagt

SEQ ID NO: 10208 - DNA, 23 bp, Artificial Sequence
  epidermal growth factor receptor (EGFR), ERBB1 phosphotyrosine kinase siRNA
gaaaatattttcagcctacagtt

SEQ ID NO: 10209 - DNA, 23 bp, Artificial Sequence
  epidermal growth factor receptor (EGFR), ERBB1 phosphotyrosine kinase siRNA
aaaatattttcagcctacagtta

SEQ ID NO: 10210 - DNA, 23 bp, Artificial Sequence
  epidermal growth factor receptor (EGFR), ERBB1 phosphotyrosine kinase siRNA
aaatattttcagcctacagttat

SEQ ID NO: 10211 - DNA, 23 bp, Artificial Sequence
  epidermal growth factor receptor (EGFR), ERBB1 phosphotyrosine kinase siRNA
aatattttcagcctacagttatg

SEQ ID NO: 10212 - DNA, 23 bp, Artificial Sequence
  epidermal growth factor receptor (EGFR), ERBB1 phosphotyrosine kinase siRNA
atattttcagcctacagttatgt

SEQ ID NO: 10213 - DNA, 23 bp, Artificial Sequence
  epidermal growth factor receptor (EGFR), ERBB1 phosphotyrosine kinase siRNA
tattttcagcctacagttatgtt

SEQ ID NO: 10214 - DNA, 23 bp, Artificial Sequence
  epidermal growth factor receptor (EGFR), ERBB1 phosphotyrosine kinase siRNA
attttcagcctacagttatgttc

SEQ ID NO: 10215 - DNA, 23 bp, Artificial Sequence
  epidermal growth factor receptor (EGFR), ERBB1 phosphotyrosine kinase siRNA
ttttcagcctacagttatgttca

SEQ ID NO: 10216 - DNA, 23 bp, Artificial Sequence
  epidermal growth factor receptor (EGFR), ERBB1 phosphotyrosine kinase siRNA
tttcagcctacagttatgttcag

SEQ ID NO: 10217 - DNA, 23 bp, Artificial Sequence
  epidermal growth factor receptor (EGFR), ERBB1 phosphotyrosine kinase siRNA
ttcagcctacagttatgttcagt

SEQ ID NO: 10218 - DNA, 23 bp, Artificial Sequence
  epidermal growth factor receptor (EGFR), ERBB1 phosphotyrosine kinase siRNA
tcagcctacagttatgttcagtc

SEQ ID NO: 10219 - DNA, 23 bp, Artificial Sequence
  epidermal growth factor receptor (EGFR), ERBB1 phosphotyrosine kinase siRNA
cagcctacagttatgttcagtca

SEQ ID NO: 10220 - DNA, 23 bp, Artificial Sequence
  epidermal growth factor receptor (EGFR), ERBB1 phosphotyrosine kinase siRNA
agcctacagttatgttcagtcac

SEQ ID NO: 10221 - DNA, 23 bp, Artificial Sequence
  epidermal growth factor receptor (EGFR), ERBB1 phosphotyrosine kinase siRNA
gcctacagttatgttcagtcaca

SEQ ID NO: 10222 - DNA, 23 bp, Artificial Sequence
  epidermal growth factor receptor (EGFR), ERBB1 phosphotyrosine kinase siRNA
cctacagttatgttcagtcacac

SEQ ID NO: 10223 - DNA, 23 bp, Artificial Sequence
  epidermal growth factor receptor (EGFR), ERBB1 phosphotyrosine kinase siRNA
ctacagttatgttcagtcacaca

SEQ ID NO: 10224 - DNA, 23 bp, Artificial Sequence
  epidermal growth factor receptor (EGFR), ERBB1 phosphotyrosine kinase siRNA
tacagttatgttcagtcacacac

SEQ ID NO: 10225 - DNA, 23 bp, Artificial Sequence
  epidermal growth factor receptor (EGFR), ERBB1 phosphotyrosine kinase siRNA
acagttatgttcagtcacacaca

SEQ ID NO: 10226 - DNA, 23 bp, Artificial Sequence
  epidermal growth factor receptor (EGFR), ERBB1 phosphotyrosine kinase siRNA
cagttatgttcagtcacacacac

SEQ ID NO: 10227 - DNA, 23 bp, Artificial Sequence
  epidermal growth factor receptor (EGFR), ERBB1 phosphotyrosine kinase siRNA
agttatgttcagtcacacacaca

SEQ ID NO: 10228 - DNA, 23 bp, Artificial Sequence
  epidermal growth factor receptor (EGFR), ERBB1 phosphotyrosine kinase siRNA
gttatgttcagtcacacacacat

SEQ ID NO: 10229 - DNA, 23 bp, Artificial Sequence
  epidermal growth factor receptor (EGFR), ERBB1 phosphotyrosine kinase siRNA
ttatgttcagtcacacacacata

SEQ ID NO: 10230 - DNA, 23 bp, Artificial Sequence
  epidermal growth factor receptor (EGFR), ERBB1 phosphotyrosine kinase siRNA
tatgttcagtcacacacacatac

SEQ ID NO: 10231 - DNA, 23 bp, Artificial Sequence
  epidermal growth factor receptor (EGFR), ERBB1 phosphotyrosine kinase siRNA
atgttcagtcacacacacataca

SEQ ID NO: 10232 - DNA, 23 bp, Artificial Sequence
  epidermal growth factor receptor (EGFR), ERBB1 phosphotyrosine kinase siRNA
tgttcagtcacacacacatacaa

SEQ ID NO: 10233 - DNA, 23 bp, Artificial Sequence
  epidermal growth factor receptor (EGFR), ERBB1 phosphotyrosine kinase siRNA
gttcagtcacacacacatacaaa

SEQ ID NO: 10234 - DNA, 23 bp, Artificial Sequence
  epidermal growth factor receptor (EGFR), ERBB1 phosphotyrosine kinase siRNA
ttcagtcacacacacatacaaaa

SEQ ID NO: 10235 - DNA, 23 bp, Artificial Sequence
  epidermal growth factor receptor (EGFR), ERBB1 phosphotyrosine kinase siRNA
tcagtcacacacacatacaaaat

SEQ ID NO: 10236 - DNA, 23 bp, Artificial Sequence
  epidermal growth factor receptor (EGFR), ERBB1 phosphotyrosine kinase siRNA
cagtcacacacacatacaaaatg

SEQ ID NO: 10237 - DNA, 23 bp, Artificial Sequence
  epidermal growth factor receptor (EGFR), ERBB1 phosphotyrosine kinase siRNA
agtcacacacacatacaaaatgt

SEQ ID NO: 10238 - DNA, 23 bp, Artificial Sequence
  epidermal growth factor receptor (EGFR), ERBB1 phosphotyrosine kinase siRNA
gtcacacacacatacaaaatgtt

SEQ ID NO: 10239 - DNA, 23 bp, Artificial Sequence
  epidermal growth factor receptor (EGFR), ERBB1 phosphotyrosine kinase siRNA
tcacacacacatacaaaatgttc

SEQ ID NO: 10240 - DNA, 23 bp, Artificial Sequence
  epidermal growth factor receptor (EGFR), ERBB1 phosphotyrosine kinase siRNA
cacacacacatacaaaatgttcc

SEQ ID NO: 10241 - DNA, 23 bp, Artificial Sequence
  epidermal growth factor receptor (EGFR), ERBB1 phosphotyrosine kinase siRNA
acacacacatacaaaatgttcct

SEQ ID NO: 10242 - DNA, 23 bp, Artificial Sequence
  epidermal growth factor receptor (EGFR), ERBB1 phosphotyrosine kinase siRNA
cacacacatacaaaatgttcctt

SEQ ID NO: 10243 - DNA, 23 bp, Artificial Sequence
  epidermal growth factor receptor (EGFR), ERBB1 phosphotyrosine kinase siRNA
acacacatacaaaatgttccttt

SEQ ID NO: 10244 - DNA, 23 bp, Artificial Sequence
  epidermal growth factor receptor (EGFR), ERBB1 phosphotyrosine kinase siRNA
cacacatacaaaatgttcctttt

SEQ ID NO: 10245 - DNA, 23 bp, Artificial Sequence
  epidermal growth factor receptor (EGFR), ERBB1 phosphotyrosine kinase siRNA
acacatacaaaatgttccttttg

SEQ ID NO: 10246 - DNA, 23 bp, Artificial Sequence
  epidermal growth factor receptor (EGFR), ERBB1 phosphotyrosine kinase siRNA
cacatacaaaatgttccttttgc

SEQ ID NO: 10247 - DNA, 23 bp, Artificial Sequence
  epidermal growth factor receptor (EGFR), ERBB1 phosphotyrosine kinase siRNA
acatacaaaatgttccttttgct

SEQ ID NO: 10248 - DNA, 23 bp, Artificial Sequence
  epidermal growth factor receptor (EGFR), ERBB1 phosphotyrosine kinase siRNA
catacaaaatgttccttttgctt

SEQ ID NO: 10249 - DNA, 23 bp, Artificial Sequence
  epidermal growth factor receptor (EGFR), ERBB1 phosphotyrosine kinase siRNA
atacaaaatgttccttttgcttt

SEQ ID NO: 10250 - DNA, 23 bp, Artificial Sequence
  epidermal growth factor receptor (EGFR), ERBB1 phosphotyrosine kinase siRNA
tacaaaatgttccttttgctttt

SEQ ID NO: 10251 - DNA, 23 bp, Artificial Sequence
  epidermal growth factor receptor (EGFR), ERBB1 phosphotyrosine kinase siRNA
acaaaatgttccttttgctttta

SEQ ID NO: 10252 - DNA, 23 bp, Artificial Sequence
  epidermal growth factor receptor (EGFR), ERBB1 phosphotyrosine kinase siRNA
caaaatgttccttttgcttttaa

SEQ ID NO: 10253 - DNA, 23 bp, Artificial Sequence
  epidermal growth factor receptor (EGFR), ERBB1 phosphotyrosine kinase siRNA
aaaatgttccttttgcttttaaa

SEQ ID NO: 10254 - DNA, 23 bp, Artificial Sequence
  epidermal growth factor receptor (EGFR), ERBB1 phosphotyrosine kinase siRNA
aaatgttccttttgcttttaaag

SEQ ID NO: 10255 - DNA, 23 bp, Artificial Sequence
  epidermal growth factor receptor (EGFR), ERBB1 phosphotyrosine kinase siRNA
aatgttccttttgcttttaaagt

SEQ ID NO: 10256 - DNA, 23 bp, Artificial Sequence
  epidermal growth factor receptor (EGFR), ERBB1 phosphotyrosine kinase siRNA
atgttccttttgcttttaaagta

SEQ ID NO: 10257 - DNA, 23 bp, Artificial Sequence
  epidermal growth factor receptor (EGFR), ERBB1 phosphotyrosine kinase siRNA
tgttccttttgcttttaaagtaa

SEQ ID NO: 10258 - DNA, 23 bp, Artificial Sequence
  epidermal growth factor receptor (EGFR), ERBB1 phosphotyrosine kinase siRNA
gttccttttgcttttaaagtaat

SEQ ID NO: 10259 - DNA, 23 bp, Artificial Sequence
  epidermal growth factor receptor (EGFR), ERBB1 phosphotyrosine kinase siRNA
ttccttttgcttttaaagtaatt

SEQ ID NO: 10260 - DNA, 23 bp, Artificial Sequence
  epidermal growth factor receptor (EGFR), ERBB1 phosphotyrosine kinase siRNA
tccttttgcttttaaagtaattt

SEQ ID NO: 10261 - DNA, 23 bp, Artificial Sequence
  epidermal growth factor receptor (EGFR), ERBB1 phosphotyrosine kinase siRNA
ccttttgcttttaaagtaatttt

SEQ ID NO: 10262 - DNA, 23 bp, Artificial Sequence
  epidermal growth factor receptor (EGFR), ERBB1 phosphotyrosine kinase siRNA
cttttgcttttaaagtaattttt

SEQ ID NO: 10263 - DNA, 23 bp, Artificial Sequence
  epidermal growth factor receptor (EGFR), ERBB1 phosphotyrosine kinase siRNA
ttttgcttttaaagtaatttttg

SEQ ID NO: 10264 - DNA, 23 bp, Artificial Sequence
  epidermal growth factor receptor (EGFR), ERBB1 phosphotyrosine kinase siRNA
tttgcttttaaagtaatttttga

SEQ ID NO: 10265 - DNA, 23 bp, Artificial Sequence
  epidermal growth factor receptor (EGFR), ERBB1 phosphotyrosine kinase siRNA
ttgcttttaaagtaatttttgac

SEQ ID NO: 10266 - DNA, 23 bp, Artificial Sequence
  epidermal growth factor receptor (EGFR), ERBB1 phosphotyrosine kinase siRNA
tgcttttaaagtaatttttgact

SEQ ID NO: 10267 - DNA, 23 bp, Artificial Sequence
  epidermal growth factor receptor (EGFR), ERBB1 phosphotyrosine kinase siRNA
gcttttaaagtaatttttgactc

SEQ ID NO: 10268 - DNA, 23 bp, Artificial Sequence
  epidermal growth factor receptor (EGFR), ERBB1 phosphotyrosine kinase siRNA
cttttaaagtaatttttgactcc

SEQ ID NO: 10269 - DNA, 23 bp, Artificial Sequence
  epidermal growth factor receptor (EGFR), ERBB1 phosphotyrosine kinase siRNA
ttttaaagtaatttttgactccc

SEQ ID NO: 10270 - DNA, 23 bp, Artificial Sequence
  epidermal growth factor receptor (EGFR), ERBB1 phosphotyrosine kinase siRNA
tttaaagtaatttttgactccca

SEQ ID NO: 10271 - DNA, 23 bp, Artificial Sequence
  epidermal growth factor receptor (EGFR), ERBB1 phosphotyrosine kinase siRNA
ttaaagtaatttttgactcccag

SEQ ID NO: 10272 - DNA, 23 bp, Artificial Sequence
  epidermal growth factor receptor (EGFR), ERBB1 phosphotyrosine kinase siRNA
taaagtaatttttgactcccaga

SEQ ID NO: 10273 - DNA, 23 bp, Artificial Sequence
  epidermal growth factor receptor (EGFR), ERBB1 phosphotyrosine kinase siRNA
aaagtaatttttgactcccagat

SEQ ID NO: 10274 - DNA, 23 bp, Artificial Sequence
  epidermal growth factor receptor (EGFR), ERBB1 phosphotyrosine kinase siRNA
aagtaatttttgactcccagatc

SEQ ID NO: 10275 - DNA, 23 bp, Artificial Sequence
  epidermal growth factor receptor (EGFR), ERBB1 phosphotyrosine kinase siRNA
agtaatttttgactcccagatca

SEQ ID NO: 10276 - DNA, 23 bp, Artificial Sequence
  epidermal growth factor receptor (EGFR), ERBB1 phosphotyrosine kinase siRNA
gtaatttttgactcccagatcag

SEQ ID NO: 10277 - DNA, 23 bp, Artificial Sequence
  epidermal growth factor receptor (EGFR), ERBB1 phosphotyrosine kinase siRNA
taatttttgactcccagatcagt

SEQ ID NO: 10278 - DNA, 23 bp, Artificial Sequence
  epidermal growth factor receptor (EGFR), ERBB1 phosphotyrosine kinase siRNA
aatttttgactcccagatcagtc

SEQ ID NO: 10279 - DNA, 23 bp, Artificial Sequence
  epidermal growth factor receptor (EGFR), ERBB1 phosphotyrosine kinase siRNA
atttttgactcccagatcagtca

SEQ ID NO: 10280 - DNA, 23 bp, Artificial Sequence
  epidermal growth factor receptor (EGFR), ERBB1 phosphotyrosine kinase siRNA
tttttgactcccagatcagtcag

SEQ ID NO: 10281 - DNA, 23 bp, Artificial Sequence
  epidermal growth factor receptor (EGFR), ERBB1 phosphotyrosine kinase siRNA
ttttgactcccagatcagtcaga

SEQ ID NO: 10282 - DNA, 23 bp, Artificial Sequence
  epidermal growth factor receptor (EGFR), ERBB1 phosphotyrosine kinase siRNA
tttgactcccagatcagtcagag

SEQ ID NO: 10283 - DNA, 23 bp, Artificial Sequence
  epidermal growth factor receptor (EGFR), ERBB1 phosphotyrosine kinase siRNA
ttgactcccagatcagtcagagc

SEQ ID NO: 10284 - DNA, 23 bp, Artificial Sequence
  epidermal growth factor receptor (EGFR), ERBB1 phosphotyrosine kinase siRNA
tgactcccagatcagtcagagcc

SEQ ID NO: 10285 - DNA, 23 bp, Artificial Sequence
  epidermal growth factor receptor (EGFR), ERBB1 phosphotyrosine kinase siRNA
gactcccagatcagtcagagccc

SEQ ID NO: 10286 - DNA, 23 bp, Artificial Sequence
  epidermal growth factor receptor (EGFR), ERBB1 phosphotyrosine kinase siRNA
actcccagatcagtcagagcccc

SEQ ID NO: 10287 - DNA, 23 bp, Artificial Sequence
  epidermal growth factor receptor (EGFR), ERBB1 phosphotyrosine kinase siRNA
ctcccagatcagtcagagcccct

SEQ ID NO: 10288 - DNA, 23 bp, Artificial Sequence
  epidermal growth factor receptor (EGFR), ERBB1 phosphotyrosine kinase siRNA
tcccagatcagtcagagccccta

SEQ ID NO: 10289 - DNA, 23 bp, Artificial Sequence
  epidermal growth factor receptor (EGFR), ERBB1 phosphotyrosine kinase siRNA
cccagatcagtcagagcccctac

SEQ ID NO: 10290 - DNA, 23 bp, Artificial Sequence
  epidermal growth factor receptor (EGFR), ERBB1 phosphotyrosine kinase siRNA
ccagatcagtcagagcccctaca

SEQ ID NO: 10291 - DNA, 23 bp, Artificial Sequence
  epidermal growth factor receptor (EGFR), ERBB1 phosphotyrosine kinase siRNA
cagatcagtcagagcccctacag

SEQ ID NO: 10292 - DNA, 23 bp, Artificial Sequence
  epidermal growth factor receptor (EGFR), ERBB1 phosphotyrosine kinase siRNA
agatcagtcagagcccctacagc

SEQ ID NO: 10293 - DNA, 23 bp, Artificial Sequence
  epidermal growth factor receptor (EGFR), ERBB1 phosphotyrosine kinase siRNA
gatcagtcagagcccctacagca

SEQ ID NO: 10294 - DNA, 23 bp, Artificial Sequence
  epidermal growth factor receptor (EGFR), ERBB1 phosphotyrosine kinase siRNA
atcagtcagagcccctacagcat

SEQ ID NO: 10295 - DNA, 23 bp, Artificial Sequence
  epidermal growth factor receptor (EGFR), ERBB1 phosphotyrosine kinase siRNA
tcagtcagagcccctacagcatt

SEQ ID NO: 10296 - DNA, 23 bp, Artificial Sequence
  epidermal growth factor receptor (EGFR), ERBB1 phosphotyrosine kinase siRNA
cagtcagagcccctacagcattg

SEQ ID NO: 10297 - DNA, 23 bp, Artificial Sequence
  epidermal growth factor receptor (EGFR), ERBB1 phosphotyrosine kinase siRNA
agtcagagcccctacagcattgt

SEQ ID NO: 10298 - DNA, 23 bp, Artificial Sequence
  epidermal growth factor receptor (EGFR), ERBB1 phosphotyrosine kinase siRNA
gtcagagcccctacagcattgtt

SEQ ID NO: 10299 - DNA, 23 bp, Artificial Sequence
  epidermal growth factor receptor (EGFR), ERBB1 phosphotyrosine kinase siRNA
tcagagcccctacagcattgtta

SEQ ID NO: 10300 - DNA, 23 bp, Artificial Sequence
  epidermal growth factor receptor (EGFR), ERBB1 phosphotyrosine kinase siRNA
cagagcccctacagcattgttaa

SEQ ID NO: 10301 - DNA, 23 bp, Artificial Sequence
  epidermal growth factor receptor (EGFR), ERBB1 phosphotyrosine kinase siRNA
agagcccctacagcattgttaag

SEQ ID NO: 10302 - DNA, 23 bp, Artificial Sequence
  epidermal growth factor receptor (EGFR), ERBB1 phosphotyrosine kinase siRNA
gagcccctacagcattgttaaga

SEQ ID NO: 10303 - DNA, 23 bp, Artificial Sequence
  epidermal growth factor receptor (EGFR), ERBB1 phosphotyrosine kinase siRNA
agcccctacagcattgttaagaa

SEQ ID NO: 10304 - DNA, 23 bp, Artificial Sequence
  epidermal growth factor receptor (EGFR), ERBB1 phosphotyrosine kinase siRNA
gcccctacagcattgttaagaaa

SEQ ID NO: 10305 - DNA, 23 bp, Artificial Sequence
  epidermal growth factor receptor (EGFR), ERBB1 phosphotyrosine kinase siRNA
cccctacagcattgttaagaaag

SEQ ID NO: 10306 - DNA, 23 bp, Artificial Sequence
  epidermal growth factor receptor (EGFR), ERBB1 phosphotyrosine kinase siRNA
ccctacagcattgttaagaaagt

SEQ ID NO: 10307 - DNA, 23 bp, Artificial Sequence
  epidermal growth factor receptor (EGFR), ERBB1 phosphotyrosine kinase siRNA
cctacagcattgttaagaaagta

SEQ ID NO: 10308 - DNA, 23 bp, Artificial Sequence
  epidermal growth factor receptor (EGFR), ERBB1 phosphotyrosine kinase siRNA
ctacagcattgttaagaaagtat

SEQ ID NO: 10309 - DNA, 23 bp, Artificial Sequence
  epidermal growth factor receptor (EGFR), ERBB1 phosphotyrosine kinase siRNA
tacagcattgttaagaaagtatt

SEQ ID NO: 10310 - DNA, 23 bp, Artificial Sequence
  epidermal growth factor receptor (EGFR), ERBB1 phosphotyrosine kinase siRNA
acagcattgttaagaaagtattt

SEQ ID NO: 10311 - DNA, 23 bp, Artificial Sequence
  epidermal growth factor receptor (EGFR), ERBB1 phosphotyrosine kinase siRNA
cagcattgttaagaaagtatttg

SEQ ID NO: 10312 - DNA, 23 bp, Artificial Sequence
  epidermal growth factor receptor (EGFR), ERBB1 phosphotyrosine kinase siRNA
agcattgttaagaaagtatttga

SEQ ID NO: 10313 - DNA, 23 bp, Artificial Sequence
  epidermal growth factor receptor (EGFR), ERBB1 phosphotyrosine kinase siRNA
gcattgttaagaaagtatttgat

SEQ ID NO: 10314 - DNA, 23 bp, Artificial Sequence
  epidermal growth factor receptor (EGFR), ERBB1 phosphotyrosine kinase siRNA
cattgttaagaaagtatttgatt

SEQ ID NO: 10315 - DNA, 23 bp, Artificial Sequence
  epidermal growth factor receptor (EGFR), ERBB1 phosphotyrosine kinase siRNA
attgttaagaaagtatttgattt

SEQ ID NO: 10316 - DNA, 23 bp, Artificial Sequence
  epidermal growth factor receptor (EGFR), ERBB1 phosphotyrosine kinase siRNA
ttgttaagaaagtatttgatttt

SEQ ID NO: 10317 - DNA, 23 bp, Artificial Sequence
  epidermal growth factor receptor (EGFR), ERBB1 phosphotyrosine kinase siRNA
tgttaagaaagtatttgattttt

SEQ ID NO: 10318 - DNA, 23 bp, Artificial Sequence
  epidermal growth factor receptor (EGFR), ERBB1 phosphotyrosine kinase siRNA
gttaagaaagtatttgatttttg

SEQ ID NO: 10319 - DNA, 23 bp, Artificial Sequence
  epidermal growth factor receptor (EGFR), ERBB1 phosphotyrosine kinase siRNA
ttaagaaagtatttgatttttgt

SEQ ID NO: 10320 - DNA, 23 bp, Artificial Sequence
  epidermal growth factor receptor (EGFR), ERBB1 phosphotyrosine kinase siRNA
taagaaagtatttgatttttgtc

SEQ ID NO: 10321 - DNA, 23 bp, Artificial Sequence
  epidermal growth factor receptor (EGFR), ERBB1 phosphotyrosine kinase siRNA
aagaaagtatttgatttttgtct

SEQ ID NO: 10322 - DNA, 23 bp, Artificial Sequence
  epidermal growth factor receptor (EGFR), ERBB1 phosphotyrosine kinase siRNA
agaaagtatttgatttttgtctc

SEQ ID NO: 10323 - DNA, 23 bp, Artificial Sequence
  epidermal growth factor receptor (EGFR), ERBB1 phosphotyrosine kinase siRNA
gaaagtatttgatttttgtctca

SEQ ID NO: 10324 - DNA, 23 bp, Artificial Sequence
  epidermal growth factor receptor (EGFR), ERBB1 phosphotyrosine kinase siRNA
aaagtatttgatttttgtctcaa

SEQ ID NO: 10325 - DNA, 23 bp, Artificial Sequence
  epidermal growth factor receptor (EGFR), ERBB1 phosphotyrosine kinase siRNA
aagtatttgatttttgtctcaat

SEQ ID NO: 10326 - DNA, 23 bp, Artificial Sequence
  epidermal growth factor receptor (EGFR), ERBB1 phosphotyrosine kinase siRNA
agtatttgatttttgtctcaatg

SEQ ID NO: 10327 - DNA, 23 bp, Artificial Sequence
  epidermal growth factor receptor (EGFR), ERBB1 phosphotyrosine kinase siRNA
gtatttgatttttgtctcaatga

SEQ ID NO: 10328 - DNA, 23 bp, Artificial Sequence
  epidermal growth factor receptor (EGFR), ERBB1 phosphotyrosine kinase siRNA
tatttgatttttgtctcaatgaa

SEQ ID NO: 10329 - DNA, 23 bp, Artificial Sequence
  epidermal growth factor receptor (EGFR), ERBB1 phosphotyrosine kinase siRNA
atttgatttttgtctcaatgaaa

SEQ ID NO: 10330 - DNA, 23 bp, Artificial Sequence
  epidermal growth factor receptor (EGFR), ERBB1 phosphotyrosine kinase siRNA
tttgatttttgtctcaatgaaaa

SEQ ID NO: 10331 - DNA, 23 bp, Artificial Sequence
  epidermal growth factor receptor (EGFR), ERBB1 phosphotyrosine kinase siRNA
ttgatttttgtctcaatgaaaat

SEQ ID NO: 10332 - DNA, 23 bp, Artificial Sequence
  epidermal growth factor receptor (EGFR), ERBB1 phosphotyrosine kinase siRNA
tgatttttgtctcaatgaaaata

SEQ ID NO: 10333 - DNA, 23 bp, Artificial Sequence
  epidermal growth factor receptor (EGFR), ERBB1 phosphotyrosine kinase siRNA
gatttttgtctcaatgaaaataa

SEQ ID NO: 10334 - DNA, 23 bp, Artificial Sequence
  epidermal growth factor receptor (EGFR), ERBB1 phosphotyrosine kinase siRNA
atttttgtctcaatgaaaataaa

SEQ ID NO: 10335 - DNA, 23 bp, Artificial Sequence
  epidermal growth factor receptor (EGFR), ERBB1 phosphotyrosine kinase siRNA
tttttgtctcaatgaaaataaaa

SEQ ID NO: 10336 - DNA, 23 bp, Artificial Sequence
  epidermal growth factor receptor (EGFR), ERBB1 phosphotyrosine kinase siRNA
ttttgtctcaatgaaaataaaac

SEQ ID NO: 10337 - DNA, 23 bp, Artificial Sequence
  epidermal growth factor receptor (EGFR), ERBB1 phosphotyrosine kinase siRNA
tttgtctcaatgaaaataaaact

SEQ ID NO: 10338 - DNA, 23 bp, Artificial Sequence
  epidermal growth factor receptor (EGFR), ERBB1 phosphotyrosine kinase siRNA
ttgtctcaatgaaaataaaacta

SEQ ID NO: 10339 - DNA, 23 bp, Artificial Sequence
  epidermal growth factor receptor (EGFR), ERBB1 phosphotyrosine kinase siRNA
tgtctcaatgaaaataaaactat

SEQ ID NO: 10340 - DNA, 23 bp, Artificial Sequence
  epidermal growth factor receptor (EGFR), ERBB1 phosphotyrosine kinase siRNA
gtctcaatgaaaataaaactata

SEQ ID NO: 10341 - DNA, 23 bp, Artificial Sequence
  epidermal growth factor receptor (EGFR), ERBB1 phosphotyrosine kinase siRNA
tctcaatgaaaataaaactatat

SEQ ID NO: 10342 - DNA, 23 bp, Artificial Sequence
  epidermal growth factor receptor (EGFR), ERBB1 phosphotyrosine kinase siRNA
ctcaatgaaaataaaactatatt

SEQ ID NO: 10343 - DNA, 23 bp, Artificial Sequence
  epidermal growth factor receptor (EGFR), ERBB1 phosphotyrosine kinase siRNA
tcaatgaaaataaaactatattc

SEQ ID NO: 10344 - DNA, 23 bp, Artificial Sequence
  epidermal growth factor receptor (EGFR), ERBB1 phosphotyrosine kinase siRNA
caatgaaaataaaactatattca

SEQ ID NO: 10345 - DNA, 23 bp, Artificial Sequence
  epidermal growth factor receptor (EGFR), ERBB1 phosphotyrosine kinase siRNA
aatgaaaataaaactatattcat

SEQ ID NO: 10346 - DNA, 23 bp, Artificial Sequence
  epidermal growth factor receptor (EGFR), ERBB1 phosphotyrosine kinase siRNA
atgaaaataaaactatattcatt

SEQ ID NO: 10347 - DNA, 23 bp, Artificial Sequence
  epidermal growth factor receptor (EGFR), ERBB1 phosphotyrosine kinase siRNA
tgaaaataaaactatattcattt

SEQ ID NO: 10348 - DNA, 23 bp, Artificial Sequence
  epidermal growth factor receptor (EGFR), ERBB1 phosphotyrosine kinase siRNA
gaaaataaaactatattcatttc

SEQ ID NO: 10349 - DNA, 23 bp, Artificial Sequence
  epidermal growth factor receptor (EGFR), ERBB1 phosphotyrosine kinase siRNA
aaaataaaactatattcatttcc

SEQ ID NO: 10350 - DNA, 23 bp, Artificial Sequence
  epidermal growth factor receptor (EGFR), ERBB1 phosphotyrosine kinase siRNA
aaataaaactatattcatttcca

SEQ ID NO: 10351 - DNA, 23 bp, Artificial Sequence
  epidermal growth factor receptor (EGFR), ERBB1 phosphotyrosine kinase siRNA
aataaaactatattcatttccac

SEQ ID NO: 10352 - DNA, 23 bp, Artificial Sequence
  epidermal growth factor receptor (EGFR), ERBB1 phosphotyrosine kinase siRNA
ataaaactatattcatttccact

SEQ ID NO: 10353 - DNA, 23 bp, Artificial Sequence
  epidermal growth factor receptor (EGFR), ERBB1 phosphotyrosine kinase siRNA
taaaactatattcatttccactc

SEQ ID NO: 10354 - DNA, 23 bp, Artificial Sequence
  epidermal growth factor receptor (EGFR), ERBB1 phosphotyrosine kinase siRNA
aaaactatattcatttccactct

SEQ ID NO: 10355 - DNA, 23 bp, Artificial Sequence
  epidermal growth factor receptor (EGFR), ERBB1 phosphotyrosine kinase siRNA
aaactatattcatttccactcta

SEQ ID NO: 10356 - DNA, 23 bp, Artificial Sequence
  epidermal growth factor receptor (EGFR), ERBB1 phosphotyrosine kinase siRNA
aactatattcatttccactctaa

SEQ ID NO: 10357 - DNA, 23 bp, Artificial Sequence
  epidermal growth factor receptor (EGFR), ERBB1 phosphotyrosine kinase siRNA
actatattcatttccactctaaa

SEQ ID NO: 10358 - DNA, 23 bp, Artificial Sequence
  epidermal growth factor receptor (EGFR), ERBB1 phosphotyrosine kinase siRNA
ctatattcatttccactctaaaa

SEQ ID NO: 10359 - DNA, 23 bp, Artificial Sequence
  epidermal growth factor receptor (EGFR), ERBB1 phosphotyrosine kinase siRNA
tatattcatttccactctaaaaa

SEQ ID NO: 10360 - DNA, 23 bp, Artificial Sequence
  epidermal growth factor receptor (EGFR), ERBB1 phosphotyrosine kinase siRNA
atattcatttccactctaaaaaa

SEQ ID NO: 10361 - DNA, 23 bp, Artificial Sequence
  epidermal growth factor receptor (EGFR), ERBB1 phosphotyrosine kinase siRNA
tattcatttccactctaaaaaaa

SEQ ID NO: 10362 - DNA, 23 bp, Artificial Sequence
  epidermal growth factor receptor (EGFR), ERBB1 phosphotyrosine kinase siRNA
attcatttccactctaaaaaaaa

SEQ ID NO: 10363 - DNA, 23 bp, Artificial Sequence
  X-linked inhibitor of apoptosis (XIAP) siRNA
tttccagattggggctcgggccg

SEQ ID NO: 10364 - DNA, 23 bp, Artificial Sequence
  X-linked inhibitor of apoptosis (XIAP) siRNA
ttccagattggggctcgggccgc

SEQ ID NO: 10365 - DNA, 23 bp, Artificial Sequence
  X-linked inhibitor of apoptosis (XIAP) siRNA
gccgcgcctcctccgggaccctc

SEQ ID NO: 10366 - DNA, 23 bp, Artificial Sequence
  X-linked inhibitor of apoptosis (XIAP) siRNA
ccgcgcctcctccgggaccctcc

SEQ ID NO: 10367 - DNA, 23 bp, Artificial Sequence
  X-linked inhibitor of apoptosis (XIAP) siRNA
cgcgcctcctccgggaccctccc

SEQ ID NO: 10368 - DNA, 23 bp, Artificial Sequence
  X-linked inhibitor of apoptosis (XIAP) siRNA
gcgcctcctccgggaccctcccc

SEQ ID NO: 10369 - DNA, 23 bp, Artificial Sequence
  X-linked inhibitor of apoptosis (XIAP) siRNA
cgcctcctccgggaccctcccct

SEQ ID NO: 10370 - DNA, 23 bp, Artificial Sequence
  X-linked inhibitor of apoptosis (XIAP) siRNA
gcctcctccgggaccctcccctt

SEQ ID NO: 10371 - DNA, 23 bp, Artificial Sequence
  X-linked inhibitor of apoptosis (XIAP) siRNA
cctcctccgggaccctccccttg

SEQ ID NO: 10372 - DNA, 23 bp, Artificial Sequence
  X-linked inhibitor of apoptosis (XIAP) siRNA
ctcctccgggaccctccccttgg

SEQ ID NO: 10373 - DNA, 23 bp, Artificial Sequence
  X-linked inhibitor of apoptosis (XIAP) siRNA
tcctccgggaccctccccttgga

SEQ ID NO: 10374 - DNA, 23 bp, Artificial Sequence
  X-linked inhibitor of apoptosis (XIAP) siRNA
cctccgggaccctccccttggac

SEQ ID NO: 10375 - DNA, 23 bp, Artificial Sequence
  X-linked inhibitor of apoptosis (XIAP) siRNA
ctccgggaccctccccttggacc

SEQ ID NO: 10376 - DNA, 23 bp, Artificial Sequence
  X-linked inhibitor of apoptosis (XIAP) siRNA
tccgggaccctccccttggaccg

SEQ ID NO: 10377 - DNA, 23 bp, Artificial Sequence
  X-linked inhibitor of apoptosis (XIAP) siRNA
ccgggaccctccccttggaccga

SEQ ID NO: 10378 - DNA, 23 bp, Artificial Sequence
  X-linked inhibitor of apoptosis (XIAP) siRNA
cgggaccctccccttggaccgag

SEQ ID NO: 10379 - DNA, 23 bp, Artificial Sequence
  X-linked inhibitor of apoptosis (XIAP) siRNA
gggaccctccccttggaccgagc

SEQ ID NO: 10380 - DNA, 23 bp, Artificial Sequence
  X-linked inhibitor of apoptosis (XIAP) siRNA
ggaccctccccttggaccgagcc

SEQ ID NO: 10381 - DNA, 23 bp, Artificial Sequence
  X-linked inhibitor of apoptosis (XIAP) siRNA
gaccctccccttggaccgagccg

SEQ ID NO: 10382 - DNA, 23 bp, Artificial Sequence
  X-linked inhibitor of apoptosis (XIAP) siRNA
accctccccttggaccgagccga

SEQ ID NO: 10383 - DNA, 23 bp, Artificial Sequence
  X-linked inhibitor of apoptosis (XIAP) siRNA
ccctccccttggaccgagccgat

SEQ ID NO: 10384 - DNA, 23 bp, Artificial Sequence
  X-linked inhibitor of apoptosis (XIAP) siRNA
cctccccttggaccgagccgatc

SEQ ID NO: 10385 - DNA, 23 bp, Artificial Sequence
  X-linked inhibitor of apoptosis (XIAP) siRNA
ctccccttggaccgagccgatcg

SEQ ID NO: 10386 - DNA, 23 bp, Artificial Sequence
  X-linked inhibitor of apoptosis (XIAP) siRNA
tccccttggaccgagccgatcgc

SEQ ID NO: 10387 - DNA, 23 bp, Artificial Sequence
  X-linked inhibitor of apoptosis (XIAP) siRNA
ccccttggaccgagccgatcgcc

SEQ ID NO: 10388 - DNA, 23 bp, Artificial Sequence
  X-linked inhibitor of apoptosis (XIAP) siRNA
cccttggaccgagccgatcgccg

SEQ ID NO: 10389 - DNA, 23 bp, Artificial Sequence
  X-linked inhibitor of apoptosis (XIAP) siRNA
ccttggaccgagccgatcgccgc

SEQ ID NO: 10390 - DNA, 23 bp, Artificial Sequence
  X-linked inhibitor of apoptosis (XIAP) siRNA
cttggaccgagccgatcgccgcg

SEQ ID NO: 10391 - DNA, 23 bp, Artificial Sequence
  X-linked inhibitor of apoptosis (XIAP) siRNA
ttggaccgagccgatcgccgcgg

SEQ ID NO: 10392 - DNA, 23 bp, Artificial Sequence
  X-linked inhibitor of apoptosis (XIAP) siRNA
gggccggctgtcctggcgcgaaa

SEQ ID NO: 10393 - DNA, 23 bp, Artificial Sequence
  X-linked inhibitor of apoptosis (XIAP) siRNA
ggccggctgtcctggcgcgaaaa

SEQ ID NO: 10394 - DNA, 23 bp, Artificial Sequence
  X-linked inhibitor of apoptosis (XIAP) siRNA
gccggctgtcctggcgcgaaaag

SEQ ID NO: 10395 - DNA, 23 bp, Artificial Sequence
  X-linked inhibitor of apoptosis (XIAP) siRNA
ccggctgtcctggcgcgaaaagg

SEQ ID NO: 10396 - DNA, 23 bp, Artificial Sequence
  X-linked inhibitor of apoptosis (XIAP) siRNA
cggctgtcctggcgcgaaaaggt

SEQ ID NO: 10397 - DNA, 23 bp, Artificial Sequence
  X-linked inhibitor of apoptosis (XIAP) siRNA
ggctgtcctggcgcgaaaaggtg

SEQ ID NO: 10398 - DNA, 23 bp, Artificial Sequence
  X-linked inhibitor of apoptosis (XIAP) siRNA
gctgtcctggcgcgaaaaggtgg

SEQ ID NO: 10399 - DNA, 23 bp, Artificial Sequence
  X-linked inhibitor of apoptosis (XIAP) siRNA
ctgtcctggcgcgaaaaggtgga

SEQ ID NO: 10400 - DNA, 23 bp, Artificial Sequence
  X-linked inhibitor of apoptosis (XIAP) siRNA
tgtcctggcgcgaaaaggtggac

SEQ ID NO: 10401 - DNA, 23 bp, Artificial Sequence
  X-linked inhibitor of apoptosis (XIAP) siRNA
gtcctggcgcgaaaaggtggaca

SEQ ID NO: 10402 - DNA, 23 bp, Artificial Sequence
  X-linked inhibitor of apoptosis (XIAP) siRNA
tcctggcgcgaaaaggtggacaa

SEQ ID NO: 10403 - DNA, 23 bp, Artificial Sequence
  X-linked inhibitor of apoptosis (XIAP) siRNA
cctggcgcgaaaaggtggacaag

SEQ ID NO: 10404 - DNA, 23 bp, Artificial Sequence
  X-linked inhibitor of apoptosis (XIAP) siRNA
ctggcgcgaaaaggtggacaagt

SEQ ID NO: 10405 - DNA, 23 bp, Artificial Sequence
  X-linked inhibitor of apoptosis (XIAP) siRNA
tggcgcgaaaaggtggacaagtc

SEQ ID NO: 10406 - DNA, 23 bp, Artificial Sequence
  X-linked inhibitor of apoptosis (XIAP) siRNA
ggcgcgaaaaggtggacaagtcc

SEQ ID NO: 10407 - DNA, 23 bp, Artificial Sequence
  X-linked inhibitor of apoptosis (XIAP) siRNA
gcgcgaaaaggtggacaagtcct

SEQ ID NO: 10408 - DNA, 23 bp, Artificial Sequence
  X-linked inhibitor of apoptosis (XIAP) siRNA
cgcgaaaaggtggacaagtccta

SEQ ID NO: 10409 - DNA, 23 bp, Artificial Sequence
  X-linked inhibitor of apoptosis (XIAP) siRNA
gcgaaaaggtggacaagtcctat

SEQ ID NO: 10410 - DNA, 23 bp, Artificial Sequence
  X-linked inhibitor of apoptosis (XIAP) siRNA
cgaaaaggtggacaagtcctatt

SEQ ID NO: 10411 - DNA, 23 bp, Artificial Sequence
  X-linked inhibitor of apoptosis (XIAP) siRNA
gaaaaggtggacaagtcctattt

SEQ ID NO: 10412 - DNA, 23 bp, Artificial Sequence
  X-linked inhibitor of apoptosis (XIAP) siRNA
aaaaggtggacaagtcctatttt

SEQ ID NO: 10413 - DNA, 23 bp, Artificial Sequence
  X-linked inhibitor of apoptosis (XIAP) siRNA
aaaggtggacaagtcctattttc

SEQ ID NO: 10414 - DNA, 23 bp, Artificial Sequence
  X-linked inhibitor of apoptosis (XIAP) siRNA
aaggtggacaagtcctattttca

SEQ ID NO: 10415 - DNA, 23 bp, Artificial Sequence
  X-linked inhibitor of apoptosis (XIAP) siRNA
aggtggacaagtcctattttcaa

SEQ ID NO: 10416 - DNA, 23 bp, Artificial Sequence
  X-linked inhibitor of apoptosis (XIAP) siRNA
ggtggacaagtcctattttcaag

SEQ ID NO: 10417 - DNA, 23 bp, Artificial Sequence
  X-linked inhibitor of apoptosis (XIAP) siRNA
gtggacaagtcctattttcaaga

SEQ ID NO: 10418 - DNA, 23 bp, Artificial Sequence
  X-linked inhibitor of apoptosis (XIAP) siRNA
tggacaagtcctattttcaagag

SEQ ID NO: 10419 - DNA, 23 bp, Artificial Sequence
  X-linked inhibitor of apoptosis (XIAP) siRNA
ggacaagtcctattttcaagaga

SEQ ID NO: 10420 - DNA, 23 bp, Artificial Sequence
  X-linked inhibitor of apoptosis (XIAP) siRNA
gacaagtcctattttcaagagaa

SEQ ID NO: 10421 - DNA, 23 bp, Artificial Sequence
  X-linked inhibitor of apoptosis (XIAP) siRNA
atgacttttaacagttttgaagg

SEQ ID NO: 10422 - DNA, 23 bp, Artificial Sequence
  X-linked inhibitor of apoptosis (XIAP) siRNA
tgacttttaacagttttgaagga

SEQ ID NO: 10423 - DNA, 23 bp, Artificial Sequence
  X-linked inhibitor of apoptosis (XIAP) siRNA
gacttttaacagttttgaaggat

SEQ ID NO: 10424 - DNA, 23 bp, Artificial Sequence
  X-linked inhibitor of apoptosis (XIAP) siRNA
acttttaacagttttgaaggatc

SEQ ID NO: 10425 - DNA, 23 bp, Artificial Sequence
  X-linked inhibitor of apoptosis (XIAP) siRNA
cttttaacagttttgaaggatct

SEQ ID NO: 10426 - DNA, 23 bp, Artificial Sequence
  X-linked inhibitor of apoptosis (XIAP) siRNA
ttttaacagttttgaaggatcta

SEQ ID NO: 10427 - DNA, 23 bp, Artificial Sequence
  X-linked inhibitor of apoptosis (XIAP) siRNA
tttaacagttttgaaggatctaa

SEQ ID NO: 10428 - DNA, 23 bp, Artificial Sequence
  X-linked inhibitor of apoptosis (XIAP) siRNA
ttaacagttttgaaggatctaaa

SEQ ID NO: 10429 - DNA, 23 bp, Artificial Sequence
  X-linked inhibitor of apoptosis (XIAP) siRNA
taacagttttgaaggatctaaaa

SEQ ID NO: 10430 - DNA, 23 bp, Artificial Sequence
  X-linked inhibitor of apoptosis (XIAP) siRNA
aacagttttgaaggatctaaaac

SEQ ID NO: 10431 - DNA, 23 bp, Artificial Sequence
  X-linked inhibitor of apoptosis (XIAP) siRNA
acagttttgaaggatctaaaact

SEQ ID NO: 10432 - DNA, 23 bp, Artificial Sequence
  X-linked inhibitor of apoptosis (XIAP) siRNA
cagttttgaaggatctaaaactt

SEQ ID NO: 10433 - DNA, 23 bp, Artificial Sequence
  X-linked inhibitor of apoptosis (XIAP) siRNA
agttttgaaggatctaaaacttg

SEQ ID NO: 10434 - DNA, 23 bp, Artificial Sequence
  X-linked inhibitor of apoptosis (XIAP) siRNA
gttttgaaggatctaaaacttgt

SEQ ID NO: 10435 - DNA, 23 bp, Artificial Sequence
  X-linked inhibitor of apoptosis (XIAP) siRNA
ttttgaaggatctaaaacttgtg

SEQ ID NO: 10436 - DNA, 23 bp, Artificial Sequence
  X-linked inhibitor of apoptosis (XIAP) siRNA
tttgaaggatctaaaacttgtgt

SEQ ID NO: 10437 - DNA, 23 bp, Artificial Sequence
  X-linked inhibitor of apoptosis (XIAP) siRNA
ttgaaggatctaaaacttgtgta

SEQ ID NO: 10438 - DNA, 23 bp, Artificial Sequence
  X-linked inhibitor of apoptosis (XIAP) siRNA
tgaaggatctaaaacttgtgtac

SEQ ID NO: 10439 - DNA, 23 bp, Artificial Sequence
  X-linked inhibitor of apoptosis (XIAP) siRNA
gaaggatctaaaacttgtgtacc

SEQ ID NO: 10440 - DNA, 23 bp, Artificial Sequence
  X-linked inhibitor of apoptosis (XIAP) siRNA
aaggatctaaaacttgtgtacct

SEQ ID NO: 10441 - DNA, 23 bp, Artificial Sequence
  X-linked inhibitor of apoptosis (XIAP) siRNA
aggatctaaaacttgtgtacctg

SEQ ID NO: 10442 - DNA, 23 bp, Artificial Sequence
  X-linked inhibitor of apoptosis (XIAP) siRNA
ggatctaaaacttgtgtacctgc

SEQ ID NO: 10443 - DNA, 23 bp, Artificial Sequence
  X-linked inhibitor of apoptosis (XIAP) siRNA
gatctaaaacttgtgtacctgca

SEQ ID NO: 10444 - DNA, 23 bp, Artificial Sequence
  X-linked inhibitor of apoptosis (XIAP) siRNA
atctaaaacttgtgtacctgcag

SEQ ID NO: 10445 - DNA, 23 bp, Artificial Sequence
  X-linked inhibitor of apoptosis (XIAP) siRNA
tctaaaacttgtgtacctgcaga

SEQ ID NO: 10446 - DNA, 23 bp, Artificial Sequence
  X-linked inhibitor of apoptosis (XIAP) siRNA
ctaaaacttgtgtacctgcagac

SEQ ID NO: 10447 - DNA, 23 bp, Artificial Sequence
  X-linked inhibitor of apoptosis (XIAP) siRNA
taaaacttgtgtacctgcagaca

SEQ ID NO: 10448 - DNA, 23 bp, Artificial Sequence
  X-linked inhibitor of apoptosis (XIAP) siRNA
aaaacttgtgtacctgcagacat

SEQ ID NO: 10449 - DNA, 23 bp, Artificial Sequence
  X-linked inhibitor of apoptosis (XIAP) siRNA
aaacttgtgtacctgcagacatc

SEQ ID NO: 10450 - DNA, 23 bp, Artificial Sequence
  X-linked inhibitor of apoptosis (XIAP) siRNA
aacttgtgtacctgcagacatca

SEQ ID NO: 10451 - DNA, 23 bp, Artificial Sequence
  X-linked inhibitor of apoptosis (XIAP) siRNA
acttgtgtacctgcagacatcaa

SEQ ID NO: 10452 - DNA, 23 bp, Artificial Sequence
  X-linked inhibitor of apoptosis (XIAP) siRNA
cttgtgtacctgcagacatcaat

SEQ ID NO: 10453 - DNA, 23 bp, Artificial Sequence
  X-linked inhibitor of apoptosis (XIAP) siRNA
ttgtgtacctgcagacatcaata

SEQ ID NO: 10454 - DNA, 23 bp, Artificial Sequence
  X-linked inhibitor of apoptosis (XIAP) siRNA
tgtgtacctgcagacatcaataa

SEQ ID NO: 10455 - DNA, 23 bp, Artificial Sequence
  X-linked inhibitor of apoptosis (XIAP) siRNA
gtgtacctgcagacatcaataag

SEQ ID NO: 10456 - DNA, 23 bp, Artificial Sequence
  X-linked inhibitor of apoptosis (XIAP) siRNA
tgtacctgcagacatcaataagg

SEQ ID NO: 10457 - DNA, 23 bp, Artificial Sequence
  X-linked inhibitor of apoptosis (XIAP) siRNA
gtacctgcagacatcaataagga

SEQ ID NO: 10458 - DNA, 23 bp, Artificial Sequence
  X-linked inhibitor of apoptosis (XIAP) siRNA
tacctgcagacatcaataaggaa

SEQ ID NO: 10459 - DNA, 23 bp, Artificial Sequence
  X-linked inhibitor of apoptosis (XIAP) siRNA
acctgcagacatcaataaggaag

SEQ ID NO: 10460 - DNA, 23 bp, Artificial Sequence
  X-linked inhibitor of apoptosis (XIAP) siRNA
cctgcagacatcaataaggaaga

SEQ ID NO: 10461 - DNA, 23 bp, Artificial Sequence
  X-linked inhibitor of apoptosis (XIAP) siRNA
ctgcagacatcaataaggaagaa

SEQ ID NO: 10462 - DNA, 23 bp, Artificial Sequence
  X-linked inhibitor of apoptosis (XIAP) siRNA
tgcagacatcaataaggaagaag

SEQ ID NO: 10463 - DNA, 23 bp, Artificial Sequence
  X-linked inhibitor of apoptosis (XIAP) siRNA
gcagacatcaataaggaagaaga

SEQ ID NO: 10464 - DNA, 23 bp, Artificial Sequence
  X-linked inhibitor of apoptosis (XIAP) siRNA
cagacatcaataaggaagaagaa

SEQ ID NO: 10465 - DNA, 23 bp, Artificial Sequence
  X-linked inhibitor of apoptosis (XIAP) siRNA
agacatcaataaggaagaagaat

SEQ ID NO: 10466 - DNA, 23 bp, Artificial Sequence
  X-linked inhibitor of apoptosis (XIAP) siRNA
gacatcaataaggaagaagaatt

SEQ ID NO: 10467 - DNA, 23 bp, Artificial Sequence
  X-linked inhibitor of apoptosis (XIAP) siRNA
acatcaataaggaagaagaattt

SEQ ID NO: 10468 - DNA, 23 bp, Artificial Sequence
  X-linked inhibitor of apoptosis (XIAP) siRNA
catcaataaggaagaagaatttg

SEQ ID NO: 10469 - DNA, 23 bp, Artificial Sequence
  X-linked inhibitor of apoptosis (XIAP) siRNA
atcaataaggaagaagaatttgt

SEQ ID NO: 10470 - DNA, 23 bp, Artificial Sequence
  X-linked inhibitor of apoptosis (XIAP) siRNA
tcaataaggaagaagaatttgta

SEQ ID NO: 10471 - DNA, 23 bp, Artificial Sequence
  X-linked inhibitor of apoptosis (XIAP) siRNA
caataaggaagaagaatttgtag

SEQ ID NO: 10472 - DNA, 23 bp, Artificial Sequence
  X-linked inhibitor of apoptosis (XIAP) siRNA
aataaggaagaagaatttgtaga

SEQ ID NO: 10473 - DNA, 23 bp, Artificial Sequence
  X-linked inhibitor of apoptosis (XIAP) siRNA
ataaggaagaagaatttgtagaa

SEQ ID NO: 10474 - DNA, 23 bp, Artificial Sequence
  X-linked inhibitor of apoptosis (XIAP) siRNA
taaggaagaagaatttgtagaag

SEQ ID NO: 10475 - DNA, 23 bp, Artificial Sequence
  X-linked inhibitor of apoptosis (XIAP) siRNA
aaggaagaagaatttgtagaaga

SEQ ID NO: 10476 - DNA, 23 bp, Artificial Sequence
  X-linked inhibitor of apoptosis (XIAP) siRNA
aggaagaagaatttgtagaagag

SEQ ID NO: 10477 - DNA, 23 bp, Artificial Sequence
  X-linked inhibitor of apoptosis (XIAP) siRNA
ggaagaagaatttgtagaagagt

SEQ ID NO: 10478 - DNA, 23 bp, Artificial Sequence
  X-linked inhibitor of apoptosis (XIAP) siRNA
gaagaagaatttgtagaagagtt

SEQ ID NO: 10479 - DNA, 23 bp, Artificial Sequence
  X-linked inhibitor of apoptosis (XIAP) siRNA
aagaagaatttgtagaagagttt

SEQ ID NO: 10480 - DNA, 23 bp, Artificial Sequence
  X-linked inhibitor of apoptosis (XIAP) siRNA
agaagaatttgtagaagagttta

SEQ ID NO: 10481 - DNA, 23 bp, Artificial Sequence
  X-linked inhibitor of apoptosis (XIAP) siRNA
gaagaatttgtagaagagtttaa

SEQ ID NO: 10482 - DNA, 23 bp, Artificial Sequence
  X-linked inhibitor of apoptosis (XIAP) siRNA
aagaatttgtagaagagtttaat

SEQ ID NO: 10483 - DNA, 23 bp, Artificial Sequence
  X-linked inhibitor of apoptosis (XIAP) siRNA
agaatttgtagaagagtttaata

SEQ ID NO: 10484 - DNA, 23 bp, Artificial Sequence
  X-linked inhibitor of apoptosis (XIAP) siRNA
gaatttgtagaagagtttaatag

SEQ ID NO: 10485 - DNA, 23 bp, Artificial Sequence
  X-linked inhibitor of apoptosis (XIAP) siRNA
aatttgtagaagagtttaataga

SEQ ID NO: 10486 - DNA, 23 bp, Artificial Sequence
  X-linked inhibitor of apoptosis (XIAP) siRNA
atttgtagaagagtttaatagat

SEQ ID NO: 10487 - DNA, 23 bp, Artificial Sequence
  X-linked inhibitor of apoptosis (XIAP) siRNA
tttgtagaagagtttaatagatt

SEQ ID NO: 10488 - DNA, 23 bp, Artificial Sequence
  X-linked inhibitor of apoptosis (XIAP) siRNA
ttgtagaagagtttaatagatta

SEQ ID NO: 10489 - DNA, 23 bp, Artificial Sequence
  X-linked inhibitor of apoptosis (XIAP) siRNA
tgtagaagagtttaatagattaa

SEQ ID NO: 10490 - DNA, 23 bp, Artificial Sequence
  X-linked inhibitor of apoptosis (XIAP) siRNA
gtagaagagtttaatagattaaa

SEQ ID NO: 10491 - DNA, 23 bp, Artificial Sequence
  X-linked inhibitor of apoptosis (XIAP) siRNA
tagaagagtttaatagattaaaa

SEQ ID NO: 10492 - DNA, 23 bp, Artificial Sequence
  X-linked inhibitor of apoptosis (XIAP) siRNA
agaagagtttaatagattaaaaa

SEQ ID NO: 10493 - DNA, 23 bp, Artificial Sequence
  X-linked inhibitor of apoptosis (XIAP) siRNA
gaagagtttaatagattaaaaac

SEQ ID NO: 10494 - DNA, 23 bp, Artificial Sequence
  X-linked inhibitor of apoptosis (XIAP) siRNA
aagagtttaatagattaaaaact

SEQ ID NO: 10495 - DNA, 23 bp, Artificial Sequence
  X-linked inhibitor of apoptosis (XIAP) siRNA
agagtttaatagattaaaaactt

SEQ ID NO: 10496 - DNA, 23 bp, Artificial Sequence
  X-linked inhibitor of apoptosis (XIAP) siRNA
gagtttaatagattaaaaacttt

SEQ ID NO: 10497 - DNA, 23 bp, Artificial Sequence
  X-linked inhibitor of apoptosis (XIAP) siRNA
agtttaatagattaaaaactttt

SEQ ID NO: 10498 - DNA, 23 bp, Artificial Sequence
  X-linked inhibitor of apoptosis (XIAP) siRNA
gtttaatagattaaaaacttttg

SEQ ID NO: 10499 - DNA, 23 bp, Artificial Sequence
  X-linked inhibitor of apoptosis (XIAP) siRNA
tttaatagattaaaaacttttgc

SEQ ID NO: 10500 - DNA, 23 bp, Artificial Sequence
  X-linked inhibitor of apoptosis (XIAP) siRNA
ttaatagattaaaaacttttgct

SEQ ID NO: 10501 - DNA, 23 bp, Artificial Sequence
  X-linked inhibitor of apoptosis (XIAP) siRNA
taatagattaaaaacttttgcta

SEQ ID NO: 10502 - DNA, 23 bp, Artificial Sequence
  X-linked inhibitor of apoptosis (XIAP) siRNA
aatagattaaaaacttttgctaa

SEQ ID NO: 10503 - DNA, 23 bp, Artificial Sequence
  X-linked inhibitor of apoptosis (XIAP) siRNA
atagattaaaaacttttgctaat

SEQ ID NO: 10504 - DNA, 23 bp, Artificial Sequence
  X-linked inhibitor of apoptosis (XIAP) siRNA
tagattaaaaacttttgctaatt

SEQ ID NO: 10505 - DNA, 23 bp, Artificial Sequence
  X-linked inhibitor of apoptosis (XIAP) siRNA
agattaaaaacttttgctaattt

SEQ ID NO: 10506 - DNA, 23 bp, Artificial Sequence
  X-linked inhibitor of apoptosis (XIAP) siRNA
gattaaaaacttttgctaatttt

SEQ ID NO: 10507 - DNA, 23 bp, Artificial Sequence
  X-linked inhibitor of apoptosis (XIAP) siRNA
attaaaaacttttgctaattttc

SEQ ID NO: 10508 - DNA, 23 bp, Artificial Sequence
  X-linked inhibitor of apoptosis (XIAP) siRNA
ttaaaaacttttgctaattttcc

SEQ ID NO: 10509 - DNA, 23 bp, Artificial Sequence
  X-linked inhibitor of apoptosis (XIAP) siRNA
taaaaacttttgctaattttcca

SEQ ID NO: 10510 - DNA, 23 bp, Artificial Sequence
  X-linked inhibitor of apoptosis (XIAP) siRNA
aaaaacttttgctaattttccaa

SEQ ID NO: 10511 - DNA, 23 bp, Artificial Sequence
  X-linked inhibitor of apoptosis (XIAP) siRNA
aaaacttttgctaattttccaag

SEQ ID NO: 10512 - DNA, 23 bp, Artificial Sequence
  X-linked inhibitor of apoptosis (XIAP) siRNA
aaacttttgctaattttccaagt

SEQ ID NO: 10513 - DNA, 23 bp, Artificial Sequence
  X-linked inhibitor of apoptosis (XIAP) siRNA
aacttttgctaattttccaagtg

SEQ ID NO: 10514 - DNA, 23 bp, Artificial Sequence
  X-linked inhibitor of apoptosis (XIAP) siRNA
acttttgctaattttccaagtgg

SEQ ID NO: 10515 - DNA, 23 bp, Artificial Sequence
  X-linked inhibitor of apoptosis (XIAP) siRNA
cttttgctaattttccaagtggt

SEQ ID NO: 10516 - DNA, 23 bp, Artificial Sequence
  X-linked inhibitor of apoptosis (XIAP) siRNA
ttttgctaattttccaagtggta

SEQ ID NO: 10517 - DNA, 23 bp, Artificial Sequence
  X-linked inhibitor of apoptosis (XIAP) siRNA
tttgctaattttccaagtggtag

SEQ ID NO: 10518 - DNA, 23 bp, Artificial Sequence
  X-linked inhibitor of apoptosis (XIAP) siRNA
ttgctaattttccaagtggtagt

SEQ ID NO: 10519 - DNA, 23 bp, Artificial Sequence
  X-linked inhibitor of apoptosis (XIAP) siRNA
tgctaattttccaagtggtagtc

SEQ ID NO: 10520 - DNA, 23 bp, Artificial Sequence
  X-linked inhibitor of apoptosis (XIAP) siRNA
gctaattttccaagtggtagtcc

SEQ ID NO: 10521 - DNA, 23 bp, Artificial Sequence
  X-linked inhibitor of apoptosis (XIAP) siRNA
ctaattttccaagtggtagtcct

SEQ ID NO: 10522 - DNA, 23 bp, Artificial Sequence
  X-linked inhibitor of apoptosis (XIAP) siRNA
taattttccaagtggtagtcctg

SEQ ID NO: 10523 - DNA, 23 bp, Artificial Sequence
  X-linked inhibitor of apoptosis (XIAP) siRNA
aattttccaagtggtagtcctgt

SEQ ID NO: 10524 - DNA, 23 bp, Artificial Sequence
  X-linked inhibitor of apoptosis (XIAP) siRNA
attttccaagtggtagtcctgtt

SEQ ID NO: 10525 - DNA, 23 bp, Artificial Sequence
  X-linked inhibitor of apoptosis (XIAP) siRNA
ttttccaagtggtagtcctgttt

SEQ ID NO: 10526 - DNA, 23 bp, Artificial Sequence
  X-linked inhibitor of apoptosis (XIAP) siRNA
tttccaagtggtagtcctgtttc

SEQ ID NO: 10527 - DNA, 23 bp, Artificial Sequence
  X-linked inhibitor of apoptosis (XIAP) siRNA
ttccaagtggtagtcctgtttca

SEQ ID NO: 10528 - DNA, 23 bp, Artificial Sequence
  X-linked inhibitor of apoptosis (XIAP) siRNA
tccaagtggtagtcctgtttcag

SEQ ID NO: 10529 - DNA, 23 bp, Artificial Sequence
  X-linked inhibitor of apoptosis (XIAP) siRNA
ccaagtggtagtcctgtttcagc

SEQ ID NO: 10530 - DNA, 23 bp, Artificial Sequence
  X-linked inhibitor of apoptosis (XIAP) siRNA
caagtggtagtcctgtttcagca

SEQ ID NO: 10531 - DNA, 23 bp, Artificial Sequence
  X-linked inhibitor of apoptosis (XIAP) siRNA
aagtggtagtcctgtttcagcat

SEQ ID NO: 10532 - DNA, 23 bp, Artificial Sequence
  X-linked inhibitor of apoptosis (XIAP) siRNA
agtggtagtcctgtttcagcatc

SEQ ID NO: 10533 - DNA, 23 bp, Artificial Sequence
  X-linked inhibitor of apoptosis (XIAP) siRNA
gtggtagtcctgtttcagcatca

SEQ ID NO: 10534 - DNA, 23 bp, Artificial Sequence
  X-linked inhibitor of apoptosis (XIAP) siRNA
tggtagtcctgtttcagcatcaa

SEQ ID NO: 10535 - DNA, 23 bp, Artificial Sequence
  X-linked inhibitor of apoptosis (XIAP) siRNA
ggtagtcctgtttcagcatcaac

SEQ ID NO: 10536 - DNA, 23 bp, Artificial Sequence
  X-linked inhibitor of apoptosis (XIAP) siRNA
gtagtcctgtttcagcatcaaca

SEQ ID NO: 10537 - DNA, 23 bp, Artificial Sequence
  X-linked inhibitor of apoptosis (XIAP) siRNA
tagtcctgtttcagcatcaacac

SEQ ID NO: 10538 - DNA, 23 bp, Artificial Sequence
  X-linked inhibitor of apoptosis (XIAP) siRNA
agtcctgtttcagcatcaacact

SEQ ID NO: 10539 - DNA, 23 bp, Artificial Sequence
  X-linked inhibitor of apoptosis (XIAP) siRNA
gtcctgtttcagcatcaacactg

SEQ ID NO: 10540 - DNA, 23 bp, Artificial Sequence
  X-linked inhibitor of apoptosis (XIAP) siRNA
tcctgtttcagcatcaacactgg

SEQ ID NO: 10541 - DNA, 23 bp, Artificial Sequence
  X-linked inhibitor of apoptosis (XIAP) siRNA
cctgtttcagcatcaacactggc

SEQ ID NO: 10542 - DNA, 23 bp, Artificial Sequence
  X-linked inhibitor of apoptosis (XIAP) siRNA
ctgtttcagcatcaacactggca

SEQ ID NO: 10543 - DNA, 23 bp, Artificial Sequence
  X-linked inhibitor of apoptosis (XIAP) siRNA
tgtttcagcatcaacactggcac

SEQ ID NO: 10544 - DNA, 23 bp, Artificial Sequence
  X-linked inhibitor of apoptosis (XIAP) siRNA
gtttcagcatcaacactggcacg

SEQ ID NO: 10545 - DNA, 23 bp, Artificial Sequence
  X-linked inhibitor of apoptosis (XIAP) siRNA
tttcagcatcaacactggcacga

SEQ ID NO: 10546 - DNA, 23 bp, Artificial Sequence
  X-linked inhibitor of apoptosis (XIAP) siRNA
ttcagcatcaacactggcacgag

SEQ ID NO: 10547 - DNA, 23 bp, Artificial Sequence
  X-linked inhibitor of apoptosis (XIAP) siRNA
tcagcatcaacactggcacgagc

SEQ ID NO: 10548 - DNA, 23 bp, Artificial Sequence
  X-linked inhibitor of apoptosis (XIAP) siRNA
cagcatcaacactggcacgagca

SEQ ID NO: 10549 - DNA, 23 bp, Artificial Sequence
  X-linked inhibitor of apoptosis (XIAP) siRNA
agcatcaacactggcacgagcag

SEQ ID NO: 10550 - DNA, 23 bp, Artificial Sequence
  X-linked inhibitor of apoptosis (XIAP) siRNA
gcatcaacactggcacgagcagg

SEQ ID NO: 10551 - DNA, 23 bp, Artificial Sequence
  X-linked inhibitor of apoptosis (XIAP) siRNA
catcaacactggcacgagcaggg

SEQ ID NO: 10552 - DNA, 23 bp, Artificial Sequence
  X-linked inhibitor of apoptosis (XIAP) siRNA
atcaacactggcacgagcagggt

SEQ ID NO: 10553 - DNA, 23 bp, Artificial Sequence
  X-linked inhibitor of apoptosis (XIAP) siRNA
tcaacactggcacgagcagggtt

SEQ ID NO: 10554 - DNA, 23 bp, Artificial Sequence
  X-linked inhibitor of apoptosis (XIAP) siRNA
caacactggcacgagcagggttt

SEQ ID NO: 10555 - DNA, 23 bp, Artificial Sequence
  X-linked inhibitor of apoptosis (XIAP) siRNA
aacactggcacgagcagggtttc

SEQ ID NO: 10556 - DNA, 23 bp, Artificial Sequence
  X-linked inhibitor of apoptosis (XIAP) siRNA
acactggcacgagcagggtttct

SEQ ID NO: 10557 - DNA, 23 bp, Artificial Sequence
  X-linked inhibitor of apoptosis (XIAP) siRNA
cactggcacgagcagggtttctt

SEQ ID NO: 10558 - DNA, 23 bp, Artificial Sequence
  X-linked inhibitor of apoptosis (XIAP) siRNA
actggcacgagcagggtttcttt

SEQ ID NO: 10559 - DNA, 23 bp, Artificial Sequence
  X-linked inhibitor of apoptosis (XIAP) siRNA
ctggcacgagcagggtttcttta

SEQ ID NO: 10560 - DNA, 23 bp, Artificial Sequence
  X-linked inhibitor of apoptosis (XIAP) siRNA
tggcacgagcagggtttctttat

SEQ ID NO: 10561 - DNA, 23 bp, Artificial Sequence
  X-linked inhibitor of apoptosis (XIAP) siRNA
ggcacgagcagggtttctttata

SEQ ID NO: 10562 - DNA, 23 bp, Artificial Sequence
  X-linked inhibitor of apoptosis (XIAP) siRNA
gcacgagcagggtttctttatac

SEQ ID NO: 10563 - DNA, 23 bp, Artificial Sequence
  X-linked inhibitor of apoptosis (XIAP) siRNA
cacgagcagggtttctttatact

SEQ ID NO: 10564 - DNA, 23 bp, Artificial Sequence
  X-linked inhibitor of apoptosis (XIAP) siRNA
acgagcagggtttctttatactg

SEQ ID NO: 10565 - DNA, 23 bp, Artificial Sequence
  X-linked inhibitor of apoptosis (XIAP) siRNA
cgagcagggtttctttatactgg

SEQ ID NO: 10566 - DNA, 23 bp, Artificial Sequence
  X-linked inhibitor of apoptosis (XIAP) siRNA
gagcagggtttctttatactggt

SEQ ID NO: 10567 - DNA, 23 bp, Artificial Sequence
  X-linked inhibitor of apoptosis (XIAP) siRNA
agcagggtttctttatactggtg

SEQ ID NO: 10568 - DNA, 23 bp, Artificial Sequence
  X-linked inhibitor of apoptosis (XIAP) siRNA
gcagggtttctttatactggtga

SEQ ID NO: 10569 - DNA, 23 bp, Artificial Sequence
  X-linked inhibitor of apoptosis (XIAP) siRNA
cagggtttctttatactggtgaa

SEQ ID NO: 10570 - DNA, 23 bp, Artificial Sequence
  X-linked inhibitor of apoptosis (XIAP) siRNA
agggtttctttatactggtgaag

SEQ ID NO: 10571 - DNA, 23 bp, Artificial Sequence
  X-linked inhibitor of apoptosis (XIAP) siRNA
gggtttctttatactggtgaagg

SEQ ID NO: 10572 - DNA, 23 bp, Artificial Sequence
  X-linked inhibitor of apoptosis (XIAP) siRNA
ggtttctttatactggtgaagga

SEQ ID NO: 10573 - DNA, 23 bp, Artificial Sequence
  X-linked inhibitor of apoptosis (XIAP) siRNA
gtttctttatactggtgaaggag

SEQ ID NO: 10574 - DNA, 23 bp, Artificial Sequence
  X-linked inhibitor of apoptosis (XIAP) siRNA
tttctttatactggtgaaggaga

SEQ ID NO: 10575 - DNA, 23 bp, Artificial Sequence
  X-linked inhibitor of apoptosis (XIAP) siRNA
ttctttatactggtgaaggagat

SEQ ID NO: 10576 - DNA, 23 bp, Artificial Sequence
  X-linked inhibitor of apoptosis (XIAP) siRNA
tctttatactggtgaaggagata

SEQ ID NO: 10577 - DNA, 23 bp, Artificial Sequence
  X-linked inhibitor of apoptosis (XIAP) siRNA
ctttatactggtgaaggagatac

SEQ ID NO: 10578 - DNA, 23 bp, Artificial Sequence
  X-linked inhibitor of apoptosis (XIAP) siRNA
tttatactggtgaaggagatacc

SEQ ID NO: 10579 - DNA, 23 bp, Artificial Sequence
  X-linked inhibitor of apoptosis (XIAP) siRNA
ttatactggtgaaggagataccg

SEQ ID NO: 10580 - DNA, 23 bp, Artificial Sequence
  X-linked inhibitor of apoptosis (XIAP) siRNA
tatactggtgaaggagataccgt

SEQ ID NO: 10581 - DNA, 23 bp, Artificial Sequence
  X-linked inhibitor of apoptosis (XIAP) siRNA
atactggtgaaggagataccgtg

SEQ ID NO: 10582 - DNA, 23 bp, Artificial Sequence
  X-linked inhibitor of apoptosis (XIAP) siRNA
tactggtgaaggagataccgtgc

SEQ ID NO: 10583 - DNA, 23 bp, Artificial Sequence
  X-linked inhibitor of apoptosis (XIAP) siRNA
actggtgaaggagataccgtgcg

SEQ ID NO: 10584 - DNA, 23 bp, Artificial Sequence
  X-linked inhibitor of apoptosis (XIAP) siRNA
ctggtgaaggagataccgtgcgg

SEQ ID NO: 10585 - DNA, 23 bp, Artificial Sequence
  X-linked inhibitor of apoptosis (XIAP) siRNA
tggtgaaggagataccgtgcggt

SEQ ID NO: 10586 - DNA, 23 bp, Artificial Sequence
  X-linked inhibitor of apoptosis (XIAP) siRNA
ggtgaaggagataccgtgcggtg

SEQ ID NO: 10587 - DNA, 23 bp, Artificial Sequence
  X-linked inhibitor of apoptosis (XIAP) siRNA
gtgaaggagataccgtgcggtgc

SEQ ID NO: 10588 - DNA, 23 bp, Artificial Sequence
  X-linked inhibitor of apoptosis (XIAP) siRNA
tgaaggagataccgtgcggtgct

SEQ ID NO: 10589 - DNA, 23 bp, Artificial Sequence
  X-linked inhibitor of apoptosis (XIAP) siRNA
gaaggagataccgtgcggtgctt

SEQ ID NO: 10590 - DNA, 23 bp, Artificial Sequence
  X-linked inhibitor of apoptosis (XIAP) siRNA
aaggagataccgtgcggtgcttt

SEQ ID NO: 10591 - DNA, 23 bp, Artificial Sequence
  X-linked inhibitor of apoptosis (XIAP) siRNA
aggagataccgtgcggtgcttta

SEQ ID NO: 10592 - DNA, 23 bp, Artificial Sequence
  X-linked inhibitor of apoptosis (XIAP) siRNA
ggagataccgtgcggtgctttag

SEQ ID NO: 10593 - DNA, 23 bp, Artificial Sequence
  X-linked inhibitor of apoptosis (XIAP) siRNA
gagataccgtgcggtgctttagt

SEQ ID NO: 10594 - DNA, 23 bp, Artificial Sequence
  X-linked inhibitor of apoptosis (XIAP) siRNA
agataccgtgcggtgctttagtt

SEQ ID NO: 10595 - DNA, 23 bp, Artificial Sequence
  X-linked inhibitor of apoptosis (XIAP) siRNA
gataccgtgcggtgctttagttg

SEQ ID NO: 10596 - DNA, 23 bp, Artificial Sequence
  X-linked inhibitor of apoptosis (XIAP) siRNA
ataccgtgcggtgctttagttgt

SEQ ID NO: 10597 - DNA, 23 bp, Artificial Sequence
  X-linked inhibitor of apoptosis (XIAP) siRNA
taccgtgcggtgctttagttgtc

SEQ ID NO: 10598 - DNA, 23 bp, Artificial Sequence
  X-linked inhibitor of apoptosis (XIAP) siRNA
accgtgcggtgctttagttgtca

SEQ ID NO: 10599 - DNA, 23 bp, Artificial Sequence
  X-linked inhibitor of apoptosis (XIAP) siRNA
ccgtgcggtgctttagttgtcat

SEQ ID NO: 10600 - DNA, 23 bp, Artificial Sequence
  X-linked inhibitor of apoptosis (XIAP) siRNA
cgtgcggtgctttagttgtcatg

SEQ ID NO: 10601 - DNA, 23 bp, Artificial Sequence
  X-linked inhibitor of apoptosis (XIAP) siRNA
gtgcggtgctttagttgtcatgc

SEQ ID NO: 10602 - DNA, 23 bp, Artificial Sequence
  X-linked inhibitor of apoptosis (XIAP) siRNA
tgcggtgctttagttgtcatgca

SEQ ID NO: 10603 - DNA, 23 bp, Artificial Sequence
  X-linked inhibitor of apoptosis (XIAP) siRNA
gcggtgctttagttgtcatgcag

SEQ ID NO: 10604 - DNA, 23 bp, Artificial Sequence
  X-linked inhibitor of apoptosis (XIAP) siRNA
cggtgctttagttgtcatgcagc

SEQ ID NO: 10605 - DNA, 23 bp, Artificial Sequence
  X-linked inhibitor of apoptosis (XIAP) siRNA
ggtgctttagttgtcatgcagct

SEQ ID NO: 10606 - DNA, 23 bp, Artificial Sequence
  X-linked inhibitor of apoptosis (XIAP) siRNA
gtgctttagttgtcatgcagctg

SEQ ID NO: 10607 - DNA, 23 bp, Artificial Sequence
  X-linked inhibitor of apoptosis (XIAP) siRNA
tgctttagttgtcatgcagctgt

SEQ ID NO: 10608 - DNA, 23 bp, Artificial Sequence
  X-linked inhibitor of apoptosis (XIAP) siRNA
gctttagttgtcatgcagctgta

SEQ ID NO: 10609 - DNA, 23 bp, Artificial Sequence
  X-linked inhibitor of apoptosis (XIAP) siRNA
ctttagttgtcatgcagctgtag

SEQ ID NO: 10610 - DNA, 23 bp, Artificial Sequence
  X-linked inhibitor of apoptosis (XIAP) siRNA
tttagttgtcatgcagctgtaga

SEQ ID NO: 10611 - DNA, 23 bp, Artificial Sequence
  X-linked inhibitor of apoptosis (XIAP) siRNA
ttagttgtcatgcagctgtagat

SEQ ID NO: 10612 - DNA, 23 bp, Artificial Sequence
  X-linked inhibitor of apoptosis (XIAP) siRNA
tagttgtcatgcagctgtagata

SEQ ID NO: 10613 - DNA, 23 bp, Artificial Sequence
  X-linked inhibitor of apoptosis (XIAP) siRNA
agttgtcatgcagctgtagatag

SEQ ID NO: 10614 - DNA, 23 bp, Artificial Sequence
  X-linked inhibitor of apoptosis (XIAP) siRNA
gttgtcatgcagctgtagataga

SEQ ID NO: 10615 - DNA, 23 bp, Artificial Sequence
  X-linked inhibitor of apoptosis (XIAP) siRNA
ttgtcatgcagctgtagatagat

SEQ ID NO: 10616 - DNA, 23 bp, Artificial Sequence
  X-linked inhibitor of apoptosis (XIAP) siRNA
tgtcatgcagctgtagatagatg

SEQ ID NO: 10617 - DNA, 23 bp, Artificial Sequence
  X-linked inhibitor of apoptosis (XIAP) siRNA
gtcatgcagctgtagatagatgg

SEQ ID NO: 10618 - DNA, 23 bp, Artificial Sequence
  X-linked inhibitor of apoptosis (XIAP) siRNA
tcatgcagctgtagatagatggc

SEQ ID NO: 10619 - DNA, 23 bp, Artificial Sequence
  X-linked inhibitor of apoptosis (XIAP) siRNA
catgcagctgtagatagatggca

SEQ ID NO: 10620 - DNA, 23 bp, Artificial Sequence
  X-linked inhibitor of apoptosis (XIAP) siRNA
atgcagctgtagatagatggcaa

SEQ ID NO: 10621 - DNA, 23 bp, Artificial Sequence
  X-linked inhibitor of apoptosis (XIAP) siRNA
tgcagctgtagatagatggcaat

SEQ ID NO: 10622 - DNA, 23 bp, Artificial Sequence
  X-linked inhibitor of apoptosis (XIAP) siRNA
gcagctgtagatagatggcaata

SEQ ID NO: 10623 - DNA, 23 bp, Artificial Sequence
  X-linked inhibitor of apoptosis (XIAP) siRNA
cagctgtagatagatggcaatat

SEQ ID NO: 10624 - DNA, 23 bp, Artificial Sequence
  X-linked inhibitor of apoptosis (XIAP) siRNA
agctgtagatagatggcaatatg

SEQ ID NO: 10625 - DNA, 23 bp, Artificial Sequence
  X-linked inhibitor of apoptosis (XIAP) siRNA
gctgtagatagatggcaatatgg

SEQ ID NO: 10626 - DNA, 23 bp, Artificial Sequence
  X-linked inhibitor of apoptosis (XIAP) siRNA
ctgtagatagatggcaatatgga

SEQ ID NO: 10627 - DNA, 23 bp, Artificial Sequence
  X-linked inhibitor of apoptosis (XIAP) siRNA
tgtagatagatggcaatatggag

SEQ ID NO: 10628 - DNA, 23 bp, Artificial Sequence
  X-linked inhibitor of apoptosis (XIAP) siRNA
gtagatagatggcaatatggaga

SEQ ID NO: 10629 - DNA, 23 bp, Artificial Sequence
  X-linked inhibitor of apoptosis (XIAP) siRNA
tagatagatggcaatatggagac

SEQ ID NO: 10630 - DNA, 23 bp, Artificial Sequence
  X-linked inhibitor of apoptosis (XIAP) siRNA
agatagatggcaatatggagact

SEQ ID NO: 10631 - DNA, 23 bp, Artificial Sequence
  X-linked inhibitor of apoptosis (XIAP) siRNA
gatagatggcaatatggagactc

SEQ ID NO: 10632 - DNA, 23 bp, Artificial Sequence
  X-linked inhibitor of apoptosis (XIAP) siRNA
atagatggcaatatggagactca

SEQ ID NO: 10633 - DNA, 23 bp, Artificial Sequence
  X-linked inhibitor of apoptosis (XIAP) siRNA
tagatggcaatatggagactcag

SEQ ID NO: 10634 - DNA, 23 bp, Artificial Sequence
  X-linked inhibitor of apoptosis (XIAP) siRNA
agatggcaatatggagactcagc

SEQ ID NO: 10635 - DNA, 23 bp, Artificial Sequence
  X-linked inhibitor of apoptosis (XIAP) siRNA
gatggcaatatggagactcagca

SEQ ID NO: 10636 - DNA, 23 bp, Artificial Sequence
  X-linked inhibitor of apoptosis (XIAP) siRNA
atggcaatatggagactcagcag

SEQ ID NO: 10637 - DNA, 23 bp, Artificial Sequence
  X-linked inhibitor of apoptosis (XIAP) siRNA
tggcaatatggagactcagcagt

SEQ ID NO: 10638 - DNA, 23 bp, Artificial Sequence
  X-linked inhibitor of apoptosis (XIAP) siRNA
ggcaatatggagactcagcagtt

SEQ ID NO: 10639 - DNA, 23 bp, Artificial Sequence
  X-linked inhibitor of apoptosis (XIAP) siRNA
gcaatatggagactcagcagttg

SEQ ID NO: 10640 - DNA, 23 bp, Artificial Sequence
  X-linked inhibitor of apoptosis (XIAP) siRNA
caatatggagactcagcagttgg

SEQ ID NO: 10641 - DNA, 23 bp, Artificial Sequence
  X-linked inhibitor of apoptosis (XIAP) siRNA
aatatggagactcagcagttgga

SEQ ID NO: 10642 - DNA, 23 bp, Artificial Sequence
  X-linked inhibitor of apoptosis (XIAP) siRNA
atatggagactcagcagttggaa

SEQ ID NO: 10643 - DNA, 23 bp, Artificial Sequence
  X-linked inhibitor of apoptosis (XIAP) siRNA
tatggagactcagcagttggaag

SEQ ID NO: 10644 - DNA, 23 bp, Artificial Sequence
  X-linked inhibitor of apoptosis (XIAP) siRNA
atggagactcagcagttggaaga

SEQ ID NO: 10645 - DNA, 23 bp, Artificial Sequence
  X-linked inhibitor of apoptosis (XIAP) siRNA
tggagactcagcagttggaagac

SEQ ID NO: 10646 - DNA, 23 bp, Artificial Sequence
  X-linked inhibitor of apoptosis (XIAP) siRNA
ggagactcagcagttggaagaca

SEQ ID NO: 10647 - DNA, 23 bp, Artificial Sequence
  X-linked inhibitor of apoptosis (XIAP) siRNA
gagactcagcagttggaagacac

SEQ ID NO: 10648 - DNA, 23 bp, Artificial Sequence
  X-linked inhibitor of apoptosis (XIAP) siRNA
agactcagcagttggaagacaca

SEQ ID NO: 10649 - DNA, 23 bp, Artificial Sequence
  X-linked inhibitor of apoptosis (XIAP) siRNA
gactcagcagttggaagacacag

SEQ ID NO: 10650 - DNA, 23 bp, Artificial Sequence
  X-linked inhibitor of apoptosis (XIAP) siRNA
actcagcagttggaagacacagg

SEQ ID NO: 10651 - DNA, 23 bp, Artificial Sequence
  X-linked inhibitor of apoptosis (XIAP) siRNA
ctcagcagttggaagacacagga

SEQ ID NO: 10652 - DNA, 23 bp, Artificial Sequence
  X-linked inhibitor of apoptosis (XIAP) siRNA
tcagcagttggaagacacaggaa

SEQ ID NO: 10653 - DNA, 23 bp, Artificial Sequence
  X-linked inhibitor of apoptosis (XIAP) siRNA
cagcagttggaagacacaggaaa

SEQ ID NO: 10654 - DNA, 23 bp, Artificial Sequence
  X-linked inhibitor of apoptosis (XIAP) siRNA
agcagttggaagacacaggaaag

SEQ ID NO: 10655 - DNA, 23 bp, Artificial Sequence
  X-linked inhibitor of apoptosis (XIAP) siRNA
gcagttggaagacacaggaaagt

SEQ ID NO: 10656 - DNA, 23 bp, Artificial Sequence
  X-linked inhibitor of apoptosis (XIAP) siRNA
cagttggaagacacaggaaagta

SEQ ID NO: 10657 - DNA, 23 bp, Artificial Sequence
  X-linked inhibitor of apoptosis (XIAP) siRNA
agttggaagacacaggaaagtat

SEQ ID NO: 10658 - DNA, 23 bp, Artificial Sequence
  X-linked inhibitor of apoptosis (XIAP) siRNA
gttggaagacacaggaaagtatc

SEQ ID NO: 10659 - DNA, 23 bp, Artificial Sequence
  X-linked inhibitor of apoptosis (XIAP) siRNA
ttggaagacacaggaaagtatcc

SEQ ID NO: 10660 - DNA, 23 bp, Artificial Sequence
  X-linked inhibitor of apoptosis (XIAP) siRNA
tggaagacacaggaaagtatccc

SEQ ID NO: 10661 - DNA, 23 bp, Artificial Sequence
  X-linked inhibitor of apoptosis (XIAP) siRNA
ggaagacacaggaaagtatcccc

SEQ ID NO: 10662 - DNA, 23 bp, Artificial Sequence
  X-linked inhibitor of apoptosis (XIAP) siRNA
gaagacacaggaaagtatcccca

SEQ ID NO: 10663 - DNA, 23 bp, Artificial Sequence
  X-linked inhibitor of apoptosis (XIAP) siRNA
aagacacaggaaagtatccccaa

SEQ ID NO: 10664 - DNA, 23 bp, Artificial Sequence
  X-linked inhibitor of apoptosis (XIAP) siRNA
agacacaggaaagtatccccaaa

SEQ ID NO: 10665 - DNA, 23 bp, Artificial Sequence
  X-linked inhibitor of apoptosis (XIAP) siRNA
gacacaggaaagtatccccaaat

SEQ ID NO: 10666 - DNA, 23 bp, Artificial Sequence
  X-linked inhibitor of apoptosis (XIAP) siRNA
acacaggaaagtatccccaaatt

SEQ ID NO: 10667 - DNA, 23 bp, Artificial Sequence
  X-linked inhibitor of apoptosis (XIAP) siRNA
cacaggaaagtatccccaaattg

SEQ ID NO: 10668 - DNA, 23 bp, Artificial Sequence
  X-linked inhibitor of apoptosis (XIAP) siRNA
acaggaaagtatccccaaattgc

SEQ ID NO: 10669 - DNA, 23 bp, Artificial Sequence
  X-linked inhibitor of apoptosis (XIAP) siRNA
caggaaagtatccccaaattgca

SEQ ID NO: 10670 - DNA, 23 bp, Artificial Sequence
  X-linked inhibitor of apoptosis (XIAP) siRNA
aggaaagtatccccaaattgcag

SEQ ID NO: 10671 - DNA, 23 bp, Artificial Sequence
  X-linked inhibitor of apoptosis (XIAP) siRNA
ggaaagtatccccaaattgcaga

SEQ ID NO: 10672 - DNA, 23 bp, Artificial Sequence
  X-linked inhibitor of apoptosis (XIAP) siRNA
gaaagtatccccaaattgcagat

SEQ ID NO: 10673 - DNA, 23 bp, Artificial Sequence
  X-linked inhibitor of apoptosis (XIAP) siRNA
aaagtatccccaaattgcagatt

SEQ ID NO: 10674 - DNA, 23 bp, Artificial Sequence
  X-linked inhibitor of apoptosis (XIAP) siRNA
aagtatccccaaattgcagattt

SEQ ID NO: 10675 - DNA, 23 bp, Artificial Sequence
  X-linked inhibitor of apoptosis (XIAP) siRNA
agtatccccaaattgcagattta

SEQ ID NO: 10676 - DNA, 23 bp, Artificial Sequence
  X-linked inhibitor of apoptosis (XIAP) siRNA
gtatccccaaattgcagatttat

SEQ ID NO: 10677 - DNA, 23 bp, Artificial Sequence
  X-linked inhibitor of apoptosis (XIAP) siRNA
tatccccaaattgcagatttatc

SEQ ID NO: 10678 - DNA, 23 bp, Artificial Sequence
  X-linked inhibitor of apoptosis (XIAP) siRNA
atccccaaattgcagatttatca

SEQ ID NO: 10679 - DNA, 23 bp, Artificial Sequence
  X-linked inhibitor of apoptosis (XIAP) siRNA
tccccaaattgcagatttatcaa

SEQ ID NO: 10680 - DNA, 23 bp, Artificial Sequence
  X-linked inhibitor of apoptosis (XIAP) siRNA
ccccaaattgcagatttatcaac

SEQ ID NO: 10681 - DNA, 23 bp, Artificial Sequence
  X-linked inhibitor of apoptosis (XIAP) siRNA
cccaaattgcagatttatcaacg

SEQ ID NO: 10682 - DNA, 23 bp, Artificial Sequence
  X-linked inhibitor of apoptosis (XIAP) siRNA
ccaaattgcagatttatcaacgg

SEQ ID NO: 10683 - DNA, 23 bp, Artificial Sequence
  X-linked inhibitor of apoptosis (XIAP) siRNA
caaattgcagatttatcaacggc

SEQ ID NO: 10684 - DNA, 23 bp, Artificial Sequence
  X-linked inhibitor of apoptosis (XIAP) siRNA
aaattgcagatttatcaacggct

SEQ ID NO: 10685 - DNA, 23 bp, Artificial Sequence
  X-linked inhibitor of apoptosis (XIAP) siRNA
aattgcagatttatcaacggctt

SEQ ID NO: 10686 - DNA, 23 bp, Artificial Sequence
  X-linked inhibitor of apoptosis (XIAP) siRNA
attgcagatttatcaacggcttt

SEQ ID NO: 10687 - DNA, 23 bp, Artificial Sequence
  X-linked inhibitor of apoptosis (XIAP) siRNA
ttgcagatttatcaacggctttt

SEQ ID NO: 10688 - DNA, 23 bp, Artificial Sequence
  X-linked inhibitor of apoptosis (XIAP) siRNA
tgcagatttatcaacggctttta

SEQ ID NO: 10689 - DNA, 23 bp, Artificial Sequence
  X-linked inhibitor of apoptosis (XIAP) siRNA
gcagatttatcaacggcttttat

SEQ ID NO: 10690 - DNA, 23 bp, Artificial Sequence
  X-linked inhibitor of apoptosis (XIAP) siRNA
cagatttatcaacggcttttatc

SEQ ID NO: 10691 - DNA, 23 bp, Artificial Sequence
  X-linked inhibitor of apoptosis (XIAP) siRNA
agatttatcaacggcttttatct

SEQ ID NO: 10692 - DNA, 23 bp, Artificial Sequence
  X-linked inhibitor of apoptosis (XIAP) siRNA
gatttatcaacggcttttatctt

SEQ ID NO: 10693 - DNA, 23 bp, Artificial Sequence
  X-linked inhibitor of apoptosis (XIAP) siRNA
atttatcaacggcttttatcttg

SEQ ID NO: 10694 - DNA, 23 bp, Artificial Sequence
  X-linked inhibitor of apoptosis (XIAP) siRNA
tttatcaacggcttttatcttga

SEQ ID NO: 10695 - DNA, 23 bp, Artificial Sequence
  X-linked inhibitor of apoptosis (XIAP) siRNA
ttatcaacggcttttatcttgaa

SEQ ID NO: 10696 - DNA, 23 bp, Artificial Sequence
  X-linked inhibitor of apoptosis (XIAP) siRNA
tatcaacggcttttatcttgaaa

SEQ ID NO: 10697 - DNA, 23 bp, Artificial Sequence
  X-linked inhibitor of apoptosis (XIAP) siRNA
atcaacggcttttatcttgaaaa

SEQ ID NO: 10698 - DNA, 23 bp, Artificial Sequence
  X-linked inhibitor of apoptosis (XIAP) siRNA
tcaacggcttttatcttgaaaat

SEQ ID NO: 10699 - DNA, 23 bp, Artificial Sequence
  X-linked inhibitor of apoptosis (XIAP) siRNA
caacggcttttatcttgaaaata

SEQ ID NO: 10700 - DNA, 23 bp, Artificial Sequence
  X-linked inhibitor of apoptosis (XIAP) siRNA
aacggcttttatcttgaaaatag

SEQ ID NO: 10701 - DNA, 23 bp, Artificial Sequence
  X-linked inhibitor of apoptosis (XIAP) siRNA
acggcttttatcttgaaaatagt

SEQ ID NO: 10702 - DNA, 23 bp, Artificial Sequence
  X-linked inhibitor of apoptosis (XIAP) siRNA
cggcttttatcttgaaaatagtg

SEQ ID NO: 10703 - DNA, 23 bp, Artificial Sequence
  X-linked inhibitor of apoptosis (XIAP) siRNA
ggcttttatcttgaaaatagtgc

SEQ ID NO: 10704 - DNA, 23 bp, Artificial Sequence
  X-linked inhibitor of apoptosis (XIAP) siRNA
gcttttatcttgaaaatagtgcc

SEQ ID NO: 10705 - DNA, 23 bp, Artificial Sequence
  X-linked inhibitor of apoptosis (XIAP) siRNA
cttttatcttgaaaatagtgcca

SEQ ID NO: 10706 - DNA, 23 bp, Artificial Sequence
  X-linked inhibitor of apoptosis (XIAP) siRNA
ttttatcttgaaaatagtgccac

SEQ ID NO: 10707 - DNA, 23 bp, Artificial Sequence
  X-linked inhibitor of apoptosis (XIAP) siRNA
tttatcttgaaaatagtgccacg

SEQ ID NO: 10708 - DNA, 23 bp, Artificial Sequence
  X-linked inhibitor of apoptosis (XIAP) siRNA
ttatcttgaaaatagtgccacgc

SEQ ID NO: 10709 - DNA, 23 bp, Artificial Sequence
  X-linked inhibitor of apoptosis (XIAP) siRNA
tatcttgaaaatagtgccacgca

SEQ ID NO: 10710 - DNA, 23 bp, Artificial Sequence
  X-linked inhibitor of apoptosis (XIAP) siRNA
atcttgaaaatagtgccacgcag

SEQ ID NO: 10711 - DNA, 23 bp, Artificial Sequence
  X-linked inhibitor of apoptosis (XIAP) siRNA
tcttgaaaatagtgccacgcagt

SEQ ID NO: 10712 - DNA, 23 bp, Artificial Sequence
  X-linked inhibitor of apoptosis (XIAP) siRNA
cttgaaaatagtgccacgcagtc

SEQ ID NO: 10713 - DNA, 23 bp, Artificial Sequence
  X-linked inhibitor of apoptosis (XIAP) siRNA
ttgaaaatagtgccacgcagtct

SEQ ID NO: 10714 - DNA, 23 bp, Artificial Sequence
  X-linked inhibitor of apoptosis (XIAP) siRNA
tgaaaatagtgccacgcagtcta

SEQ ID NO: 10715 - DNA, 23 bp, Artificial Sequence
  X-linked inhibitor of apoptosis (XIAP) siRNA
gaaaatagtgccacgcagtctac

SEQ ID NO: 10716 - DNA, 23 bp, Artificial Sequence
  X-linked inhibitor of apoptosis (XIAP) siRNA
aaaatagtgccacgcagtctaca

SEQ ID NO: 10717 - DNA, 23 bp, Artificial Sequence
  X-linked inhibitor of apoptosis (XIAP) siRNA
aaatagtgccacgcagtctacaa

SEQ ID NO: 10718 - DNA, 23 bp, Artificial Sequence
  X-linked inhibitor of apoptosis (XIAP) siRNA
aatagtgccacgcagtctacaaa

SEQ ID NO: 10719 - DNA, 23 bp, Artificial Sequence
  X-linked inhibitor of apoptosis (XIAP) siRNA
atagtgccacgcagtctacaaat

SEQ ID NO: 10720 - DNA, 23 bp, Artificial Sequence
  X-linked inhibitor of apoptosis (XIAP) siRNA
tagtgccacgcagtctacaaatt

SEQ ID NO: 10721 - DNA, 23 bp, Artificial Sequence
  X-linked inhibitor of apoptosis (XIAP) siRNA
agtgccacgcagtctacaaattc

SEQ ID NO: 10722 - DNA, 23 bp, Artificial Sequence
  X-linked inhibitor of apoptosis (XIAP) siRNA
gtgccacgcagtctacaaattct

SEQ ID NO: 10723 - DNA, 23 bp, Artificial Sequence
  X-linked inhibitor of apoptosis (XIAP) siRNA
tgccacgcagtctacaaattctg

SEQ ID NO: 10724 - DNA, 23 bp, Artificial Sequence
  X-linked inhibitor of apoptosis (XIAP) siRNA
gccacgcagtctacaaattctgg

SEQ ID NO: 10725 - DNA, 23 bp, Artificial Sequence
  X-linked inhibitor of apoptosis (XIAP) siRNA
ccacgcagtctacaaattctggt

SEQ ID NO: 10726 - DNA, 23 bp, Artificial Sequence
  X-linked inhibitor of apoptosis (XIAP) siRNA
cacgcagtctacaaattctggta

SEQ ID NO: 10727 - DNA, 23 bp, Artificial Sequence
  X-linked inhibitor of apoptosis (XIAP) siRNA
acgcagtctacaaattctggtat

SEQ ID NO: 10728 - DNA, 23 bp, Artificial Sequence
  X-linked inhibitor of apoptosis (XIAP) siRNA
cgcagtctacaaattctggtatc

SEQ ID NO: 10729 - DNA, 23 bp, Artificial Sequence
  X-linked inhibitor of apoptosis (XIAP) siRNA
gcagtctacaaattctggtatcc

SEQ ID NO: 10730 - DNA, 23 bp, Artificial Sequence
  X-linked inhibitor of apoptosis (XIAP) siRNA
cagtctacaaattctggtatcca

SEQ ID NO: 10731 - DNA, 23 bp, Artificial Sequence
  X-linked inhibitor of apoptosis (XIAP) siRNA
agtctacaaattctggtatccag

SEQ ID NO: 10732 - DNA, 23 bp, Artificial Sequence
  X-linked inhibitor of apoptosis (XIAP) siRNA
gtctacaaattctggtatccaga

SEQ ID NO: 10733 - DNA, 23 bp, Artificial Sequence
  X-linked inhibitor of apoptosis (XIAP) siRNA
tctacaaattctggtatccagaa

SEQ ID NO: 10734 - DNA, 23 bp, Artificial Sequence
  X-linked inhibitor of apoptosis (XIAP) siRNA
ctacaaattctggtatccagaat

SEQ ID NO: 10735 - DNA, 23 bp, Artificial Sequence
  X-linked inhibitor of apoptosis (XIAP) siRNA
tacaaattctggtatccagaatg

SEQ ID NO: 10736 - DNA, 23 bp, Artificial Sequence
  X-linked inhibitor of apoptosis (XIAP) siRNA
acaaattctggtatccagaatgg

SEQ ID NO: 10737 - DNA, 23 bp, Artificial Sequence
  X-linked inhibitor of apoptosis (XIAP) siRNA
caaattctggtatccagaatggt

SEQ ID NO: 10738 - DNA, 23 bp, Artificial Sequence
  X-linked inhibitor of apoptosis (XIAP) siRNA
aaattctggtatccagaatggtc

SEQ ID NO: 10739 - DNA, 23 bp, Artificial Sequence
  X-linked inhibitor of apoptosis (XIAP) siRNA
aattctggtatccagaatggtca

SEQ ID NO: 10740 - DNA, 23 bp, Artificial Sequence
  X-linked inhibitor of apoptosis (XIAP) siRNA
attctggtatccagaatggtcag

SEQ ID NO: 10741 - DNA, 23 bp, Artificial Sequence
  X-linked inhibitor of apoptosis (XIAP) siRNA
ttctggtatccagaatggtcagt

SEQ ID NO: 10742 - DNA, 23 bp, Artificial Sequence
  X-linked inhibitor of apoptosis (XIAP) siRNA
tctggtatccagaatggtcagta

SEQ ID NO: 10743 - DNA, 23 bp, Artificial Sequence
  X-linked inhibitor of apoptosis (XIAP) siRNA
ctggtatccagaatggtcagtac

SEQ ID NO: 10744 - DNA, 23 bp, Artificial Sequence
  X-linked inhibitor of apoptosis (XIAP) siRNA
tggtatccagaatggtcagtaca

SEQ ID NO: 10745 - DNA, 23 bp, Artificial Sequence
  X-linked inhibitor of apoptosis (XIAP) siRNA
ggtatccagaatggtcagtacaa

SEQ ID NO: 10746 - DNA, 23 bp, Artificial Sequence
  X-linked inhibitor of apoptosis (XIAP) siRNA
gtatccagaatggtcagtacaaa

SEQ ID NO: 10747 - DNA, 23 bp, Artificial Sequence
  X-linked inhibitor of apoptosis (XIAP) siRNA
tatccagaatggtcagtacaaag

SEQ ID NO: 10748 - DNA, 23 bp, Artificial Sequence
  X-linked inhibitor of apoptosis (XIAP) siRNA
atccagaatggtcagtacaaagt

SEQ ID NO: 10749 - DNA, 23 bp, Artificial Sequence
  X-linked inhibitor of apoptosis (XIAP) siRNA
tccagaatggtcagtacaaagtt

SEQ ID NO: 10750 - DNA, 23 bp, Artificial Sequence
  X-linked inhibitor of apoptosis (XIAP) siRNA
ccagaatggtcagtacaaagttg

SEQ ID NO: 10751 - DNA, 23 bp, Artificial Sequence
  X-linked inhibitor of apoptosis (XIAP) siRNA
cagaatggtcagtacaaagttga

SEQ ID NO: 10752 - DNA, 23 bp, Artificial Sequence
  X-linked inhibitor of apoptosis (XIAP) siRNA
agaatggtcagtacaaagttgaa

SEQ ID NO: 10753 - DNA, 23 bp, Artificial Sequence
  X-linked inhibitor of apoptosis (XIAP) siRNA
gaatggtcagtacaaagttgaaa

SEQ ID NO: 10754 - DNA, 23 bp, Artificial Sequence
  X-linked inhibitor of apoptosis (XIAP) siRNA
aatggtcagtacaaagttgaaaa

SEQ ID NO: 10755 - DNA, 23 bp, Artificial Sequence
  X-linked inhibitor of apoptosis (XIAP) siRNA
atggtcagtacaaagttgaaaac

SEQ ID NO: 10756 - DNA, 23 bp, Artificial Sequence
  X-linked inhibitor of apoptosis (XIAP) siRNA
tggtcagtacaaagttgaaaact

SEQ ID NO: 10757 - DNA, 23 bp, Artificial Sequence
  X-linked inhibitor of apoptosis (XIAP) siRNA
ggtcagtacaaagttgaaaacta

SEQ ID NO: 10758 - DNA, 23 bp, Artificial Sequence
  X-linked inhibitor of apoptosis (XIAP) siRNA
gtcagtacaaagttgaaaactat

SEQ ID NO: 10759 - DNA, 23 bp, Artificial Sequence
  X-linked inhibitor of apoptosis (XIAP) siRNA
tcagtacaaagttgaaaactatc

SEQ ID NO: 10760 - DNA, 23 bp, Artificial Sequence
  X-linked inhibitor of apoptosis (XIAP) siRNA
cagtacaaagttgaaaactatct

SEQ ID NO: 10761 - DNA, 23 bp, Artificial Sequence
  X-linked inhibitor of apoptosis (XIAP) siRNA
agtacaaagttgaaaactatctg

SEQ ID NO: 10762 - DNA, 23 bp, Artificial Sequence
  X-linked inhibitor of apoptosis (XIAP) siRNA
gtacaaagttgaaaactatctgg

SEQ ID NO: 10763 - DNA, 23 bp, Artificial Sequence
  X-linked inhibitor of apoptosis (XIAP) siRNA
tacaaagttgaaaactatctggg

SEQ ID NO: 10764 - DNA, 23 bp, Artificial Sequence
  X-linked inhibitor of apoptosis (XIAP) siRNA
acaaagttgaaaactatctggga

SEQ ID NO: 10765 - DNA, 23 bp, Artificial Sequence
  X-linked inhibitor of apoptosis (XIAP) siRNA
caaagttgaaaactatctgggaa

SEQ ID NO: 10766 - DNA, 23 bp, Artificial Sequence
  X-linked inhibitor of apoptosis (XIAP) siRNA
aaagttgaaaactatctgggaag

SEQ ID NO: 10767 - DNA, 23 bp, Artificial Sequence
  X-linked inhibitor of apoptosis (XIAP) siRNA
aagttgaaaactatctgggaagc

SEQ ID NO: 10768 - DNA, 23 bp, Artificial Sequence
  X-linked inhibitor of apoptosis (XIAP) siRNA
agttgaaaactatctgggaagca

SEQ ID NO: 10769 - DNA, 23 bp, Artificial Sequence
  X-linked inhibitor of apoptosis (XIAP) siRNA
gttgaaaactatctgggaagcag

SEQ ID NO: 10770 - DNA, 23 bp, Artificial Sequence
  X-linked inhibitor of apoptosis (XIAP) siRNA
ttgaaaactatctgggaagcaga

SEQ ID NO: 10771 - DNA, 23 bp, Artificial Sequence
  X-linked inhibitor of apoptosis (XIAP) siRNA
tgaaaactatctgggaagcagag

SEQ ID NO: 10772 - DNA, 23 bp, Artificial Sequence
  X-linked inhibitor of apoptosis (XIAP) siRNA
gaaaactatctgggaagcagaga

SEQ ID NO: 10773 - DNA, 23 bp, Artificial Sequence
  X-linked inhibitor of apoptosis (XIAP) siRNA
aaaactatctgggaagcagagat

SEQ ID NO: 10774 - DNA, 23 bp, Artificial Sequence
  X-linked inhibitor of apoptosis (XIAP) siRNA
aaactatctgggaagcagagatc

SEQ ID NO: 10775 - DNA, 23 bp, Artificial Sequence
  X-linked inhibitor of apoptosis (XIAP) siRNA
aactatctgggaagcagagatca

SEQ ID NO: 10776 - DNA, 23 bp, Artificial Sequence
  X-linked inhibitor of apoptosis (XIAP) siRNA
actatctgggaagcagagatcat

SEQ ID NO: 10777 - DNA, 23 bp, Artificial Sequence
  X-linked inhibitor of apoptosis (XIAP) siRNA
ctatctgggaagcagagatcatt

SEQ ID NO: 10778 - DNA, 23 bp, Artificial Sequence
  X-linked inhibitor of apoptosis (XIAP) siRNA
tatctgggaagcagagatcattt

SEQ ID NO: 10779 - DNA, 23 bp, Artificial Sequence
  X-linked inhibitor of apoptosis (XIAP) siRNA
atctgggaagcagagatcatttt

SEQ ID NO: 10780 - DNA, 23 bp, Artificial Sequence
  X-linked inhibitor of apoptosis (XIAP) siRNA
tctgggaagcagagatcattttg

SEQ ID NO: 10781 - DNA, 23 bp, Artificial Sequence
  X-linked inhibitor of apoptosis (XIAP) siRNA
ctgggaagcagagatcattttgc

SEQ ID NO: 10782 - DNA, 23 bp, Artificial Sequence
  X-linked inhibitor of apoptosis (XIAP) siRNA
tgggaagcagagatcattttgcc

SEQ ID NO: 10783 - DNA, 23 bp, Artificial Sequence
  X-linked inhibitor of apoptosis (XIAP) siRNA
gggaagcagagatcattttgcct

SEQ ID NO: 10784 - DNA, 23 bp, Artificial Sequence
  X-linked inhibitor of apoptosis (XIAP) siRNA
ggaagcagagatcattttgcctt

SEQ ID NO: 10785 - DNA, 23 bp, Artificial Sequence
  X-linked inhibitor of apoptosis (XIAP) siRNA
gaagcagagatcattttgcctta

SEQ ID NO: 10786 - DNA, 23 bp, Artificial Sequence
  X-linked inhibitor of apoptosis (XIAP) siRNA
aagcagagatcattttgccttag

SEQ ID NO: 10787 - DNA, 23 bp, Artificial Sequence
  X-linked inhibitor of apoptosis (XIAP) siRNA
agcagagatcattttgccttaga

SEQ ID NO: 10788 - DNA, 23 bp, Artificial Sequence
  X-linked inhibitor of apoptosis (XIAP) siRNA
gcagagatcattttgccttagac

SEQ ID NO: 10789 - DNA, 23 bp, Artificial Sequence
  X-linked inhibitor of apoptosis (XIAP) siRNA
cagagatcattttgccttagaca

SEQ ID NO: 10790 - DNA, 23 bp, Artificial Sequence
  X-linked inhibitor of apoptosis (XIAP) siRNA
agagatcattttgccttagacag

SEQ ID NO: 10791 - DNA, 23 bp, Artificial Sequence
  X-linked inhibitor of apoptosis (XIAP) siRNA
gagatcattttgccttagacagg

SEQ ID NO: 10792 - DNA, 23 bp, Artificial Sequence
  X-linked inhibitor of apoptosis (XIAP) siRNA
agatcattttgccttagacaggc

SEQ ID NO: 10793 - DNA, 23 bp, Artificial Sequence
  X-linked inhibitor of apoptosis (XIAP) siRNA
gatcattttgccttagacaggcc

SEQ ID NO: 10794 - DNA, 23 bp, Artificial Sequence
  X-linked inhibitor of apoptosis (XIAP) siRNA
atcattttgccttagacaggcca

SEQ ID NO: 10795 - DNA, 23 bp, Artificial Sequence
  X-linked inhibitor of apoptosis (XIAP) siRNA
tcattttgccttagacaggccat

SEQ ID NO: 10796 - DNA, 23 bp, Artificial Sequence
  X-linked inhibitor of apoptosis (XIAP) siRNA
cattttgccttagacaggccatc

SEQ ID NO: 10797 - DNA, 23 bp, Artificial Sequence
  X-linked inhibitor of apoptosis (XIAP) siRNA
attttgccttagacaggccatct

SEQ ID NO: 10798 - DNA, 23 bp, Artificial Sequence
  X-linked inhibitor of apoptosis (XIAP) siRNA
ttttgccttagacaggccatctg

SEQ ID NO: 10799 - DNA, 23 bp, Artificial Sequence
  X-linked inhibitor of apoptosis (XIAP) siRNA
tttgccttagacaggccatctga

SEQ ID NO: 10800 - DNA, 23 bp, Artificial Sequence
  X-linked inhibitor of apoptosis (XIAP) siRNA
ttgccttagacaggccatctgag

SEQ ID NO: 10801 - DNA, 23 bp, Artificial Sequence
  X-linked inhibitor of apoptosis (XIAP) siRNA
tgccttagacaggccatctgaga

SEQ ID NO: 10802 - DNA, 23 bp, Artificial Sequence
  X-linked inhibitor of apoptosis (XIAP) siRNA
gccttagacaggccatctgagac

SEQ ID NO: 10803 - DNA, 23 bp, Artificial Sequence
  X-linked inhibitor of apoptosis (XIAP) siRNA
ccttagacaggccatctgagaca

SEQ ID NO: 10804 - DNA, 23 bp, Artificial Sequence
  X-linked inhibitor of apoptosis (XIAP) siRNA
cttagacaggccatctgagacac

SEQ ID NO: 10805 - DNA, 23 bp, Artificial Sequence
  X-linked inhibitor of apoptosis (XIAP) siRNA
ttagacaggccatctgagacaca

SEQ ID NO: 10806 - DNA, 23 bp, Artificial Sequence
  X-linked inhibitor of apoptosis (XIAP) siRNA
tagacaggccatctgagacacat

SEQ ID NO: 10807 - DNA, 23 bp, Artificial Sequence
  X-linked inhibitor of apoptosis (XIAP) siRNA
agacaggccatctgagacacatg

SEQ ID NO: 10808 - DNA, 23 bp, Artificial Sequence
  X-linked inhibitor of apoptosis (XIAP) siRNA
gacaggccatctgagacacatgc

SEQ ID NO: 10809 - DNA, 23 bp, Artificial Sequence
  X-linked inhibitor of apoptosis (XIAP) siRNA
acaggccatctgagacacatgca

SEQ ID NO: 10810 - DNA, 23 bp, Artificial Sequence
  X-linked inhibitor of apoptosis (XIAP) siRNA
caggccatctgagacacatgcag

SEQ ID NO: 10811 - DNA, 23 bp, Artificial Sequence
  X-linked inhibitor of apoptosis (XIAP) siRNA
aggccatctgagacacatgcaga

SEQ ID NO: 10812 - DNA, 23 bp, Artificial Sequence
  X-linked inhibitor of apoptosis (XIAP) siRNA
ggccatctgagacacatgcagac

SEQ ID NO: 10813 - DNA, 23 bp, Artificial Sequence
  X-linked inhibitor of apoptosis (XIAP) siRNA
gccatctgagacacatgcagact

SEQ ID NO: 10814 - DNA, 23 bp, Artificial Sequence
  X-linked inhibitor of apoptosis (XIAP) siRNA
ccatctgagacacatgcagacta

SEQ ID NO: 10815 - DNA, 23 bp, Artificial Sequence
  X-linked inhibitor of apoptosis (XIAP) siRNA
catctgagacacatgcagactat

SEQ ID NO: 10816 - DNA, 23 bp, Artificial Sequence
  X-linked inhibitor of apoptosis (XIAP) siRNA
atctgagacacatgcagactatc

SEQ ID NO: 10817 - DNA, 23 bp, Artificial Sequence
  X-linked inhibitor of apoptosis (XIAP) siRNA
tctgagacacatgcagactatct

SEQ ID NO: 10818 - DNA, 23 bp, Artificial Sequence
  X-linked inhibitor of apoptosis (XIAP) siRNA
ctgagacacatgcagactatctt

SEQ ID NO: 10819 - DNA, 23 bp, Artificial Sequence
  X-linked inhibitor of apoptosis (XIAP) siRNA
tgagacacatgcagactatcttt

SEQ ID NO: 10820 - DNA, 23 bp, Artificial Sequence
  X-linked inhibitor of apoptosis (XIAP) siRNA
gagacacatgcagactatctttt

SEQ ID NO: 10821 - DNA, 23 bp, Artificial Sequence
  X-linked inhibitor of apoptosis (XIAP) siRNA
agacacatgcagactatcttttg

SEQ ID NO: 10822 - DNA, 23 bp, Artificial Sequence
  X-linked inhibitor of apoptosis (XIAP) siRNA
gacacatgcagactatcttttga

SEQ ID NO: 10823 - DNA, 23 bp, Artificial Sequence
  X-linked inhibitor of apoptosis (XIAP) siRNA
acacatgcagactatcttttgag

SEQ ID NO: 10824 - DNA, 23 bp, Artificial Sequence
  X-linked inhibitor of apoptosis (XIAP) siRNA
cacatgcagactatcttttgaga

SEQ ID NO: 10825 - DNA, 23 bp, Artificial Sequence
  X-linked inhibitor of apoptosis (XIAP) siRNA
acatgcagactatcttttgagaa

SEQ ID NO: 10826 - DNA, 23 bp, Artificial Sequence
  X-linked inhibitor of apoptosis (XIAP) siRNA
catgcagactatcttttgagaac

SEQ ID NO: 10827 - DNA, 23 bp, Artificial Sequence
  X-linked inhibitor of apoptosis (XIAP) siRNA
atgcagactatcttttgagaact

SEQ ID NO: 10828 - DNA, 23 bp, Artificial Sequence
  X-linked inhibitor of apoptosis (XIAP) siRNA
tgcagactatcttttgagaactg

SEQ ID NO: 10829 - DNA, 23 bp, Artificial Sequence
  X-linked inhibitor of apoptosis (XIAP) siRNA
gcagactatcttttgagaactgg

SEQ ID NO: 10830 - DNA, 23 bp, Artificial Sequence
  X-linked inhibitor of apoptosis (XIAP) siRNA
cagactatcttttgagaactggg

SEQ ID NO: 10831 - DNA, 23 bp, Artificial Sequence
  X-linked inhibitor of apoptosis (XIAP) siRNA
agactatcttttgagaactgggc

SEQ ID NO: 10832 - DNA, 23 bp, Artificial Sequence
  X-linked inhibitor of apoptosis (XIAP) siRNA
gactatcttttgagaactgggca

SEQ ID NO: 10833 - DNA, 23 bp, Artificial Sequence
  X-linked inhibitor of apoptosis (XIAP) siRNA
actatcttttgagaactgggcag

SEQ ID NO: 10834 - DNA, 23 bp, Artificial Sequence
  X-linked inhibitor of apoptosis (XIAP) siRNA
ctatcttttgagaactgggcagg

SEQ ID NO: 10835 - DNA, 23 bp, Artificial Sequence
  X-linked inhibitor of apoptosis (XIAP) siRNA
tatcttttgagaactgggcaggt

SEQ ID NO: 10836 - DNA, 23 bp, Artificial Sequence
  X-linked inhibitor of apoptosis (XIAP) siRNA
atcttttgagaactgggcaggtt

SEQ ID NO: 10837 - DNA, 23 bp, Artificial Sequence
  X-linked inhibitor of apoptosis (XIAP) siRNA
tcttttgagaactgggcaggttg

SEQ ID NO: 10838 - DNA, 23 bp, Artificial Sequence
  X-linked inhibitor of apoptosis (XIAP) siRNA
cttttgagaactgggcaggttgt

SEQ ID NO: 10839 - DNA, 23 bp, Artificial Sequence
  X-linked inhibitor of apoptosis (XIAP) siRNA
ttttgagaactgggcaggttgta

SEQ ID NO: 10840 - DNA, 23 bp, Artificial Sequence
  X-linked inhibitor of apoptosis (XIAP) siRNA
tttgagaactgggcaggttgtag

SEQ ID NO: 10841 - DNA, 23 bp, Artificial Sequence
  X-linked inhibitor of apoptosis (XIAP) siRNA
ttgagaactgggcaggttgtaga

SEQ ID NO: 10842 - DNA, 23 bp, Artificial Sequence
  X-linked inhibitor of apoptosis (XIAP) siRNA
tgagaactgggcaggttgtagat

SEQ ID NO: 10843 - DNA, 23 bp, Artificial Sequence
  X-linked inhibitor of apoptosis (XIAP) siRNA
gagaactgggcaggttgtagata

SEQ ID NO: 10844 - DNA, 23 bp, Artificial Sequence
  X-linked inhibitor of apoptosis (XIAP) siRNA
agaactgggcaggttgtagatat

SEQ ID NO: 10845 - DNA, 23 bp, Artificial Sequence
  X-linked inhibitor of apoptosis (XIAP) siRNA
gaactgggcaggttgtagatata

SEQ ID NO: 10846 - DNA, 23 bp, Artificial Sequence
  X-linked inhibitor of apoptosis (XIAP) siRNA
aactgggcaggttgtagatatat

SEQ ID NO: 10847 - DNA, 23 bp, Artificial Sequence
  X-linked inhibitor of apoptosis (XIAP) siRNA
actgggcaggttgtagatatatc

SEQ ID NO: 10848 - DNA, 23 bp, Artificial Sequence
  X-linked inhibitor of apoptosis (XIAP) siRNA
ctgggcaggttgtagatatatca

SEQ ID NO: 10849 - DNA, 23 bp, Artificial Sequence
  X-linked inhibitor of apoptosis (XIAP) siRNA
tgggcaggttgtagatatatcag

SEQ ID NO: 10850 - DNA, 23 bp, Artificial Sequence
  X-linked inhibitor of apoptosis (XIAP) siRNA
gggcaggttgtagatatatcaga

SEQ ID NO: 10851 - DNA, 23 bp, Artificial Sequence
  X-linked inhibitor of apoptosis (XIAP) siRNA
ggcaggttgtagatatatcagac

SEQ ID NO: 10852 - DNA, 23 bp, Artificial Sequence
  X-linked inhibitor of apoptosis (XIAP) siRNA
gcaggttgtagatatatcagaca

SEQ ID NO: 10853 - DNA, 23 bp, Artificial Sequence
  X-linked inhibitor of apoptosis (XIAP) siRNA
caggttgtagatatatcagacac

SEQ ID NO: 10854 - DNA, 23 bp, Artificial Sequence
  X-linked inhibitor of apoptosis (XIAP) siRNA
aggttgtagatatatcagacacc

SEQ ID NO: 10855 - DNA, 23 bp, Artificial Sequence
  X-linked inhibitor of apoptosis (XIAP) siRNA
ggttgtagatatatcagacacca

SEQ ID NO: 10856 - DNA, 23 bp, Artificial Sequence
  X-linked inhibitor of apoptosis (XIAP) siRNA
gttgtagatatatcagacaccat

SEQ ID NO: 10857 - DNA, 23 bp, Artificial Sequence
  X-linked inhibitor of apoptosis (XIAP) siRNA
ttgtagatatatcagacaccata

SEQ ID NO: 10858 - DNA, 23 bp, Artificial Sequence
  X-linked inhibitor of apoptosis (XIAP) siRNA
tgtagatatatcagacaccatat

SEQ ID NO: 10859 - DNA, 23 bp, Artificial Sequence
  X-linked inhibitor of apoptosis (XIAP) siRNA
gtagatatatcagacaccatata

SEQ ID NO: 10860 - DNA, 23 bp, Artificial Sequence
  X-linked inhibitor of apoptosis (XIAP) siRNA
tagatatatcagacaccatatac

SEQ ID NO: 10861 - DNA, 23 bp, Artificial Sequence
  X-linked inhibitor of apoptosis (XIAP) siRNA
agatatatcagacaccatatacc

SEQ ID NO: 10862 - DNA, 23 bp, Artificial Sequence
  X-linked inhibitor of apoptosis (XIAP) siRNA
gatatatcagacaccatataccc

SEQ ID NO: 10863 - DNA, 23 bp, Artificial Sequence
  X-linked inhibitor of apoptosis (XIAP) siRNA
atatatcagacaccatatacccg

SEQ ID NO: 10864 - DNA, 23 bp, Artificial Sequence
  X-linked inhibitor of apoptosis (XIAP) siRNA
tatatcagacaccatatacccga

SEQ ID NO: 10865 - DNA, 23 bp, Artificial Sequence
  X-linked inhibitor of apoptosis (XIAP) siRNA
atatcagacaccatatacccgag

SEQ ID NO: 10866 - DNA, 23 bp, Artificial Sequence
  X-linked inhibitor of apoptosis (XIAP) siRNA
tatcagacaccatatacccgagg

SEQ ID NO: 10867 - DNA, 23 bp, Artificial Sequence
  X-linked inhibitor of apoptosis (XIAP) siRNA
atcagacaccatatacccgagga

SEQ ID NO: 10868 - DNA, 23 bp, Artificial Sequence
  X-linked inhibitor of apoptosis (XIAP) siRNA
tcagacaccatatacccgaggaa

SEQ ID NO: 10869 - DNA, 23 bp, Artificial Sequence
  X-linked inhibitor of apoptosis (XIAP) siRNA
cagacaccatatacccgaggaac

SEQ ID NO: 10870 - DNA, 23 bp, Artificial Sequence
  X-linked inhibitor of apoptosis (XIAP) siRNA
agacaccatatacccgaggaacc

SEQ ID NO: 10871 - DNA, 23 bp, Artificial Sequence
  X-linked inhibitor of apoptosis (XIAP) siRNA
gacaccatatacccgaggaaccc

SEQ ID NO: 10872 - DNA, 23 bp, Artificial Sequence
  X-linked inhibitor of apoptosis (XIAP) siRNA
acaccatatacccgaggaaccct

SEQ ID NO: 10873 - DNA, 23 bp, Artificial Sequence
  X-linked inhibitor of apoptosis (XIAP) siRNA
caccatatacccgaggaaccctg

SEQ ID NO: 10874 - DNA, 23 bp, Artificial Sequence
  X-linked inhibitor of apoptosis (XIAP) siRNA
accatatacccgaggaaccctgc

SEQ ID NO: 10875 - DNA, 23 bp, Artificial Sequence
  X-linked inhibitor of apoptosis (XIAP) siRNA
ccatatacccgaggaaccctgcc

SEQ ID NO: 10876 - DNA, 23 bp, Artificial Sequence
  X-linked inhibitor of apoptosis (XIAP) siRNA
catatacccgaggaaccctgcca

SEQ ID NO: 10877 - DNA, 23 bp, Artificial Sequence
  X-linked inhibitor of apoptosis (XIAP) siRNA
atatacccgaggaaccctgccat

SEQ ID NO: 10878 - DNA, 23 bp, Artificial Sequence
  X-linked inhibitor of apoptosis (XIAP) siRNA
tatacccgaggaaccctgccatg

SEQ ID NO: 10879 - DNA, 23 bp, Artificial Sequence
  X-linked inhibitor of apoptosis (XIAP) siRNA
atacccgaggaaccctgccatgt

SEQ ID NO: 10880 - DNA, 23 bp, Artificial Sequence
  X-linked inhibitor of apoptosis (XIAP) siRNA
tacccgaggaaccctgccatgta

SEQ ID NO: 10881 - DNA, 23 bp, Artificial Sequence
  X-linked inhibitor of apoptosis (XIAP) siRNA
acccgaggaaccctgccatgtat

SEQ ID NO: 10882 - DNA, 23 bp, Artificial Sequence
  X-linked inhibitor of apoptosis (XIAP) siRNA
cccgaggaaccctgccatgtata

SEQ ID NO: 10883 - DNA, 23 bp, Artificial Sequence
  X-linked inhibitor of apoptosis (XIAP) siRNA
ccgaggaaccctgccatgtatag

SEQ ID NO: 10884 - DNA, 23 bp, Artificial Sequence
  X-linked inhibitor of apoptosis (XIAP) siRNA
cgaggaaccctgccatgtatagt

SEQ ID NO: 10885 - DNA, 23 bp, Artificial Sequence
  X-linked inhibitor of apoptosis (XIAP) siRNA
gaggaaccctgccatgtatagtg

SEQ ID NO: 10886 - DNA, 23 bp, Artificial Sequence
  X-linked inhibitor of apoptosis (XIAP) siRNA
aggaaccctgccatgtatagtga

SEQ ID NO: 10887 - DNA, 23 bp, Artificial Sequence
  X-linked inhibitor of apoptosis (XIAP) siRNA
ggaaccctgccatgtatagtgaa

SEQ ID NO: 10888 - DNA, 23 bp, Artificial Sequence
  X-linked inhibitor of apoptosis (XIAP) siRNA
gaaccctgccatgtatagtgaag

SEQ ID NO: 10889 - DNA, 23 bp, Artificial Sequence
  X-linked inhibitor of apoptosis (XIAP) siRNA
aaccctgccatgtatagtgaaga

SEQ ID NO: 10890 - DNA, 23 bp, Artificial Sequence
  X-linked inhibitor of apoptosis (XIAP) siRNA
accctgccatgtatagtgaagaa

SEQ ID NO: 10891 - DNA, 23 bp, Artificial Sequence
  X-linked inhibitor of apoptosis (XIAP) siRNA
ccctgccatgtatagtgaagaag

SEQ ID NO: 10892 - DNA, 23 bp, Artificial Sequence
  X-linked inhibitor of apoptosis (XIAP) siRNA
cctgccatgtatagtgaagaagc

SEQ ID NO: 10893 - DNA, 23 bp, Artificial Sequence
  X-linked inhibitor of apoptosis (XIAP) siRNA
ctgccatgtatagtgaagaagct

SEQ ID NO: 10894 - DNA, 23 bp, Artificial Sequence
  X-linked inhibitor of apoptosis (XIAP) siRNA
tgccatgtatagtgaagaagcta

SEQ ID NO: 10895 - DNA, 23 bp, Artificial Sequence
  X-linked inhibitor of apoptosis (XIAP) siRNA
gccatgtatagtgaagaagctag

SEQ ID NO: 10896 - DNA, 23 bp, Artificial Sequence
  X-linked inhibitor of apoptosis (XIAP) siRNA
ccatgtatagtgaagaagctaga

SEQ ID NO: 10897 - DNA, 23 bp, Artificial Sequence
  X-linked inhibitor of apoptosis (XIAP) siRNA
catgtatagtgaagaagctagat

SEQ ID NO: 10898 - DNA, 23 bp, Artificial Sequence
  X-linked inhibitor of apoptosis (XIAP) siRNA
atgtatagtgaagaagctagatt

SEQ ID NO: 10899 - DNA, 23 bp, Artificial Sequence
  X-linked inhibitor of apoptosis (XIAP) siRNA
tgtatagtgaagaagctagatta

SEQ ID NO: 10900 - DNA, 23 bp, Artificial Sequence
  X-linked inhibitor of apoptosis (XIAP) siRNA
gtatagtgaagaagctagattaa

SEQ ID NO: 10901 - DNA, 23 bp, Artificial Sequence
  X-linked inhibitor of apoptosis (XIAP) siRNA
tatagtgaagaagctagattaaa

SEQ ID NO: 10902 - DNA, 23 bp, Artificial Sequence
  X-linked inhibitor of apoptosis (XIAP) siRNA
atagtgaagaagctagattaaag

SEQ ID NO: 10903 - DNA, 23 bp, Artificial Sequence
  X-linked inhibitor of apoptosis (XIAP) siRNA
tagtgaagaagctagattaaagt

SEQ ID NO: 10904 - DNA, 23 bp, Artificial Sequence
  X-linked inhibitor of apoptosis (XIAP) siRNA
agtgaagaagctagattaaagtc

SEQ ID NO: 10905 - DNA, 23 bp, Artificial Sequence
  X-linked inhibitor of apoptosis (XIAP) siRNA
gtgaagaagctagattaaagtcc

SEQ ID NO: 10906 - DNA, 23 bp, Artificial Sequence
  X-linked inhibitor of apoptosis (XIAP) siRNA
tgaagaagctagattaaagtcct

SEQ ID NO: 10907 - DNA, 23 bp, Artificial Sequence
  X-linked inhibitor of apoptosis (XIAP) siRNA
gaagaagctagattaaagtcctt

SEQ ID NO: 10908 - DNA, 23 bp, Artificial Sequence
  X-linked inhibitor of apoptosis (XIAP) siRNA
aagaagctagattaaagtccttt

SEQ ID NO: 10909 - DNA, 23 bp, Artificial Sequence
  X-linked inhibitor of apoptosis (XIAP) siRNA
agaagctagattaaagtcctttc

SEQ ID NO: 10910 - DNA, 23 bp, Artificial Sequence
  X-linked inhibitor of apoptosis (XIAP) siRNA
gaagctagattaaagtcctttca

SEQ ID NO: 10911 - DNA, 23 bp, Artificial Sequence
  X-linked inhibitor of apoptosis (XIAP) siRNA
aagctagattaaagtcctttcag

SEQ ID NO: 10912 - DNA, 23 bp, Artificial Sequence
  X-linked inhibitor of apoptosis (XIAP) siRNA
agctagattaaagtcctttcaga

SEQ ID NO: 10913 - DNA, 23 bp, Artificial Sequence
  X-linked inhibitor of apoptosis (XIAP) siRNA
gctagattaaagtcctttcagaa

SEQ ID NO: 10914 - DNA, 23 bp, Artificial Sequence
  X-linked inhibitor of apoptosis (XIAP) siRNA
ctagattaaagtcctttcagaac

SEQ ID NO: 10915 - DNA, 23 bp, Artificial Sequence
  X-linked inhibitor of apoptosis (XIAP) siRNA
tagattaaagtcctttcagaact

SEQ ID NO: 10916 - DNA, 23 bp, Artificial Sequence
  X-linked inhibitor of apoptosis (XIAP) siRNA
agattaaagtcctttcagaactg

SEQ ID NO: 10917 - DNA, 23 bp, Artificial Sequence
  X-linked inhibitor of apoptosis (XIAP) siRNA
gattaaagtcctttcagaactgg

SEQ ID NO: 10918 - DNA, 23 bp, Artificial Sequence
  X-linked inhibitor of apoptosis (XIAP) siRNA
attaaagtcctttcagaactggc

SEQ ID NO: 10919 - DNA, 23 bp, Artificial Sequence
  X-linked inhibitor of apoptosis (XIAP) siRNA
ttaaagtcctttcagaactggcc

SEQ ID NO: 10920 - DNA, 23 bp, Artificial Sequence
  X-linked inhibitor of apoptosis (XIAP) siRNA
taaagtcctttcagaactggcca

SEQ ID NO: 10921 - DNA, 23 bp, Artificial Sequence
  X-linked inhibitor of apoptosis (XIAP) siRNA
aaagtcctttcagaactggccag

SEQ ID NO: 10922 - DNA, 23 bp, Artificial Sequence
  X-linked inhibitor of apoptosis (XIAP) siRNA
aagtcctttcagaactggccaga

SEQ ID NO: 10923 - DNA, 23 bp, Artificial Sequence
  X-linked inhibitor of apoptosis (XIAP) siRNA
agtcctttcagaactggccagac

SEQ ID NO: 10924 - DNA, 23 bp, Artificial Sequence
  X-linked inhibitor of apoptosis (XIAP) siRNA
gtcctttcagaactggccagact

SEQ ID NO: 10925 - DNA, 23 bp, Artificial Sequence
  X-linked inhibitor of apoptosis (XIAP) siRNA
tcctttcagaactggccagacta

SEQ ID NO: 10926 - DNA, 23 bp, Artificial Sequence
  X-linked inhibitor of apoptosis (XIAP) siRNA
cctttcagaactggccagactat

SEQ ID NO: 10927 - DNA, 23 bp, Artificial Sequence
  X-linked inhibitor of apoptosis (XIAP) siRNA
ctttcagaactggccagactatg

SEQ ID NO: 10928 - DNA, 23 bp, Artificial Sequence
  X-linked inhibitor of apoptosis (XIAP) siRNA
tttcagaactggccagactatgc

SEQ ID NO: 10929 - DNA, 23 bp, Artificial Sequence
  X-linked inhibitor of apoptosis (XIAP) siRNA
ttcagaactggccagactatgct

SEQ ID NO: 10930 - DNA, 23 bp, Artificial Sequence
  X-linked inhibitor of apoptosis (XIAP) siRNA
tcagaactggccagactatgctc

SEQ ID NO: 10931 - DNA, 23 bp, Artificial Sequence
  X-linked inhibitor of apoptosis (XIAP) siRNA
cagaactggccagactatgctca

SEQ ID NO: 10932 - DNA, 23 bp, Artificial Sequence
  X-linked inhibitor of apoptosis (XIAP) siRNA
agaactggccagactatgctcac

SEQ ID NO: 10933 - DNA, 23 bp, Artificial Sequence
  X-linked inhibitor of apoptosis (XIAP) siRNA
gaactggccagactatgctcacc

SEQ ID NO: 10934 - DNA, 23 bp, Artificial Sequence
  X-linked inhibitor of apoptosis (XIAP) siRNA
aactggccagactatgctcacct

SEQ ID NO: 10935 - DNA, 23 bp, Artificial Sequence
  X-linked inhibitor of apoptosis (XIAP) siRNA
actggccagactatgctcaccta

SEQ ID NO: 10936 - DNA, 23 bp, Artificial Sequence
  X-linked inhibitor of apoptosis (XIAP) siRNA
ctggccagactatgctcacctaa

SEQ ID NO: 10937 - DNA, 23 bp, Artificial Sequence
  X-linked inhibitor of apoptosis (XIAP) siRNA
tggccagactatgctcacctaac

SEQ ID NO: 10938 - DNA, 23 bp, Artificial Sequence
  X-linked inhibitor of apoptosis (XIAP) siRNA
ggccagactatgctcacctaacc

SEQ ID NO: 10939 - DNA, 23 bp, Artificial Sequence
  X-linked inhibitor of apoptosis (XIAP) siRNA
gccagactatgctcacctaaccc

SEQ ID NO: 10940 - DNA, 23 bp, Artificial Sequence
  X-linked inhibitor of apoptosis (XIAP) siRNA
ccagactatgctcacctaacccc

SEQ ID NO: 10941 - DNA, 23 bp, Artificial Sequence
  X-linked inhibitor of apoptosis (XIAP) siRNA
cagactatgctcacctaacccca

SEQ ID NO: 10942 - DNA, 23 bp, Artificial Sequence
  X-linked inhibitor of apoptosis (XIAP) siRNA
agactatgctcacctaaccccaa

SEQ ID NO: 10943 - DNA, 23 bp, Artificial Sequence
  X-linked inhibitor of apoptosis (XIAP) siRNA
gactatgctcacctaaccccaag

SEQ ID NO: 10944 - DNA, 23 bp, Artificial Sequence
  X-linked inhibitor of apoptosis (XIAP) siRNA
actatgctcacctaaccccaaga

SEQ ID NO: 10945 - DNA, 23 bp, Artificial Sequence
  X-linked inhibitor of apoptosis (XIAP) siRNA
ctatgctcacctaaccccaagag

SEQ ID NO: 10946 - DNA, 23 bp, Artificial Sequence
  X-linked inhibitor of apoptosis (XIAP) siRNA
tatgctcacctaaccccaagaga

SEQ ID NO: 10947 - DNA, 23 bp, Artificial Sequence
  X-linked inhibitor of apoptosis (XIAP) siRNA
atgctcacctaaccccaagagag

SEQ ID NO: 10948 - DNA, 23 bp, Artificial Sequence
  X-linked inhibitor of apoptosis (XIAP) siRNA
tgctcacctaaccccaagagagt

SEQ ID NO: 10949 - DNA, 23 bp, Artificial Sequence
  X-linked inhibitor of apoptosis (XIAP) siRNA
gctcacctaaccccaagagagtt

SEQ ID NO: 10950 - DNA, 23 bp, Artificial Sequence
  X-linked inhibitor of apoptosis (XIAP) siRNA
ctcacctaaccccaagagagtta

SEQ ID NO: 10951 - DNA, 23 bp, Artificial Sequence
  X-linked inhibitor of apoptosis (XIAP) siRNA
tcacctaaccccaagagagttag

SEQ ID NO: 10952 - DNA, 23 bp, Artificial Sequence
  X-linked inhibitor of apoptosis (XIAP) siRNA
cacctaaccccaagagagttagc

SEQ ID NO: 10953 - DNA, 23 bp, Artificial Sequence
  X-linked inhibitor of apoptosis (XIAP) siRNA
acctaaccccaagagagttagca

SEQ ID NO: 10954 - DNA, 23 bp, Artificial Sequence
  X-linked inhibitor of apoptosis (XIAP) siRNA
cctaaccccaagagagttagcaa

SEQ ID NO: 10955 - DNA, 23 bp, Artificial Sequence
  X-linked inhibitor of apoptosis (XIAP) siRNA
ctaaccccaagagagttagcaag

SEQ ID NO: 10956 - DNA, 23 bp, Artificial Sequence
  X-linked inhibitor of apoptosis (XIAP) siRNA
taaccccaagagagttagcaagt

SEQ ID NO: 10957 - DNA, 23 bp, Artificial Sequence
  X-linked inhibitor of apoptosis (XIAP) siRNA
aaccccaagagagttagcaagtg

SEQ ID NO: 10958 - DNA, 23 bp, Artificial Sequence
  X-linked inhibitor of apoptosis (XIAP) siRNA
accccaagagagttagcaagtgc

SEQ ID NO: 10959 - DNA, 23 bp, Artificial Sequence
  X-linked inhibitor of apoptosis (XIAP) siRNA
ccccaagagagttagcaagtgct

SEQ ID NO: 10960 - DNA, 23 bp, Artificial Sequence
  X-linked inhibitor of apoptosis (XIAP) siRNA
cccaagagagttagcaagtgctg

SEQ ID NO: 10961 - DNA, 23 bp, Artificial Sequence
  X-linked inhibitor of apoptosis (XIAP) siRNA
ccaagagagttagcaagtgctgg

SEQ ID NO: 10962 - DNA, 23 bp, Artificial Sequence
  X-linked inhibitor of apoptosis (XIAP) siRNA
caagagagttagcaagtgctgga

SEQ ID NO: 10963 - DNA, 23 bp, Artificial Sequence
  X-linked inhibitor of apoptosis (XIAP) siRNA
aagagagttagcaagtgctggac

SEQ ID NO: 10964 - DNA, 23 bp, Artificial Sequence
  X-linked inhibitor of apoptosis (XIAP) siRNA
agagagttagcaagtgctggact

SEQ ID NO: 10965 - DNA, 23 bp, Artificial Sequence
  X-linked inhibitor of apoptosis (XIAP) siRNA
gagagttagcaagtgctggactc

SEQ ID NO: 10966 - DNA, 23 bp, Artificial Sequence
  X-linked inhibitor of apoptosis (XIAP) siRNA
agagttagcaagtgctggactct

SEQ ID NO: 10967 - DNA, 23 bp, Artificial Sequence
  X-linked inhibitor of apoptosis (XIAP) siRNA
gagttagcaagtgctggactcta

SEQ ID NO: 10968 - DNA, 23 bp, Artificial Sequence
  X-linked inhibitor of apoptosis (XIAP) siRNA
agttagcaagtgctggactctac

SEQ ID NO: 10969 - DNA, 23 bp, Artificial Sequence
  X-linked inhibitor of apoptosis (XIAP) siRNA
gttagcaagtgctggactctact

SEQ ID NO: 10970 - DNA, 23 bp, Artificial Sequence
  X-linked inhibitor of apoptosis (XIAP) siRNA
ttagcaagtgctggactctacta

SEQ ID NO: 10971 - DNA, 23 bp, Artificial Sequence
  X-linked inhibitor of apoptosis (XIAP) siRNA
tagcaagtgctggactctactac

SEQ ID NO: 10972 - DNA, 23 bp, Artificial Sequence
  X-linked inhibitor of apoptosis (XIAP) siRNA
agcaagtgctggactctactaca

SEQ ID NO: 10973 - DNA, 23 bp, Artificial Sequence
  X-linked inhibitor of apoptosis (XIAP) siRNA
gcaagtgctggactctactacac

SEQ ID NO: 10974 - DNA, 23 bp, Artificial Sequence
  X-linked inhibitor of apoptosis (XIAP) siRNA
caagtgctggactctactacaca

SEQ ID NO: 10975 - DNA, 23 bp, Artificial Sequence
  X-linked inhibitor of apoptosis (XIAP) siRNA
aagtgctggactctactacacag

SEQ ID NO: 10976 - DNA, 23 bp, Artificial Sequence
  X-linked inhibitor of apoptosis (XIAP) siRNA
agtgctggactctactacacagg

SEQ ID NO: 10977 - DNA, 23 bp, Artificial Sequence
  X-linked inhibitor of apoptosis (XIAP) siRNA
gtgctggactctactacacaggt

SEQ ID NO: 10978 - DNA, 23 bp, Artificial Sequence
  X-linked inhibitor of apoptosis (XIAP) siRNA
tgctggactctactacacaggta

SEQ ID NO: 10979 - DNA, 23 bp, Artificial Sequence
  X-linked inhibitor of apoptosis (XIAP) siRNA
gctggactctactacacaggtat

SEQ ID NO: 10980 - DNA, 23 bp, Artificial Sequence
  X-linked inhibitor of apoptosis (XIAP) siRNA
ctggactctactacacaggtatt

SEQ ID NO: 10981 - DNA, 23 bp, Artificial Sequence
  X-linked inhibitor of apoptosis (XIAP) siRNA
tggactctactacacaggtattg

SEQ ID NO: 10982 - DNA, 23 bp, Artificial Sequence
  X-linked inhibitor of apoptosis (XIAP) siRNA
ggactctactacacaggtattgg

SEQ ID NO: 10983 - DNA, 23 bp, Artificial Sequence
  X-linked inhibitor of apoptosis (XIAP) siRNA
gactctactacacaggtattggt

SEQ ID NO: 10984 - DNA, 23 bp, Artificial Sequence
  X-linked inhibitor of apoptosis (XIAP) siRNA
actctactacacaggtattggtg

SEQ ID NO: 10985 - DNA, 23 bp, Artificial Sequence
  X-linked inhibitor of apoptosis (XIAP) siRNA
ctctactacacaggtattggtga

SEQ ID NO: 10986 - DNA, 23 bp, Artificial Sequence
  X-linked inhibitor of apoptosis (XIAP) siRNA
tctactacacaggtattggtgac

SEQ ID NO: 10987 - DNA, 23 bp, Artificial Sequence
  X-linked inhibitor of apoptosis (XIAP) siRNA
ctactacacaggtattggtgacc

SEQ ID NO: 10988 - DNA, 23 bp, Artificial Sequence
  X-linked inhibitor of apoptosis (XIAP) siRNA
tactacacaggtattggtgacca

SEQ ID NO: 10989 - DNA, 23 bp, Artificial Sequence
  X-linked inhibitor of apoptosis (XIAP) siRNA
actacacaggtattggtgaccaa

SEQ ID NO: 10990 - DNA, 23 bp, Artificial Sequence
  X-linked inhibitor of apoptosis (XIAP) siRNA
ctacacaggtattggtgaccaag

SEQ ID NO: 10991 - DNA, 23 bp, Artificial Sequence
  X-linked inhibitor of apoptosis (XIAP) siRNA
tacacaggtattggtgaccaagt

SEQ ID NO: 10992 - DNA, 23 bp, Artificial Sequence
  X-linked inhibitor of apoptosis (XIAP) siRNA
acacaggtattggtgaccaagtg

SEQ ID NO: 10993 - DNA, 23 bp, Artificial Sequence
  X-linked inhibitor of apoptosis (XIAP) siRNA
cacaggtattggtgaccaagtgc

SEQ ID NO: 10994 - DNA, 23 bp, Artificial Sequence
  X-linked inhibitor of apoptosis (XIAP) siRNA
acaggtattggtgaccaagtgca

SEQ ID NO: 10995 - DNA, 23 bp, Artificial Sequence
  X-linked inhibitor of apoptosis (XIAP) siRNA
caggtattggtgaccaagtgcag

SEQ ID NO: 10996 - DNA, 23 bp, Artificial Sequence
  X-linked inhibitor of apoptosis (XIAP) siRNA
aggtattggtgaccaagtgcagt

SEQ ID NO: 10997 - DNA, 23 bp, Artificial Sequence
  X-linked inhibitor of apoptosis (XIAP) siRNA
ggtattggtgaccaagtgcagtg

SEQ ID NO: 10998 - DNA, 23 bp, Artificial Sequence
  X-linked inhibitor of apoptosis (XIAP) siRNA
gtattggtgaccaagtgcagtgc

SEQ ID NO: 10999 - DNA, 23 bp, Artificial Sequence
  X-linked inhibitor of apoptosis (XIAP) siRNA
tattggtgaccaagtgcagtgct

SEQ ID NO: 11000 - DNA, 23 bp, Artificial Sequence
  X-linked inhibitor of apoptosis (XIAP) siRNA
attggtgaccaagtgcagtgctt

SEQ ID NO: 11001 - DNA, 23 bp, Artificial Sequence
  X-linked inhibitor of apoptosis (XIAP) siRNA
ttggtgaccaagtgcagtgcttt

SEQ ID NO: 11002 - DNA, 23 bp, Artificial Sequence
  X-linked inhibitor of apoptosis (XIAP) siRNA
tggtgaccaagtgcagtgctttt

SEQ ID NO: 11003 - DNA, 23 bp, Artificial Sequence
  X-linked inhibitor of apoptosis (XIAP) siRNA
ggtgaccaagtgcagtgcttttg

SEQ ID NO: 11004 - DNA, 23 bp, Artificial Sequence
  X-linked inhibitor of apoptosis (XIAP) siRNA
gtgaccaagtgcagtgcttttgt

SEQ ID NO: 11005 - DNA, 23 bp, Artificial Sequence
  X-linked inhibitor of apoptosis (XIAP) siRNA
tgaccaagtgcagtgcttttgtt

SEQ ID NO: 11006 - DNA, 23 bp, Artificial Sequence
  X-linked inhibitor of apoptosis (XIAP) siRNA
gaccaagtgcagtgcttttgttg

SEQ ID NO: 11007 - DNA, 23 bp, Artificial Sequence
  X-linked inhibitor of apoptosis (XIAP) siRNA
accaagtgcagtgcttttgttgt

SEQ ID NO: 11008 - DNA, 23 bp, Artificial Sequence
  X-linked inhibitor of apoptosis (XIAP) siRNA
ccaagtgcagtgcttttgttgtg

SEQ ID NO: 11009 - DNA, 23 bp, Artificial Sequence
  X-linked inhibitor of apoptosis (XIAP) siRNA
caagtgcagtgcttttgttgtgg

SEQ ID NO: 11010 - DNA, 23 bp, Artificial Sequence
  X-linked inhibitor of apoptosis (XIAP) siRNA
aagtgcagtgcttttgttgtggt

SEQ ID NO: 11011 - DNA, 23 bp, Artificial Sequence
  X-linked inhibitor of apoptosis (XIAP) siRNA
agtgcagtgcttttgttgtggtg

SEQ ID NO: 11012 - DNA, 23 bp, Artificial Sequence
  X-linked inhibitor of apoptosis (XIAP) siRNA
gtgcagtgcttttgttgtggtgg

SEQ ID NO: 11013 - DNA, 23 bp, Artificial Sequence
  X-linked inhibitor of apoptosis (XIAP) siRNA
tgcagtgcttttgttgtggtgga

SEQ ID NO: 11014 - DNA, 23 bp, Artificial Sequence
  X-linked inhibitor of apoptosis (XIAP) siRNA
gcagtgcttttgttgtggtggaa

SEQ ID NO: 11015 - DNA, 23 bp, Artificial Sequence
  X-linked inhibitor of apoptosis (XIAP) siRNA
cagtgcttttgttgtggtggaaa

SEQ ID NO: 11016 - DNA, 23 bp, Artificial Sequence
  X-linked inhibitor of apoptosis (XIAP) siRNA
agtgcttttgttgtggtggaaaa

SEQ ID NO: 11017 - DNA, 23 bp, Artificial Sequence
  X-linked inhibitor of apoptosis (XIAP) siRNA
gtgcttttgttgtggtggaaaac

SEQ ID NO: 11018 - DNA, 23 bp, Artificial Sequence
  X-linked inhibitor of apoptosis (XIAP) siRNA
tgcttttgttgtggtggaaaact

SEQ ID NO: 11019 - DNA, 23 bp, Artificial Sequence
  X-linked inhibitor of apoptosis (XIAP) siRNA
gcttttgttgtggtggaaaactg

SEQ ID NO: 11020 - DNA, 23 bp, Artificial Sequence
  X-linked inhibitor of apoptosis (XIAP) siRNA
cttttgttgtggtggaaaactga

SEQ ID NO: 11021 - DNA, 23 bp, Artificial Sequence
  X-linked inhibitor of apoptosis (XIAP) siRNA
ttttgttgtggtggaaaactgaa

SEQ ID NO: 11022 - DNA, 23 bp, Artificial Sequence
  X-linked inhibitor of apoptosis (XIAP) siRNA
tttgttgtggtggaaaactgaaa

SEQ ID NO: 11023 - DNA, 23 bp, Artificial Sequence
  X-linked inhibitor of apoptosis (XIAP) siRNA
ttgttgtggtggaaaactgaaaa

SEQ ID NO: 11024 - DNA, 23 bp, Artificial Sequence
  X-linked inhibitor of apoptosis (XIAP) siRNA
tgttgtggtggaaaactgaaaaa

SEQ ID NO: 11025 - DNA, 23 bp, Artificial Sequence
  X-linked inhibitor of apoptosis (XIAP) siRNA
gttgtggtggaaaactgaaaaat

SEQ ID NO: 11026 - DNA, 23 bp, Artificial Sequence
  X-linked inhibitor of apoptosis (XIAP) siRNA
ttgtggtggaaaactgaaaaatt

SEQ ID NO: 11027 - DNA, 23 bp, Artificial Sequence
  X-linked inhibitor of apoptosis (XIAP) siRNA
tgtggtggaaaactgaaaaattg

SEQ ID NO: 11028 - DNA, 23 bp, Artificial Sequence
  X-linked inhibitor of apoptosis (XIAP) siRNA
gtggtggaaaactgaaaaattgg

SEQ ID NO: 11029 - DNA, 23 bp, Artificial Sequence
  X-linked inhibitor of apoptosis (XIAP) siRNA
tggtggaaaactgaaaaattggg

SEQ ID NO: 11030 - DNA, 23 bp, Artificial Sequence
  X-linked inhibitor of apoptosis (XIAP) siRNA
ggtggaaaactgaaaaattggga

SEQ ID NO: 11031 - DNA, 23 bp, Artificial Sequence
  X-linked inhibitor of apoptosis (XIAP) siRNA
gtggaaaactgaaaaattgggaa

SEQ ID NO: 11032 - DNA, 23 bp, Artificial Sequence
  X-linked inhibitor of apoptosis (XIAP) siRNA
tggaaaactgaaaaattgggaac

SEQ ID NO: 11033 - DNA, 23 bp, Artificial Sequence
  X-linked inhibitor of apoptosis (XIAP) siRNA
ggaaaactgaaaaattgggaacc

SEQ ID NO: 11034 - DNA, 23 bp, Artificial Sequence
  X-linked inhibitor of apoptosis (XIAP) siRNA
gaaaactgaaaaattgggaacct

SEQ ID NO: 11035 - DNA, 23 bp, Artificial Sequence
  X-linked inhibitor of apoptosis (XIAP) siRNA
aaaactgaaaaattgggaacctt

SEQ ID NO: 11036 - DNA, 23 bp, Artificial Sequence
  X-linked inhibitor of apoptosis (XIAP) siRNA
aaactgaaaaattgggaaccttg

SEQ ID NO: 11037 - DNA, 23 bp, Artificial Sequence
  X-linked inhibitor of apoptosis (XIAP) siRNA
aactgaaaaattgggaaccttgt

SEQ ID NO: 11038 - DNA, 23 bp, Artificial Sequence
  X-linked inhibitor of apoptosis (XIAP) siRNA
actgaaaaattgggaaccttgtg

SEQ ID NO: 11039 - DNA, 23 bp, Artificial Sequence
  X-linked inhibitor of apoptosis (XIAP) siRNA
ctgaaaaattgggaaccttgtga

SEQ ID NO: 11040 - DNA, 23 bp, Artificial Sequence
  X-linked inhibitor of apoptosis (XIAP) siRNA
tgaaaaattgggaaccttgtgat

SEQ ID NO: 11041 - DNA, 23 bp, Artificial Sequence
  X-linked inhibitor of apoptosis (XIAP) siRNA
gaaaaattgggaaccttgtgatc

SEQ ID NO: 11042 - DNA, 23 bp, Artificial Sequence
  X-linked inhibitor of apoptosis (XIAP) siRNA
aaaaattgggaaccttgtgatcg

SEQ ID NO: 11043 - DNA, 23 bp, Artificial Sequence
  X-linked inhibitor of apoptosis (XIAP) siRNA
aaaattgggaaccttgtgatcgt

SEQ ID NO: 11044 - DNA, 23 bp, Artificial Sequence
  X-linked inhibitor of apoptosis (XIAP) siRNA
aaattgggaaccttgtgatcgtg

SEQ ID NO: 11045 - DNA, 23 bp, Artificial Sequence
  X-linked inhibitor of apoptosis (XIAP) siRNA
aattgggaaccttgtgatcgtgc

SEQ ID NO: 11046 - DNA, 23 bp, Artificial Sequence
  X-linked inhibitor of apoptosis (XIAP) siRNA
attgggaaccttgtgatcgtgcc

SEQ ID NO: 11047 - DNA, 23 bp, Artificial Sequence
  X-linked inhibitor of apoptosis (XIAP) siRNA
ttgggaaccttgtgatcgtgcct

SEQ ID NO: 11048 - DNA, 23 bp, Artificial Sequence
  X-linked inhibitor of apoptosis (XIAP) siRNA
tgggaaccttgtgatcgtgcctg

SEQ ID NO: 11049 - DNA, 23 bp, Artificial Sequence
  X-linked inhibitor of apoptosis (XIAP) siRNA
gggaaccttgtgatcgtgcctgg

SEQ ID NO: 11050 - DNA, 23 bp, Artificial Sequence
  X-linked inhibitor of apoptosis (XIAP) siRNA
ggaaccttgtgatcgtgcctggt

SEQ ID NO: 11051 - DNA, 23 bp, Artificial Sequence
  X-linked inhibitor of apoptosis (XIAP) siRNA
gaaccttgtgatcgtgcctggtc

SEQ ID NO: 11052 - DNA, 23 bp, Artificial Sequence
  X-linked inhibitor of apoptosis (XIAP) siRNA
aaccttgtgatcgtgcctggtca

SEQ ID NO: 11053 - DNA, 23 bp, Artificial Sequence
  X-linked inhibitor of apoptosis (XIAP) siRNA
accttgtgatcgtgcctggtcag

SEQ ID NO: 11054 - DNA, 23 bp, Artificial Sequence
  X-linked inhibitor of apoptosis (XIAP) siRNA
ccttgtgatcgtgcctggtcaga

SEQ ID NO: 11055 - DNA, 23 bp, Artificial Sequence
  X-linked inhibitor of apoptosis (XIAP) siRNA
cttgtgatcgtgcctggtcagaa

SEQ ID NO: 11056 - DNA, 23 bp, Artificial Sequence
  X-linked inhibitor of apoptosis (XIAP) siRNA
ttgtgatcgtgcctggtcagaac

SEQ ID NO: 11057 - DNA, 23 bp, Artificial Sequence
  X-linked inhibitor of apoptosis (XIAP) siRNA
tgtgatcgtgcctggtcagaaca

SEQ ID NO: 11058 - DNA, 23 bp, Artificial Sequence
  X-linked inhibitor of apoptosis (XIAP) siRNA
gtgatcgtgcctggtcagaacac

SEQ ID NO: 11059 - DNA, 23 bp, Artificial Sequence
  X-linked inhibitor of apoptosis (XIAP) siRNA
tgatcgtgcctggtcagaacaca

SEQ ID NO: 11060 - DNA, 23 bp, Artificial Sequence
  X-linked inhibitor of apoptosis (XIAP) siRNA
gatcgtgcctggtcagaacacag

SEQ ID NO: 11061 - DNA, 23 bp, Artificial Sequence
  X-linked inhibitor of apoptosis (XIAP) siRNA
atcgtgcctggtcagaacacagg

SEQ ID NO: 11062 - DNA, 23 bp, Artificial Sequence
  X-linked inhibitor of apoptosis (XIAP) siRNA
tcgtgcctggtcagaacacaggc

SEQ ID NO: 11063 - DNA, 23 bp, Artificial Sequence
  X-linked inhibitor of apoptosis (XIAP) siRNA
cgtgcctggtcagaacacaggcg

SEQ ID NO: 11064 - DNA, 23 bp, Artificial Sequence
  X-linked inhibitor of apoptosis (XIAP) siRNA
gtgcctggtcagaacacaggcga

SEQ ID NO: 11065 - DNA, 23 bp, Artificial Sequence
  X-linked inhibitor of apoptosis (XIAP) siRNA
tgcctggtcagaacacaggcgac

SEQ ID NO: 11066 - DNA, 23 bp, Artificial Sequence
  X-linked inhibitor of apoptosis (XIAP) siRNA
gcctggtcagaacacaggcgaca

SEQ ID NO: 11067 - DNA, 23 bp, Artificial Sequence
  X-linked inhibitor of apoptosis (XIAP) siRNA
cctggtcagaacacaggcgacac

SEQ ID NO: 11068 - DNA, 23 bp, Artificial Sequence
  X-linked inhibitor of apoptosis (XIAP) siRNA
ctggtcagaacacaggcgacact

SEQ ID NO: 11069 - DNA, 23 bp, Artificial Sequence
  X-linked inhibitor of apoptosis (XIAP) siRNA
tggtcagaacacaggcgacactt

SEQ ID NO: 11070 - DNA, 23 bp, Artificial Sequence
  X-linked inhibitor of apoptosis (XIAP) siRNA
ggtcagaacacaggcgacacttt

SEQ ID NO: 11071 - DNA, 23 bp, Artificial Sequence
  X-linked inhibitor of apoptosis (XIAP) siRNA
gtcagaacacaggcgacactttc

SEQ ID NO: 11072 - DNA, 23 bp, Artificial Sequence
  X-linked inhibitor of apoptosis (XIAP) siRNA
tcagaacacaggcgacactttcc

SEQ ID NO: 11073 - DNA, 23 bp, Artificial Sequence
  X-linked inhibitor of apoptosis (XIAP) siRNA
cagaacacaggcgacactttcct

SEQ ID NO: 11074 - DNA, 23 bp, Artificial Sequence
  X-linked inhibitor of apoptosis (XIAP) siRNA
agaacacaggcgacactttccta

SEQ ID NO: 11075 - DNA, 23 bp, Artificial Sequence
  X-linked inhibitor of apoptosis (XIAP) siRNA
gaacacaggcgacactttcctaa

SEQ ID NO: 11076 - DNA, 23 bp, Artificial Sequence
  X-linked inhibitor of apoptosis (XIAP) siRNA
aacacaggcgacactttcctaat

SEQ ID NO: 11077 - DNA, 23 bp, Artificial Sequence
  X-linked inhibitor of apoptosis (XIAP) siRNA
acacaggcgacactttcctaatt

SEQ ID NO: 11078 - DNA, 23 bp, Artificial Sequence
  X-linked inhibitor of apoptosis (XIAP) siRNA
cacaggcgacactttcctaattg

SEQ ID NO: 11079 - DNA, 23 bp, Artificial Sequence
  X-linked inhibitor of apoptosis (XIAP) siRNA
acaggcgacactttcctaattgc

SEQ ID NO: 11080 - DNA, 23 bp, Artificial Sequence
  X-linked inhibitor of apoptosis (XIAP) siRNA
caggcgacactttcctaattgct

SEQ ID NO: 11081 - DNA, 23 bp, Artificial Sequence
  X-linked inhibitor of apoptosis (XIAP) siRNA
aggcgacactttcctaattgctt

SEQ ID NO: 11082 - DNA, 23 bp, Artificial Sequence
  X-linked inhibitor of apoptosis (XIAP) siRNA
ggcgacactttcctaattgcttc

SEQ ID NO: 11083 - DNA, 23 bp, Artificial Sequence
  X-linked inhibitor of apoptosis (XIAP) siRNA
gcgacactttcctaattgcttct

SEQ ID NO: 11084 - DNA, 23 bp, Artificial Sequence
  X-linked inhibitor of apoptosis (XIAP) siRNA
cgacactttcctaattgcttctt

SEQ ID NO: 11085 - DNA, 23 bp, Artificial Sequence
  X-linked inhibitor of apoptosis (XIAP) siRNA
gacactttcctaattgcttcttt

SEQ ID NO: 11086 - DNA, 23 bp, Artificial Sequence
  X-linked inhibitor of apoptosis (XIAP) siRNA
acactttcctaattgcttctttg

SEQ ID NO: 11087 - DNA, 23 bp, Artificial Sequence
  X-linked inhibitor of apoptosis (XIAP) siRNA
cactttcctaattgcttctttgt

SEQ ID NO: 11088 - DNA, 23 bp, Artificial Sequence
  X-linked inhibitor of apoptosis (XIAP) siRNA
actttcctaattgcttctttgtt

SEQ ID NO: 11089 - DNA, 23 bp, Artificial Sequence
  X-linked inhibitor of apoptosis (XIAP) siRNA
ctttcctaattgcttctttgttt

SEQ ID NO: 11090 - DNA, 23 bp, Artificial Sequence
  X-linked inhibitor of apoptosis (XIAP) siRNA
tttcctaattgcttctttgtttt

SEQ ID NO: 11091 - DNA, 23 bp, Artificial Sequence
  X-linked inhibitor of apoptosis (XIAP) siRNA
ttcctaattgcttctttgttttg

SEQ ID NO: 11092 - DNA, 23 bp, Artificial Sequence
  X-linked inhibitor of apoptosis (XIAP) siRNA
tcctaattgcttctttgttttgg

SEQ ID NO: 11093 - DNA, 23 bp, Artificial Sequence
  X-linked inhibitor of apoptosis (XIAP) siRNA
cctaattgcttctttgttttggg

SEQ ID NO: 11094 - DNA, 23 bp, Artificial Sequence
  X-linked inhibitor of apoptosis (XIAP) siRNA
ctaattgcttctttgttttgggc

SEQ ID NO: 11095 - DNA, 23 bp, Artificial Sequence
  X-linked inhibitor of apoptosis (XIAP) siRNA
taattgcttctttgttttgggcc

SEQ ID NO: 11096 - DNA, 23 bp, Artificial Sequence
  X-linked inhibitor of apoptosis (XIAP) siRNA
aattgcttctttgttttgggccg

SEQ ID NO: 11097 - DNA, 23 bp, Artificial Sequence
  X-linked inhibitor of apoptosis (XIAP) siRNA
attgcttctttgttttgggccgg

SEQ ID NO: 11098 - DNA, 23 bp, Artificial Sequence
  X-linked inhibitor of apoptosis (XIAP) siRNA
ttgcttctttgttttgggccgga

SEQ ID NO: 11099 - DNA, 23 bp, Artificial Sequence
  X-linked inhibitor of apoptosis (XIAP) siRNA
tgcttctttgttttgggccggaa

SEQ ID NO: 11100 - DNA, 23 bp, Artificial Sequence
  X-linked inhibitor of apoptosis (XIAP) siRNA
gcttctttgttttgggccggaat

SEQ ID NO: 11101 - DNA, 23 bp, Artificial Sequence
  X-linked inhibitor of apoptosis (XIAP) siRNA
cttctttgttttgggccggaatc

SEQ ID NO: 11102 - DNA, 23 bp, Artificial Sequence
  X-linked inhibitor of apoptosis (XIAP) siRNA
ttctttgttttgggccggaatct

SEQ ID NO: 11103 - DNA, 23 bp, Artificial Sequence
  X-linked inhibitor of apoptosis (XIAP) siRNA
tctttgttttgggccggaatctt

SEQ ID NO: 11104 - DNA, 23 bp, Artificial Sequence
  X-linked inhibitor of apoptosis (XIAP) siRNA
ctttgttttgggccggaatctta

SEQ ID NO: 11105 - DNA, 23 bp, Artificial Sequence
  X-linked inhibitor of apoptosis (XIAP) siRNA
tttgttttgggccggaatcttaa

SEQ ID NO: 11106 - DNA, 23 bp, Artificial Sequence
  X-linked inhibitor of apoptosis (XIAP) siRNA
ttgttttgggccggaatcttaat

SEQ ID NO: 11107 - DNA, 23 bp, Artificial Sequence
  X-linked inhibitor of apoptosis (XIAP) siRNA
tgttttgggccggaatcttaata

SEQ ID NO: 11108 - DNA, 23 bp, Artificial Sequence
  X-linked inhibitor of apoptosis (XIAP) siRNA
gttttgggccggaatcttaatat

SEQ ID NO: 11109 - DNA, 23 bp, Artificial Sequence
  X-linked inhibitor of apoptosis (XIAP) siRNA
ttttgggccggaatcttaatatt

SEQ ID NO: 11110 - DNA, 23 bp, Artificial Sequence
  X-linked inhibitor of apoptosis (XIAP) siRNA
tttgggccggaatcttaatattc

SEQ ID NO: 11111 - DNA, 23 bp, Artificial Sequence
  X-linked inhibitor of apoptosis (XIAP) siRNA
ttgggccggaatcttaatattcg

SEQ ID NO: 11112 - DNA, 23 bp, Artificial Sequence
  X-linked inhibitor of apoptosis (XIAP) siRNA
tgggccggaatcttaatattcga

SEQ ID NO: 11113 - DNA, 23 bp, Artificial Sequence
  X-linked inhibitor of apoptosis (XIAP) siRNA
gggccggaatcttaatattcgaa

SEQ ID NO: 11114 - DNA, 23 bp, Artificial Sequence
  X-linked inhibitor of apoptosis (XIAP) siRNA
ggccggaatcttaatattcgaag

SEQ ID NO: 11115 - DNA, 23 bp, Artificial Sequence
  X-linked inhibitor of apoptosis (XIAP) siRNA
gccggaatcttaatattcgaagt

SEQ ID NO: 11116 - DNA, 23 bp, Artificial Sequence
  X-linked inhibitor of apoptosis (XIAP) siRNA
ccggaatcttaatattcgaagtg

SEQ ID NO: 11117 - DNA, 23 bp, Artificial Sequence
  X-linked inhibitor of apoptosis (XIAP) siRNA
cggaatcttaatattcgaagtga

SEQ ID NO: 11118 - DNA, 23 bp, Artificial Sequence
  X-linked inhibitor of apoptosis (XIAP) siRNA
ggaatcttaatattcgaagtgaa

SEQ ID NO: 11119 - DNA, 23 bp, Artificial Sequence
  X-linked inhibitor of apoptosis (XIAP) siRNA
gaatcttaatattcgaagtgaat

SEQ ID NO: 11120 - DNA, 23 bp, Artificial Sequence
  X-linked inhibitor of apoptosis (XIAP) siRNA
aatcttaatattcgaagtgaatc

SEQ ID NO: 11121 - DNA, 23 bp, Artificial Sequence
  X-linked inhibitor of apoptosis (XIAP) siRNA
atcttaatattcgaagtgaatct

SEQ ID NO: 11122 - DNA, 23 bp, Artificial Sequence
  X-linked inhibitor of apoptosis (XIAP) siRNA
tcttaatattcgaagtgaatctg

SEQ ID NO: 11123 - DNA, 23 bp, Artificial Sequence
  X-linked inhibitor of apoptosis (XIAP) siRNA
cttaatattcgaagtgaatctga

SEQ ID NO: 11124 - DNA, 23 bp, Artificial Sequence
  X-linked inhibitor of apoptosis (XIAP) siRNA
ttaatattcgaagtgaatctgat

SEQ ID NO: 11125 - DNA, 23 bp, Artificial Sequence
  X-linked inhibitor of apoptosis (XIAP) siRNA
taatattcgaagtgaatctgatg

SEQ ID NO: 11126 - DNA, 23 bp, Artificial Sequence
  X-linked inhibitor of apoptosis (XIAP) siRNA
aatattcgaagtgaatctgatgc

SEQ ID NO: 11127 - DNA, 23 bp, Artificial Sequence
  X-linked inhibitor of apoptosis (XIAP) siRNA
atattcgaagtgaatctgatgct

SEQ ID NO: 11128 - DNA, 23 bp, Artificial Sequence
  X-linked inhibitor of apoptosis (XIAP) siRNA
tattcgaagtgaatctgatgctg

SEQ ID NO: 11129 - DNA, 23 bp, Artificial Sequence
  X-linked inhibitor of apoptosis (XIAP) siRNA
attcgaagtgaatctgatgctgt

SEQ ID NO: 11130 - DNA, 23 bp, Artificial Sequence
  X-linked inhibitor of apoptosis (XIAP) siRNA
ttcgaagtgaatctgatgctgtg

SEQ ID NO: 11131 - DNA, 23 bp, Artificial Sequence
  X-linked inhibitor of apoptosis (XIAP) siRNA
tcgaagtgaatctgatgctgtga

SEQ ID NO: 11132 - DNA, 23 bp, Artificial Sequence
  X-linked inhibitor of apoptosis (XIAP) siRNA
cgaagtgaatctgatgctgtgag

SEQ ID NO: 11133 - DNA, 23 bp, Artificial Sequence
  X-linked inhibitor of apoptosis (XIAP) siRNA
gaagtgaatctgatgctgtgagt

SEQ ID NO: 11134 - DNA, 23 bp, Artificial Sequence
  X-linked inhibitor of apoptosis (XIAP) siRNA
aagtgaatctgatgctgtgagtt

SEQ ID NO: 11135 - DNA, 23 bp, Artificial Sequence
  X-linked inhibitor of apoptosis (XIAP) siRNA
agtgaatctgatgctgtgagttc

SEQ ID NO: 11136 - DNA, 23 bp, Artificial Sequence
  X-linked inhibitor of apoptosis (XIAP) siRNA
gtgaatctgatgctgtgagttct

SEQ ID NO: 11137 - DNA, 23 bp, Artificial Sequence
  X-linked inhibitor of apoptosis (XIAP) siRNA
tgaatctgatgctgtgagttctg

SEQ ID NO: 11138 - DNA, 23 bp, Artificial Sequence
  X-linked inhibitor of apoptosis (XIAP) siRNA
gaatctgatgctgtgagttctga

SEQ ID NO: 11139 - DNA, 23 bp, Artificial Sequence
  X-linked inhibitor of apoptosis (XIAP) siRNA
aatctgatgctgtgagttctgat

SEQ ID NO: 11140 - DNA, 23 bp, Artificial Sequence
  X-linked inhibitor of apoptosis (XIAP) siRNA
atctgatgctgtgagttctgata

SEQ ID NO: 11141 - DNA, 23 bp, Artificial Sequence
  X-linked inhibitor of apoptosis (XIAP) siRNA
tctgatgctgtgagttctgatag

SEQ ID NO: 11142 - DNA, 23 bp, Artificial Sequence
  X-linked inhibitor of apoptosis (XIAP) siRNA
ctgatgctgtgagttctgatagg

SEQ ID NO: 11143 - DNA, 23 bp, Artificial Sequence
  X-linked inhibitor of apoptosis (XIAP) siRNA
tgatgctgtgagttctgatagga

SEQ ID NO: 11144 - DNA, 23 bp, Artificial Sequence
  X-linked inhibitor of apoptosis (XIAP) siRNA
gatgctgtgagttctgataggaa

SEQ ID NO: 11145 - DNA, 23 bp, Artificial Sequence
  X-linked inhibitor of apoptosis (XIAP) siRNA
atgctgtgagttctgataggaat

SEQ ID NO: 11146 - DNA, 23 bp, Artificial Sequence
  X-linked inhibitor of apoptosis (XIAP) siRNA
tgctgtgagttctgataggaatt

SEQ ID NO: 11147 - DNA, 23 bp, Artificial Sequence
  X-linked inhibitor of apoptosis (XIAP) siRNA
gctgtgagttctgataggaattt

SEQ ID NO: 11148 - DNA, 23 bp, Artificial Sequence
  X-linked inhibitor of apoptosis (XIAP) siRNA
ctgtgagttctgataggaatttc

SEQ ID NO: 11149 - DNA, 23 bp, Artificial Sequence
  X-linked inhibitor of apoptosis (XIAP) siRNA
tgtgagttctgataggaatttcc

SEQ ID NO: 11150 - DNA, 23 bp, Artificial Sequence
  X-linked inhibitor of apoptosis (XIAP) siRNA
gtgagttctgataggaatttccc

SEQ ID NO: 11151 - DNA, 23 bp, Artificial Sequence
  X-linked inhibitor of apoptosis (XIAP) siRNA
tgagttctgataggaatttccca

SEQ ID NO: 11152 - DNA, 23 bp, Artificial Sequence
  X-linked inhibitor of apoptosis (XIAP) siRNA
gagttctgataggaatttcccaa

SEQ ID NO: 11153 - DNA, 23 bp, Artificial Sequence
  X-linked inhibitor of apoptosis (XIAP) siRNA
agttctgataggaatttcccaaa

SEQ ID NO: 11154 - DNA, 23 bp, Artificial Sequence
  X-linked inhibitor of apoptosis (XIAP) siRNA
gttctgataggaatttcccaaat

SEQ ID NO: 11155 - DNA, 23 bp, Artificial Sequence
  X-linked inhibitor of apoptosis (XIAP) siRNA
ttctgataggaatttcccaaatt

SEQ ID NO: 11156 - DNA, 23 bp, Artificial Sequence
  X-linked inhibitor of apoptosis (XIAP) siRNA
tctgataggaatttcccaaattc

SEQ ID NO: 11157 - DNA, 23 bp, Artificial Sequence
  X-linked inhibitor of apoptosis (XIAP) siRNA
ctgataggaatttcccaaattca

SEQ ID NO: 11158 - DNA, 23 bp, Artificial Sequence
  X-linked inhibitor of apoptosis (XIAP) siRNA
tgataggaatttcccaaattcaa

SEQ ID NO: 11159 - DNA, 23 bp, Artificial Sequence
  X-linked inhibitor of apoptosis (XIAP) siRNA
gataggaatttcccaaattcaac

SEQ ID NO: 11160 - DNA, 23 bp, Artificial Sequence
  X-linked inhibitor of apoptosis (XIAP) siRNA
ataggaatttcccaaattcaaca

SEQ ID NO: 11161 - DNA, 23 bp, Artificial Sequence
  X-linked inhibitor of apoptosis (XIAP) siRNA
taggaatttcccaaattcaacaa

SEQ ID NO: 11162 - DNA, 23 bp, Artificial Sequence
  X-linked inhibitor of apoptosis (XIAP) siRNA
aggaatttcccaaattcaacaaa

SEQ ID NO: 11163 - DNA, 23 bp, Artificial Sequence
  X-linked inhibitor of apoptosis (XIAP) siRNA
ggaatttcccaaattcaacaaat

SEQ ID NO: 11164 - DNA, 23 bp, Artificial Sequence
  X-linked inhibitor of apoptosis (XIAP) siRNA
gaatttcccaaattcaacaaatc

SEQ ID NO: 11165 - DNA, 23 bp, Artificial Sequence
  X-linked inhibitor of apoptosis (XIAP) siRNA
aatttcccaaattcaacaaatct

SEQ ID NO: 11166 - DNA, 23 bp, Artificial Sequence
  X-linked inhibitor of apoptosis (XIAP) siRNA
atttcccaaattcaacaaatctt

SEQ ID NO: 11167 - DNA, 23 bp, Artificial Sequence
  X-linked inhibitor of apoptosis (XIAP) siRNA
tttcccaaattcaacaaatcttc

SEQ ID NO: 11168 - DNA, 23 bp, Artificial Sequence
  X-linked inhibitor of apoptosis (XIAP) siRNA
ttcccaaattcaacaaatcttcc

SEQ ID NO: 11169 - DNA, 23 bp, Artificial Sequence
  X-linked inhibitor of apoptosis (XIAP) siRNA
tcccaaattcaacaaatcttcca

SEQ ID NO: 11170 - DNA, 23 bp, Artificial Sequence
  X-linked inhibitor of apoptosis (XIAP) siRNA
cccaaattcaacaaatcttccaa

SEQ ID NO: 11171 - DNA, 23 bp, Artificial Sequence
  X-linked inhibitor of apoptosis (XIAP) siRNA
ccaaattcaacaaatcttccaag

SEQ ID NO: 11172 - DNA, 23 bp, Artificial Sequence
  X-linked inhibitor of apoptosis (XIAP) siRNA
caaattcaacaaatcttccaaga

SEQ ID NO: 11173 - DNA, 23 bp, Artificial Sequence
  X-linked inhibitor of apoptosis (XIAP) siRNA
aaattcaacaaatcttccaagaa

SEQ ID NO: 11174 - DNA, 23 bp, Artificial Sequence
  X-linked inhibitor of apoptosis (XIAP) siRNA
aattcaacaaatcttccaagaaa

SEQ ID NO: 11175 - DNA, 23 bp, Artificial Sequence
  X-linked inhibitor of apoptosis (XIAP) siRNA
attcaacaaatcttccaagaaat

SEQ ID NO: 11176 - DNA, 23 bp, Artificial Sequence
  X-linked inhibitor of apoptosis (XIAP) siRNA
ttcaacaaatcttccaagaaatc

SEQ ID NO: 11177 - DNA, 23 bp, Artificial Sequence
  X-linked inhibitor of apoptosis (XIAP) siRNA
tcaacaaatcttccaagaaatcc

SEQ ID NO: 11178 - DNA, 23 bp, Artificial Sequence
  X-linked inhibitor of apoptosis (XIAP) siRNA
caacaaatcttccaagaaatcca

SEQ ID NO: 11179 - DNA, 23 bp, Artificial Sequence
  X-linked inhibitor of apoptosis (XIAP) siRNA
aacaaatcttccaagaaatccat

SEQ ID NO: 11180 - DNA, 23 bp, Artificial Sequence
  X-linked inhibitor of apoptosis (XIAP) siRNA
acaaatcttccaagaaatccatc

SEQ ID NO: 11181 - DNA, 23 bp, Artificial Sequence
  X-linked inhibitor of apoptosis (XIAP) siRNA
caaatcttccaagaaatccatcc

SEQ ID NO: 11182 - DNA, 23 bp, Artificial Sequence
  X-linked inhibitor of apoptosis (XIAP) siRNA
aaatcttccaagaaatccatcca

SEQ ID NO: 11183 - DNA, 23 bp, Artificial Sequence
  X-linked inhibitor of apoptosis (XIAP) siRNA
aatcttccaagaaatccatccat

SEQ ID NO: 11184 - DNA, 23 bp, Artificial Sequence
  X-linked inhibitor of apoptosis (XIAP) siRNA
atcttccaagaaatccatccatg

SEQ ID NO: 11185 - DNA, 23 bp, Artificial Sequence
  X-linked inhibitor of apoptosis (XIAP) siRNA
tcttccaagaaatccatccatgg

SEQ ID NO: 11186 - DNA, 23 bp, Artificial Sequence
  X-linked inhibitor of apoptosis (XIAP) siRNA
cttccaagaaatccatccatggc

SEQ ID NO: 11187 - DNA, 23 bp, Artificial Sequence
  X-linked inhibitor of apoptosis (XIAP) siRNA
ttccaagaaatccatccatggca

SEQ ID NO: 11188 - DNA, 23 bp, Artificial Sequence
  X-linked inhibitor of apoptosis (XIAP) siRNA
tccaagaaatccatccatggcag

SEQ ID NO: 11189 - DNA, 23 bp, Artificial Sequence
  X-linked inhibitor of apoptosis (XIAP) siRNA
ccaagaaatccatccatggcaga

SEQ ID NO: 11190 - DNA, 23 bp, Artificial Sequence
  X-linked inhibitor of apoptosis (XIAP) siRNA
caagaaatccatccatggcagat

SEQ ID NO: 11191 - DNA, 23 bp, Artificial Sequence
  X-linked inhibitor of apoptosis (XIAP) siRNA
aagaaatccatccatggcagatt

SEQ ID NO: 11192 - DNA, 23 bp, Artificial Sequence
  X-linked inhibitor of apoptosis (XIAP) siRNA
agaaatccatccatggcagatta

SEQ ID NO: 11193 - DNA, 23 bp, Artificial Sequence
  X-linked inhibitor of apoptosis (XIAP) siRNA
gaaatccatccatggcagattat

SEQ ID NO: 11194 - DNA, 23 bp, Artificial Sequence
  X-linked inhibitor of apoptosis (XIAP) siRNA
aaatccatccatggcagattatg

SEQ ID NO: 11195 - DNA, 23 bp, Artificial Sequence
  X-linked inhibitor of apoptosis (XIAP) siRNA
aatccatccatggcagattatga

SEQ ID NO: 11196 - DNA, 23 bp, Artificial Sequence
  X-linked inhibitor of apoptosis (XIAP) siRNA
atccatccatggcagattatgaa

SEQ ID NO: 11197 - DNA, 23 bp, Artificial Sequence
  X-linked inhibitor of apoptosis (XIAP) siRNA
tccatccatggcagattatgaag

SEQ ID NO: 11198 - DNA, 23 bp, Artificial Sequence
  X-linked inhibitor of apoptosis (XIAP) siRNA
ccatccatggcagattatgaagc

SEQ ID NO: 11199 - DNA, 23 bp, Artificial Sequence
  X-linked inhibitor of apoptosis (XIAP) siRNA
catccatggcagattatgaagca

SEQ ID NO: 11200 - DNA, 23 bp, Artificial Sequence
  X-linked inhibitor of apoptosis (XIAP) siRNA
atccatggcagattatgaagcac

SEQ ID NO: 11201 - DNA, 23 bp, Artificial Sequence
  X-linked inhibitor of apoptosis (XIAP) siRNA
tccatggcagattatgaagcacg

SEQ ID NO: 11202 - DNA, 23 bp, Artificial Sequence
  X-linked inhibitor of apoptosis (XIAP) siRNA
ccatggcagattatgaagcacgg

SEQ ID NO: 11203 - DNA, 23 bp, Artificial Sequence
  X-linked inhibitor of apoptosis (XIAP) siRNA
catggcagattatgaagcacgga

SEQ ID NO: 11204 - DNA, 23 bp, Artificial Sequence
  X-linked inhibitor of apoptosis (XIAP) siRNA
atggcagattatgaagcacggat

SEQ ID NO: 11205 - DNA, 23 bp, Artificial Sequence
  X-linked inhibitor of apoptosis (XIAP) siRNA
tggcagattatgaagcacggatc

SEQ ID NO: 11206 - DNA, 23 bp, Artificial Sequence
  X-linked inhibitor of apoptosis (XIAP) siRNA
ggcagattatgaagcacggatct

SEQ ID NO: 11207 - DNA, 23 bp, Artificial Sequence
  X-linked inhibitor of apoptosis (XIAP) siRNA
gcagattatgaagcacggatctt

SEQ ID NO: 11208 - DNA, 23 bp, Artificial Sequence
  X-linked inhibitor of apoptosis (XIAP) siRNA
cagattatgaagcacggatcttt

SEQ ID NO: 11209 - DNA, 23 bp, Artificial Sequence
  X-linked inhibitor of apoptosis (XIAP) siRNA
agattatgaagcacggatcttta

SEQ ID NO: 11210 - DNA, 23 bp, Artificial Sequence
  X-linked inhibitor of apoptosis (XIAP) siRNA
gattatgaagcacggatctttac

SEQ ID NO: 11211 - DNA, 23 bp, Artificial Sequence
  X-linked inhibitor of apoptosis (XIAP) siRNA
attatgaagcacggatctttact

SEQ ID NO: 11212 - DNA, 23 bp, Artificial Sequence
  X-linked inhibitor of apoptosis (XIAP) siRNA
ttatgaagcacggatctttactt

SEQ ID NO: 11213 - DNA, 23 bp, Artificial Sequence
  X-linked inhibitor of apoptosis (XIAP) siRNA
tatgaagcacggatctttacttt

SEQ ID NO: 11214 - DNA, 23 bp, Artificial Sequence
  X-linked inhibitor of apoptosis (XIAP) siRNA
atgaagcacggatctttactttt

SEQ ID NO: 11215 - DNA, 23 bp, Artificial Sequence
  X-linked inhibitor of apoptosis (XIAP) siRNA
tgaagcacggatctttacttttg

SEQ ID NO: 11216 - DNA, 23 bp, Artificial Sequence
  X-linked inhibitor of apoptosis (XIAP) siRNA
gaagcacggatctttacttttgg

SEQ ID NO: 11217 - DNA, 23 bp, Artificial Sequence
  X-linked inhibitor of apoptosis (XIAP) siRNA
aagcacggatctttacttttggg

SEQ ID NO: 11218 - DNA, 23 bp, Artificial Sequence
  X-linked inhibitor of apoptosis (XIAP) siRNA
agcacggatctttacttttggga

SEQ ID NO: 11219 - DNA, 23 bp, Artificial Sequence
  X-linked inhibitor of apoptosis (XIAP) siRNA
gcacggatctttacttttgggac

SEQ ID NO: 11220 - DNA, 23 bp, Artificial Sequence
  X-linked inhibitor of apoptosis (XIAP) siRNA
cacggatctttacttttgggaca

SEQ ID NO: 11221 - DNA, 23 bp, Artificial Sequence
  X-linked inhibitor of apoptosis (XIAP) siRNA
acggatctttacttttgggacat

SEQ ID NO: 11222 - DNA, 23 bp, Artificial Sequence
  X-linked inhibitor of apoptosis (XIAP) siRNA
cggatctttacttttgggacatg

SEQ ID NO: 11223 - DNA, 23 bp, Artificial Sequence
  X-linked inhibitor of apoptosis (XIAP) siRNA
ggatctttacttttgggacatgg

SEQ ID NO: 11224 - DNA, 23 bp, Artificial Sequence
  X-linked inhibitor of apoptosis (XIAP) siRNA
gatctttacttttgggacatgga

SEQ ID NO: 11225 - DNA, 23 bp, Artificial Sequence
  X-linked inhibitor of apoptosis (XIAP) siRNA
atctttacttttgggacatggat

SEQ ID NO: 11226 - DNA, 23 bp, Artificial Sequence
  X-linked inhibitor of apoptosis (XIAP) siRNA
tctttacttttgggacatggata

SEQ ID NO: 11227 - DNA, 23 bp, Artificial Sequence
  X-linked inhibitor of apoptosis (XIAP) siRNA
ctttacttttgggacatggatat

SEQ ID NO: 11228 - DNA, 23 bp, Artificial Sequence
  X-linked inhibitor of apoptosis (XIAP) siRNA
tttacttttgggacatggatata

SEQ ID NO: 11229 - DNA, 23 bp, Artificial Sequence
  X-linked inhibitor of apoptosis (XIAP) siRNA
ttacttttgggacatggatatac

SEQ ID NO: 11230 - DNA, 23 bp, Artificial Sequence
  X-linked inhibitor of apoptosis (XIAP) siRNA
tacttttgggacatggatatact

SEQ ID NO: 11231 - DNA, 23 bp, Artificial Sequence
  X-linked inhibitor of apoptosis (XIAP) siRNA
acttttgggacatggatatactc

SEQ ID NO: 11232 - DNA, 23 bp, Artificial Sequence
  X-linked inhibitor of apoptosis (XIAP) siRNA
cttttgggacatggatatactca

SEQ ID NO: 11233 - DNA, 23 bp, Artificial Sequence
  X-linked inhibitor of apoptosis (XIAP) siRNA
ttttgggacatggatatactcag

SEQ ID NO: 11234 - DNA, 23 bp, Artificial Sequence
  X-linked inhibitor of apoptosis (XIAP) siRNA
tttgggacatggatatactcagt

SEQ ID NO: 11235 - DNA, 23 bp, Artificial Sequence
  X-linked inhibitor of apoptosis (XIAP) siRNA
ttgggacatggatatactcagtt

SEQ ID NO: 11236 - DNA, 23 bp, Artificial Sequence
  X-linked inhibitor of apoptosis (XIAP) siRNA
tgggacatggatatactcagtta

SEQ ID NO: 11237 - DNA, 23 bp, Artificial Sequence
  X-linked inhibitor of apoptosis (XIAP) siRNA
gggacatggatatactcagttaa

SEQ ID NO: 11238 - DNA, 23 bp, Artificial Sequence
  X-linked inhibitor of apoptosis (XIAP) siRNA
ggacatggatatactcagttaac

SEQ ID NO: 11239 - DNA, 23 bp, Artificial Sequence
  X-linked inhibitor of apoptosis (XIAP) siRNA
gacatggatatactcagttaaca

SEQ ID NO: 11240 - DNA, 23 bp, Artificial Sequence
  X-linked inhibitor of apoptosis (XIAP) siRNA
acatggatatactcagttaacaa

SEQ ID NO: 11241 - DNA, 23 bp, Artificial Sequence
  X-linked inhibitor of apoptosis (XIAP) siRNA
catggatatactcagttaacaag

SEQ ID NO: 11242 - DNA, 23 bp, Artificial Sequence
  X-linked inhibitor of apoptosis (XIAP) siRNA
atggatatactcagttaacaagg

SEQ ID NO: 11243 - DNA, 23 bp, Artificial Sequence
  X-linked inhibitor of apoptosis (XIAP) siRNA
tggatatactcagttaacaagga

SEQ ID NO: 11244 - DNA, 23 bp, Artificial Sequence
  X-linked inhibitor of apoptosis (XIAP) siRNA
ggatatactcagttaacaaggag

SEQ ID NO: 11245 - DNA, 23 bp, Artificial Sequence
  X-linked inhibitor of apoptosis (XIAP) siRNA
gatatactcagttaacaaggagc

SEQ ID NO: 11246 - DNA, 23 bp, Artificial Sequence
  X-linked inhibitor of apoptosis (XIAP) siRNA
atatactcagttaacaaggagca

SEQ ID NO: 11247 - DNA, 23 bp, Artificial Sequence
  X-linked inhibitor of apoptosis (XIAP) siRNA
tatactcagttaacaaggagcag

SEQ ID NO: 11248 - DNA, 23 bp, Artificial Sequence
  X-linked inhibitor of apoptosis (XIAP) siRNA
atactcagttaacaaggagcagc

SEQ ID NO: 11249 - DNA, 23 bp, Artificial Sequence
  X-linked inhibitor of apoptosis (XIAP) siRNA
tactcagttaacaaggagcagct

SEQ ID NO: 11250 - DNA, 23 bp, Artificial Sequence
  X-linked inhibitor of apoptosis (XIAP) siRNA
actcagttaacaaggagcagctt

SEQ ID NO: 11251 - DNA, 23 bp, Artificial Sequence
  X-linked inhibitor of apoptosis (XIAP) siRNA
ctcagttaacaaggagcagcttg

SEQ ID NO: 11252 - DNA, 23 bp, Artificial Sequence
  X-linked inhibitor of apoptosis (XIAP) siRNA
tcagttaacaaggagcagcttgc

SEQ ID NO: 11253 - DNA, 23 bp, Artificial Sequence
  X-linked inhibitor of apoptosis (XIAP) siRNA
cagttaacaaggagcagcttgca

SEQ ID NO: 11254 - DNA, 23 bp, Artificial Sequence
  X-linked inhibitor of apoptosis (XIAP) siRNA
agttaacaaggagcagcttgcaa

SEQ ID NO: 11255 - DNA, 23 bp, Artificial Sequence
  X-linked inhibitor of apoptosis (XIAP) siRNA
gttaacaaggagcagcttgcaag

SEQ ID NO: 11256 - DNA, 23 bp, Artificial Sequence
  X-linked inhibitor of apoptosis (XIAP) siRNA
ttaacaaggagcagcttgcaaga

SEQ ID NO: 11257 - DNA, 23 bp, Artificial Sequence
  X-linked inhibitor of apoptosis (XIAP) siRNA
taacaaggagcagcttgcaagag

SEQ ID NO: 11258 - DNA, 23 bp, Artificial Sequence
  X-linked inhibitor of apoptosis (XIAP) siRNA
aacaaggagcagcttgcaagagc

SEQ ID NO: 11259 - DNA, 23 bp, Artificial Sequence
  X-linked inhibitor of apoptosis (XIAP) siRNA
acaaggagcagcttgcaagagct

SEQ ID NO: 11260 - DNA, 23 bp, Artificial Sequence
  X-linked inhibitor of apoptosis (XIAP) siRNA
caaggagcagcttgcaagagctg

SEQ ID NO: 11261 - DNA, 23 bp, Artificial Sequence
  X-linked inhibitor of apoptosis (XIAP) siRNA
aaggagcagcttgcaagagctgg

SEQ ID NO: 11262 - DNA, 23 bp, Artificial Sequence
  X-linked inhibitor of apoptosis (XIAP) siRNA
aggagcagcttgcaagagctgga

SEQ ID NO: 11263 - DNA, 23 bp, Artificial Sequence
  X-linked inhibitor of apoptosis (XIAP) siRNA
ggagcagcttgcaagagctggat

SEQ ID NO: 11264 - DNA, 23 bp, Artificial Sequence
  X-linked inhibitor of apoptosis (XIAP) siRNA
gagcagcttgcaagagctggatt

SEQ ID NO: 11265 - DNA, 23 bp, Artificial Sequence
  X-linked inhibitor of apoptosis (XIAP) siRNA
agcagcttgcaagagctggattt

SEQ ID NO: 11266 - DNA, 23 bp, Artificial Sequence
  X-linked inhibitor of apoptosis (XIAP) siRNA
gcagcttgcaagagctggatttt

SEQ ID NO: 11267 - DNA, 23 bp, Artificial Sequence
  X-linked inhibitor of apoptosis (XIAP) siRNA
cagcttgcaagagctggatttta

SEQ ID NO: 11268 - DNA, 23 bp, Artificial Sequence
  X-linked inhibitor of apoptosis (XIAP) siRNA
agcttgcaagagctggattttat

SEQ ID NO: 11269 - DNA, 23 bp, Artificial Sequence
  X-linked inhibitor of apoptosis (XIAP) siRNA
gcttgcaagagctggattttatg

SEQ ID NO: 11270 - DNA, 23 bp, Artificial Sequence
  X-linked inhibitor of apoptosis (XIAP) siRNA
cttgcaagagctggattttatgc

SEQ ID NO: 11271 - DNA, 23 bp, Artificial Sequence
  X-linked inhibitor of apoptosis (XIAP) siRNA
ttgcaagagctggattttatgct

SEQ ID NO: 11272 - DNA, 23 bp, Artificial Sequence
  X-linked inhibitor of apoptosis (XIAP) siRNA
tgcaagagctggattttatgctt

SEQ ID NO: 11273 - DNA, 23 bp, Artificial Sequence
  X-linked inhibitor of apoptosis (XIAP) siRNA
gcaagagctggattttatgcttt

SEQ ID NO: 11274 - DNA, 23 bp, Artificial Sequence
  X-linked inhibitor of apoptosis (XIAP) siRNA
caagagctggattttatgcttta

SEQ ID NO: 11275 - DNA, 23 bp, Artificial Sequence
  X-linked inhibitor of apoptosis (XIAP) siRNA
aagagctggattttatgctttag

SEQ ID NO: 11276 - DNA, 23 bp, Artificial Sequence
  X-linked inhibitor of apoptosis (XIAP) siRNA
agagctggattttatgctttagg

SEQ ID NO: 11277 - DNA, 23 bp, Artificial Sequence
  X-linked inhibitor of apoptosis (XIAP) siRNA
gagctggattttatgctttaggt

SEQ ID NO: 11278 - DNA, 23 bp, Artificial Sequence
  X-linked inhibitor of apoptosis (XIAP) siRNA
agctggattttatgctttaggtg

SEQ ID NO: 11279 - DNA, 23 bp, Artificial Sequence
  X-linked inhibitor of apoptosis (XIAP) siRNA
gctggattttatgctttaggtga

SEQ ID NO: 11280 - DNA, 23 bp, Artificial Sequence
  X-linked inhibitor of apoptosis (XIAP) siRNA
ctggattttatgctttaggtgaa

SEQ ID NO: 11281 - DNA, 23 bp, Artificial Sequence
  X-linked inhibitor of apoptosis (XIAP) siRNA
tggattttatgctttaggtgaag

SEQ ID NO: 11282 - DNA, 23 bp, Artificial Sequence
  X-linked inhibitor of apoptosis (XIAP) siRNA
ggattttatgctttaggtgaagg

SEQ ID NO: 11283 - DNA, 23 bp, Artificial Sequence
  X-linked inhibitor of apoptosis (XIAP) siRNA
gattttatgctttaggtgaaggt

SEQ ID NO: 11284 - DNA, 23 bp, Artificial Sequence
  X-linked inhibitor of apoptosis (XIAP) siRNA
attttatgctttaggtgaaggtg

SEQ ID NO: 11285 - DNA, 23 bp, Artificial Sequence
  X-linked inhibitor of apoptosis (XIAP) siRNA
ttttatgctttaggtgaaggtga

SEQ ID NO: 11286 - DNA, 23 bp, Artificial Sequence
  X-linked inhibitor of apoptosis (XIAP) siRNA
tttatgctttaggtgaaggtgat

SEQ ID NO: 11287 - DNA, 23 bp, Artificial Sequence
  X-linked inhibitor of apoptosis (XIAP) siRNA
ttatgctttaggtgaaggtgata

SEQ ID NO: 11288 - DNA, 23 bp, Artificial Sequence
  X-linked inhibitor of apoptosis (XIAP) siRNA
tatgctttaggtgaaggtgataa

SEQ ID NO: 11289 - DNA, 23 bp, Artificial Sequence
  X-linked inhibitor of apoptosis (XIAP) siRNA
atgctttaggtgaaggtgataaa

SEQ ID NO: 11290 - DNA, 23 bp, Artificial Sequence
  X-linked inhibitor of apoptosis (XIAP) siRNA
tgctttaggtgaaggtgataaag

SEQ ID NO: 11291 - DNA, 23 bp, Artificial Sequence
  X-linked inhibitor of apoptosis (XIAP) siRNA
gctttaggtgaaggtgataaagt

SEQ ID NO: 11292 - DNA, 23 bp, Artificial Sequence
  X-linked inhibitor of apoptosis (XIAP) siRNA
ctttaggtgaaggtgataaagta

SEQ ID NO: 11293 - DNA, 23 bp, Artificial Sequence
  X-linked inhibitor of apoptosis (XIAP) siRNA
tttaggtgaaggtgataaagtaa

SEQ ID NO: 11294 - DNA, 23 bp, Artificial Sequence
  X-linked inhibitor of apoptosis (XIAP) siRNA
ttaggtgaaggtgataaagtaaa

SEQ ID NO: 11295 - DNA, 23 bp, Artificial Sequence
  X-linked inhibitor of apoptosis (XIAP) siRNA
taggtgaaggtgataaagtaaag

SEQ ID NO: 11296 - DNA, 23 bp, Artificial Sequence
  X-linked inhibitor of apoptosis (XIAP) siRNA
aggtgaaggtgataaagtaaagt

SEQ ID NO: 11297 - DNA, 23 bp, Artificial Sequence
  X-linked inhibitor of apoptosis (XIAP) siRNA
ggtgaaggtgataaagtaaagtg

SEQ ID NO: 11298 - DNA, 23 bp, Artificial Sequence
  X-linked inhibitor of apoptosis (XIAP) siRNA
gtgaaggtgataaagtaaagtgc

SEQ ID NO: 11299 - DNA, 23 bp, Artificial Sequence
  X-linked inhibitor of apoptosis (XIAP) siRNA
tgaaggtgataaagtaaagtgct

SEQ ID NO: 11300 - DNA, 23 bp, Artificial Sequence
  X-linked inhibitor of apoptosis (XIAP) siRNA
gaaggtgataaagtaaagtgctt

SEQ ID NO: 11301 - DNA, 23 bp, Artificial Sequence
  X-linked inhibitor of apoptosis (XIAP) siRNA
aaggtgataaagtaaagtgcttt

SEQ ID NO: 11302 - DNA, 23 bp, Artificial Sequence
  X-linked inhibitor of apoptosis (XIAP) siRNA
aggtgataaagtaaagtgctttc

SEQ ID NO: 11303 - DNA, 23 bp, Artificial Sequence
  X-linked inhibitor of apoptosis (XIAP) siRNA
ggtgataaagtaaagtgctttca

SEQ ID NO: 11304 - DNA, 23 bp, Artificial Sequence
  X-linked inhibitor of apoptosis (XIAP) siRNA
gtgataaagtaaagtgctttcac

SEQ ID NO: 11305 - DNA, 23 bp, Artificial Sequence
  X-linked inhibitor of apoptosis (XIAP) siRNA
tgataaagtaaagtgctttcact

SEQ ID NO: 11306 - DNA, 23 bp, Artificial Sequence
  X-linked inhibitor of apoptosis (XIAP) siRNA
gataaagtaaagtgctttcactg

SEQ ID NO: 11307 - DNA, 23 bp, Artificial Sequence
  X-linked inhibitor of apoptosis (XIAP) siRNA
ataaagtaaagtgctttcactgt

SEQ ID NO: 11308 - DNA, 23 bp, Artificial Sequence
  X-linked inhibitor of apoptosis (XIAP) siRNA
taaagtaaagtgctttcactgtg

SEQ ID NO: 11309 - DNA, 23 bp, Artificial Sequence
  X-linked inhibitor of apoptosis (XIAP) siRNA
aaagtaaagtgctttcactgtgg

SEQ ID NO: 11310 - DNA, 23 bp, Artificial Sequence
  X-linked inhibitor of apoptosis (XIAP) siRNA
aagtaaagtgctttcactgtgga

SEQ ID NO: 11311 - DNA, 23 bp, Artificial Sequence
  X-linked inhibitor of apoptosis (XIAP) siRNA
agtaaagtgctttcactgtggag

SEQ ID NO: 11312 - DNA, 23 bp, Artificial Sequence
  X-linked inhibitor of apoptosis (XIAP) siRNA
gtaaagtgctttcactgtggagg

SEQ ID NO: 11313 - DNA, 23 bp, Artificial Sequence
  X-linked inhibitor of apoptosis (XIAP) siRNA
taaagtgctttcactgtggagga

SEQ ID NO: 11314 - DNA, 23 bp, Artificial Sequence
  X-linked inhibitor of apoptosis (XIAP) siRNA
aaagtgctttcactgtggaggag

SEQ ID NO: 11315 - DNA, 23 bp, Artificial Sequence
  X-linked inhibitor of apoptosis (XIAP) siRNA
aagtgctttcactgtggaggagg

SEQ ID NO: 11316 - DNA, 23 bp, Artificial Sequence
  X-linked inhibitor of apoptosis (XIAP) siRNA
agtgctttcactgtggaggaggg

SEQ ID NO: 11317 - DNA, 23 bp, Artificial Sequence
  X-linked inhibitor of apoptosis (XIAP) siRNA
gtgctttcactgtggaggagggc

SEQ ID NO: 11318 - DNA, 23 bp, Artificial Sequence
  X-linked inhibitor of apoptosis (XIAP) siRNA
tgctttcactgtggaggagggct

SEQ ID NO: 11319 - DNA, 23 bp, Artificial Sequence
  X-linked inhibitor of apoptosis (XIAP) siRNA
gctttcactgtggaggagggcta

SEQ ID NO: 11320 - DNA, 23 bp, Artificial Sequence
  X-linked inhibitor of apoptosis (XIAP) siRNA
ctttcactgtggaggagggctaa

SEQ ID NO: 11321 - DNA, 23 bp, Artificial Sequence
  X-linked inhibitor of apoptosis (XIAP) siRNA
tttcactgtggaggagggctaac

SEQ ID NO: 11322 - DNA, 23 bp, Artificial Sequence
  X-linked inhibitor of apoptosis (XIAP) siRNA
ttcactgtggaggagggctaact

SEQ ID NO: 11323 - DNA, 23 bp, Artificial Sequence
  X-linked inhibitor of apoptosis (XIAP) siRNA
tcactgtggaggagggctaactg

SEQ ID NO: 11324 - DNA, 23 bp, Artificial Sequence
  X-linked inhibitor of apoptosis (XIAP) siRNA
cactgtggaggagggctaactga

SEQ ID NO: 11325 - DNA, 23 bp, Artificial Sequence
  X-linked inhibitor of apoptosis (XIAP) siRNA
actgtggaggagggctaactgat

SEQ ID NO: 11326 - DNA, 23 bp, Artificial Sequence
  X-linked inhibitor of apoptosis (XIAP) siRNA
ctgtggaggagggctaactgatt

SEQ ID NO: 11327 - DNA, 23 bp, Artificial Sequence
  X-linked inhibitor of apoptosis (XIAP) siRNA
tgtggaggagggctaactgattg

SEQ ID NO: 11328 - DNA, 23 bp, Artificial Sequence
  X-linked inhibitor of apoptosis (XIAP) siRNA
gtggaggagggctaactgattgg

SEQ ID NO: 11329 - DNA, 23 bp, Artificial Sequence
  X-linked inhibitor of apoptosis (XIAP) siRNA
tggaggagggctaactgattgga

SEQ ID NO: 11330 - DNA, 23 bp, Artificial Sequence
  X-linked inhibitor of apoptosis (XIAP) siRNA
ggaggagggctaactgattggaa

SEQ ID NO: 11331 - DNA, 23 bp, Artificial Sequence
  X-linked inhibitor of apoptosis (XIAP) siRNA
gaggagggctaactgattggaag

SEQ ID NO: 11332 - DNA, 23 bp, Artificial Sequence
  X-linked inhibitor of apoptosis (XIAP) siRNA
aggagggctaactgattggaagc

SEQ ID NO: 11333 - DNA, 23 bp, Artificial Sequence
  X-linked inhibitor of apoptosis (XIAP) siRNA
ggagggctaactgattggaagcc

SEQ ID NO: 11334 - DNA, 23 bp, Artificial Sequence
  X-linked inhibitor of apoptosis (XIAP) siRNA
gagggctaactgattggaagccc

SEQ ID NO: 11335 - DNA, 23 bp, Artificial Sequence
  X-linked inhibitor of apoptosis (XIAP) siRNA
agggctaactgattggaagccca

SEQ ID NO: 11336 - DNA, 23 bp, Artificial Sequence
  X-linked inhibitor of apoptosis (XIAP) siRNA
gggctaactgattggaagcccag

SEQ ID NO: 11337 - DNA, 23 bp, Artificial Sequence
  X-linked inhibitor of apoptosis (XIAP) siRNA
ggctaactgattggaagcccagt

SEQ ID NO: 11338 - DNA, 23 bp, Artificial Sequence
  X-linked inhibitor of apoptosis (XIAP) siRNA
gctaactgattggaagcccagtg

SEQ ID NO: 11339 - DNA, 23 bp, Artificial Sequence
  X-linked inhibitor of apoptosis (XIAP) siRNA
ctaactgattggaagcccagtga

SEQ ID NO: 11340 - DNA, 23 bp, Artificial Sequence
  X-linked inhibitor of apoptosis (XIAP) siRNA
taactgattggaagcccagtgaa

SEQ ID NO: 11341 - DNA, 23 bp, Artificial Sequence
  X-linked inhibitor of apoptosis (XIAP) siRNA
aactgattggaagcccagtgaag

SEQ ID NO: 11342 - DNA, 23 bp, Artificial Sequence
  X-linked inhibitor of apoptosis (XIAP) siRNA
actgattggaagcccagtgaaga

SEQ ID NO: 11343 - DNA, 23 bp, Artificial Sequence
  X-linked inhibitor of apoptosis (XIAP) siRNA
ctgattggaagcccagtgaagac

SEQ ID NO: 11344 - DNA, 23 bp, Artificial Sequence
  X-linked inhibitor of apoptosis (XIAP) siRNA
tgattggaagcccagtgaagacc

SEQ ID NO: 11345 - DNA, 23 bp, Artificial Sequence
  X-linked inhibitor of apoptosis (XIAP) siRNA
gattggaagcccagtgaagaccc

SEQ ID NO: 11346 - DNA, 23 bp, Artificial Sequence
  X-linked inhibitor of apoptosis (XIAP) siRNA
attggaagcccagtgaagaccct

SEQ ID NO: 11347 - DNA, 23 bp, Artificial Sequence
  X-linked inhibitor of apoptosis (XIAP) siRNA
ttggaagcccagtgaagaccctt

SEQ ID NO: 11348 - DNA, 23 bp, Artificial Sequence
  X-linked inhibitor of apoptosis (XIAP) siRNA
tggaagcccagtgaagacccttg

SEQ ID NO: 11349 - DNA, 23 bp, Artificial Sequence
  X-linked inhibitor of apoptosis (XIAP) siRNA
ggaagcccagtgaagacccttgg

SEQ ID NO: 11350 - DNA, 23 bp, Artificial Sequence
  X-linked inhibitor of apoptosis (XIAP) siRNA
gaagcccagtgaagacccttggg

SEQ ID NO: 11351 - DNA, 23 bp, Artificial Sequence
  X-linked inhibitor of apoptosis (XIAP) siRNA
aagcccagtgaagacccttggga

SEQ ID NO: 11352 - DNA, 23 bp, Artificial Sequence
  X-linked inhibitor of apoptosis (XIAP) siRNA
agcccagtgaagacccttgggaa

SEQ ID NO: 11353 - DNA, 23 bp, Artificial Sequence
  X-linked inhibitor of apoptosis (XIAP) siRNA
gcccagtgaagacccttgggaac

SEQ ID NO: 11354 - DNA, 23 bp, Artificial Sequence
  X-linked inhibitor of apoptosis (XIAP) siRNA
cccagtgaagacccttgggaaca

SEQ ID NO: 11355 - DNA, 23 bp, Artificial Sequence
  X-linked inhibitor of apoptosis (XIAP) siRNA
ccagtgaagacccttgggaacaa

SEQ ID NO: 11356 - DNA, 23 bp, Artificial Sequence
  X-linked inhibitor of apoptosis (XIAP) siRNA
cagtgaagacccttgggaacaac

SEQ ID NO: 11357 - DNA, 23 bp, Artificial Sequence
  X-linked inhibitor of apoptosis (XIAP) siRNA
agtgaagacccttgggaacaaca

SEQ ID NO: 11358 - DNA, 23 bp, Artificial Sequence
  X-linked inhibitor of apoptosis (XIAP) siRNA
gtgaagacccttgggaacaacat

SEQ ID NO: 11359 - DNA, 23 bp, Artificial Sequence
  X-linked inhibitor of apoptosis (XIAP) siRNA
tgaagacccttgggaacaacatg

SEQ ID NO: 11360 - DNA, 23 bp, Artificial Sequence
  X-linked inhibitor of apoptosis (XIAP) siRNA
gaagacccttgggaacaacatgc

SEQ ID NO: 11361 - DNA, 23 bp, Artificial Sequence
  X-linked inhibitor of apoptosis (XIAP) siRNA
aagacccttgggaacaacatgct

SEQ ID NO: 11362 - DNA, 23 bp, Artificial Sequence
  X-linked inhibitor of apoptosis (XIAP) siRNA
agacccttgggaacaacatgcta

SEQ ID NO: 11363 - DNA, 23 bp, Artificial Sequence
  X-linked inhibitor of apoptosis (XIAP) siRNA
gacccttgggaacaacatgctaa

SEQ ID NO: 11364 - DNA, 23 bp, Artificial Sequence
  X-linked inhibitor of apoptosis (XIAP) siRNA
acccttgggaacaacatgctaaa

SEQ ID NO: 11365 - DNA, 23 bp, Artificial Sequence
  X-linked inhibitor of apoptosis (XIAP) siRNA
cccttgggaacaacatgctaaat

SEQ ID NO: 11366 - DNA, 23 bp, Artificial Sequence
  X-linked inhibitor of apoptosis (XIAP) siRNA
ccttgggaacaacatgctaaatg

SEQ ID NO: 11367 - DNA, 23 bp, Artificial Sequence
  X-linked inhibitor of apoptosis (XIAP) siRNA
cttgggaacaacatgctaaatgg

SEQ ID NO: 11368 - DNA, 23 bp, Artificial Sequence
  X-linked inhibitor of apoptosis (XIAP) siRNA
ttgggaacaacatgctaaatggt

SEQ ID NO: 11369 - DNA, 23 bp, Artificial Sequence
  X-linked inhibitor of apoptosis (XIAP) siRNA
tgggaacaacatgctaaatggta

SEQ ID NO: 11370 - DNA, 23 bp, Artificial Sequence
  X-linked inhibitor of apoptosis (XIAP) siRNA
gggaacaacatgctaaatggtat

SEQ ID NO: 11371 - DNA, 23 bp, Artificial Sequence
  X-linked inhibitor of apoptosis (XIAP) siRNA
ggaacaacatgctaaatggtatc

SEQ ID NO: 11372 - DNA, 23 bp, Artificial Sequence
  X-linked inhibitor of apoptosis (XIAP) siRNA
gaacaacatgctaaatggtatcc

SEQ ID NO: 11373 - DNA, 23 bp, Artificial Sequence
  X-linked inhibitor of apoptosis (XIAP) siRNA
aacaacatgctaaatggtatcca

SEQ ID NO: 11374 - DNA, 23 bp, Artificial Sequence
  X-linked inhibitor of apoptosis (XIAP) siRNA
acaacatgctaaatggtatccag

SEQ ID NO: 11375 - DNA, 23 bp, Artificial Sequence
  X-linked inhibitor of apoptosis (XIAP) siRNA
caacatgctaaatggtatccagg

SEQ ID NO: 11376 - DNA, 23 bp, Artificial Sequence
  X-linked inhibitor of apoptosis (XIAP) siRNA
aacatgctaaatggtatccaggg

SEQ ID NO: 11377 - DNA, 23 bp, Artificial Sequence
  X-linked inhibitor of apoptosis (XIAP) siRNA
acatgctaaatggtatccagggt

SEQ ID NO: 11378 - DNA, 23 bp, Artificial Sequence
  X-linked inhibitor of apoptosis (XIAP) siRNA
catgctaaatggtatccagggtg

SEQ ID NO: 11379 - DNA, 23 bp, Artificial Sequence
  X-linked inhibitor of apoptosis (XIAP) siRNA
atgctaaatggtatccagggtgc

SEQ ID NO: 11380 - DNA, 23 bp, Artificial Sequence
  X-linked inhibitor of apoptosis (XIAP) siRNA
tgctaaatggtatccagggtgca

SEQ ID NO: 11381 - DNA, 23 bp, Artificial Sequence
  X-linked inhibitor of apoptosis (XIAP) siRNA
gctaaatggtatccagggtgcaa

SEQ ID NO: 11382 - DNA, 23 bp, Artificial Sequence
  X-linked inhibitor of apoptosis (XIAP) siRNA
ctaaatggtatccagggtgcaaa

SEQ ID NO: 11383 - DNA, 23 bp, Artificial Sequence
  X-linked inhibitor of apoptosis (XIAP) siRNA
taaatggtatccagggtgcaaat

SEQ ID NO: 11384 - DNA, 23 bp, Artificial Sequence
  X-linked inhibitor of apoptosis (XIAP) siRNA
aaatggtatccagggtgcaaata

SEQ ID NO: 11385 - DNA, 23 bp, Artificial Sequence
  X-linked inhibitor of apoptosis (XIAP) siRNA
aatggtatccagggtgcaaatat

SEQ ID NO: 11386 - DNA, 23 bp, Artificial Sequence
  X-linked inhibitor of apoptosis (XIAP) siRNA
atggtatccagggtgcaaatatc

SEQ ID NO: 11387 - DNA, 23 bp, Artificial Sequence
  X-linked inhibitor of apoptosis (XIAP) siRNA
tggtatccagggtgcaaatatct

SEQ ID NO: 11388 - DNA, 23 bp, Artificial Sequence
  X-linked inhibitor of apoptosis (XIAP) siRNA
ggtatccagggtgcaaatatctg

SEQ ID NO: 11389 - DNA, 23 bp, Artificial Sequence
  X-linked inhibitor of apoptosis (XIAP) siRNA
gtatccagggtgcaaatatctgt

SEQ ID NO: 11390 - DNA, 23 bp, Artificial Sequence
  X-linked inhibitor of apoptosis (XIAP) siRNA
tatccagggtgcaaatatctgtt

SEQ ID NO: 11391 - DNA, 23 bp, Artificial Sequence
  X-linked inhibitor of apoptosis (XIAP) siRNA
atccagggtgcaaatatctgtta

SEQ ID NO: 11392 - DNA, 23 bp, Artificial Sequence
  X-linked inhibitor of apoptosis (XIAP) siRNA
tccagggtgcaaatatctgttag

SEQ ID NO: 11393 - DNA, 23 bp, Artificial Sequence
  X-linked inhibitor of apoptosis (XIAP) siRNA
ccagggtgcaaatatctgttaga

SEQ ID NO: 11394 - DNA, 23 bp, Artificial Sequence
  X-linked inhibitor of apoptosis (XIAP) siRNA
cagggtgcaaatatctgttagaa

SEQ ID NO: 11395 - DNA, 23 bp, Artificial Sequence
  X-linked inhibitor of apoptosis (XIAP) siRNA
agggtgcaaatatctgttagaac

SEQ ID NO: 11396 - DNA, 23 bp, Artificial Sequence
  X-linked inhibitor of apoptosis (XIAP) siRNA
gggtgcaaatatctgttagaaca

SEQ ID NO: 11397 - DNA, 23 bp, Artificial Sequence
  X-linked inhibitor of apoptosis (XIAP) siRNA
ggtgcaaatatctgttagaacag

SEQ ID NO: 11398 - DNA, 23 bp, Artificial Sequence
  X-linked inhibitor of apoptosis (XIAP) siRNA
gtgcaaatatctgttagaacaga

SEQ ID NO: 11399 - DNA, 23 bp, Artificial Sequence
  X-linked inhibitor of apoptosis (XIAP) siRNA
tgcaaatatctgttagaacagaa

SEQ ID NO: 11400 - DNA, 23 bp, Artificial Sequence
  X-linked inhibitor of apoptosis (XIAP) siRNA
gcaaatatctgttagaacagaag

SEQ ID NO: 11401 - DNA, 23 bp, Artificial Sequence
  X-linked inhibitor of apoptosis (XIAP) siRNA
caaatatctgttagaacagaagg

SEQ ID NO: 11402 - DNA, 23 bp, Artificial Sequence
  X-linked inhibitor of apoptosis (XIAP) siRNA
aaatatctgttagaacagaaggg

SEQ ID NO: 11403 - DNA, 23 bp, Artificial Sequence
  X-linked inhibitor of apoptosis (XIAP) siRNA
aatatctgttagaacagaaggga

SEQ ID NO: 11404 - DNA, 23 bp, Artificial Sequence
  X-linked inhibitor of apoptosis (XIAP) siRNA
atatctgttagaacagaagggac

SEQ ID NO: 11405 - DNA, 23 bp, Artificial Sequence
  X-linked inhibitor of apoptosis (XIAP) siRNA
tatctgttagaacagaagggaca

SEQ ID NO: 11406 - DNA, 23 bp, Artificial Sequence
  X-linked inhibitor of apoptosis (XIAP) siRNA
atctgttagaacagaagggacaa

SEQ ID NO: 11407 - DNA, 23 bp, Artificial Sequence
  X-linked inhibitor of apoptosis (XIAP) siRNA
tctgttagaacagaagggacaag

SEQ ID NO: 11408 - DNA, 23 bp, Artificial Sequence
  X-linked inhibitor of apoptosis (XIAP) siRNA
ctgttagaacagaagggacaaga

SEQ ID NO: 11409 - DNA, 23 bp, Artificial Sequence
  X-linked inhibitor of apoptosis (XIAP) siRNA
tgttagaacagaagggacaagaa

SEQ ID NO: 11410 - DNA, 23 bp, Artificial Sequence
  X-linked inhibitor of apoptosis (XIAP) siRNA
gttagaacagaagggacaagaat

SEQ ID NO: 11411 - DNA, 23 bp, Artificial Sequence
  X-linked inhibitor of apoptosis (XIAP) siRNA
ttagaacagaagggacaagaata

SEQ ID NO: 11412 - DNA, 23 bp, Artificial Sequence
  X-linked inhibitor of apoptosis (XIAP) siRNA
tagaacagaagggacaagaatat

SEQ ID NO: 11413 - DNA, 23 bp, Artificial Sequence
  X-linked inhibitor of apoptosis (XIAP) siRNA
agaacagaagggacaagaatata

SEQ ID NO: 11414 - DNA, 23 bp, Artificial Sequence
  X-linked inhibitor of apoptosis (XIAP) siRNA
gaacagaagggacaagaatatat

SEQ ID NO: 11415 - DNA, 23 bp, Artificial Sequence
  X-linked inhibitor of apoptosis (XIAP) siRNA
aacagaagggacaagaatatata

SEQ ID NO: 11416 - DNA, 23 bp, Artificial Sequence
  X-linked inhibitor of apoptosis (XIAP) siRNA
acagaagggacaagaatatataa

SEQ ID NO: 11417 - DNA, 23 bp, Artificial Sequence
  X-linked inhibitor of apoptosis (XIAP) siRNA
cagaagggacaagaatatataaa

SEQ ID NO: 11418 - DNA, 23 bp, Artificial Sequence
  X-linked inhibitor of apoptosis (XIAP) siRNA
agaagggacaagaatatataaac

SEQ ID NO: 11419 - DNA, 23 bp, Artificial Sequence
  X-linked inhibitor of apoptosis (XIAP) siRNA
gaagggacaagaatatataaaca

SEQ ID NO: 11420 - DNA, 23 bp, Artificial Sequence
  X-linked inhibitor of apoptosis (XIAP) siRNA
aagggacaagaatatataaacaa

SEQ ID NO: 11421 - DNA, 23 bp, Artificial Sequence
  X-linked inhibitor of apoptosis (XIAP) siRNA
agggacaagaatatataaacaat

SEQ ID NO: 11422 - DNA, 23 bp, Artificial Sequence
  X-linked inhibitor of apoptosis (XIAP) siRNA
gggacaagaatatataaacaata

SEQ ID NO: 11423 - DNA, 23 bp, Artificial Sequence
  X-linked inhibitor of apoptosis (XIAP) siRNA
ggacaagaatatataaacaatat

SEQ ID NO: 11424 - DNA, 23 bp, Artificial Sequence
  X-linked inhibitor of apoptosis (XIAP) siRNA
gacaagaatatataaacaatatt

SEQ ID NO: 11425 - DNA, 23 bp, Artificial Sequence
  X-linked inhibitor of apoptosis (XIAP) siRNA
acaagaatatataaacaatattc

SEQ ID NO: 11426 - DNA, 23 bp, Artificial Sequence
  X-linked inhibitor of apoptosis (XIAP) siRNA
caagaatatataaacaatattca

SEQ ID NO: 11427 - DNA, 23 bp, Artificial Sequence
  X-linked inhibitor of apoptosis (XIAP) siRNA
aagaatatataaacaatattcat

SEQ ID NO: 11428 - DNA, 23 bp, Artificial Sequence
  X-linked inhibitor of apoptosis (XIAP) siRNA
agaatatataaacaatattcatt

SEQ ID NO: 11429 - DNA, 23 bp, Artificial Sequence
  X-linked inhibitor of apoptosis (XIAP) siRNA
gaatatataaacaatattcattt

SEQ ID NO: 11430 - DNA, 23 bp, Artificial Sequence
  X-linked inhibitor of apoptosis (XIAP) siRNA
aatatataaacaatattcattta

SEQ ID NO: 11431 - DNA, 23 bp, Artificial Sequence
  X-linked inhibitor of apoptosis (XIAP) siRNA
atatataaacaatattcatttaa

SEQ ID NO: 11432 - DNA, 23 bp, Artificial Sequence
  X-linked inhibitor of apoptosis (XIAP) siRNA
tatataaacaatattcatttaac

SEQ ID NO: 11433 - DNA, 23 bp, Artificial Sequence
  X-linked inhibitor of apoptosis (XIAP) siRNA
atataaacaatattcatttaact

SEQ ID NO: 11434 - DNA, 23 bp, Artificial Sequence
  X-linked inhibitor of apoptosis (XIAP) siRNA
tataaacaatattcatttaactc

SEQ ID NO: 11435 - DNA, 23 bp, Artificial Sequence
  X-linked inhibitor of apoptosis (XIAP) siRNA
ataaacaatattcatttaactca

SEQ ID NO: 11436 - DNA, 23 bp, Artificial Sequence
  X-linked inhibitor of apoptosis (XIAP) siRNA
taaacaatattcatttaactcat

SEQ ID NO: 11437 - DNA, 23 bp, Artificial Sequence
  X-linked inhibitor of apoptosis (XIAP) siRNA
aaacaatattcatttaactcatt

SEQ ID NO: 11438 - DNA, 23 bp, Artificial Sequence
  X-linked inhibitor of apoptosis (XIAP) siRNA
aacaatattcatttaactcattc

SEQ ID NO: 11439 - DNA, 23 bp, Artificial Sequence
  X-linked inhibitor of apoptosis (XIAP) siRNA
acaatattcatttaactcattca

SEQ ID NO: 11440 - DNA, 23 bp, Artificial Sequence
  X-linked inhibitor of apoptosis (XIAP) siRNA
caatattcatttaactcattcac

SEQ ID NO: 11441 - DNA, 23 bp, Artificial Sequence
  X-linked inhibitor of apoptosis (XIAP) siRNA
aatattcatttaactcattcact

SEQ ID NO: 11442 - DNA, 23 bp, Artificial Sequence
  X-linked inhibitor of apoptosis (XIAP) siRNA
atattcatttaactcattcactt

SEQ ID NO: 11443 - DNA, 23 bp, Artificial Sequence
  X-linked inhibitor of apoptosis (XIAP) siRNA
tattcatttaactcattcacttg

SEQ ID NO: 11444 - DNA, 23 bp, Artificial Sequence
  X-linked inhibitor of apoptosis (XIAP) siRNA
attcatttaactcattcacttga

SEQ ID NO: 11445 - DNA, 23 bp, Artificial Sequence
  X-linked inhibitor of apoptosis (XIAP) siRNA
ttcatttaactcattcacttgag

SEQ ID NO: 11446 - DNA, 23 bp, Artificial Sequence
  X-linked inhibitor of apoptosis (XIAP) siRNA
tcatttaactcattcacttgagg

SEQ ID NO: 11447 - DNA, 23 bp, Artificial Sequence
  X-linked inhibitor of apoptosis (XIAP) siRNA
catttaactcattcacttgagga

SEQ ID NO: 11448 - DNA, 23 bp, Artificial Sequence
  X-linked inhibitor of apoptosis (XIAP) siRNA
atttaactcattcacttgaggag

SEQ ID NO: 11449 - DNA, 23 bp, Artificial Sequence
  X-linked inhibitor of apoptosis (XIAP) siRNA
tttaactcattcacttgaggagt

SEQ ID NO: 11450 - DNA, 23 bp, Artificial Sequence
  X-linked inhibitor of apoptosis (XIAP) siRNA
ttaactcattcacttgaggagtg

SEQ ID NO: 11451 - DNA, 23 bp, Artificial Sequence
  X-linked inhibitor of apoptosis (XIAP) siRNA
taactcattcacttgaggagtgt

SEQ ID NO: 11452 - DNA, 23 bp, Artificial Sequence
  X-linked inhibitor of apoptosis (XIAP) siRNA
aactcattcacttgaggagtgtc

SEQ ID NO: 11453 - DNA, 23 bp, Artificial Sequence
  X-linked inhibitor of apoptosis (XIAP) siRNA
actcattcacttgaggagtgtct

SEQ ID NO: 11454 - DNA, 23 bp, Artificial Sequence
  X-linked inhibitor of apoptosis (XIAP) siRNA
ctcattcacttgaggagtgtctg

SEQ ID NO: 11455 - DNA, 23 bp, Artificial Sequence
  X-linked inhibitor of apoptosis (XIAP) siRNA
tcattcacttgaggagtgtctgg

SEQ ID NO: 11456 - DNA, 23 bp, Artificial Sequence
  X-linked inhibitor of apoptosis (XIAP) siRNA
cattcacttgaggagtgtctggt

SEQ ID NO: 11457 - DNA, 23 bp, Artificial Sequence
  X-linked inhibitor of apoptosis (XIAP) siRNA
attcacttgaggagtgtctggta

SEQ ID NO: 11458 - DNA, 23 bp, Artificial Sequence
  X-linked inhibitor of apoptosis (XIAP) siRNA
ttcacttgaggagtgtctggtaa

SEQ ID NO: 11459 - DNA, 23 bp, Artificial Sequence
  X-linked inhibitor of apoptosis (XIAP) siRNA
tcacttgaggagtgtctggtaag

SEQ ID NO: 11460 - DNA, 23 bp, Artificial Sequence
  X-linked inhibitor of apoptosis (XIAP) siRNA
cacttgaggagtgtctggtaaga

SEQ ID NO: 11461 - DNA, 23 bp, Artificial Sequence
  X-linked inhibitor of apoptosis (XIAP) siRNA
acttgaggagtgtctggtaagaa

SEQ ID NO: 11462 - DNA, 23 bp, Artificial Sequence
  X-linked inhibitor of apoptosis (XIAP) siRNA
cttgaggagtgtctggtaagaac

SEQ ID NO: 11463 - DNA, 23 bp, Artificial Sequence
  X-linked inhibitor of apoptosis (XIAP) siRNA
ttgaggagtgtctggtaagaact

SEQ ID NO: 11464 - DNA, 23 bp, Artificial Sequence
  X-linked inhibitor of apoptosis (XIAP) siRNA
tgaggagtgtctggtaagaacta

SEQ ID NO: 11465 - DNA, 23 bp, Artificial Sequence
  X-linked inhibitor of apoptosis (XIAP) siRNA
gaggagtgtctggtaagaactac

SEQ ID NO: 11466 - DNA, 23 bp, Artificial Sequence
  X-linked inhibitor of apoptosis (XIAP) siRNA
aggagtgtctggtaagaactact

SEQ ID NO: 11467 - DNA, 23 bp, Artificial Sequence
  X-linked inhibitor of apoptosis (XIAP) siRNA
ggagtgtctggtaagaactactg

SEQ ID NO: 11468 - DNA, 23 bp, Artificial Sequence
  X-linked inhibitor of apoptosis (XIAP) siRNA
gagtgtctggtaagaactactga

SEQ ID NO: 11469 - DNA, 23 bp, Artificial Sequence
  X-linked inhibitor of apoptosis (XIAP) siRNA
agtgtctggtaagaactactgag

SEQ ID NO: 11470 - DNA, 23 bp, Artificial Sequence
  X-linked inhibitor of apoptosis (XIAP) siRNA
gtgtctggtaagaactactgaga

SEQ ID NO: 11471 - DNA, 23 bp, Artificial Sequence
  X-linked inhibitor of apoptosis (XIAP) siRNA
tgtctggtaagaactactgagaa

SEQ ID NO: 11472 - DNA, 23 bp, Artificial Sequence
  X-linked inhibitor of apoptosis (XIAP) siRNA
gtctggtaagaactactgagaaa

SEQ ID NO: 11473 - DNA, 23 bp, Artificial Sequence
  X-linked inhibitor of apoptosis (XIAP) siRNA
tctggtaagaactactgagaaaa

SEQ ID NO: 11474 - DNA, 23 bp, Artificial Sequence
  X-linked inhibitor of apoptosis (XIAP) siRNA
ctggtaagaactactgagaaaac

SEQ ID NO: 11475 - DNA, 23 bp, Artificial Sequence
  X-linked inhibitor of apoptosis (XIAP) siRNA
tggtaagaactactgagaaaaca

SEQ ID NO: 11476 - DNA, 23 bp, Artificial Sequence
  X-linked inhibitor of apoptosis (XIAP) siRNA
ggtaagaactactgagaaaacac

SEQ ID NO: 11477 - DNA, 23 bp, Artificial Sequence
  X-linked inhibitor of apoptosis (XIAP) siRNA
gtaagaactactgagaaaacacc

SEQ ID NO: 11478 - DNA, 23 bp, Artificial Sequence
  X-linked inhibitor of apoptosis (XIAP) siRNA
taagaactactgagaaaacacca

SEQ ID NO: 11479 - DNA, 23 bp, Artificial Sequence
  X-linked inhibitor of apoptosis (XIAP) siRNA
aagaactactgagaaaacaccat

SEQ ID NO: 11480 - DNA, 23 bp, Artificial Sequence
  X-linked inhibitor of apoptosis (XIAP) siRNA
agaactactgagaaaacaccatc

SEQ ID NO: 11481 - DNA, 23 bp, Artificial Sequence
  X-linked inhibitor of apoptosis (XIAP) siRNA
gaactactgagaaaacaccatca

SEQ ID NO: 11482 - DNA, 23 bp, Artificial Sequence
  X-linked inhibitor of apoptosis (XIAP) siRNA
aactactgagaaaacaccatcac

SEQ ID NO: 11483 - DNA, 23 bp, Artificial Sequence
  X-linked inhibitor of apoptosis (XIAP) siRNA
actactgagaaaacaccatcact

SEQ ID NO: 11484 - DNA, 23 bp, Artificial Sequence
  X-linked inhibitor of apoptosis (XIAP) siRNA
ctactgagaaaacaccatcacta

SEQ ID NO: 11485 - DNA, 23 bp, Artificial Sequence
  X-linked inhibitor of apoptosis (XIAP) siRNA
tactgagaaaacaccatcactaa

SEQ ID NO: 11486 - DNA, 23 bp, Artificial Sequence
  X-linked inhibitor of apoptosis (XIAP) siRNA
actgagaaaacaccatcactaac

SEQ ID NO: 11487 - DNA, 23 bp, Artificial Sequence
  X-linked inhibitor of apoptosis (XIAP) siRNA
ctgagaaaacaccatcactaact

SEQ ID NO: 11488 - DNA, 23 bp, Artificial Sequence
  X-linked inhibitor of apoptosis (XIAP) siRNA
tgagaaaacaccatcactaacta

SEQ ID NO: 11489 - DNA, 23 bp, Artificial Sequence
  X-linked inhibitor of apoptosis (XIAP) siRNA
gagaaaacaccatcactaactag

SEQ ID NO: 11490 - DNA, 23 bp, Artificial Sequence
  X-linked inhibitor of apoptosis (XIAP) siRNA
agaaaacaccatcactaactaga

SEQ ID NO: 11491 - DNA, 23 bp, Artificial Sequence
  X-linked inhibitor of apoptosis (XIAP) siRNA
gaaaacaccatcactaactagaa

SEQ ID NO: 11492 - DNA, 23 bp, Artificial Sequence
  X-linked inhibitor of apoptosis (XIAP) siRNA
aaaacaccatcactaactagaag

SEQ ID NO: 11493 - DNA, 23 bp, Artificial Sequence
  X-linked inhibitor of apoptosis (XIAP) siRNA
aaacaccatcactaactagaaga

SEQ ID NO: 11494 - DNA, 23 bp, Artificial Sequence
  X-linked inhibitor of apoptosis (XIAP) siRNA
aacaccatcactaactagaagaa

SEQ ID NO: 11495 - DNA, 23 bp, Artificial Sequence
  X-linked inhibitor of apoptosis (XIAP) siRNA
acaccatcactaactagaagaat

SEQ ID NO: 11496 - DNA, 23 bp, Artificial Sequence
  X-linked inhibitor of apoptosis (XIAP) siRNA
caccatcactaactagaagaatt

SEQ ID NO: 11497 - DNA, 23 bp, Artificial Sequence
  X-linked inhibitor of apoptosis (XIAP) siRNA
accatcactaactagaagaattg

SEQ ID NO: 11498 - DNA, 23 bp, Artificial Sequence
  X-linked inhibitor of apoptosis (XIAP) siRNA
ccatcactaactagaagaattga

SEQ ID NO: 11499 - DNA, 23 bp, Artificial Sequence
  X-linked inhibitor of apoptosis (XIAP) siRNA
catcactaactagaagaattgat

SEQ ID NO: 11500 - DNA, 23 bp, Artificial Sequence
  X-linked inhibitor of apoptosis (XIAP) siRNA
atcactaactagaagaattgatg

SEQ ID NO: 11501 - DNA, 23 bp, Artificial Sequence
  X-linked inhibitor of apoptosis (XIAP) siRNA
tcactaactagaagaattgatga

SEQ ID NO: 11502 - DNA, 23 bp, Artificial Sequence
  X-linked inhibitor of apoptosis (XIAP) siRNA
cactaactagaagaattgatgat

SEQ ID NO: 11503 - DNA, 23 bp, Artificial Sequence
  X-linked inhibitor of apoptosis (XIAP) siRNA
actaactagaagaattgatgata

SEQ ID NO: 11504 - DNA, 23 bp, Artificial Sequence
  X-linked inhibitor of apoptosis (XIAP) siRNA
ctaactagaagaattgatgatac

SEQ ID NO: 11505 - DNA, 23 bp, Artificial Sequence
  X-linked inhibitor of apoptosis (XIAP) siRNA
taactagaagaattgatgatacc

SEQ ID NO: 11506 - DNA, 23 bp, Artificial Sequence
  X-linked inhibitor of apoptosis (XIAP) siRNA
aactagaagaattgatgatacca

SEQ ID NO: 11507 - DNA, 23 bp, Artificial Sequence
  X-linked inhibitor of apoptosis (XIAP) siRNA
actagaagaattgatgataccat

SEQ ID NO: 11508 - DNA, 23 bp, Artificial Sequence
  X-linked inhibitor of apoptosis (XIAP) siRNA
ctagaagaattgatgataccatc

SEQ ID NO: 11509 - DNA, 23 bp, Artificial Sequence
  X-linked inhibitor of apoptosis (XIAP) siRNA
tagaagaattgatgataccatct

SEQ ID NO: 11510 - DNA, 23 bp, Artificial Sequence
  X-linked inhibitor of apoptosis (XIAP) siRNA
agaagaattgatgataccatctt

SEQ ID NO: 11511 - DNA, 23 bp, Artificial Sequence
  X-linked inhibitor of apoptosis (XIAP) siRNA
gaagaattgatgataccatcttc

SEQ ID NO: 11512 - DNA, 23 bp, Artificial Sequence
  X-linked inhibitor of apoptosis (XIAP) siRNA
aagaattgatgataccatcttcc

SEQ ID NO: 11513 - DNA, 23 bp, Artificial Sequence
  X-linked inhibitor of apoptosis (XIAP) siRNA
agaattgatgataccatcttcca

SEQ ID NO: 11514 - DNA, 23 bp, Artificial Sequence
  X-linked inhibitor of apoptosis (XIAP) siRNA
gaattgatgataccatcttccaa

SEQ ID NO: 11515 - DNA, 23 bp, Artificial Sequence
  X-linked inhibitor of apoptosis (XIAP) siRNA
aattgatgataccatcttccaaa

SEQ ID NO: 11516 - DNA, 23 bp, Artificial Sequence
  X-linked inhibitor of apoptosis (XIAP) siRNA
attgatgataccatcttccaaaa

SEQ ID NO: 11517 - DNA, 23 bp, Artificial Sequence
  X-linked inhibitor of apoptosis (XIAP) siRNA
ttgatgataccatcttccaaaat

SEQ ID NO: 11518 - DNA, 23 bp, Artificial Sequence
  X-linked inhibitor of apoptosis (XIAP) siRNA
tgatgataccatcttccaaaatc

SEQ ID NO: 11519 - DNA, 23 bp, Artificial Sequence
  X-linked inhibitor of apoptosis (XIAP) siRNA
gatgataccatcttccaaaatcc

SEQ ID NO: 11520 - DNA, 23 bp, Artificial Sequence
  X-linked inhibitor of apoptosis (XIAP) siRNA
atgataccatcttccaaaatcct

SEQ ID NO: 11521 - DNA, 23 bp, Artificial Sequence
  X-linked inhibitor of apoptosis (XIAP) siRNA
tgataccatcttccaaaatccta

SEQ ID NO: 11522 - DNA, 23 bp, Artificial Sequence
  X-linked inhibitor of apoptosis (XIAP) siRNA
gataccatcttccaaaatcctat

SEQ ID NO: 11523 - DNA, 23 bp, Artificial Sequence
  X-linked inhibitor of apoptosis (XIAP) siRNA
ataccatcttccaaaatcctatg

SEQ ID NO: 11524 - DNA, 23 bp, Artificial Sequence
  X-linked inhibitor of apoptosis (XIAP) siRNA
taccatcttccaaaatcctatgg

SEQ ID NO: 11525 - DNA, 23 bp, Artificial Sequence
  X-linked inhibitor of apoptosis (XIAP) siRNA
accatcttccaaaatcctatggt

SEQ ID NO: 11526 - DNA, 23 bp, Artificial Sequence
  X-linked inhibitor of apoptosis (XIAP) siRNA
ccatcttccaaaatcctatggta

SEQ ID NO: 11527 - DNA, 23 bp, Artificial Sequence
  X-linked inhibitor of apoptosis (XIAP) siRNA
catcttccaaaatcctatggtac

SEQ ID NO: 11528 - DNA, 23 bp, Artificial Sequence
  X-linked inhibitor of apoptosis (XIAP) siRNA
atcttccaaaatcctatggtaca

SEQ ID NO: 11529 - DNA, 23 bp, Artificial Sequence
  X-linked inhibitor of apoptosis (XIAP) siRNA
tcttccaaaatcctatggtacaa

SEQ ID NO: 11530 - DNA, 23 bp, Artificial Sequence
  X-linked inhibitor of apoptosis (XIAP) siRNA
cttccaaaatcctatggtacaag

SEQ ID NO: 11531 - DNA, 23 bp, Artificial Sequence
  X-linked inhibitor of apoptosis (XIAP) siRNA
ttccaaaatcctatggtacaaga

SEQ ID NO: 11532 - DNA, 23 bp, Artificial Sequence
  X-linked inhibitor of apoptosis (XIAP) siRNA
tccaaaatcctatggtacaagaa

SEQ ID NO: 11533 - DNA, 23 bp, Artificial Sequence
  X-linked inhibitor of apoptosis (XIAP) siRNA
ccaaaatcctatggtacaagaag

SEQ ID NO: 11534 - DNA, 23 bp, Artificial Sequence
  X-linked inhibitor of apoptosis (XIAP) siRNA
caaaatcctatggtacaagaagc

SEQ ID NO: 11535 - DNA, 23 bp, Artificial Sequence
  X-linked inhibitor of apoptosis (XIAP) siRNA
aaaatcctatggtacaagaagct

SEQ ID NO: 11536 - DNA, 23 bp, Artificial Sequence
  X-linked inhibitor of apoptosis (XIAP) siRNA
aaatcctatggtacaagaagcta

SEQ ID NO: 11537 - DNA, 23 bp, Artificial Sequence
  X-linked inhibitor of apoptosis (XIAP) siRNA
aatcctatggtacaagaagctat

SEQ ID NO: 11538 - DNA, 23 bp, Artificial Sequence
  X-linked inhibitor of apoptosis (XIAP) siRNA
atcctatggtacaagaagctata

SEQ ID NO: 11539 - DNA, 23 bp, Artificial Sequence
  X-linked inhibitor of apoptosis (XIAP) siRNA
tcctatggtacaagaagctatac

SEQ ID NO: 11540 - DNA, 23 bp, Artificial Sequence
  X-linked inhibitor of apoptosis (XIAP) siRNA
cctatggtacaagaagctatacg

SEQ ID NO: 11541 - DNA, 23 bp, Artificial Sequence
  X-linked inhibitor of apoptosis (XIAP) siRNA
ctatggtacaagaagctatacga

SEQ ID NO: 11542 - DNA, 23 bp, Artificial Sequence
  X-linked inhibitor of apoptosis (XIAP) siRNA
tatggtacaagaagctatacgaa

SEQ ID NO: 11543 - DNA, 23 bp, Artificial Sequence
  X-linked inhibitor of apoptosis (XIAP) siRNA
atggtacaagaagctatacgaat

SEQ ID NO: 11544 - DNA, 23 bp, Artificial Sequence
  X-linked inhibitor of apoptosis (XIAP) siRNA
tggtacaagaagctatacgaatg

SEQ ID NO: 11545 - DNA, 23 bp, Artificial Sequence
  X-linked inhibitor of apoptosis (XIAP) siRNA
ggtacaagaagctatacgaatgg

SEQ ID NO: 11546 - DNA, 23 bp, Artificial Sequence
  X-linked inhibitor of apoptosis (XIAP) siRNA
gtacaagaagctatacgaatggg

SEQ ID NO: 11547 - DNA, 23 bp, Artificial Sequence
  X-linked inhibitor of apoptosis (XIAP) siRNA
tacaagaagctatacgaatgggg

SEQ ID NO: 11548 - DNA, 23 bp, Artificial Sequence
  X-linked inhibitor of apoptosis (XIAP) siRNA
acaagaagctatacgaatggggt

SEQ ID NO: 11549 - DNA, 23 bp, Artificial Sequence
  X-linked inhibitor of apoptosis (XIAP) siRNA
caagaagctatacgaatggggtt

SEQ ID NO: 11550 - DNA, 23 bp, Artificial Sequence
  X-linked inhibitor of apoptosis (XIAP) siRNA
aagaagctatacgaatggggttc

SEQ ID NO: 11551 - DNA, 23 bp, Artificial Sequence
  X-linked inhibitor of apoptosis (XIAP) siRNA
agaagctatacgaatggggttca

SEQ ID NO: 11552 - DNA, 23 bp, Artificial Sequence
  X-linked inhibitor of apoptosis (XIAP) siRNA
gaagctatacgaatggggttcag

SEQ ID NO: 11553 - DNA, 23 bp, Artificial Sequence
  X-linked inhibitor of apoptosis (XIAP) siRNA
aagctatacgaatggggttcagt

SEQ ID NO: 11554 - DNA, 23 bp, Artificial Sequence
  X-linked inhibitor of apoptosis (XIAP) siRNA
agctatacgaatggggttcagtt

SEQ ID NO: 11555 - DNA, 23 bp, Artificial Sequence
  X-linked inhibitor of apoptosis (XIAP) siRNA
gctatacgaatggggttcagttt

SEQ ID NO: 11556 - DNA, 23 bp, Artificial Sequence
  X-linked inhibitor of apoptosis (XIAP) siRNA
ctatacgaatggggttcagtttc

SEQ ID NO: 11557 - DNA, 23 bp, Artificial Sequence
  X-linked inhibitor of apoptosis (XIAP) siRNA
tatacgaatggggttcagtttca

SEQ ID NO: 11558 - DNA, 23 bp, Artificial Sequence
  X-linked inhibitor of apoptosis (XIAP) siRNA
atacgaatggggttcagtttcaa

SEQ ID NO: 11559 - DNA, 23 bp, Artificial Sequence
  X-linked inhibitor of apoptosis (XIAP) siRNA
tacgaatggggttcagtttcaag

SEQ ID NO: 11560 - DNA, 23 bp, Artificial Sequence
  X-linked inhibitor of apoptosis (XIAP) siRNA
acgaatggggttcagtttcaagg

SEQ ID NO: 11561 - DNA, 23 bp, Artificial Sequence
  X-linked inhibitor of apoptosis (XIAP) siRNA
cgaatggggttcagtttcaagga

SEQ ID NO: 11562 - DNA, 23 bp, Artificial Sequence
  X-linked inhibitor of apoptosis (XIAP) siRNA
gaatggggttcagtttcaaggac

SEQ ID NO: 11563 - DNA, 23 bp, Artificial Sequence
  X-linked inhibitor of apoptosis (XIAP) siRNA
aatggggttcagtttcaaggaca

SEQ ID NO: 11564 - DNA, 23 bp, Artificial Sequence
  X-linked inhibitor of apoptosis (XIAP) siRNA
atggggttcagtttcaaggacat

SEQ ID NO: 11565 - DNA, 23 bp, Artificial Sequence
  X-linked inhibitor of apoptosis (XIAP) siRNA
tggggttcagtttcaaggacatt

SEQ ID NO: 11566 - DNA, 23 bp, Artificial Sequence
  X-linked inhibitor of apoptosis (XIAP) siRNA
ggggttcagtttcaaggacatta

SEQ ID NO: 11567 - DNA, 23 bp, Artificial Sequence
  X-linked inhibitor of apoptosis (XIAP) siRNA
gggttcagtttcaaggacattaa

SEQ ID NO: 11568 - DNA, 23 bp, Artificial Sequence
  X-linked inhibitor of apoptosis (XIAP) siRNA
ggttcagtttcaaggacattaag

SEQ ID NO: 11569 - DNA, 23 bp, Artificial Sequence
  X-linked inhibitor of apoptosis (XIAP) siRNA
gttcagtttcaaggacattaaga

SEQ ID NO: 11570 - DNA, 23 bp, Artificial Sequence
  X-linked inhibitor of apoptosis (XIAP) siRNA
ttcagtttcaaggacattaagaa

SEQ ID NO: 11571 - DNA, 23 bp, Artificial Sequence
  X-linked inhibitor of apoptosis (XIAP) siRNA
tcagtttcaaggacattaagaaa

SEQ ID NO: 11572 - DNA, 23 bp, Artificial Sequence
  X-linked inhibitor of apoptosis (XIAP) siRNA
cagtttcaaggacattaagaaaa

SEQ ID NO: 11573 - DNA, 23 bp, Artificial Sequence
  X-linked inhibitor of apoptosis (XIAP) siRNA
agtttcaaggacattaagaaaat

SEQ ID NO: 11574 - DNA, 23 bp, Artificial Sequence
  X-linked inhibitor of apoptosis (XIAP) siRNA
gtttcaaggacattaagaaaata

SEQ ID NO: 11575 - DNA, 23 bp, Artificial Sequence
  X-linked inhibitor of apoptosis (XIAP) siRNA
tttcaaggacattaagaaaataa

SEQ ID NO: 11576 - DNA, 23 bp, Artificial Sequence
  X-linked inhibitor of apoptosis (XIAP) siRNA
ttcaaggacattaagaaaataat

SEQ ID NO: 11577 - DNA, 23 bp, Artificial Sequence
  X-linked inhibitor of apoptosis (XIAP) siRNA
tcaaggacattaagaaaataatg

SEQ ID NO: 11578 - DNA, 23 bp, Artificial Sequence
  X-linked inhibitor of apoptosis (XIAP) siRNA
caaggacattaagaaaataatgg

SEQ ID NO: 11579 - DNA, 23 bp, Artificial Sequence
  X-linked inhibitor of apoptosis (XIAP) siRNA
aaggacattaagaaaataatgga

SEQ ID NO: 11580 - DNA, 23 bp, Artificial Sequence
  X-linked inhibitor of apoptosis (XIAP) siRNA
aggacattaagaaaataatggag

SEQ ID NO: 11581 - DNA, 23 bp, Artificial Sequence
  X-linked inhibitor of apoptosis (XIAP) siRNA
ggacattaagaaaataatggagg

SEQ ID NO: 11582 - DNA, 23 bp, Artificial Sequence
  X-linked inhibitor of apoptosis (XIAP) siRNA
gacattaagaaaataatggagga

SEQ ID NO: 11583 - DNA, 23 bp, Artificial Sequence
  X-linked inhibitor of apoptosis (XIAP) siRNA
acattaagaaaataatggaggaa

SEQ ID NO: 11584 - DNA, 23 bp, Artificial Sequence
  X-linked inhibitor of apoptosis (XIAP) siRNA
cattaagaaaataatggaggaaa

SEQ ID NO: 11585 - DNA, 23 bp, Artificial Sequence
  X-linked inhibitor of apoptosis (XIAP) siRNA
attaagaaaataatggaggaaaa

SEQ ID NO: 11586 - DNA, 23 bp, Artificial Sequence
  X-linked inhibitor of apoptosis (XIAP) siRNA
ttaagaaaataatggaggaaaaa

SEQ ID NO: 11587 - DNA, 23 bp, Artificial Sequence
  X-linked inhibitor of apoptosis (XIAP) siRNA
taagaaaataatggaggaaaaaa

SEQ ID NO: 11588 - DNA, 23 bp, Artificial Sequence
  X-linked inhibitor of apoptosis (XIAP) siRNA
aagaaaataatggaggaaaaaat

SEQ ID NO: 11589 - DNA, 23 bp, Artificial Sequence
  X-linked inhibitor of apoptosis (XIAP) siRNA
agaaaataatggaggaaaaaatt

SEQ ID NO: 11590 - DNA, 23 bp, Artificial Sequence
  X-linked inhibitor of apoptosis (XIAP) siRNA
gaaaataatggaggaaaaaattc

SEQ ID NO: 11591 - DNA, 23 bp, Artificial Sequence
  X-linked inhibitor of apoptosis (XIAP) siRNA
aaaataatggaggaaaaaattca

SEQ ID NO: 11592 - DNA, 23 bp, Artificial Sequence
  X-linked inhibitor of apoptosis (XIAP) siRNA
aaataatggaggaaaaaattcag

SEQ ID NO: 11593 - DNA, 23 bp, Artificial Sequence
  X-linked inhibitor of apoptosis (XIAP) siRNA
aataatggaggaaaaaattcaga

SEQ ID NO: 11594 - DNA, 23 bp, Artificial Sequence
  X-linked inhibitor of apoptosis (XIAP) siRNA
ataatggaggaaaaaattcagat

SEQ ID NO: 11595 - DNA, 23 bp, Artificial Sequence
  X-linked inhibitor of apoptosis (XIAP) siRNA
taatggaggaaaaaattcagata

SEQ ID NO: 11596 - DNA, 23 bp, Artificial Sequence
  X-linked inhibitor of apoptosis (XIAP) siRNA
aatggaggaaaaaattcagatat

SEQ ID NO: 11597 - DNA, 23 bp, Artificial Sequence
  X-linked inhibitor of apoptosis (XIAP) siRNA
atggaggaaaaaattcagatatc

SEQ ID NO: 11598 - DNA, 23 bp, Artificial Sequence
  X-linked inhibitor of apoptosis (XIAP) siRNA
tggaggaaaaaattcagatatct

SEQ ID NO: 11599 - DNA, 23 bp, Artificial Sequence
  X-linked inhibitor of apoptosis (XIAP) siRNA
ggaggaaaaaattcagatatctg

SEQ ID NO: 11600 - DNA, 23 bp, Artificial Sequence
  X-linked inhibitor of apoptosis (XIAP) siRNA
gaggaaaaaattcagatatctgg

SEQ ID NO: 11601 - DNA, 23 bp, Artificial Sequence
  X-linked inhibitor of apoptosis (XIAP) siRNA
aggaaaaaattcagatatctggg

SEQ ID NO: 11602 - DNA, 23 bp, Artificial Sequence
  X-linked inhibitor of apoptosis (XIAP) siRNA
ggaaaaaattcagatatctggga

SEQ ID NO: 11603 - DNA, 23 bp, Artificial Sequence
  X-linked inhibitor of apoptosis (XIAP) siRNA
gaaaaaattcagatatctgggag

SEQ ID NO: 11604 - DNA, 23 bp, Artificial Sequence
  X-linked inhibitor of apoptosis (XIAP) siRNA
aaaaaattcagatatctgggagc

SEQ ID NO: 11605 - DNA, 23 bp, Artificial Sequence
  X-linked inhibitor of apoptosis (XIAP) siRNA
aaaaattcagatatctgggagca

SEQ ID NO: 11606 - DNA, 23 bp, Artificial Sequence
  X-linked inhibitor of apoptosis (XIAP) siRNA
aaaattcagatatctgggagcaa

SEQ ID NO: 11607 - DNA, 23 bp, Artificial Sequence
  X-linked inhibitor of apoptosis (XIAP) siRNA
aaattcagatatctgggagcaac

SEQ ID NO: 11608 - DNA, 23 bp, Artificial Sequence
  X-linked inhibitor of apoptosis (XIAP) siRNA
aattcagatatctgggagcaact

SEQ ID NO: 11609 - DNA, 23 bp, Artificial Sequence
  X-linked inhibitor of apoptosis (XIAP) siRNA
attcagatatctgggagcaacta

SEQ ID NO: 11610 - DNA, 23 bp, Artificial Sequence
  X-linked inhibitor of apoptosis (XIAP) siRNA
ttcagatatctgggagcaactat

SEQ ID NO: 11611 - DNA, 23 bp, Artificial Sequence
  X-linked inhibitor of apoptosis (XIAP) siRNA
tcagatatctgggagcaactata

SEQ ID NO: 11612 - DNA, 23 bp, Artificial Sequence
  X-linked inhibitor of apoptosis (XIAP) siRNA
cagatatctgggagcaactataa

SEQ ID NO: 11613 - DNA, 23 bp, Artificial Sequence
  X-linked inhibitor of apoptosis (XIAP) siRNA
agatatctgggagcaactataaa

SEQ ID NO: 11614 - DNA, 23 bp, Artificial Sequence
  X-linked inhibitor of apoptosis (XIAP) siRNA
gatatctgggagcaactataaat

SEQ ID NO: 11615 - DNA, 23 bp, Artificial Sequence
  X-linked inhibitor of apoptosis (XIAP) siRNA
atatctgggagcaactataaatc

SEQ ID NO: 11616 - DNA, 23 bp, Artificial Sequence
  X-linked inhibitor of apoptosis (XIAP) siRNA
tatctgggagcaactataaatca

SEQ ID NO: 11617 - DNA, 23 bp, Artificial Sequence
  X-linked inhibitor of apoptosis (XIAP) siRNA
atctgggagcaactataaatcac

SEQ ID NO: 11618 - DNA, 23 bp, Artificial Sequence
  X-linked inhibitor of apoptosis (XIAP) siRNA
tctgggagcaactataaatcact

SEQ ID NO: 11619 - DNA, 23 bp, Artificial Sequence
  X-linked inhibitor of apoptosis (XIAP) siRNA
ctgggagcaactataaatcactt

SEQ ID NO: 11620 - DNA, 23 bp, Artificial Sequence
  X-linked inhibitor of apoptosis (XIAP) siRNA
tgggagcaactataaatcacttg

SEQ ID NO: 11621 - DNA, 23 bp, Artificial Sequence
  X-linked inhibitor of apoptosis (XIAP) siRNA
gggagcaactataaatcacttga

SEQ ID NO: 11622 - DNA, 23 bp, Artificial Sequence
  X-linked inhibitor of apoptosis (XIAP) siRNA
ggagcaactataaatcacttgag

SEQ ID NO: 11623 - DNA, 23 bp, Artificial Sequence
  X-linked inhibitor of apoptosis (XIAP) siRNA
gagcaactataaatcacttgagg

SEQ ID NO: 11624 - DNA, 23 bp, Artificial Sequence
  X-linked inhibitor of apoptosis (XIAP) siRNA
agcaactataaatcacttgaggt

SEQ ID NO: 11625 - DNA, 23 bp, Artificial Sequence
  X-linked inhibitor of apoptosis (XIAP) siRNA
gcaactataaatcacttgaggtt

SEQ ID NO: 11626 - DNA, 23 bp, Artificial Sequence
  X-linked inhibitor of apoptosis (XIAP) siRNA
caactataaatcacttgaggttc

SEQ ID NO: 11627 - DNA, 23 bp, Artificial Sequence
  X-linked inhibitor of apoptosis (XIAP) siRNA
aactataaatcacttgaggttct

SEQ ID NO: 11628 - DNA, 23 bp, Artificial Sequence
  X-linked inhibitor of apoptosis (XIAP) siRNA
actataaatcacttgaggttctg

SEQ ID NO: 11629 - DNA, 23 bp, Artificial Sequence
  X-linked inhibitor of apoptosis (XIAP) siRNA
ctataaatcacttgaggttctgg

SEQ ID NO: 11630 - DNA, 23 bp, Artificial Sequence
  X-linked inhibitor of apoptosis (XIAP) siRNA
tataaatcacttgaggttctggt

SEQ ID NO: 11631 - DNA, 23 bp, Artificial Sequence
  X-linked inhibitor of apoptosis (XIAP) siRNA
ataaatcacttgaggttctggtt

SEQ ID NO: 11632 - DNA, 23 bp, Artificial Sequence
  X-linked inhibitor of apoptosis (XIAP) siRNA
taaatcacttgaggttctggttg

SEQ ID NO: 11633 - DNA, 23 bp, Artificial Sequence
  X-linked inhibitor of apoptosis (XIAP) siRNA
aaatcacttgaggttctggttgc

SEQ ID NO: 11634 - DNA, 23 bp, Artificial Sequence
  X-linked inhibitor of apoptosis (XIAP) siRNA
aatcacttgaggttctggttgca

SEQ ID NO: 11635 - DNA, 23 bp, Artificial Sequence
  X-linked inhibitor of apoptosis (XIAP) siRNA
atcacttgaggttctggttgcag

SEQ ID NO: 11636 - DNA, 23 bp, Artificial Sequence
  X-linked inhibitor of apoptosis (XIAP) siRNA
tcacttgaggttctggttgcaga

SEQ ID NO: 11637 - DNA, 23 bp, Artificial Sequence
  X-linked inhibitor of apoptosis (XIAP) siRNA
cacttgaggttctggttgcagat

SEQ ID NO: 11638 - DNA, 23 bp, Artificial Sequence
  X-linked inhibitor of apoptosis (XIAP) siRNA
acttgaggttctggttgcagatc

SEQ ID NO: 11639 - DNA, 23 bp, Artificial Sequence
  X-linked inhibitor of apoptosis (XIAP) siRNA
cttgaggttctggttgcagatct

SEQ ID NO: 11640 - DNA, 23 bp, Artificial Sequence
  X-linked inhibitor of apoptosis (XIAP) siRNA
ttgaggttctggttgcagatcta

SEQ ID NO: 11641 - DNA, 23 bp, Artificial Sequence
  X-linked inhibitor of apoptosis (XIAP) siRNA
tgaggttctggttgcagatctag

SEQ ID NO: 11642 - DNA, 23 bp, Artificial Sequence
  X-linked inhibitor of apoptosis (XIAP) siRNA
gaggttctggttgcagatctagt

SEQ ID NO: 11643 - DNA, 23 bp, Artificial Sequence
  X-linked inhibitor of apoptosis (XIAP) siRNA
aggttctggttgcagatctagtg

SEQ ID NO: 11644 - DNA, 23 bp, Artificial Sequence
  X-linked inhibitor of apoptosis (XIAP) siRNA
ggttctggttgcagatctagtga

SEQ ID NO: 11645 - DNA, 23 bp, Artificial Sequence
  X-linked inhibitor of apoptosis (XIAP) siRNA
gttctggttgcagatctagtgaa

SEQ ID NO: 11646 - DNA, 23 bp, Artificial Sequence
  X-linked inhibitor of apoptosis (XIAP) siRNA
ttctggttgcagatctagtgaat

SEQ ID NO: 11647 - DNA, 23 bp, Artificial Sequence
  X-linked inhibitor of apoptosis (XIAP) siRNA
tctggttgcagatctagtgaatg

SEQ ID NO: 11648 - DNA, 23 bp, Artificial Sequence
  X-linked inhibitor of apoptosis (XIAP) siRNA
ctggttgcagatctagtgaatgc

SEQ ID NO: 11649 - DNA, 23 bp, Artificial Sequence
  X-linked inhibitor of apoptosis (XIAP) siRNA
tggttgcagatctagtgaatgct

SEQ ID NO: 11650 - DNA, 23 bp, Artificial Sequence
  X-linked inhibitor of apoptosis (XIAP) siRNA
ggttgcagatctagtgaatgctc

SEQ ID NO: 11651 - DNA, 23 bp, Artificial Sequence
  X-linked inhibitor of apoptosis (XIAP) siRNA
gttgcagatctagtgaatgctca

SEQ ID NO: 11652 - DNA, 23 bp, Artificial Sequence
  X-linked inhibitor of apoptosis (XIAP) siRNA
ttgcagatctagtgaatgctcag

SEQ ID NO: 11653 - DNA, 23 bp, Artificial Sequence
  X-linked inhibitor of apoptosis (XIAP) siRNA
tgcagatctagtgaatgctcaga

SEQ ID NO: 11654 - DNA, 23 bp, Artificial Sequence
  X-linked inhibitor of apoptosis (XIAP) siRNA
gcagatctagtgaatgctcagaa

SEQ ID NO: 11655 - DNA, 23 bp, Artificial Sequence
  X-linked inhibitor of apoptosis (XIAP) siRNA
cagatctagtgaatgctcagaaa

SEQ ID NO: 11656 - DNA, 23 bp, Artificial Sequence
  X-linked inhibitor of apoptosis (XIAP) siRNA
agatctagtgaatgctcagaaag

SEQ ID NO: 11657 - DNA, 23 bp, Artificial Sequence
  X-linked inhibitor of apoptosis (XIAP) siRNA
gatctagtgaatgctcagaaaga

SEQ ID NO: 11658 - DNA, 23 bp, Artificial Sequence
  X-linked inhibitor of apoptosis (XIAP) siRNA
atctagtgaatgctcagaaagac

SEQ ID NO: 11659 - DNA, 23 bp, Artificial Sequence
  X-linked inhibitor of apoptosis (XIAP) siRNA
tctagtgaatgctcagaaagaca

SEQ ID NO: 11660 - DNA, 23 bp, Artificial Sequence
  X-linked inhibitor of apoptosis (XIAP) siRNA
ctagtgaatgctcagaaagacag

SEQ ID NO: 11661 - DNA, 23 bp, Artificial Sequence
  X-linked inhibitor of apoptosis (XIAP) siRNA
tagtgaatgctcagaaagacagt

SEQ ID NO: 11662 - DNA, 23 bp, Artificial Sequence
  X-linked inhibitor of apoptosis (XIAP) siRNA
agtgaatgctcagaaagacagta

SEQ ID NO: 11663 - DNA, 23 bp, Artificial Sequence
  X-linked inhibitor of apoptosis (XIAP) siRNA
gtgaatgctcagaaagacagtat

SEQ ID NO: 11664 - DNA, 23 bp, Artificial Sequence
  X-linked inhibitor of apoptosis (XIAP) siRNA
tgaatgctcagaaagacagtatg

SEQ ID NO: 11665 - DNA, 23 bp, Artificial Sequence
  X-linked inhibitor of apoptosis (XIAP) siRNA
gaatgctcagaaagacagtatgc

SEQ ID NO: 11666 - DNA, 23 bp, Artificial Sequence
  X-linked inhibitor of apoptosis (XIAP) siRNA
aatgctcagaaagacagtatgca

SEQ ID NO: 11667 - DNA, 23 bp, Artificial Sequence
  X-linked inhibitor of apoptosis (XIAP) siRNA
atgctcagaaagacagtatgcaa

SEQ ID NO: 11668 - DNA, 23 bp, Artificial Sequence
  X-linked inhibitor of apoptosis (XIAP) siRNA
tgctcagaaagacagtatgcaag

SEQ ID NO: 11669 - DNA, 23 bp, Artificial Sequence
  X-linked inhibitor of apoptosis (XIAP) siRNA
gctcagaaagacagtatgcaaga

SEQ ID NO: 11670 - DNA, 23 bp, Artificial Sequence
  X-linked inhibitor of apoptosis (XIAP) siRNA
ctcagaaagacagtatgcaagat

SEQ ID NO: 11671 - DNA, 23 bp, Artificial Sequence
  X-linked inhibitor of apoptosis (XIAP) siRNA
tcagaaagacagtatgcaagatg

SEQ ID NO: 11672 - DNA, 23 bp, Artificial Sequence
  X-linked inhibitor of apoptosis (XIAP) siRNA
cagaaagacagtatgcaagatga

SEQ ID NO: 11673 - DNA, 23 bp, Artificial Sequence
  X-linked inhibitor of apoptosis (XIAP) siRNA
agaaagacagtatgcaagatgag

SEQ ID NO: 11674 - DNA, 23 bp, Artificial Sequence
  X-linked inhibitor of apoptosis (XIAP) siRNA
gaaagacagtatgcaagatgagt

SEQ ID NO: 11675 - DNA, 23 bp, Artificial Sequence
  X-linked inhibitor of apoptosis (XIAP) siRNA
aaagacagtatgcaagatgagtc

SEQ ID NO: 11676 - DNA, 23 bp, Artificial Sequence
  X-linked inhibitor of apoptosis (XIAP) siRNA
aagacagtatgcaagatgagtca

SEQ ID NO: 11677 - DNA, 23 bp, Artificial Sequence
  X-linked inhibitor of apoptosis (XIAP) siRNA
agacagtatgcaagatgagtcaa

SEQ ID NO: 11678 - DNA, 23 bp, Artificial Sequence
  X-linked inhibitor of apoptosis (XIAP) siRNA
gacagtatgcaagatgagtcaag

SEQ ID NO: 11679 - DNA, 23 bp, Artificial Sequence
  X-linked inhibitor of apoptosis (XIAP) siRNA
acagtatgcaagatgagtcaagt

SEQ ID NO: 11680 - DNA, 23 bp, Artificial Sequence
  X-linked inhibitor of apoptosis (XIAP) siRNA
cagtatgcaagatgagtcaagtc

SEQ ID NO: 11681 - DNA, 23 bp, Artificial Sequence
  X-linked inhibitor of apoptosis (XIAP) siRNA
agtatgcaagatgagtcaagtca

SEQ ID NO: 11682 - DNA, 23 bp, Artificial Sequence
  X-linked inhibitor of apoptosis (XIAP) siRNA
gtatgcaagatgagtcaagtcag

SEQ ID NO: 11683 - DNA, 23 bp, Artificial Sequence
  X-linked inhibitor of apoptosis (XIAP) siRNA
tatgcaagatgagtcaagtcaga

SEQ ID NO: 11684 - DNA, 23 bp, Artificial Sequence
  X-linked inhibitor of apoptosis (XIAP) siRNA
atgcaagatgagtcaagtcagac

SEQ ID NO: 11685 - DNA, 23 bp, Artificial Sequence
  X-linked inhibitor of apoptosis (XIAP) siRNA
tgcaagatgagtcaagtcagact

SEQ ID NO: 11686 - DNA, 23 bp, Artificial Sequence
  X-linked inhibitor of apoptosis (XIAP) siRNA
gcaagatgagtcaagtcagactt

SEQ ID NO: 11687 - DNA, 23 bp, Artificial Sequence
  X-linked inhibitor of apoptosis (XIAP) siRNA
caagatgagtcaagtcagacttc

SEQ ID NO: 11688 - DNA, 23 bp, Artificial Sequence
  X-linked inhibitor of apoptosis (XIAP) siRNA
aagatgagtcaagtcagacttca

SEQ ID NO: 11689 - DNA, 23 bp, Artificial Sequence
  X-linked inhibitor of apoptosis (XIAP) siRNA
agatgagtcaagtcagacttcat

SEQ ID NO: 11690 - DNA, 23 bp, Artificial Sequence
  X-linked inhibitor of apoptosis (XIAP) siRNA
gatgagtcaagtcagacttcatt

SEQ ID NO: 11691 - DNA, 23 bp, Artificial Sequence
  X-linked inhibitor of apoptosis (XIAP) siRNA
atgagtcaagtcagacttcatta

SEQ ID NO: 11692 - DNA, 23 bp, Artificial Sequence
  X-linked inhibitor of apoptosis (XIAP) siRNA
tgagtcaagtcagacttcattac

SEQ ID NO: 11693 - DNA, 23 bp, Artificial Sequence
  X-linked inhibitor of apoptosis (XIAP) siRNA
gagtcaagtcagacttcattaca

SEQ ID NO: 11694 - DNA, 23 bp, Artificial Sequence
  X-linked inhibitor of apoptosis (XIAP) siRNA
agtcaagtcagacttcattacag

SEQ ID NO: 11695 - DNA, 23 bp, Artificial Sequence
  X-linked inhibitor of apoptosis (XIAP) siRNA
gtcaagtcagacttcattacaga

SEQ ID NO: 11696 - DNA, 23 bp, Artificial Sequence
  X-linked inhibitor of apoptosis (XIAP) siRNA
tcaagtcagacttcattacagaa

SEQ ID NO: 11697 - DNA, 23 bp, Artificial Sequence
  X-linked inhibitor of apoptosis (XIAP) siRNA
caagtcagacttcattacagaaa

SEQ ID NO: 11698 - DNA, 23 bp, Artificial Sequence
  X-linked inhibitor of apoptosis (XIAP) siRNA
aagtcagacttcattacagaaag

SEQ ID NO: 11699 - DNA, 23 bp, Artificial Sequence
  X-linked inhibitor of apoptosis (XIAP) siRNA
agtcagacttcattacagaaaga

SEQ ID NO: 11700 - DNA, 23 bp, Artificial Sequence
  X-linked inhibitor of apoptosis (XIAP) siRNA
gtcagacttcattacagaaagag

SEQ ID NO: 11701 - DNA, 23 bp, Artificial Sequence
  X-linked inhibitor of apoptosis (XIAP) siRNA
tcagacttcattacagaaagaga

SEQ ID NO: 11702 - DNA, 23 bp, Artificial Sequence
  X-linked inhibitor of apoptosis (XIAP) siRNA
cagacttcattacagaaagagat

SEQ ID NO: 11703 - DNA, 23 bp, Artificial Sequence
  X-linked inhibitor of apoptosis (XIAP) siRNA
agacttcattacagaaagagatt

SEQ ID NO: 11704 - DNA, 23 bp, Artificial Sequence
  X-linked inhibitor of apoptosis (XIAP) siRNA
gacttcattacagaaagagatta

SEQ ID NO: 11705 - DNA, 23 bp, Artificial Sequence
  X-linked inhibitor of apoptosis (XIAP) siRNA
acttcattacagaaagagattag

SEQ ID NO: 11706 - DNA, 23 bp, Artificial Sequence
  X-linked inhibitor of apoptosis (XIAP) siRNA
cttcattacagaaagagattagt

SEQ ID NO: 11707 - DNA, 23 bp, Artificial Sequence
  X-linked inhibitor of apoptosis (XIAP) siRNA
ttcattacagaaagagattagta

SEQ ID NO: 11708 - DNA, 23 bp, Artificial Sequence
  X-linked inhibitor of apoptosis (XIAP) siRNA
tcattacagaaagagattagtac

SEQ ID NO: 11709 - DNA, 23 bp, Artificial Sequence
  X-linked inhibitor of apoptosis (XIAP) siRNA
cattacagaaagagattagtact

SEQ ID NO: 11710 - DNA, 23 bp, Artificial Sequence
  X-linked inhibitor of apoptosis (XIAP) siRNA
attacagaaagagattagtactg

SEQ ID NO: 11711 - DNA, 23 bp, Artificial Sequence
  X-linked inhibitor of apoptosis (XIAP) siRNA
ttacagaaagagattagtactga

SEQ ID NO: 11712 - DNA, 23 bp, Artificial Sequence
  X-linked inhibitor of apoptosis (XIAP) siRNA
tacagaaagagattagtactgaa

SEQ ID NO: 11713 - DNA, 23 bp, Artificial Sequence
  X-linked inhibitor of apoptosis (XIAP) siRNA
acagaaagagattagtactgaag

SEQ ID NO: 11714 - DNA, 23 bp, Artificial Sequence
  X-linked inhibitor of apoptosis (XIAP) siRNA
cagaaagagattagtactgaaga

SEQ ID NO: 11715 - DNA, 23 bp, Artificial Sequence
  X-linked inhibitor of apoptosis (XIAP) siRNA
agaaagagattagtactgaagag

SEQ ID NO: 11716 - DNA, 23 bp, Artificial Sequence
  X-linked inhibitor of apoptosis (XIAP) siRNA
gaaagagattagtactgaagagc

SEQ ID NO: 11717 - DNA, 23 bp, Artificial Sequence
  X-linked inhibitor of apoptosis (XIAP) siRNA
aaagagattagtactgaagagca

SEQ ID NO: 11718 - DNA, 23 bp, Artificial Sequence
  X-linked inhibitor of apoptosis (XIAP) siRNA
aagagattagtactgaagagcag

SEQ ID NO: 11719 - DNA, 23 bp, Artificial Sequence
  X-linked inhibitor of apoptosis (XIAP) siRNA
agagattagtactgaagagcagc

SEQ ID NO: 11720 - DNA, 23 bp, Artificial Sequence
  X-linked inhibitor of apoptosis (XIAP) siRNA
gagattagtactgaagagcagct

SEQ ID NO: 11721 - DNA, 23 bp, Artificial Sequence
  X-linked inhibitor of apoptosis (XIAP) siRNA
agattagtactgaagagcagcta

SEQ ID NO: 11722 - DNA, 23 bp, Artificial Sequence
  X-linked inhibitor of apoptosis (XIAP) siRNA
gattagtactgaagagcagctaa

SEQ ID NO: 11723 - DNA, 23 bp, Artificial Sequence
  X-linked inhibitor of apoptosis (XIAP) siRNA
attagtactgaagagcagctaag

SEQ ID NO: 11724 - DNA, 23 bp, Artificial Sequence
  X-linked inhibitor of apoptosis (XIAP) siRNA
ttagtactgaagagcagctaagg

SEQ ID NO: 11725 - DNA, 23 bp, Artificial Sequence
  X-linked inhibitor of apoptosis (XIAP) siRNA
tagtactgaagagcagctaaggc

SEQ ID NO: 11726 - DNA, 23 bp, Artificial Sequence
  X-linked inhibitor of apoptosis (XIAP) siRNA
agtactgaagagcagctaaggcg

SEQ ID NO: 11727 - DNA, 23 bp, Artificial Sequence
  X-linked inhibitor of apoptosis (XIAP) siRNA
gtactgaagagcagctaaggcgc

SEQ ID NO: 11728 - DNA, 23 bp, Artificial Sequence
  X-linked inhibitor of apoptosis (XIAP) siRNA
tactgaagagcagctaaggcgcc

SEQ ID NO: 11729 - DNA, 23 bp, Artificial Sequence
  X-linked inhibitor of apoptosis (XIAP) siRNA
actgaagagcagctaaggcgcct

SEQ ID NO: 11730 - DNA, 23 bp, Artificial Sequence
  X-linked inhibitor of apoptosis (XIAP) siRNA
ctgaagagcagctaaggcgcctg

SEQ ID NO: 11731 - DNA, 23 bp, Artificial Sequence
  X-linked inhibitor of apoptosis (XIAP) siRNA
tgaagagcagctaaggcgcctgc

SEQ ID NO: 11732 - DNA, 23 bp, Artificial Sequence
  X-linked inhibitor of apoptosis (XIAP) siRNA
gaagagcagctaaggcgcctgca

SEQ ID NO: 11733 - DNA, 23 bp, Artificial Sequence
  X-linked inhibitor of apoptosis (XIAP) siRNA
aagagcagctaaggcgcctgcaa

SEQ ID NO: 11734 - DNA, 23 bp, Artificial Sequence
  X-linked inhibitor of apoptosis (XIAP) siRNA
agagcagctaaggcgcctgcaag

SEQ ID NO: 11735 - DNA, 23 bp, Artificial Sequence
  X-linked inhibitor of apoptosis (XIAP) siRNA
gagcagctaaggcgcctgcaaga

SEQ ID NO: 11736 - DNA, 23 bp, Artificial Sequence
  X-linked inhibitor of apoptosis (XIAP) siRNA
agcagctaaggcgcctgcaagag

SEQ ID NO: 11737 - DNA, 23 bp, Artificial Sequence
  X-linked inhibitor of apoptosis (XIAP) siRNA
gcagctaaggcgcctgcaagagg

SEQ ID NO: 11738 - DNA, 23 bp, Artificial Sequence
  X-linked inhibitor of apoptosis (XIAP) siRNA
cagctaaggcgcctgcaagagga

SEQ ID NO: 11739 - DNA, 23 bp, Artificial Sequence
  X-linked inhibitor of apoptosis (XIAP) siRNA
agctaaggcgcctgcaagaggag

SEQ ID NO: 11740 - DNA, 23 bp, Artificial Sequence
  X-linked inhibitor of apoptosis (XIAP) siRNA
gctaaggcgcctgcaagaggaga

SEQ ID NO: 11741 - DNA, 23 bp, Artificial Sequence
  X-linked inhibitor of apoptosis (XIAP) siRNA
ctaaggcgcctgcaagaggagaa

SEQ ID NO: 11742 - DNA, 23 bp, Artificial Sequence
  X-linked inhibitor of apoptosis (XIAP) siRNA
taaggcgcctgcaagaggagaag

SEQ ID NO: 11743 - DNA, 23 bp, Artificial Sequence
  X-linked inhibitor of apoptosis (XIAP) siRNA
aaggcgcctgcaagaggagaagc

SEQ ID NO: 11744 - DNA, 23 bp, Artificial Sequence
  X-linked inhibitor of apoptosis (XIAP) siRNA
aggcgcctgcaagaggagaagct

SEQ ID NO: 11745 - DNA, 23 bp, Artificial Sequence
  X-linked inhibitor of apoptosis (XIAP) siRNA
ggcgcctgcaagaggagaagctt

SEQ ID NO: 11746 - DNA, 23 bp, Artificial Sequence
  X-linked inhibitor of apoptosis (XIAP) siRNA
gcgcctgcaagaggagaagcttt

SEQ ID NO: 11747 - DNA, 23 bp, Artificial Sequence
  X-linked inhibitor of apoptosis (XIAP) siRNA
cgcctgcaagaggagaagctttg

SEQ ID NO: 11748 - DNA, 23 bp, Artificial Sequence
  X-linked inhibitor of apoptosis (XIAP) siRNA
gcctgcaagaggagaagctttgc

SEQ ID NO: 11749 - DNA, 23 bp, Artificial Sequence
  X-linked inhibitor of apoptosis (XIAP) siRNA
cctgcaagaggagaagctttgca

SEQ ID NO: 11750 - DNA, 23 bp, Artificial Sequence
  X-linked inhibitor of apoptosis (XIAP) siRNA
ctgcaagaggagaagctttgcaa

SEQ ID NO: 11751 - DNA, 23 bp, Artificial Sequence
  X-linked inhibitor of apoptosis (XIAP) siRNA
tgcaagaggagaagctttgcaaa

SEQ ID NO: 11752 - DNA, 23 bp, Artificial Sequence
  X-linked inhibitor of apoptosis (XIAP) siRNA
gcaagaggagaagctttgcaaaa

SEQ ID NO: 11753 - DNA, 23 bp, Artificial Sequence
  X-linked inhibitor of apoptosis (XIAP) siRNA
caagaggagaagctttgcaaaat

SEQ ID NO: 11754 - DNA, 23 bp, Artificial Sequence
  X-linked inhibitor of apoptosis (XIAP) siRNA
aagaggagaagctttgcaaaatc

SEQ ID NO: 11755 - DNA, 23 bp, Artificial Sequence
  X-linked inhibitor of apoptosis (XIAP) siRNA
agaggagaagctttgcaaaatct

SEQ ID NO: 11756 - DNA, 23 bp, Artificial Sequence
  X-linked inhibitor of apoptosis (XIAP) siRNA
gaggagaagctttgcaaaatctg

SEQ ID NO: 11757 - DNA, 23 bp, Artificial Sequence
  X-linked inhibitor of apoptosis (XIAP) siRNA
aggagaagctttgcaaaatctgt

SEQ ID NO: 11758 - DNA, 23 bp, Artificial Sequence
  X-linked inhibitor of apoptosis (XIAP) siRNA
ggagaagctttgcaaaatctgta

SEQ ID NO: 11759 - DNA, 23 bp, Artificial Sequence
  X-linked inhibitor of apoptosis (XIAP) siRNA
gagaagctttgcaaaatctgtat

SEQ ID NO: 11760 - DNA, 23 bp, Artificial Sequence
  X-linked inhibitor of apoptosis (XIAP) siRNA
agaagctttgcaaaatctgtatg

SEQ ID NO: 11761 - DNA, 23 bp, Artificial Sequence
  X-linked inhibitor of apoptosis (XIAP) siRNA
gaagctttgcaaaatctgtatgg

SEQ ID NO: 11762 - DNA, 23 bp, Artificial Sequence
  X-linked inhibitor of apoptosis (XIAP) siRNA
aagctttgcaaaatctgtatgga

SEQ ID NO: 11763 - DNA, 23 bp, Artificial Sequence
  X-linked inhibitor of apoptosis (XIAP) siRNA
agctttgcaaaatctgtatggat

SEQ ID NO: 11764 - DNA, 23 bp, Artificial Sequence
  X-linked inhibitor of apoptosis (XIAP) siRNA
gctttgcaaaatctgtatggata

SEQ ID NO: 11765 - DNA, 23 bp, Artificial Sequence
  X-linked inhibitor of apoptosis (XIAP) siRNA
ctttgcaaaatctgtatggatag

SEQ ID NO: 11766 - DNA, 23 bp, Artificial Sequence
  X-linked inhibitor of apoptosis (XIAP) siRNA
tttgcaaaatctgtatggataga

SEQ ID NO: 11767 - DNA, 23 bp, Artificial Sequence
  X-linked inhibitor of apoptosis (XIAP) siRNA
ttgcaaaatctgtatggatagaa

SEQ ID NO: 11768 - DNA, 23 bp, Artificial Sequence
  X-linked inhibitor of apoptosis (XIAP) siRNA
tgcaaaatctgtatggatagaaa

SEQ ID NO: 11769 - DNA, 23 bp, Artificial Sequence
  X-linked inhibitor of apoptosis (XIAP) siRNA
gcaaaatctgtatggatagaaat

SEQ ID NO: 11770 - DNA, 23 bp, Artificial Sequence
  X-linked inhibitor of apoptosis (XIAP) siRNA
caaaatctgtatggatagaaata

SEQ ID NO: 11771 - DNA, 23 bp, Artificial Sequence
  X-linked inhibitor of apoptosis (XIAP) siRNA
aaaatctgtatggatagaaatat

SEQ ID NO: 11772 - DNA, 23 bp, Artificial Sequence
  X-linked inhibitor of apoptosis (XIAP) siRNA
aaatctgtatggatagaaatatt

SEQ ID NO: 11773 - DNA, 23 bp, Artificial Sequence
  X-linked inhibitor of apoptosis (XIAP) siRNA
aatctgtatggatagaaatattg

SEQ ID NO: 11774 - DNA, 23 bp, Artificial Sequence
  X-linked inhibitor of apoptosis (XIAP) siRNA
atctgtatggatagaaatattgc

SEQ ID NO: 11775 - DNA, 23 bp, Artificial Sequence
  X-linked inhibitor of apoptosis (XIAP) siRNA
tctgtatggatagaaatattgct

SEQ ID NO: 11776 - DNA, 23 bp, Artificial Sequence
  X-linked inhibitor of apoptosis (XIAP) siRNA
ctgtatggatagaaatattgcta

SEQ ID NO: 11777 - DNA, 23 bp, Artificial Sequence
  X-linked inhibitor of apoptosis (XIAP) siRNA
tgtatggatagaaatattgctat

SEQ ID NO: 11778 - DNA, 23 bp, Artificial Sequence
  X-linked inhibitor of apoptosis (XIAP) siRNA
gtatggatagaaatattgctatc

SEQ ID NO: 11779 - DNA, 23 bp, Artificial Sequence
  X-linked inhibitor of apoptosis (XIAP) siRNA
tatggatagaaatattgctatcg

SEQ ID NO: 11780 - DNA, 23 bp, Artificial Sequence
  X-linked inhibitor of apoptosis (XIAP) siRNA
atggatagaaatattgctatcgt

SEQ ID NO: 11781 - DNA, 23 bp, Artificial Sequence
  X-linked inhibitor of apoptosis (XIAP) siRNA
tggatagaaatattgctatcgtt

SEQ ID NO: 11782 - DNA, 23 bp, Artificial Sequence
  X-linked inhibitor of apoptosis (XIAP) siRNA
ggatagaaatattgctatcgttt

SEQ ID NO: 11783 - DNA, 23 bp, Artificial Sequence
  X-linked inhibitor of apoptosis (XIAP) siRNA
gatagaaatattgctatcgtttt

SEQ ID NO: 11784 - DNA, 23 bp, Artificial Sequence
  X-linked inhibitor of apoptosis (XIAP) siRNA
atagaaatattgctatcgttttt

SEQ ID NO: 11785 - DNA, 23 bp, Artificial Sequence
  X-linked inhibitor of apoptosis (XIAP) siRNA
tagaaatattgctatcgtttttg

SEQ ID NO: 11786 - DNA, 23 bp, Artificial Sequence
  X-linked inhibitor of apoptosis (XIAP) siRNA
agaaatattgctatcgtttttgt

SEQ ID NO: 11787 - DNA, 23 bp, Artificial Sequence
  X-linked inhibitor of apoptosis (XIAP) siRNA
gaaatattgctatcgtttttgtt

SEQ ID NO: 11788 - DNA, 23 bp, Artificial Sequence
  X-linked inhibitor of apoptosis (XIAP) siRNA
aaatattgctatcgtttttgttc

SEQ ID NO: 11789 - DNA, 23 bp, Artificial Sequence
  X-linked inhibitor of apoptosis (XIAP) siRNA
aatattgctatcgtttttgttcc

SEQ ID NO: 11790 - DNA, 23 bp, Artificial Sequence
  X-linked inhibitor of apoptosis (XIAP) siRNA
atattgctatcgtttttgttcct

SEQ ID NO: 11791 - DNA, 23 bp, Artificial Sequence
  X-linked inhibitor of apoptosis (XIAP) siRNA
tattgctatcgtttttgttcctt

SEQ ID NO: 11792 - DNA, 23 bp, Artificial Sequence
  X-linked inhibitor of apoptosis (XIAP) siRNA
attgctatcgtttttgttccttg

SEQ ID NO: 11793 - DNA, 23 bp, Artificial Sequence
  X-linked inhibitor of apoptosis (XIAP) siRNA
ttgctatcgtttttgttccttgt

SEQ ID NO: 11794 - DNA, 23 bp, Artificial Sequence
  X-linked inhibitor of apoptosis (XIAP) siRNA
tgctatcgtttttgttccttgtg

SEQ ID NO: 11795 - DNA, 23 bp, Artificial Sequence
  X-linked inhibitor of apoptosis (XIAP) siRNA
gctatcgtttttgttccttgtgg

SEQ ID NO: 11796 - DNA, 23 bp, Artificial Sequence
  X-linked inhibitor of apoptosis (XIAP) siRNA
ctatcgtttttgttccttgtgga

SEQ ID NO: 11797 - DNA, 23 bp, Artificial Sequence
  X-linked inhibitor of apoptosis (XIAP) siRNA
tatcgtttttgttccttgtggac

SEQ ID NO: 11798 - DNA, 23 bp, Artificial Sequence
  X-linked inhibitor of apoptosis (XIAP) siRNA
atcgtttttgttccttgtggaca

SEQ ID NO: 11799 - DNA, 23 bp, Artificial Sequence
  X-linked inhibitor of apoptosis (XIAP) siRNA
tcgtttttgttccttgtggacat

SEQ ID NO: 11800 - DNA, 23 bp, Artificial Sequence
  X-linked inhibitor of apoptosis (XIAP) siRNA
cgtttttgttccttgtggacatc

SEQ ID NO: 11801 - DNA, 23 bp, Artificial Sequence
  X-linked inhibitor of apoptosis (XIAP) siRNA
gtttttgttccttgtggacatct

SEQ ID NO: 11802 - DNA, 23 bp, Artificial Sequence
  X-linked inhibitor of apoptosis (XIAP) siRNA
tttttgttccttgtggacatcta

SEQ ID NO: 11803 - DNA, 23 bp, Artificial Sequence
  X-linked inhibitor of apoptosis (XIAP) siRNA
ttttgttccttgtggacatctag

SEQ ID NO: 11804 - DNA, 23 bp, Artificial Sequence
  X-linked inhibitor of apoptosis (XIAP) siRNA
tttgttccttgtggacatctagt

SEQ ID NO: 11805 - DNA, 23 bp, Artificial Sequence
  X-linked inhibitor of apoptosis (XIAP) siRNA
ttgttccttgtggacatctagtc

SEQ ID NO: 11806 - DNA, 23 bp, Artificial Sequence
  X-linked inhibitor of apoptosis (XIAP) siRNA
tgttccttgtggacatctagtca

SEQ ID NO: 11807 - DNA, 23 bp, Artificial Sequence
  X-linked inhibitor of apoptosis (XIAP) siRNA
gttccttgtggacatctagtcac

SEQ ID NO: 11808 - DNA, 23 bp, Artificial Sequence
  X-linked inhibitor of apoptosis (XIAP) siRNA
ttccttgtggacatctagtcact

SEQ ID NO: 11809 - DNA, 23 bp, Artificial Sequence
  X-linked inhibitor of apoptosis (XIAP) siRNA
tccttgtggacatctagtcactt

SEQ ID NO: 11810 - DNA, 23 bp, Artificial Sequence
  X-linked inhibitor of apoptosis (XIAP) siRNA
ccttgtggacatctagtcacttg

SEQ ID NO: 11811 - DNA, 23 bp, Artificial Sequence
  X-linked inhibitor of apoptosis (XIAP) siRNA
cttgtggacatctagtcacttgt

SEQ ID NO: 11812 - DNA, 23 bp, Artificial Sequence
  X-linked inhibitor of apoptosis (XIAP) siRNA
ttgtggacatctagtcacttgta

SEQ ID NO: 11813 - DNA, 23 bp, Artificial Sequence
  X-linked inhibitor of apoptosis (XIAP) siRNA
tgtggacatctagtcacttgtaa

SEQ ID NO: 11814 - DNA, 23 bp, Artificial Sequence
  X-linked inhibitor of apoptosis (XIAP) siRNA
gtggacatctagtcacttgtaaa

SEQ ID NO: 11815 - DNA, 23 bp, Artificial Sequence
  X-linked inhibitor of apoptosis (XIAP) siRNA
tggacatctagtcacttgtaaac

SEQ ID NO: 11816 - DNA, 23 bp, Artificial Sequence
  X-linked inhibitor of apoptosis (XIAP) siRNA
ggacatctagtcacttgtaaaca

SEQ ID NO: 11817 - DNA, 23 bp, Artificial Sequence
  X-linked inhibitor of apoptosis (XIAP) siRNA
gacatctagtcacttgtaaacaa

SEQ ID NO: 11818 - DNA, 23 bp, Artificial Sequence
  X-linked inhibitor of apoptosis (XIAP) siRNA
acatctagtcacttgtaaacaat

SEQ ID NO: 11819 - DNA, 23 bp, Artificial Sequence
  X-linked inhibitor of apoptosis (XIAP) siRNA
catctagtcacttgtaaacaatg

SEQ ID NO: 11820 - DNA, 23 bp, Artificial Sequence
  X-linked inhibitor of apoptosis (XIAP) siRNA
atctagtcacttgtaaacaatgt

SEQ ID NO: 11821 - DNA, 23 bp, Artificial Sequence
  X-linked inhibitor of apoptosis (XIAP) siRNA
tctagtcacttgtaaacaatgtg

SEQ ID NO: 11822 - DNA, 23 bp, Artificial Sequence
  X-linked inhibitor of apoptosis (XIAP) siRNA
ctagtcacttgtaaacaatgtgc

SEQ ID NO: 11823 - DNA, 23 bp, Artificial Sequence
  X-linked inhibitor of apoptosis (XIAP) siRNA
tagtcacttgtaaacaatgtgct

SEQ ID NO: 11824 - DNA, 23 bp, Artificial Sequence
  X-linked inhibitor of apoptosis (XIAP) siRNA
agtcacttgtaaacaatgtgctg

SEQ ID NO: 11825 - DNA, 23 bp, Artificial Sequence
  X-linked inhibitor of apoptosis (XIAP) siRNA
gtcacttgtaaacaatgtgctga

SEQ ID NO: 11826 - DNA, 23 bp, Artificial Sequence
  X-linked inhibitor of apoptosis (XIAP) siRNA
tcacttgtaaacaatgtgctgaa

SEQ ID NO: 11827 - DNA, 23 bp, Artificial Sequence
  X-linked inhibitor of apoptosis (XIAP) siRNA
cacttgtaaacaatgtgctgaag

SEQ ID NO: 11828 - DNA, 23 bp, Artificial Sequence
  X-linked inhibitor of apoptosis (XIAP) siRNA
acttgtaaacaatgtgctgaagc

SEQ ID NO: 11829 - DNA, 23 bp, Artificial Sequence
  X-linked inhibitor of apoptosis (XIAP) siRNA
cttgtaaacaatgtgctgaagca

SEQ ID NO: 11830 - DNA, 23 bp, Artificial Sequence
  X-linked inhibitor of apoptosis (XIAP) siRNA
ttgtaaacaatgtgctgaagcag

SEQ ID NO: 11831 - DNA, 23 bp, Artificial Sequence
  X-linked inhibitor of apoptosis (XIAP) siRNA
tgtaaacaatgtgctgaagcagt

SEQ ID NO: 11832 - DNA, 23 bp, Artificial Sequence
  X-linked inhibitor of apoptosis (XIAP) siRNA
gtaaacaatgtgctgaagcagtt

SEQ ID NO: 11833 - DNA, 23 bp, Artificial Sequence
  X-linked inhibitor of apoptosis (XIAP) siRNA
taaacaatgtgctgaagcagttg

SEQ ID NO: 11834 - DNA, 23 bp, Artificial Sequence
  X-linked inhibitor of apoptosis (XIAP) siRNA
aaacaatgtgctgaagcagttga

SEQ ID NO: 11835 - DNA, 23 bp, Artificial Sequence
  X-linked inhibitor of apoptosis (XIAP) siRNA
aacaatgtgctgaagcagttgac

SEQ ID NO: 11836 - DNA, 23 bp, Artificial Sequence
  X-linked inhibitor of apoptosis (XIAP) siRNA
acaatgtgctgaagcagttgaca

SEQ ID NO: 11837 - DNA, 23 bp, Artificial Sequence
  X-linked inhibitor of apoptosis (XIAP) siRNA
caatgtgctgaagcagttgacaa

SEQ ID NO: 11838 - DNA, 23 bp, Artificial Sequence
  X-linked inhibitor of apoptosis (XIAP) siRNA
aatgtgctgaagcagttgacaag

SEQ ID NO: 11839 - DNA, 23 bp, Artificial Sequence
  X-linked inhibitor of apoptosis (XIAP) siRNA
atgtgctgaagcagttgacaagt

SEQ ID NO: 11840 - DNA, 23 bp, Artificial Sequence
  X-linked inhibitor of apoptosis (XIAP) siRNA
tgtgctgaagcagttgacaagtg

SEQ ID NO: 11841 - DNA, 23 bp, Artificial Sequence
  X-linked inhibitor of apoptosis (XIAP) siRNA
gtgctgaagcagttgacaagtgt

SEQ ID NO: 11842 - DNA, 23 bp, Artificial Sequence
  X-linked inhibitor of apoptosis (XIAP) siRNA
tgctgaagcagttgacaagtgtc

SEQ ID NO: 11843 - DNA, 23 bp, Artificial Sequence
  X-linked inhibitor of apoptosis (XIAP) siRNA
gctgaagcagttgacaagtgtcc

SEQ ID NO: 11844 - DNA, 23 bp, Artificial Sequence
  X-linked inhibitor of apoptosis (XIAP) siRNA
ctgaagcagttgacaagtgtccc

SEQ ID NO: 11845 - DNA, 23 bp, Artificial Sequence
  X-linked inhibitor of apoptosis (XIAP) siRNA
tgaagcagttgacaagtgtccca

SEQ ID NO: 11846 - DNA, 23 bp, Artificial Sequence
  X-linked inhibitor of apoptosis (XIAP) siRNA
gaagcagttgacaagtgtcccat

SEQ ID NO: 11847 - DNA, 23 bp, Artificial Sequence
  X-linked inhibitor of apoptosis (XIAP) siRNA
aagcagttgacaagtgtcccatg

SEQ ID NO: 11848 - DNA, 23 bp, Artificial Sequence
  X-linked inhibitor of apoptosis (XIAP) siRNA
agcagttgacaagtgtcccatgt

SEQ ID NO: 11849 - DNA, 23 bp, Artificial Sequence
  X-linked inhibitor of apoptosis (XIAP) siRNA
gcagttgacaagtgtcccatgtg

SEQ ID NO: 11850 - DNA, 23 bp, Artificial Sequence
  X-linked inhibitor of apoptosis (XIAP) siRNA
cagttgacaagtgtcccatgtgc

SEQ ID NO: 11851 - DNA, 23 bp, Artificial Sequence
  X-linked inhibitor of apoptosis (XIAP) siRNA
agttgacaagtgtcccatgtgct

SEQ ID NO: 11852 - DNA, 23 bp, Artificial Sequence
  X-linked inhibitor of apoptosis (XIAP) siRNA
gttgacaagtgtcccatgtgcta

SEQ ID NO: 11853 - DNA, 23 bp, Artificial Sequence
  X-linked inhibitor of apoptosis (XIAP) siRNA
ttgacaagtgtcccatgtgctac

SEQ ID NO: 11854 - DNA, 23 bp, Artificial Sequence
  X-linked inhibitor of apoptosis (XIAP) siRNA
tgacaagtgtcccatgtgctaca

SEQ ID NO: 11855 - DNA, 23 bp, Artificial Sequence
  X-linked inhibitor of apoptosis (XIAP) siRNA
gacaagtgtcccatgtgctacac

SEQ ID NO: 11856 - DNA, 23 bp, Artificial Sequence
  X-linked inhibitor of apoptosis (XIAP) siRNA
acaagtgtcccatgtgctacaca

SEQ ID NO: 11857 - DNA, 23 bp, Artificial Sequence
  X-linked inhibitor of apoptosis (XIAP) siRNA
caagtgtcccatgtgctacacag

SEQ ID NO: 11858 - DNA, 23 bp, Artificial Sequence
  X-linked inhibitor of apoptosis (XIAP) siRNA
aagtgtcccatgtgctacacagt

SEQ ID NO: 11859 - DNA, 23 bp, Artificial Sequence
  X-linked inhibitor of apoptosis (XIAP) siRNA
agtgtcccatgtgctacacagtc

SEQ ID NO: 11860 - DNA, 23 bp, Artificial Sequence
  X-linked inhibitor of apoptosis (XIAP) siRNA
gtgtcccatgtgctacacagtca

SEQ ID NO: 11861 - DNA, 23 bp, Artificial Sequence
  X-linked inhibitor of apoptosis (XIAP) siRNA
tgtcccatgtgctacacagtcat

SEQ ID NO: 11862 - DNA, 23 bp, Artificial Sequence
  X-linked inhibitor of apoptosis (XIAP) siRNA
gtcccatgtgctacacagtcatt

SEQ ID NO: 11863 - DNA, 23 bp, Artificial Sequence
  X-linked inhibitor of apoptosis (XIAP) siRNA
tcccatgtgctacacagtcatta

SEQ ID NO: 11864 - DNA, 23 bp, Artificial Sequence
  X-linked inhibitor of apoptosis (XIAP) siRNA
cccatgtgctacacagtcattac

SEQ ID NO: 11865 - DNA, 23 bp, Artificial Sequence
  X-linked inhibitor of apoptosis (XIAP) siRNA
ccatgtgctacacagtcattact

SEQ ID NO: 11866 - DNA, 23 bp, Artificial Sequence
  X-linked inhibitor of apoptosis (XIAP) siRNA
catgtgctacacagtcattactt

SEQ ID NO: 11867 - DNA, 23 bp, Artificial Sequence
  X-linked inhibitor of apoptosis (XIAP) siRNA
atgtgctacacagtcattacttt

SEQ ID NO: 11868 - DNA, 23 bp, Artificial Sequence
  X-linked inhibitor of apoptosis (XIAP) siRNA
tgtgctacacagtcattactttc

SEQ ID NO: 11869 - DNA, 23 bp, Artificial Sequence
  X-linked inhibitor of apoptosis (XIAP) siRNA
gtgctacacagtcattactttca

SEQ ID NO: 11870 - DNA, 23 bp, Artificial Sequence
  X-linked inhibitor of apoptosis (XIAP) siRNA
tgctacacagtcattactttcaa

SEQ ID NO: 11871 - DNA, 23 bp, Artificial Sequence
  X-linked inhibitor of apoptosis (XIAP) siRNA
gctacacagtcattactttcaag

SEQ ID NO: 11872 - DNA, 23 bp, Artificial Sequence
  X-linked inhibitor of apoptosis (XIAP) siRNA
ctacacagtcattactttcaagc

SEQ ID NO: 11873 - DNA, 23 bp, Artificial Sequence
  X-linked inhibitor of apoptosis (XIAP) siRNA
tacacagtcattactttcaagca

SEQ ID NO: 11874 - DNA, 23 bp, Artificial Sequence
  X-linked inhibitor of apoptosis (XIAP) siRNA
acacagtcattactttcaagcaa

SEQ ID NO: 11875 - DNA, 23 bp, Artificial Sequence
  X-linked inhibitor of apoptosis (XIAP) siRNA
cacagtcattactttcaagcaaa

SEQ ID NO: 11876 - DNA, 23 bp, Artificial Sequence
  X-linked inhibitor of apoptosis (XIAP) siRNA
acagtcattactttcaagcaaaa

SEQ ID NO: 11877 - DNA, 23 bp, Artificial Sequence
  X-linked inhibitor of apoptosis (XIAP) siRNA
cagtcattactttcaagcaaaaa

SEQ ID NO: 11878 - DNA, 23 bp, Artificial Sequence
  X-linked inhibitor of apoptosis (XIAP) siRNA
agtcattactttcaagcaaaaaa

SEQ ID NO: 11879 - DNA, 23 bp, Artificial Sequence
  X-linked inhibitor of apoptosis (XIAP) siRNA
gtcattactttcaagcaaaaaat

SEQ ID NO: 11880 - DNA, 23 bp, Artificial Sequence
  X-linked inhibitor of apoptosis (XIAP) siRNA
tcattactttcaagcaaaaaatt

SEQ ID NO: 11881 - DNA, 23 bp, Artificial Sequence
  X-linked inhibitor of apoptosis (XIAP) siRNA
cattactttcaagcaaaaaattt

SEQ ID NO: 11882 - DNA, 23 bp, Artificial Sequence
  X-linked inhibitor of apoptosis (XIAP) siRNA
attactttcaagcaaaaaatttt

SEQ ID NO: 11883 - DNA, 23 bp, Artificial Sequence
  X-linked inhibitor of apoptosis (XIAP) siRNA
ttactttcaagcaaaaaattttt

SEQ ID NO: 11884 - DNA, 23 bp, Artificial Sequence
  X-linked inhibitor of apoptosis (XIAP) siRNA
tactttcaagcaaaaaattttta

SEQ ID NO: 11885 - DNA, 23 bp, Artificial Sequence
  X-linked inhibitor of apoptosis (XIAP) siRNA
actttcaagcaaaaaatttttat

SEQ ID NO: 11886 - DNA, 23 bp, Artificial Sequence
  X-linked inhibitor of apoptosis (XIAP) siRNA
ctttcaagcaaaaaatttttatg

SEQ ID NO: 11887 - DNA, 23 bp, Artificial Sequence
  X-linked inhibitor of apoptosis (XIAP) siRNA
tttcaagcaaaaaatttttatgt

SEQ ID NO: 11888 - DNA, 23 bp, Artificial Sequence
  X-linked inhibitor of apoptosis (XIAP) siRNA
ttcaagcaaaaaatttttatgtc

SEQ ID NO: 11889 - DNA, 23 bp, Artificial Sequence
  X-linked inhibitor of apoptosis (XIAP) siRNA
tcaagcaaaaaatttttatgtct

SEQ ID NO: 11890 - DNA, 23 bp, Artificial Sequence
  X-linked inhibitor of apoptosis (XIAP) siRNA
caagcaaaaaatttttatgtctt

SEQ ID NO: 11891 - DNA, 23 bp, Artificial Sequence
  X-linked inhibitor of apoptosis (XIAP) siRNA
aagcaaaaaatttttatgtctta

SEQ ID NO: 11892 - DNA, 23 bp, Artificial Sequence
  X-linked inhibitor of apoptosis (XIAP) siRNA
tctaactctatagtaggcatgtt

SEQ ID NO: 11893 - DNA, 23 bp, Artificial Sequence
  X-linked inhibitor of apoptosis (XIAP) siRNA
ctaactctatagtaggcatgtta

SEQ ID NO: 11894 - DNA, 23 bp, Artificial Sequence
  X-linked inhibitor of apoptosis (XIAP) siRNA
taactctatagtaggcatgttat

SEQ ID NO: 11895 - DNA, 23 bp, Artificial Sequence
  X-linked inhibitor of apoptosis (XIAP) siRNA
aactctatagtaggcatgttatg

SEQ ID NO: 11896 - DNA, 23 bp, Artificial Sequence
  X-linked inhibitor of apoptosis (XIAP) siRNA
actctatagtaggcatgttatgt

SEQ ID NO: 11897 - DNA, 23 bp, Artificial Sequence
  X-linked inhibitor of apoptosis (XIAP) siRNA
ctctatagtaggcatgttatgtt

SEQ ID NO: 11898 - DNA, 23 bp, Artificial Sequence
  X-linked inhibitor of apoptosis (XIAP) siRNA
tctatagtaggcatgttatgttg

SEQ ID NO: 11899 - DNA, 23 bp, Artificial Sequence
  X-linked inhibitor of apoptosis (XIAP) siRNA
ctatagtaggcatgttatgttgt

SEQ ID NO: 11900 - DNA, 23 bp, Artificial Sequence
  X-linked inhibitor of apoptosis (XIAP) siRNA
tatagtaggcatgttatgttgtt

SEQ ID NO: 11901 - DNA, 23 bp, Artificial Sequence
  X-linked inhibitor of apoptosis (XIAP) siRNA
atagtaggcatgttatgttgttc

SEQ ID NO: 11902 - DNA, 23 bp, Artificial Sequence
  X-linked inhibitor of apoptosis (XIAP) siRNA
tagtaggcatgttatgttgttct

SEQ ID NO: 11903 - DNA, 23 bp, Artificial Sequence
  X-linked inhibitor of apoptosis (XIAP) siRNA
agtaggcatgttatgttgttctt

SEQ ID NO: 11904 - DNA, 23 bp, Artificial Sequence
  X-linked inhibitor of apoptosis (XIAP) siRNA
gtaggcatgttatgttgttctta

SEQ ID NO: 11905 - DNA, 23 bp, Artificial Sequence
  X-linked inhibitor of apoptosis (XIAP) siRNA
taggcatgttatgttgttcttat

SEQ ID NO: 11906 - DNA, 23 bp, Artificial Sequence
  X-linked inhibitor of apoptosis (XIAP) siRNA
aggcatgttatgttgttcttatt

SEQ ID NO: 11907 - DNA, 23 bp, Artificial Sequence
  X-linked inhibitor of apoptosis (XIAP) siRNA
ggcatgttatgttgttcttatta

SEQ ID NO: 11908 - DNA, 23 bp, Artificial Sequence
  X-linked inhibitor of apoptosis (XIAP) siRNA
gcatgttatgttgttcttattac

SEQ ID NO: 11909 - DNA, 23 bp, Artificial Sequence
  X-linked inhibitor of apoptosis (XIAP) siRNA
catgttatgttgttcttattacc

SEQ ID NO: 11910 - DNA, 23 bp, Artificial Sequence
  X-linked inhibitor of apoptosis (XIAP) siRNA
atgttatgttgttcttattaccc

SEQ ID NO: 11911 - DNA, 23 bp, Artificial Sequence
  X-linked inhibitor of apoptosis (XIAP) siRNA
tgttatgttgttcttattaccct

SEQ ID NO: 11912 - DNA, 23 bp, Artificial Sequence
  X-linked inhibitor of apoptosis (XIAP) siRNA
gttatgttgttcttattaccctg

SEQ ID NO: 11913 - DNA, 23 bp, Artificial Sequence
  X-linked inhibitor of apoptosis (XIAP) siRNA
ttatgttgttcttattaccctga

SEQ ID NO: 11914 - DNA, 23 bp, Artificial Sequence
  X-linked inhibitor of apoptosis (XIAP) siRNA
tatgttgttcttattaccctgat

SEQ ID NO: 11915 - DNA, 23 bp, Artificial Sequence
  X-linked inhibitor of apoptosis (XIAP) siRNA
atgttgttcttattaccctgatt

SEQ ID NO: 11916 - DNA, 23 bp, Artificial Sequence
  X-linked inhibitor of apoptosis (XIAP) siRNA
tgttgttcttattaccctgattg

SEQ ID NO: 11917 - DNA, 23 bp, Artificial Sequence
  X-linked inhibitor of apoptosis (XIAP) siRNA
gttgttcttattaccctgattga

SEQ ID NO: 11918 - DNA, 23 bp, Artificial Sequence
  X-linked inhibitor of apoptosis (XIAP) siRNA
ttgttcttattaccctgattgaa

SEQ ID NO: 11919 - DNA, 23 bp, Artificial Sequence
  X-linked inhibitor of apoptosis (XIAP) siRNA
tgttcttattaccctgattgaat

SEQ ID NO: 11920 - DNA, 23 bp, Artificial Sequence
  X-linked inhibitor of apoptosis (XIAP) siRNA
gttcttattaccctgattgaatg

SEQ ID NO: 11921 - DNA, 23 bp, Artificial Sequence
  X-linked inhibitor of apoptosis (XIAP) siRNA
ttcttattaccctgattgaatgt

SEQ ID NO: 11922 - DNA, 23 bp, Artificial Sequence
  X-linked inhibitor of apoptosis (XIAP) siRNA
tcttattaccctgattgaatgtg

SEQ ID NO: 11923 - DNA, 23 bp, Artificial Sequence
  X-linked inhibitor of apoptosis (XIAP) siRNA
cttattaccctgattgaatgtgt

SEQ ID NO: 11924 - DNA, 23 bp, Artificial Sequence
  X-linked inhibitor of apoptosis (XIAP) siRNA
ttattaccctgattgaatgtgtg

SEQ ID NO: 11925 - DNA, 23 bp, Artificial Sequence
  X-linked inhibitor of apoptosis (XIAP) siRNA
tattaccctgattgaatgtgtga

SEQ ID NO: 11926 - DNA, 23 bp, Artificial Sequence
  X-linked inhibitor of apoptosis (XIAP) siRNA
attaccctgattgaatgtgtgat

SEQ ID NO: 11927 - DNA, 23 bp, Artificial Sequence
  X-linked inhibitor of apoptosis (XIAP) siRNA
ttaccctgattgaatgtgtgatg

SEQ ID NO: 11928 - DNA, 23 bp, Artificial Sequence
  X-linked inhibitor of apoptosis (XIAP) siRNA
taccctgattgaatgtgtgatgt

SEQ ID NO: 11929 - DNA, 23 bp, Artificial Sequence
  X-linked inhibitor of apoptosis (XIAP) siRNA
accctgattgaatgtgtgatgtg

SEQ ID NO: 11930 - DNA, 23 bp, Artificial Sequence
  X-linked inhibitor of apoptosis (XIAP) siRNA
ccctgattgaatgtgtgatgtga

SEQ ID NO: 11931 - DNA, 23 bp, Artificial Sequence
  X-linked inhibitor of apoptosis (XIAP) siRNA
cctgattgaatgtgtgatgtgaa

SEQ ID NO: 11932 - DNA, 23 bp, Artificial Sequence
  X-linked inhibitor of apoptosis (XIAP) siRNA
ctgattgaatgtgtgatgtgaac

SEQ ID NO: 11933 - DNA, 23 bp, Artificial Sequence
  X-linked inhibitor of apoptosis (XIAP) siRNA
tgattgaatgtgtgatgtgaact

SEQ ID NO: 11934 - DNA, 23 bp, Artificial Sequence
  X-linked inhibitor of apoptosis (XIAP) siRNA
gattgaatgtgtgatgtgaactg

SEQ ID NO: 11935 - DNA, 23 bp, Artificial Sequence
  X-linked inhibitor of apoptosis (XIAP) siRNA
attgaatgtgtgatgtgaactga

SEQ ID NO: 11936 - DNA, 23 bp, Artificial Sequence
  X-linked inhibitor of apoptosis (XIAP) siRNA
ttgaatgtgtgatgtgaactgac

SEQ ID NO: 11937 - DNA, 23 bp, Artificial Sequence
  X-linked inhibitor of apoptosis (XIAP) siRNA
tgaatgtgtgatgtgaactgact

SEQ ID NO: 11938 - DNA, 23 bp, Artificial Sequence
  X-linked inhibitor of apoptosis (XIAP) siRNA
gaatgtgtgatgtgaactgactt

SEQ ID NO: 11939 - DNA, 23 bp, Artificial Sequence
  X-linked inhibitor of apoptosis (XIAP) siRNA
aatgtgtgatgtgaactgacttt

SEQ ID NO: 11940 - DNA, 23 bp, Artificial Sequence
  X-linked inhibitor of apoptosis (XIAP) siRNA
atgtgtgatgtgaactgacttta

SEQ ID NO: 11941 - DNA, 23 bp, Artificial Sequence
  X-linked inhibitor of apoptosis (XIAP) siRNA
tgtgtgatgtgaactgactttaa

SEQ ID NO: 11942 - DNA, 23 bp, Artificial Sequence
  X-linked inhibitor of apoptosis (XIAP) siRNA
gtgtgatgtgaactgactttaag

SEQ ID NO: 11943 - DNA, 23 bp, Artificial Sequence
  X-linked inhibitor of apoptosis (XIAP) siRNA
tgtgatgtgaactgactttaagt

SEQ ID NO: 11944 - DNA, 23 bp, Artificial Sequence
  X-linked inhibitor of apoptosis (XIAP) siRNA
gtgatgtgaactgactttaagta

SEQ ID NO: 11945 - DNA, 23 bp, Artificial Sequence
  X-linked inhibitor of apoptosis (XIAP) siRNA
tgatgtgaactgactttaagtaa

SEQ ID NO: 11946 - DNA, 23 bp, Artificial Sequence
  X-linked inhibitor of apoptosis (XIAP) siRNA
gatgtgaactgactttaagtaat

SEQ ID NO: 11947 - DNA, 23 bp, Artificial Sequence
  X-linked inhibitor of apoptosis (XIAP) siRNA
atgtgaactgactttaagtaatc

SEQ ID NO: 11948 - DNA, 23 bp, Artificial Sequence
  X-linked inhibitor of apoptosis (XIAP) siRNA
tgtgaactgactttaagtaatca

SEQ ID NO: 11949 - DNA, 23 bp, Artificial Sequence
  X-linked inhibitor of apoptosis (XIAP) siRNA
gtgaactgactttaagtaatcag

SEQ ID NO: 11950 - DNA, 23 bp, Artificial Sequence
  X-linked inhibitor of apoptosis (XIAP) siRNA
tgaactgactttaagtaatcagg

SEQ ID NO: 11951 - DNA, 23 bp, Artificial Sequence
  X-linked inhibitor of apoptosis (XIAP) siRNA
gaactgactttaagtaatcagga

SEQ ID NO: 11952 - DNA, 23 bp, Artificial Sequence
  X-linked inhibitor of apoptosis (XIAP) siRNA
aactgactttaagtaatcaggat

SEQ ID NO: 11953 - DNA, 23 bp, Artificial Sequence
  X-linked inhibitor of apoptosis (XIAP) siRNA
actgactttaagtaatcaggatt

SEQ ID NO: 11954 - DNA, 23 bp, Artificial Sequence
  X-linked inhibitor of apoptosis (XIAP) siRNA
ctgactttaagtaatcaggattg

SEQ ID NO: 11955 - DNA, 23 bp, Artificial Sequence
  X-linked inhibitor of apoptosis (XIAP) siRNA
tgactttaagtaatcaggattga

SEQ ID NO: 11956 - DNA, 23 bp, Artificial Sequence
  X-linked inhibitor of apoptosis (XIAP) siRNA
gactttaagtaatcaggattgaa

SEQ ID NO: 11957 - DNA, 23 bp, Artificial Sequence
  X-linked inhibitor of apoptosis (XIAP) siRNA
actttaagtaatcaggattgaat

SEQ ID NO: 11958 - DNA, 23 bp, Artificial Sequence
  X-linked inhibitor of apoptosis (XIAP) siRNA
ctttaagtaatcaggattgaatt

SEQ ID NO: 11959 - DNA, 23 bp, Artificial Sequence
  X-linked inhibitor of apoptosis (XIAP) siRNA
tttaagtaatcaggattgaattc

SEQ ID NO: 11960 - DNA, 23 bp, Artificial Sequence
  X-linked inhibitor of apoptosis (XIAP) siRNA
ttaagtaatcaggattgaattcc

SEQ ID NO: 11961 - DNA, 23 bp, Artificial Sequence
  X-linked inhibitor of apoptosis (XIAP) siRNA
taagtaatcaggattgaattcca

SEQ ID NO: 11962 - DNA, 23 bp, Artificial Sequence
  X-linked inhibitor of apoptosis (XIAP) siRNA
aagtaatcaggattgaattccat

SEQ ID NO: 11963 - DNA, 23 bp, Artificial Sequence
  X-linked inhibitor of apoptosis (XIAP) siRNA
agtaatcaggattgaattccatt

SEQ ID NO: 11964 - DNA, 23 bp, Artificial Sequence
  X-linked inhibitor of apoptosis (XIAP) siRNA
gtaatcaggattgaattccatta

SEQ ID NO: 11965 - DNA, 23 bp, Artificial Sequence
  X-linked inhibitor of apoptosis (XIAP) siRNA
taatcaggattgaattccattag

SEQ ID NO: 11966 - DNA, 23 bp, Artificial Sequence
  X-linked inhibitor of apoptosis (XIAP) siRNA
aatcaggattgaattccattagc

SEQ ID NO: 11967 - DNA, 23 bp, Artificial Sequence
  X-linked inhibitor of apoptosis (XIAP) siRNA
atcaggattgaattccattagca

SEQ ID NO: 11968 - DNA, 23 bp, Artificial Sequence
  X-linked inhibitor of apoptosis (XIAP) siRNA
tcaggattgaattccattagcat

SEQ ID NO: 11969 - DNA, 23 bp, Artificial Sequence
  X-linked inhibitor of apoptosis (XIAP) siRNA
caggattgaattccattagcatt

SEQ ID NO: 11970 - DNA, 23 bp, Artificial Sequence
  X-linked inhibitor of apoptosis (XIAP) siRNA
aggattgaattccattagcattt

SEQ ID NO: 11971 - DNA, 23 bp, Artificial Sequence
  X-linked inhibitor of apoptosis (XIAP) siRNA
ggattgaattccattagcatttg

SEQ ID NO: 11972 - DNA, 23 bp, Artificial Sequence
  X-linked inhibitor of apoptosis (XIAP) siRNA
gattgaattccattagcatttgc

SEQ ID NO: 11973 - DNA, 23 bp, Artificial Sequence
  X-linked inhibitor of apoptosis (XIAP) siRNA
attgaattccattagcatttgct

SEQ ID NO: 11974 - DNA, 23 bp, Artificial Sequence
  X-linked inhibitor of apoptosis (XIAP) siRNA
ttgaattccattagcatttgcta

SEQ ID NO: 11975 - DNA, 23 bp, Artificial Sequence
  X-linked inhibitor of apoptosis (XIAP) siRNA
tgaattccattagcatttgctac

SEQ ID NO: 11976 - DNA, 23 bp, Artificial Sequence
  X-linked inhibitor of apoptosis (XIAP) siRNA
gaattccattagcatttgctacc

SEQ ID NO: 11977 - DNA, 23 bp, Artificial Sequence
  X-linked inhibitor of apoptosis (XIAP) siRNA
aattccattagcatttgctacca

SEQ ID NO: 11978 - DNA, 23 bp, Artificial Sequence
  X-linked inhibitor of apoptosis (XIAP) siRNA
attccattagcatttgctaccaa

SEQ ID NO: 11979 - DNA, 23 bp, Artificial Sequence
  X-linked inhibitor of apoptosis (XIAP) siRNA
ttccattagcatttgctaccaag

SEQ ID NO: 11980 - DNA, 23 bp, Artificial Sequence
  X-linked inhibitor of apoptosis (XIAP) siRNA
tccattagcatttgctaccaagt

SEQ ID NO: 11981 - DNA, 23 bp, Artificial Sequence
  X-linked inhibitor of apoptosis (XIAP) siRNA
ccattagcatttgctaccaagta

SEQ ID NO: 11982 - DNA, 23 bp, Artificial Sequence
  X-linked inhibitor of apoptosis (XIAP) siRNA
cattagcatttgctaccaagtag

SEQ ID NO: 11983 - DNA, 23 bp, Artificial Sequence
  X-linked inhibitor of apoptosis (XIAP) siRNA
attagcatttgctaccaagtagg

SEQ ID NO: 11984 - DNA, 23 bp, Artificial Sequence
  X-linked inhibitor of apoptosis (XIAP) siRNA
ttagcatttgctaccaagtagga

SEQ ID NO: 11985 - DNA, 23 bp, Artificial Sequence
  X-linked inhibitor of apoptosis (XIAP) siRNA
tagcatttgctaccaagtaggaa

SEQ ID NO: 11986 - DNA, 23 bp, Artificial Sequence
  X-linked inhibitor of apoptosis (XIAP) siRNA
agcatttgctaccaagtaggaaa

SEQ ID NO: 11987 - DNA, 23 bp, Artificial Sequence
  X-linked inhibitor of apoptosis (XIAP) siRNA
gcatttgctaccaagtaggaaaa

SEQ ID NO: 11988 - DNA, 23 bp, Artificial Sequence
  X-linked inhibitor of apoptosis (XIAP) siRNA
catttgctaccaagtaggaaaaa

SEQ ID NO: 11989 - DNA, 23 bp, Artificial Sequence
  X-linked inhibitor of apoptosis (XIAP) siRNA
atttgctaccaagtaggaaaaaa

SEQ ID NO: 11990 - DNA, 23 bp, Artificial Sequence
  X-linked inhibitor of apoptosis (XIAP) siRNA
tttgctaccaagtaggaaaaaaa

SEQ ID NO: 11991 - DNA, 23 bp, Artificial Sequence
  X-linked inhibitor of apoptosis (XIAP) siRNA
ttgctaccaagtaggaaaaaaaa

SEQ ID NO: 11992 - DNA, 23 bp, Artificial Sequence
  X-linked inhibitor of apoptosis (XIAP) siRNA
tgctaccaagtaggaaaaaaaat

SEQ ID NO: 11993 - DNA, 23 bp, Artificial Sequence
  X-linked inhibitor of apoptosis (XIAP) siRNA
gctaccaagtaggaaaaaaaatg

SEQ ID NO: 11994 - DNA, 23 bp, Artificial Sequence
  X-linked inhibitor of apoptosis (XIAP) siRNA
ctaccaagtaggaaaaaaaatgt

SEQ ID NO: 11995 - DNA, 23 bp, Artificial Sequence
  X-linked inhibitor of apoptosis (XIAP) siRNA
taccaagtaggaaaaaaaatgta

SEQ ID NO: 11996 - DNA, 23 bp, Artificial Sequence
  X-linked inhibitor of apoptosis (XIAP) siRNA
accaagtaggaaaaaaaatgtac

SEQ ID NO: 11997 - DNA, 23 bp, Artificial Sequence
  X-linked inhibitor of apoptosis (XIAP) siRNA
ccaagtaggaaaaaaaatgtaca

SEQ ID NO: 11998 - DNA, 23 bp, Artificial Sequence
  X-linked inhibitor of apoptosis (XIAP) siRNA
caagtaggaaaaaaaatgtacat

SEQ ID NO: 11999 - DNA, 23 bp, Artificial Sequence
  X-linked inhibitor of apoptosis (XIAP) siRNA
aagtaggaaaaaaaatgtacatg

SEQ ID NO: 12000 - DNA, 23 bp, Artificial Sequence
  X-linked inhibitor of apoptosis (XIAP) siRNA
agtaggaaaaaaaatgtacatgg

SEQ ID NO: 12001 - DNA, 23 bp, Artificial Sequence
  X-linked inhibitor of apoptosis (XIAP) siRNA
gtaggaaaaaaaatgtacatggc

SEQ ID NO: 12002 - DNA, 23 bp, Artificial Sequence
  X-linked inhibitor of apoptosis (XIAP) siRNA
taggaaaaaaaatgtacatggca

SEQ ID NO: 12003 - DNA, 23 bp, Artificial Sequence
  X-linked inhibitor of apoptosis (XIAP) siRNA
aggaaaaaaaatgtacatggcag

SEQ ID NO: 12004 - DNA, 23 bp, Artificial Sequence
  X-linked inhibitor of apoptosis (XIAP) siRNA
ggaaaaaaaatgtacatggcagt

SEQ ID NO: 12005 - DNA, 23 bp, Artificial Sequence
  X-linked inhibitor of apoptosis (XIAP) siRNA
gaaaaaaaatgtacatggcagtg

SEQ ID NO: 12006 - DNA, 23 bp, Artificial Sequence
  X-linked inhibitor of apoptosis (XIAP) siRNA
aaaaaaaatgtacatggcagtgt

SEQ ID NO: 12007 - DNA, 23 bp, Artificial Sequence
  X-linked inhibitor of apoptosis (XIAP) siRNA
aaaaaaatgtacatggcagtgtt

SEQ ID NO: 12008 - DNA, 23 bp, Artificial Sequence
  X-linked inhibitor of apoptosis (XIAP) siRNA
aaaaaatgtacatggcagtgttt

SEQ ID NO: 12009 - DNA, 23 bp, Artificial Sequence
  X-linked inhibitor of apoptosis (XIAP) siRNA
aaaaatgtacatggcagtgtttt

SEQ ID NO: 12010 - DNA, 23 bp, Artificial Sequence
  X-linked inhibitor of apoptosis (XIAP) siRNA
aaaatgtacatggcagtgtttta

SEQ ID NO: 12011 - DNA, 23 bp, Artificial Sequence
  X-linked inhibitor of apoptosis (XIAP) siRNA
aaatgtacatggcagtgttttag

SEQ ID NO: 12012 - DNA, 23 bp, Artificial Sequence
  X-linked inhibitor of apoptosis (XIAP) siRNA
aatgtacatggcagtgttttagt

SEQ ID NO: 12013 - DNA, 23 bp, Artificial Sequence
  X-linked inhibitor of apoptosis (XIAP) siRNA
atgtacatggcagtgttttagtt

SEQ ID NO: 12014 - DNA, 23 bp, Artificial Sequence
  X-linked inhibitor of apoptosis (XIAP) siRNA
tgtacatggcagtgttttagttg

SEQ ID NO: 12015 - DNA, 23 bp, Artificial Sequence
  X-linked inhibitor of apoptosis (XIAP) siRNA
gtacatggcagtgttttagttgg

SEQ ID NO: 12016 - DNA, 23 bp, Artificial Sequence
  X-linked inhibitor of apoptosis (XIAP) siRNA
tacatggcagtgttttagttggc

SEQ ID NO: 12017 - DNA, 23 bp, Artificial Sequence
  X-linked inhibitor of apoptosis (XIAP) siRNA
acatggcagtgttttagttggca

SEQ ID NO: 12018 - DNA, 23 bp, Artificial Sequence
  X-linked inhibitor of apoptosis (XIAP) siRNA
catggcagtgttttagttggcaa

SEQ ID NO: 12019 - DNA, 23 bp, Artificial Sequence
  X-linked inhibitor of apoptosis (XIAP) siRNA
atggcagtgttttagttggcaat

SEQ ID NO: 12020 - DNA, 23 bp, Artificial Sequence
  X-linked inhibitor of apoptosis (XIAP) siRNA
tggcagtgttttagttggcaata

SEQ ID NO: 12021 - DNA, 23 bp, Artificial Sequence
  X-linked inhibitor of apoptosis (XIAP) siRNA
ggcagtgttttagttggcaatat

SEQ ID NO: 12022 - DNA, 23 bp, Artificial Sequence
  X-linked inhibitor of apoptosis (XIAP) siRNA
gcagtgttttagttggcaatata

SEQ ID NO: 12023 - DNA, 23 bp, Artificial Sequence
  X-linked inhibitor of apoptosis (XIAP) siRNA
cagtgttttagttggcaatataa

SEQ ID NO: 12024 - DNA, 23 bp, Artificial Sequence
  X-linked inhibitor of apoptosis (XIAP) siRNA
agtgttttagttggcaatataat

SEQ ID NO: 12025 - DNA, 23 bp, Artificial Sequence
  X-linked inhibitor of apoptosis (XIAP) siRNA
gtgttttagttggcaatataatc

SEQ ID NO: 12026 - DNA, 23 bp, Artificial Sequence
  X-linked inhibitor of apoptosis (XIAP) siRNA
tgttttagttggcaatataatct

SEQ ID NO: 12027 - DNA, 23 bp, Artificial Sequence
  X-linked inhibitor of apoptosis (XIAP) siRNA
gttttagttggcaatataatctt

SEQ ID NO: 12028 - DNA, 23 bp, Artificial Sequence
  X-linked inhibitor of apoptosis (XIAP) siRNA
ttttagttggcaatataatcttt

SEQ ID NO: 12029 - DNA, 23 bp, Artificial Sequence
  X-linked inhibitor of apoptosis (XIAP) siRNA
tttagttggcaatataatctttg

SEQ ID NO: 12030 - DNA, 23 bp, Artificial Sequence
  X-linked inhibitor of apoptosis (XIAP) siRNA
ttagttggcaatataatctttga

SEQ ID NO: 12031 - DNA, 23 bp, Artificial Sequence
  X-linked inhibitor of apoptosis (XIAP) siRNA
tagttggcaatataatctttgaa

SEQ ID NO: 12032 - DNA, 23 bp, Artificial Sequence
  X-linked inhibitor of apoptosis (XIAP) siRNA
agttggcaatataatctttgaat

SEQ ID NO: 12033 - DNA, 23 bp, Artificial Sequence
  X-linked inhibitor of apoptosis (XIAP) siRNA
gttggcaatataatctttgaatt

SEQ ID NO: 12034 - DNA, 23 bp, Artificial Sequence
  X-linked inhibitor of apoptosis (XIAP) siRNA
ttggcaatataatctttgaattt

SEQ ID NO: 12035 - DNA, 23 bp, Artificial Sequence
  X-linked inhibitor of apoptosis (XIAP) siRNA
tggcaatataatctttgaatttc

SEQ ID NO: 12036 - DNA, 23 bp, Artificial Sequence
  X-linked inhibitor of apoptosis (XIAP) siRNA
ggcaatataatctttgaatttct

SEQ ID NO: 12037 - DNA, 23 bp, Artificial Sequence
  X-linked inhibitor of apoptosis (XIAP) siRNA
gcaatataatctttgaatttctt

SEQ ID NO: 12038 - DNA, 23 bp, Artificial Sequence
  X-linked inhibitor of apoptosis (XIAP) siRNA
caatataatctttgaatttcttg

SEQ ID NO: 12039 - DNA, 23 bp, Artificial Sequence
  X-linked inhibitor of apoptosis (XIAP) siRNA
aatataatctttgaatttcttga

SEQ ID NO: 12040 - DNA, 23 bp, Artificial Sequence
  X-linked inhibitor of apoptosis (XIAP) siRNA
atataatctttgaatttcttgat

SEQ ID NO: 12041 - DNA, 23 bp, Artificial Sequence
  X-linked inhibitor of apoptosis (XIAP) siRNA
tataatctttgaatttcttgatt

SEQ ID NO: 12042 - DNA, 23 bp, Artificial Sequence
  X-linked inhibitor of apoptosis (XIAP) siRNA
ataatctttgaatttcttgattt

SEQ ID NO: 12043 - DNA, 23 bp, Artificial Sequence
  X-linked inhibitor of apoptosis (XIAP) siRNA
taatctttgaatttcttgatttt

SEQ ID NO: 12044 - DNA, 23 bp, Artificial Sequence
  X-linked inhibitor of apoptosis (XIAP) siRNA
aatctttgaatttcttgattttt

SEQ ID NO: 12045 - DNA, 23 bp, Artificial Sequence
  X-linked inhibitor of apoptosis (XIAP) siRNA
atctttgaatttcttgatttttc

SEQ ID NO: 12046 - DNA, 23 bp, Artificial Sequence
  X-linked inhibitor of apoptosis (XIAP) siRNA
tctttgaatttcttgatttttca

SEQ ID NO: 12047 - DNA, 23 bp, Artificial Sequence
  X-linked inhibitor of apoptosis (XIAP) siRNA
ctttgaatttcttgatttttcag

SEQ ID NO: 12048 - DNA, 23 bp, Artificial Sequence
  X-linked inhibitor of apoptosis (XIAP) siRNA
tttgaatttcttgatttttcagg

SEQ ID NO: 12049 - DNA, 23 bp, Artificial Sequence
  X-linked inhibitor of apoptosis (XIAP) siRNA
ttgaatttcttgatttttcaggg

SEQ ID NO: 12050 - DNA, 23 bp, Artificial Sequence
  X-linked inhibitor of apoptosis (XIAP) siRNA
tgaatttcttgatttttcagggt

SEQ ID NO: 12051 - DNA, 23 bp, Artificial Sequence
  X-linked inhibitor of apoptosis (XIAP) siRNA
gaatttcttgatttttcagggta

SEQ ID NO: 12052 - DNA, 23 bp, Artificial Sequence
  X-linked inhibitor of apoptosis (XIAP) siRNA
aatttcttgatttttcagggtat

SEQ ID NO: 12053 - DNA, 23 bp, Artificial Sequence
  X-linked inhibitor of apoptosis (XIAP) siRNA
atttcttgatttttcagggtatt

SEQ ID NO: 12054 - DNA, 23 bp, Artificial Sequence
  X-linked inhibitor of apoptosis (XIAP) siRNA
tttcttgatttttcagggtatta

SEQ ID NO: 12055 - DNA, 23 bp, Artificial Sequence
  X-linked inhibitor of apoptosis (XIAP) siRNA
ttcttgatttttcagggtattag

SEQ ID NO: 12056 - DNA, 23 bp, Artificial Sequence
  X-linked inhibitor of apoptosis (XIAP) siRNA
tcttgatttttcagggtattagc

SEQ ID NO: 12057 - DNA, 23 bp, Artificial Sequence
  X-linked inhibitor of apoptosis (XIAP) siRNA
cttgatttttcagggtattagct

SEQ ID NO: 12058 - DNA, 23 bp, Artificial Sequence
  X-linked inhibitor of apoptosis (XIAP) siRNA
ttgatttttcagggtattagctg

SEQ ID NO: 12059 - DNA, 23 bp, Artificial Sequence
  X-linked inhibitor of apoptosis (XIAP) siRNA
tgatttttcagggtattagctgt

SEQ ID NO: 12060 - DNA, 23 bp, Artificial Sequence
  X-linked inhibitor of apoptosis (XIAP) siRNA
gatttttcagggtattagctgta

SEQ ID NO: 12061 - DNA, 23 bp, Artificial Sequence
  X-linked inhibitor of apoptosis (XIAP) siRNA
atttttcagggtattagctgtat

SEQ ID NO: 12062 - DNA, 23 bp, Artificial Sequence
  X-linked inhibitor of apoptosis (XIAP) siRNA
tttttcagggtattagctgtatt

SEQ ID NO: 12063 - DNA, 23 bp, Artificial Sequence
  X-linked inhibitor of apoptosis (XIAP) siRNA
ttttcagggtattagctgtatta

SEQ ID NO: 12064 - DNA, 23 bp, Artificial Sequence
  X-linked inhibitor of apoptosis (XIAP) siRNA
tttcagggtattagctgtattat

SEQ ID NO: 12065 - DNA, 23 bp, Artificial Sequence
  X-linked inhibitor of apoptosis (XIAP) siRNA
ttcagggtattagctgtattatc

SEQ ID NO: 12066 - DNA, 23 bp, Artificial Sequence
  X-linked inhibitor of apoptosis (XIAP) siRNA
tcagggtattagctgtattatcc

SEQ ID NO: 12067 - DNA, 23 bp, Artificial Sequence
  X-linked inhibitor of apoptosis (XIAP) siRNA
cagggtattagctgtattatcca

SEQ ID NO: 12068 - DNA, 23 bp, Artificial Sequence
  X-linked inhibitor of apoptosis (XIAP) siRNA
agggtattagctgtattatccat

SEQ ID NO: 12069 - DNA, 23 bp, Artificial Sequence
  X-linked inhibitor of apoptosis (XIAP) siRNA
gggtattagctgtattatccatt

SEQ ID NO: 12070 - DNA, 23 bp, Artificial Sequence
  X-linked inhibitor of apoptosis (XIAP) siRNA
ggtattagctgtattatccattt

SEQ ID NO: 12071 - DNA, 23 bp, Artificial Sequence
  X-linked inhibitor of apoptosis (XIAP) siRNA
gtattagctgtattatccatttt

SEQ ID NO: 12072 - DNA, 23 bp, Artificial Sequence
  X-linked inhibitor of apoptosis (XIAP) siRNA
tattagctgtattatccattttt

SEQ ID NO: 12073 - DNA, 23 bp, Artificial Sequence
  X-linked inhibitor of apoptosis (XIAP) siRNA
attagctgtattatccatttttt

SEQ ID NO: 12074 - DNA, 23 bp, Artificial Sequence
  X-linked inhibitor of apoptosis (XIAP) siRNA
ttagctgtattatccattttttt

SEQ ID NO: 12075 - DNA, 23 bp, Artificial Sequence
  X-linked inhibitor of apoptosis (XIAP) siRNA
tagctgtattatccatttttttt

SEQ ID NO: 12076 - DNA, 23 bp, Artificial Sequence
  X-linked inhibitor of apoptosis (XIAP) siRNA
agctgtattatccatttttttta

SEQ ID NO: 12077 - DNA, 23 bp, Artificial Sequence
  X-linked inhibitor of apoptosis (XIAP) siRNA
gctgtattatccattttttttac

SEQ ID NO: 12078 - DNA, 23 bp, Artificial Sequence
  X-linked inhibitor of apoptosis (XIAP) siRNA
ctgtattatccattttttttact

SEQ ID NO: 12079 - DNA, 23 bp, Artificial Sequence
  X-linked inhibitor of apoptosis (XIAP) siRNA
tgtattatccattttttttactg

SEQ ID NO: 12080 - DNA, 23 bp, Artificial Sequence
  X-linked inhibitor of apoptosis (XIAP) siRNA
gtattatccattttttttactgt

SEQ ID NO: 12081 - DNA, 23 bp, Artificial Sequence
  X-linked inhibitor of apoptosis (XIAP) siRNA
tattatccattttttttactgtt

SEQ ID NO: 12082 - DNA, 23 bp, Artificial Sequence
  X-linked inhibitor of apoptosis (XIAP) siRNA
attatccattttttttactgtta

SEQ ID NO: 12083 - DNA, 23 bp, Artificial Sequence
  X-linked inhibitor of apoptosis (XIAP) siRNA
ttatccattttttttactgttat

SEQ ID NO: 12084 - DNA, 23 bp, Artificial Sequence
  X-linked inhibitor of apoptosis (XIAP) siRNA
tatccattttttttactgttatt

SEQ ID NO: 12085 - DNA, 23 bp, Artificial Sequence
  X-linked inhibitor of apoptosis (XIAP) siRNA
atccattttttttactgttattt

SEQ ID NO: 12086 - DNA, 23 bp, Artificial Sequence
  X-linked inhibitor of apoptosis (XIAP) siRNA
tccattttttttactgttattta

SEQ ID NO: 12087 - DNA, 23 bp, Artificial Sequence
  X-linked inhibitor of apoptosis (XIAP) siRNA
ccattttttttactgttatttaa

SEQ ID NO: 12088 - DNA, 23 bp, Artificial Sequence
  X-linked inhibitor of apoptosis (XIAP) siRNA
cattttttttactgttatttaat

SEQ ID NO: 12089 - DNA, 23 bp, Artificial Sequence
  X-linked inhibitor of apoptosis (XIAP) siRNA
attttttttactgttatttaatt

SEQ ID NO: 12090 - DNA, 23 bp, Artificial Sequence
  X-linked inhibitor of apoptosis (XIAP) siRNA
ttttttttactgttatttaattg

SEQ ID NO: 12091 - DNA, 23 bp, Artificial Sequence
  X-linked inhibitor of apoptosis (XIAP) siRNA
tttttttactgttatttaattga

SEQ ID NO: 12092 - DNA, 23 bp, Artificial Sequence
  X-linked inhibitor of apoptosis (XIAP) siRNA
ttttttactgttatttaattgaa

SEQ ID NO: 12093 - DNA, 23 bp, Artificial Sequence
  X-linked inhibitor of apoptosis (XIAP) siRNA
tttttactgttatttaattgaaa

SEQ ID NO: 12094 - DNA, 23 bp, Artificial Sequence
  X-linked inhibitor of apoptosis (XIAP) siRNA
ttttactgttatttaattgaaac

SEQ ID NO: 12095 - DNA, 23 bp, Artificial Sequence
  X-linked inhibitor of apoptosis (XIAP) siRNA
tttactgttatttaattgaaacc

SEQ ID NO: 12096 - DNA, 23 bp, Artificial Sequence
  X-linked inhibitor of apoptosis (XIAP) siRNA
ttactgttatttaattgaaacca

SEQ ID NO: 12097 - DNA, 23 bp, Artificial Sequence
  X-linked inhibitor of apoptosis (XIAP) siRNA
tactgttatttaattgaaaccat

SEQ ID NO: 12098 - DNA, 23 bp, Artificial Sequence
  X-linked inhibitor of apoptosis (XIAP) siRNA
actgttatttaattgaaaccata

SEQ ID NO: 12099 - DNA, 23 bp, Artificial Sequence
  X-linked inhibitor of apoptosis (XIAP) siRNA
ctgttatttaattgaaaccatag

SEQ ID NO: 12100 - DNA, 23 bp, Artificial Sequence
  X-linked inhibitor of apoptosis (XIAP) siRNA
tgttatttaattgaaaccataga

SEQ ID NO: 12101 - DNA, 23 bp, Artificial Sequence
  X-linked inhibitor of apoptosis (XIAP) siRNA
gttatttaattgaaaccatagac

SEQ ID NO: 12102 - DNA, 23 bp, Artificial Sequence
  X-linked inhibitor of apoptosis (XIAP) siRNA
ttatttaattgaaaccatagact

SEQ ID NO: 12103 - DNA, 23 bp, Artificial Sequence
  X-linked inhibitor of apoptosis (XIAP) siRNA
tatttaattgaaaccatagacta

SEQ ID NO: 12104 - DNA, 23 bp, Artificial Sequence
  X-linked inhibitor of apoptosis (XIAP) siRNA
atttaattgaaaccatagactaa

SEQ ID NO: 12105 - DNA, 23 bp, Artificial Sequence
  X-linked inhibitor of apoptosis (XIAP) siRNA
tttaattgaaaccatagactaag

SEQ ID NO: 12106 - DNA, 23 bp, Artificial Sequence
  X-linked inhibitor of apoptosis (XIAP) siRNA
ttaattgaaaccatagactaaga

SEQ ID NO: 12107 - DNA, 23 bp, Artificial Sequence
  X-linked inhibitor of apoptosis (XIAP) siRNA
taattgaaaccatagactaagaa

SEQ ID NO: 12108 - DNA, 23 bp, Artificial Sequence
  X-linked inhibitor of apoptosis (XIAP) siRNA
aattgaaaccatagactaagaat

SEQ ID NO: 12109 - DNA, 23 bp, Artificial Sequence
  X-linked inhibitor of apoptosis (XIAP) siRNA
attgaaaccatagactaagaata

SEQ ID NO: 12110 - DNA, 23 bp, Artificial Sequence
  X-linked inhibitor of apoptosis (XIAP) siRNA
ttgaaaccatagactaagaataa

SEQ ID NO: 12111 - DNA, 23 bp, Artificial Sequence
  X-linked inhibitor of apoptosis (XIAP) siRNA
tgaaaccatagactaagaataag

SEQ ID NO: 12112 - DNA, 23 bp, Artificial Sequence
  X-linked inhibitor of apoptosis (XIAP) siRNA
gaaaccatagactaagaataaga

SEQ ID NO: 12113 - DNA, 23 bp, Artificial Sequence
  X-linked inhibitor of apoptosis (XIAP) siRNA
aaaccatagactaagaataagaa

SEQ ID NO: 12114 - DNA, 23 bp, Artificial Sequence
  X-linked inhibitor of apoptosis (XIAP) siRNA
aaccatagactaagaataagaag

SEQ ID NO: 12115 - DNA, 23 bp, Artificial Sequence
  X-linked inhibitor of apoptosis (XIAP) siRNA
accatagactaagaataagaagc

SEQ ID NO: 12116 - DNA, 23 bp, Artificial Sequence
  X-linked inhibitor of apoptosis (XIAP) siRNA
ccatagactaagaataagaagca

SEQ ID NO: 12117 - DNA, 23 bp, Artificial Sequence
  X-linked inhibitor of apoptosis (XIAP) siRNA
catagactaagaataagaagcat

SEQ ID NO: 12118 - DNA, 23 bp, Artificial Sequence
  X-linked inhibitor of apoptosis (XIAP) siRNA
atagactaagaataagaagcatc

SEQ ID NO: 12119 - DNA, 23 bp, Artificial Sequence
  X-linked inhibitor of apoptosis (XIAP) siRNA
tagactaagaataagaagcatca

SEQ ID NO: 12120 - DNA, 23 bp, Artificial Sequence
  X-linked inhibitor of apoptosis (XIAP) siRNA
agactaagaataagaagcatcat

SEQ ID NO: 12121 - DNA, 23 bp, Artificial Sequence
  X-linked inhibitor of apoptosis (XIAP) siRNA
gactaagaataagaagcatcata

SEQ ID NO: 12122 - DNA, 23 bp, Artificial Sequence
  X-linked inhibitor of apoptosis (XIAP) siRNA
actaagaataagaagcatcatac

SEQ ID NO: 12123 - DNA, 23 bp, Artificial Sequence
  X-linked inhibitor of apoptosis (XIAP) siRNA
ctaagaataagaagcatcatact

SEQ ID NO: 12124 - DNA, 23 bp, Artificial Sequence
  X-linked inhibitor of apoptosis (XIAP) siRNA
taagaataagaagcatcatacta

SEQ ID NO: 12125 - DNA, 23 bp, Artificial Sequence
  X-linked inhibitor of apoptosis (XIAP) siRNA
aagaataagaagcatcatactat

SEQ ID NO: 12126 - DNA, 23 bp, Artificial Sequence
  X-linked inhibitor of apoptosis (XIAP) siRNA
agaataagaagcatcatactata

SEQ ID NO: 12127 - DNA, 23 bp, Artificial Sequence
  X-linked inhibitor of apoptosis (XIAP) siRNA
gaataagaagcatcatactataa

SEQ ID NO: 12128 - DNA, 23 bp, Artificial Sequence
  X-linked inhibitor of apoptosis (XIAP) siRNA
aataagaagcatcatactataac

SEQ ID NO: 12129 - DNA, 23 bp, Artificial Sequence
  X-linked inhibitor of apoptosis (XIAP) siRNA
ataagaagcatcatactataact

SEQ ID NO: 12130 - DNA, 23 bp, Artificial Sequence
  X-linked inhibitor of apoptosis (XIAP) siRNA
taagaagcatcatactataactg

SEQ ID NO: 12131 - DNA, 23 bp, Artificial Sequence
  X-linked inhibitor of apoptosis (XIAP) siRNA
aagaagcatcatactataactga

SEQ ID NO: 12132 - DNA, 23 bp, Artificial Sequence
  X-linked inhibitor of apoptosis (XIAP) siRNA
agaagcatcatactataactgaa

SEQ ID NO: 12133 - DNA, 23 bp, Artificial Sequence
  X-linked inhibitor of apoptosis (XIAP) siRNA
gaagcatcatactataactgaac

SEQ ID NO: 12134 - DNA, 23 bp, Artificial Sequence
  X-linked inhibitor of apoptosis (XIAP) siRNA
aagcatcatactataactgaaca

SEQ ID NO: 12135 - DNA, 23 bp, Artificial Sequence
  X-linked inhibitor of apoptosis (XIAP) siRNA
agcatcatactataactgaacac

SEQ ID NO: 12136 - DNA, 23 bp, Artificial Sequence
  X-linked inhibitor of apoptosis (XIAP) siRNA
gcatcatactataactgaacaca

SEQ ID NO: 12137 - DNA, 23 bp, Artificial Sequence
  X-linked inhibitor of apoptosis (XIAP) siRNA
catcatactataactgaacacaa

SEQ ID NO: 12138 - DNA, 23 bp, Artificial Sequence
  X-linked inhibitor of apoptosis (XIAP) siRNA
atcatactataactgaacacaat

SEQ ID NO: 12139 - DNA, 23 bp, Artificial Sequence
  X-linked inhibitor of apoptosis (XIAP) siRNA
tcatactataactgaacacaatg

SEQ ID NO: 12140 - DNA, 23 bp, Artificial Sequence
  X-linked inhibitor of apoptosis (XIAP) siRNA
catactataactgaacacaatgt

SEQ ID NO: 12141 - DNA, 23 bp, Artificial Sequence
  X-linked inhibitor of apoptosis (XIAP) siRNA
atactataactgaacacaatgtg

SEQ ID NO: 12142 - DNA, 23 bp, Artificial Sequence
  X-linked inhibitor of apoptosis (XIAP) siRNA
tactataactgaacacaatgtgt

SEQ ID NO: 12143 - DNA, 23 bp, Artificial Sequence
  X-linked inhibitor of apoptosis (XIAP) siRNA
actataactgaacacaatgtgta

SEQ ID NO: 12144 - DNA, 23 bp, Artificial Sequence
  X-linked inhibitor of apoptosis (XIAP) siRNA
ctataactgaacacaatgtgtat

SEQ ID NO: 12145 - DNA, 23 bp, Artificial Sequence
  X-linked inhibitor of apoptosis (XIAP) siRNA
tataactgaacacaatgtgtatt

SEQ ID NO: 12146 - DNA, 23 bp, Artificial Sequence
  X-linked inhibitor of apoptosis (XIAP) siRNA
ataactgaacacaatgtgtattc

SEQ ID NO: 12147 - DNA, 23 bp, Artificial Sequence
  X-linked inhibitor of apoptosis (XIAP) siRNA
taactgaacacaatgtgtattca

SEQ ID NO: 12148 - DNA, 23 bp, Artificial Sequence
  X-linked inhibitor of apoptosis (XIAP) siRNA
aactgaacacaatgtgtattcat

SEQ ID NO: 12149 - DNA, 23 bp, Artificial Sequence
  X-linked inhibitor of apoptosis (XIAP) siRNA
actgaacacaatgtgtattcata

SEQ ID NO: 12150 - DNA, 23 bp, Artificial Sequence
  X-linked inhibitor of apoptosis (XIAP) siRNA
ctgaacacaatgtgtattcatag

SEQ ID NO: 12151 - DNA, 23 bp, Artificial Sequence
  X-linked inhibitor of apoptosis (XIAP) siRNA
tgaacacaatgtgtattcatagt

SEQ ID NO: 12152 - DNA, 23 bp, Artificial Sequence
  X-linked inhibitor of apoptosis (XIAP) siRNA
gaacacaatgtgtattcatagta

SEQ ID NO: 12153 - DNA, 23 bp, Artificial Sequence
  X-linked inhibitor of apoptosis (XIAP) siRNA
aacacaatgtgtattcatagtat

SEQ ID NO: 12154 - DNA, 23 bp, Artificial Sequence
  X-linked inhibitor of apoptosis (XIAP) siRNA
acacaatgtgtattcatagtata

SEQ ID NO: 12155 - DNA, 23 bp, Artificial Sequence
  X-linked inhibitor of apoptosis (XIAP) siRNA
cacaatgtgtattcatagtatac

SEQ ID NO: 12156 - DNA, 23 bp, Artificial Sequence
  X-linked inhibitor of apoptosis (XIAP) siRNA
acaatgtgtattcatagtatact

SEQ ID NO: 12157 - DNA, 23 bp, Artificial Sequence
  X-linked inhibitor of apoptosis (XIAP) siRNA
caatgtgtattcatagtatactg

SEQ ID NO: 12158 - DNA, 23 bp, Artificial Sequence
  X-linked inhibitor of apoptosis (XIAP) siRNA
aatgtgtattcatagtatactga

SEQ ID NO: 12159 - DNA, 23 bp, Artificial Sequence
  X-linked inhibitor of apoptosis (XIAP) siRNA
atgtgtattcatagtatactgat

SEQ ID NO: 12160 - DNA, 23 bp, Artificial Sequence
  X-linked inhibitor of apoptosis (XIAP) siRNA
tgtgtattcatagtatactgatt

SEQ ID NO: 12161 - DNA, 23 bp, Artificial Sequence
  X-linked inhibitor of apoptosis (XIAP) siRNA
gtgtattcatagtatactgattt

SEQ ID NO: 12162 - DNA, 23 bp, Artificial Sequence
  X-linked inhibitor of apoptosis (XIAP) siRNA
tgtattcatagtatactgattta

SEQ ID NO: 12163 - DNA, 23 bp, Artificial Sequence
  X-linked inhibitor of apoptosis (XIAP) siRNA
gtattcatagtatactgatttaa

SEQ ID NO: 12164 - DNA, 23 bp, Artificial Sequence
  X-linked inhibitor of apoptosis (XIAP) siRNA
tattcatagtatactgatttaat

SEQ ID NO: 12165 - DNA, 23 bp, Artificial Sequence
  X-linked inhibitor of apoptosis (XIAP) siRNA
attcatagtatactgatttaatt

SEQ ID NO: 12166 - DNA, 23 bp, Artificial Sequence
  X-linked inhibitor of apoptosis (XIAP) siRNA
ttcatagtatactgatttaattt

SEQ ID NO: 12167 - DNA, 23 bp, Artificial Sequence
  X-linked inhibitor of apoptosis (XIAP) siRNA
tcatagtatactgatttaatttc

SEQ ID NO: 12168 - DNA, 23 bp, Artificial Sequence
  X-linked inhibitor of apoptosis (XIAP) siRNA
catagtatactgatttaatttct

SEQ ID NO: 12169 - DNA, 23 bp, Artificial Sequence
  X-linked inhibitor of apoptosis (XIAP) siRNA
atagtatactgatttaatttcta

SEQ ID NO: 12170 - DNA, 23 bp, Artificial Sequence
  X-linked inhibitor of apoptosis (XIAP) siRNA
tagtatactgatttaatttctaa

SEQ ID NO: 12171 - DNA, 23 bp, Artificial Sequence
  X-linked inhibitor of apoptosis (XIAP) siRNA
agtatactgatttaatttctaag

SEQ ID NO: 12172 - DNA, 23 bp, Artificial Sequence
  X-linked inhibitor of apoptosis (XIAP) siRNA
gtatactgatttaatttctaagt

SEQ ID NO: 12173 - DNA, 23 bp, Artificial Sequence
  X-linked inhibitor of apoptosis (XIAP) siRNA
tatactgatttaatttctaagtg

SEQ ID NO: 12174 - DNA, 23 bp, Artificial Sequence
  X-linked inhibitor of apoptosis (XIAP) siRNA
atactgatttaatttctaagtgt

SEQ ID NO: 12175 - DNA, 23 bp, Artificial Sequence
  X-linked inhibitor of apoptosis (XIAP) siRNA
tactgatttaatttctaagtgta

SEQ ID NO: 12176 - DNA, 23 bp, Artificial Sequence
  X-linked inhibitor of apoptosis (XIAP) siRNA
actgatttaatttctaagtgtaa

SEQ ID NO: 12177 - DNA, 23 bp, Artificial Sequence
  X-linked inhibitor of apoptosis (XIAP) siRNA
ctgatttaatttctaagtgtaag

SEQ ID NO: 12178 - DNA, 23 bp, Artificial Sequence
  X-linked inhibitor of apoptosis (XIAP) siRNA
tgatttaatttctaagtgtaagt

SEQ ID NO: 12179 - DNA, 23 bp, Artificial Sequence
  X-linked inhibitor of apoptosis (XIAP) siRNA
gatttaatttctaagtgtaagtg

SEQ ID NO: 12180 - DNA, 23 bp, Artificial Sequence
  X-linked inhibitor of apoptosis (XIAP) siRNA
atttaatttctaagtgtaagtga

SEQ ID NO: 12181 - DNA, 23 bp, Artificial Sequence
  X-linked inhibitor of apoptosis (XIAP) siRNA
tttaatttctaagtgtaagtgaa

SEQ ID NO: 12182 - DNA, 23 bp, Artificial Sequence
  X-linked inhibitor of apoptosis (XIAP) siRNA
ttaatttctaagtgtaagtgaat

SEQ ID NO: 12183 - DNA, 23 bp, Artificial Sequence
  X-linked inhibitor of apoptosis (XIAP) siRNA
taatttctaagtgtaagtgaatt

SEQ ID NO: 12184 - DNA, 23 bp, Artificial Sequence
  X-linked inhibitor of apoptosis (XIAP) siRNA
aatttctaagtgtaagtgaatta

SEQ ID NO: 12185 - DNA, 23 bp, Artificial Sequence
  X-linked inhibitor of apoptosis (XIAP) siRNA
atttctaagtgtaagtgaattaa

SEQ ID NO: 12186 - DNA, 23 bp, Artificial Sequence
  X-linked inhibitor of apoptosis (XIAP) siRNA
tttctaagtgtaagtgaattaat

SEQ ID NO: 12187 - DNA, 23 bp, Artificial Sequence
  X-linked inhibitor of apoptosis (XIAP) siRNA
ttctaagtgtaagtgaattaatc

SEQ ID NO: 12188 - DNA, 23 bp, Artificial Sequence
  X-linked inhibitor of apoptosis (XIAP) siRNA
tctaagtgtaagtgaattaatca

SEQ ID NO: 12189 - DNA, 23 bp, Artificial Sequence
  X-linked inhibitor of apoptosis (XIAP) siRNA
ctaagtgtaagtgaattaatcat

SEQ ID NO: 12190 - DNA, 23 bp, Artificial Sequence
  X-linked inhibitor of apoptosis (XIAP) siRNA
taagtgtaagtgaattaatcatc

SEQ ID NO: 12191 - DNA, 23 bp, Artificial Sequence
  X-linked inhibitor of apoptosis (XIAP) siRNA
aagtgtaagtgaattaatcatct

SEQ ID NO: 12192 - DNA, 23 bp, Artificial Sequence
  X-linked inhibitor of apoptosis (XIAP) siRNA
agtgtaagtgaattaatcatctg

SEQ ID NO: 12193 - DNA, 23 bp, Artificial Sequence
  X-linked inhibitor of apoptosis (XIAP) siRNA
gtgtaagtgaattaatcatctgg

SEQ ID NO: 12194 - DNA, 23 bp, Artificial Sequence
  X-linked inhibitor of apoptosis (XIAP) siRNA
tgtaagtgaattaatcatctgga

SEQ ID NO: 12195 - DNA, 23 bp, Artificial Sequence
  X-linked inhibitor of apoptosis (XIAP) siRNA
gtaagtgaattaatcatctggat

SEQ ID NO: 12196 - DNA, 23 bp, Artificial Sequence
  X-linked inhibitor of apoptosis (XIAP) siRNA
taagtgaattaatcatctggatt

SEQ ID NO: 12197 - DNA, 23 bp, Artificial Sequence
  X-linked inhibitor of apoptosis (XIAP) siRNA
aagtgaattaatcatctggattt

SEQ ID NO: 12198 - DNA, 23 bp, Artificial Sequence
  X-linked inhibitor of apoptosis (XIAP) siRNA
agtgaattaatcatctggatttt

SEQ ID NO: 12199 - DNA, 23 bp, Artificial Sequence
  X-linked inhibitor of apoptosis (XIAP) siRNA
gtgaattaatcatctggattttt

SEQ ID NO: 12200 - DNA, 23 bp, Artificial Sequence
  X-linked inhibitor of apoptosis (XIAP) siRNA
tgaattaatcatctggatttttt

SEQ ID NO: 12201 - DNA, 23 bp, Artificial Sequence
  X-linked inhibitor of apoptosis (XIAP) siRNA
gaattaatcatctggatttttta

SEQ ID NO: 12202 - DNA, 23 bp, Artificial Sequence
  X-linked inhibitor of apoptosis (XIAP) siRNA
aattaatcatctggattttttat

SEQ ID NO: 12203 - DNA, 23 bp, Artificial Sequence
  X-linked inhibitor of apoptosis (XIAP) siRNA
attaatcatctggattttttatt

SEQ ID NO: 12204 - DNA, 23 bp, Artificial Sequence
  X-linked inhibitor of apoptosis (XIAP) siRNA
ttaatcatctggattttttattc

SEQ ID NO: 12205 - DNA, 23 bp, Artificial Sequence
  X-linked inhibitor of apoptosis (XIAP) siRNA
taatcatctggattttttattct

SEQ ID NO: 12206 - DNA, 23 bp, Artificial Sequence
  X-linked inhibitor of apoptosis (XIAP) siRNA
aatcatctggattttttattctt

SEQ ID NO: 12207 - DNA, 23 bp, Artificial Sequence
  X-linked inhibitor of apoptosis (XIAP) siRNA
atcatctggattttttattcttt

SEQ ID NO: 12208 - DNA, 23 bp, Artificial Sequence
  X-linked inhibitor of apoptosis (XIAP) siRNA
tcatctggattttttattctttt

SEQ ID NO: 12209 - DNA, 23 bp, Artificial Sequence
  X-linked inhibitor of apoptosis (XIAP) siRNA
catctggattttttattcttttc

SEQ ID NO: 12210 - DNA, 23 bp, Artificial Sequence
  X-linked inhibitor of apoptosis (XIAP) siRNA
atctggattttttattcttttca

SEQ ID NO: 12211 - DNA, 23 bp, Artificial Sequence
  X-linked inhibitor of apoptosis (XIAP) siRNA
tctggattttttattcttttcag

SEQ ID NO: 12212 - DNA, 23 bp, Artificial Sequence
  X-linked inhibitor of apoptosis (XIAP) siRNA
ctggattttttattcttttcaga

SEQ ID NO: 12213 - DNA, 23 bp, Artificial Sequence
  X-linked inhibitor of apoptosis (XIAP) siRNA
tggattttttattcttttcagat

SEQ ID NO: 12214 - DNA, 23 bp, Artificial Sequence
  X-linked inhibitor of apoptosis (XIAP) siRNA
ggattttttattcttttcagata

SEQ ID NO: 12215 - DNA, 23 bp, Artificial Sequence
  X-linked inhibitor of apoptosis (XIAP) siRNA
gattttttattcttttcagatag

SEQ ID NO: 12216 - DNA, 23 bp, Artificial Sequence
  X-linked inhibitor of apoptosis (XIAP) siRNA
attttttattcttttcagatagg

SEQ ID NO: 12217 - DNA, 23 bp, Artificial Sequence
  X-linked inhibitor of apoptosis (XIAP) siRNA
ttttttattcttttcagataggc

SEQ ID NO: 12218 - DNA, 23 bp, Artificial Sequence
  X-linked inhibitor of apoptosis (XIAP) siRNA
tttttattcttttcagataggct

SEQ ID NO: 12219 - DNA, 23 bp, Artificial Sequence
  X-linked inhibitor of apoptosis (XIAP) siRNA
ttttattcttttcagataggctt

SEQ ID NO: 12220 - DNA, 23 bp, Artificial Sequence
  X-linked inhibitor of apoptosis (XIAP) siRNA
tttattcttttcagataggctta

SEQ ID NO: 12221 - DNA, 23 bp, Artificial Sequence
  X-linked inhibitor of apoptosis (XIAP) siRNA
ttattcttttcagataggcttaa

SEQ ID NO: 12222 - DNA, 23 bp, Artificial Sequence
  X-linked inhibitor of apoptosis (XIAP) siRNA
tattcttttcagataggcttaac

SEQ ID NO: 12223 - DNA, 23 bp, Artificial Sequence
  X-linked inhibitor of apoptosis (XIAP) siRNA
attcttttcagataggcttaaca

SEQ ID NO: 12224 - DNA, 23 bp, Artificial Sequence
  X-linked inhibitor of apoptosis (XIAP) siRNA
ttcttttcagataggcttaacaa

SEQ ID NO: 12225 - DNA, 23 bp, Artificial Sequence
  X-linked inhibitor of apoptosis (XIAP) siRNA
tcttttcagataggcttaacaaa

SEQ ID NO: 12226 - DNA, 23 bp, Artificial Sequence
  X-linked inhibitor of apoptosis (XIAP) siRNA
cttttcagataggcttaacaaat

SEQ ID NO: 12227 - DNA, 23 bp, Artificial Sequence
  X-linked inhibitor of apoptosis (XIAP) siRNA
ttttcagataggcttaacaaatg

SEQ ID NO: 12228 - DNA, 23 bp, Artificial Sequence
  X-linked inhibitor of apoptosis (XIAP) siRNA
tttcagataggcttaacaaatgg

SEQ ID NO: 12229 - DNA, 23 bp, Artificial Sequence
  X-linked inhibitor of apoptosis (XIAP) siRNA
ttcagataggcttaacaaatgga

SEQ ID NO: 12230 - DNA, 23 bp, Artificial Sequence
  X-linked inhibitor of apoptosis (XIAP) siRNA
tcagataggcttaacaaatggag

SEQ ID NO: 12231 - DNA, 23 bp, Artificial Sequence
  X-linked inhibitor of apoptosis (XIAP) siRNA
cagataggcttaacaaatggagc

SEQ ID NO: 12232 - DNA, 23 bp, Artificial Sequence
  X-linked inhibitor of apoptosis (XIAP) siRNA
agataggcttaacaaatggagct

SEQ ID NO: 12233 - DNA, 23 bp, Artificial Sequence
  X-linked inhibitor of apoptosis (XIAP) siRNA
gataggcttaacaaatggagctt

SEQ ID NO: 12234 - DNA, 23 bp, Artificial Sequence
  X-linked inhibitor of apoptosis (XIAP) siRNA
ataggcttaacaaatggagcttt

SEQ ID NO: 12235 - DNA, 23 bp, Artificial Sequence
  X-linked inhibitor of apoptosis (XIAP) siRNA
taggcttaacaaatggagctttc

SEQ ID NO: 12236 - DNA, 23 bp, Artificial Sequence
  X-linked inhibitor of apoptosis (XIAP) siRNA
aggcttaacaaatggagctttct

SEQ ID NO: 12237 - DNA, 23 bp, Artificial Sequence
  X-linked inhibitor of apoptosis (XIAP) siRNA
ggcttaacaaatggagctttctg

SEQ ID NO: 12238 - DNA, 23 bp, Artificial Sequence
  X-linked inhibitor of apoptosis (XIAP) siRNA
gcttaacaaatggagctttctgt

SEQ ID NO: 12239 - DNA, 23 bp, Artificial Sequence
  X-linked inhibitor of apoptosis (XIAP) siRNA
cttaacaaatggagctttctgta

SEQ ID NO: 12240 - DNA, 23 bp, Artificial Sequence
  X-linked inhibitor of apoptosis (XIAP) siRNA
ttaacaaatggagctttctgtat

SEQ ID NO: 12241 - DNA, 23 bp, Artificial Sequence
  X-linked inhibitor of apoptosis (XIAP) siRNA
taacaaatggagctttctgtata

SEQ ID NO: 12242 - DNA, 23 bp, Artificial Sequence
  X-linked inhibitor of apoptosis (XIAP) siRNA
aacaaatggagctttctgtatat

SEQ ID NO: 12243 - DNA, 23 bp, Artificial Sequence
  X-linked inhibitor of apoptosis (XIAP) siRNA
acaaatggagctttctgtatata

SEQ ID NO: 12244 - DNA, 23 bp, Artificial Sequence
  X-linked inhibitor of apoptosis (XIAP) siRNA
caaatggagctttctgtatataa

SEQ ID NO: 12245 - DNA, 23 bp, Artificial Sequence
  X-linked inhibitor of apoptosis (XIAP) siRNA
aaatggagctttctgtatataaa

SEQ ID NO: 12246 - DNA, 23 bp, Artificial Sequence
  X-linked inhibitor of apoptosis (XIAP) siRNA
aatggagctttctgtatataaat

SEQ ID NO: 12247 - DNA, 23 bp, Artificial Sequence
  X-linked inhibitor of apoptosis (XIAP) siRNA
atggagctttctgtatataaatg

SEQ ID NO: 12248 - DNA, 23 bp, Artificial Sequence
  X-linked inhibitor of apoptosis (XIAP) siRNA
tggagctttctgtatataaatgt

SEQ ID NO: 12249 - DNA, 23 bp, Artificial Sequence
  X-linked inhibitor of apoptosis (XIAP) siRNA
ggagctttctgtatataaatgtg

SEQ ID NO: 12250 - DNA, 23 bp, Artificial Sequence
  X-linked inhibitor of apoptosis (XIAP) siRNA
gagctttctgtatataaatgtgg

SEQ ID NO: 12251 - DNA, 23 bp, Artificial Sequence
  X-linked inhibitor of apoptosis (XIAP) siRNA
agctttctgtatataaatgtgga

SEQ ID NO: 12252 - DNA, 23 bp, Artificial Sequence
  X-linked inhibitor of apoptosis (XIAP) siRNA
gctttctgtatataaatgtggag

SEQ ID NO: 12253 - DNA, 23 bp, Artificial Sequence
  X-linked inhibitor of apoptosis (XIAP) siRNA
ctttctgtatataaatgtggaga

SEQ ID NO: 12254 - DNA, 23 bp, Artificial Sequence
  X-linked inhibitor of apoptosis (XIAP) siRNA
tttctgtatataaatgtggagat

SEQ ID NO: 12255 - DNA, 23 bp, Artificial Sequence
  X-linked inhibitor of apoptosis (XIAP) siRNA
ttctgtatataaatgtggagatt

SEQ ID NO: 12256 - DNA, 23 bp, Artificial Sequence
  X-linked inhibitor of apoptosis (XIAP) siRNA
tctgtatataaatgtggagatta

SEQ ID NO: 12257 - DNA, 23 bp, Artificial Sequence
  X-linked inhibitor of apoptosis (XIAP) siRNA
ctgtatataaatgtggagattag

SEQ ID NO: 12258 - DNA, 23 bp, Artificial Sequence
  X-linked inhibitor of apoptosis (XIAP) siRNA
tgtatataaatgtggagattaga

SEQ ID NO: 12259 - DNA, 23 bp, Artificial Sequence
  X-linked inhibitor of apoptosis (XIAP) siRNA
gtatataaatgtggagattagag

SEQ ID NO: 12260 - DNA, 23 bp, Artificial Sequence
  X-linked inhibitor of apoptosis (XIAP) siRNA
tatataaatgtggagattagagt

SEQ ID NO: 12261 - DNA, 23 bp, Artificial Sequence
  X-linked inhibitor of apoptosis (XIAP) siRNA
atataaatgtggagattagagtt

SEQ ID NO: 12262 - DNA, 23 bp, Artificial Sequence
  X-linked inhibitor of apoptosis (XIAP) siRNA
tataaatgtggagattagagtta

SEQ ID NO: 12263 - DNA, 23 bp, Artificial Sequence
  X-linked inhibitor of apoptosis (XIAP) siRNA
ataaatgtggagattagagttaa

SEQ ID NO: 12264 - DNA, 23 bp, Artificial Sequence
  X-linked inhibitor of apoptosis (XIAP) siRNA
taaatgtggagattagagttaat

SEQ ID NO: 12265 - DNA, 23 bp, Artificial Sequence
  X-linked inhibitor of apoptosis (XIAP) siRNA
aaatgtggagattagagttaatc

SEQ ID NO: 12266 - DNA, 23 bp, Artificial Sequence
  X-linked inhibitor of apoptosis (XIAP) siRNA
aatgtggagattagagttaatct

SEQ ID NO: 12267 - DNA, 23 bp, Artificial Sequence
  X-linked inhibitor of apoptosis (XIAP) siRNA
atgtggagattagagttaatctc

SEQ ID NO: 12268 - DNA, 23 bp, Artificial Sequence
  X-linked inhibitor of apoptosis (XIAP) siRNA
tgtggagattagagttaatctcc

SEQ ID NO: 12269 - DNA, 23 bp, Artificial Sequence
  X-linked inhibitor of apoptosis (XIAP) siRNA
gtggagattagagttaatctccc

SEQ ID NO: 12270 - DNA, 23 bp, Artificial Sequence
  X-linked inhibitor of apoptosis (XIAP) siRNA
tggagattagagttaatctcccc

SEQ ID NO: 12271 - DNA, 23 bp, Artificial Sequence
  X-linked inhibitor of apoptosis (XIAP) siRNA
ggagattagagttaatctcccca

SEQ ID NO: 12272 - DNA, 23 bp, Artificial Sequence
  X-linked inhibitor of apoptosis (XIAP) siRNA
gagattagagttaatctccccaa

SEQ ID NO: 12273 - DNA, 23 bp, Artificial Sequence
  X-linked inhibitor of apoptosis (XIAP) siRNA
agattagagttaatctccccaat

SEQ ID NO: 12274 - DNA, 23 bp, Artificial Sequence
  X-linked inhibitor of apoptosis (XIAP) siRNA
gattagagttaatctccccaatc

SEQ ID NO: 12275 - DNA, 23 bp, Artificial Sequence
  X-linked inhibitor of apoptosis (XIAP) siRNA
attagagttaatctccccaatca

SEQ ID NO: 12276 - DNA, 23 bp, Artificial Sequence
  X-linked inhibitor of apoptosis (XIAP) siRNA
ttagagttaatctccccaatcac

SEQ ID NO: 12277 - DNA, 23 bp, Artificial Sequence
  X-linked inhibitor of apoptosis (XIAP) siRNA
tagagttaatctccccaatcaca

SEQ ID NO: 12278 - DNA, 23 bp, Artificial Sequence
  X-linked inhibitor of apoptosis (XIAP) siRNA
agagttaatctccccaatcacat

SEQ ID NO: 12279 - DNA, 23 bp, Artificial Sequence
  X-linked inhibitor of apoptosis (XIAP) siRNA
gagttaatctccccaatcacata

SEQ ID NO: 12280 - DNA, 23 bp, Artificial Sequence
  X-linked inhibitor of apoptosis (XIAP) siRNA
agttaatctccccaatcacataa

SEQ ID NO: 12281 - DNA, 23 bp, Artificial Sequence
  X-linked inhibitor of apoptosis (XIAP) siRNA
gttaatctccccaatcacataat

SEQ ID NO: 12282 - DNA, 23 bp, Artificial Sequence
  X-linked inhibitor of apoptosis (XIAP) siRNA
ttaatctccccaatcacataatt

SEQ ID NO: 12283 - DNA, 23 bp, Artificial Sequence
  X-linked inhibitor of apoptosis (XIAP) siRNA
taatctccccaatcacataattt

SEQ ID NO: 12284 - DNA, 23 bp, Artificial Sequence
  X-linked inhibitor of apoptosis (XIAP) siRNA
aatctccccaatcacataatttg

SEQ ID NO: 12285 - DNA, 23 bp, Artificial Sequence
  X-linked inhibitor of apoptosis (XIAP) siRNA
atctccccaatcacataatttgt

SEQ ID NO: 12286 - DNA, 23 bp, Artificial Sequence
  X-linked inhibitor of apoptosis (XIAP) siRNA
tctccccaatcacataatttgtt

SEQ ID NO: 12287 - DNA, 23 bp, Artificial Sequence
  X-linked inhibitor of apoptosis (XIAP) siRNA
ctccccaatcacataatttgttt

SEQ ID NO: 12288 - DNA, 23 bp, Artificial Sequence
  X-linked inhibitor of apoptosis (XIAP) siRNA
tccccaatcacataatttgtttt

SEQ ID NO: 12289 - DNA, 23 bp, Artificial Sequence
  X-linked inhibitor of apoptosis (XIAP) siRNA
ccccaatcacataatttgttttg

SEQ ID NO: 12290 - DNA, 23 bp, Artificial Sequence
  X-linked inhibitor of apoptosis (XIAP) siRNA
cccaatcacataatttgttttgt

SEQ ID NO: 12291 - DNA, 23 bp, Artificial Sequence
  X-linked inhibitor of apoptosis (XIAP) siRNA
ccaatcacataatttgttttgtg

SEQ ID NO: 12292 - DNA, 23 bp, Artificial Sequence
  X-linked inhibitor of apoptosis (XIAP) siRNA
caatcacataatttgttttgtgt

SEQ ID NO: 12293 - DNA, 23 bp, Artificial Sequence
  X-linked inhibitor of apoptosis (XIAP) siRNA
aatcacataatttgttttgtgtg

SEQ ID NO: 12294 - DNA, 23 bp, Artificial Sequence
  X-linked inhibitor of apoptosis (XIAP) siRNA
atcacataatttgttttgtgtga

SEQ ID NO: 12295 - DNA, 23 bp, Artificial Sequence
  X-linked inhibitor of apoptosis (XIAP) siRNA
tcacataatttgttttgtgtgaa

SEQ ID NO: 12296 - DNA, 23 bp, Artificial Sequence
  X-linked inhibitor of apoptosis (XIAP) siRNA
cacataatttgttttgtgtgaaa

SEQ ID NO: 12297 - DNA, 23 bp, Artificial Sequence
  X-linked inhibitor of apoptosis (XIAP) siRNA
acataatttgttttgtgtgaaaa

SEQ ID NO: 12298 - DNA, 23 bp, Artificial Sequence
  X-linked inhibitor of apoptosis (XIAP) siRNA
cataatttgttttgtgtgaaaaa

SEQ ID NO: 12299 - DNA, 23 bp, Artificial Sequence
  X-linked inhibitor of apoptosis (XIAP) siRNA
ataatttgttttgtgtgaaaaag

SEQ ID NO: 12300 - DNA, 23 bp, Artificial Sequence
  X-linked inhibitor of apoptosis (XIAP) siRNA
taatttgttttgtgtgaaaaagg

SEQ ID NO: 12301 - DNA, 23 bp, Artificial Sequence
  X-linked inhibitor of apoptosis (XIAP) siRNA
aatttgttttgtgtgaaaaagga

SEQ ID NO: 12302 - DNA, 23 bp, Artificial Sequence
  X-linked inhibitor of apoptosis (XIAP) siRNA
atttgttttgtgtgaaaaaggaa

SEQ ID NO: 12303 - DNA, 23 bp, Artificial Sequence
  X-linked inhibitor of apoptosis (XIAP) siRNA
tttgttttgtgtgaaaaaggaat

SEQ ID NO: 12304 - DNA, 23 bp, Artificial Sequence
  X-linked inhibitor of apoptosis (XIAP) siRNA
ttgttttgtgtgaaaaaggaata

SEQ ID NO: 12305 - DNA, 23 bp, Artificial Sequence
  X-linked inhibitor of apoptosis (XIAP) siRNA
tgttttgtgtgaaaaaggaataa

SEQ ID NO: 12306 - DNA, 23 bp, Artificial Sequence
  X-linked inhibitor of apoptosis (XIAP) siRNA
gttttgtgtgaaaaaggaataaa

SEQ ID NO: 12307 - DNA, 23 bp, Artificial Sequence
  X-linked inhibitor of apoptosis (XIAP) siRNA
ttttgtgtgaaaaaggaataaat

SEQ ID NO: 12308 - DNA, 23 bp, Artificial Sequence
  X-linked inhibitor of apoptosis (XIAP) siRNA
tttgtgtgaaaaaggaataaatt

SEQ ID NO: 12309 - DNA, 23 bp, Artificial Sequence
  X-linked inhibitor of apoptosis (XIAP) siRNA
ttgtgtgaaaaaggaataaattg

SEQ ID NO: 12310 - DNA, 23 bp, Artificial Sequence
  X-linked inhibitor of apoptosis (XIAP) siRNA
tgtgtgaaaaaggaataaattgt

SEQ ID NO: 12311 - DNA, 23 bp, Artificial Sequence
  X-linked inhibitor of apoptosis (XIAP) siRNA
gtgtgaaaaaggaataaattgtt

SEQ ID NO: 12312 - DNA, 23 bp, Artificial Sequence
  X-linked inhibitor of apoptosis (XIAP) siRNA
tgtgaaaaaggaataaattgttc

SEQ ID NO: 12313 - DNA, 23 bp, Artificial Sequence
  X-linked inhibitor of apoptosis (XIAP) siRNA
gtgaaaaaggaataaattgttcc

SEQ ID NO: 12314 - DNA, 23 bp, Artificial Sequence
  X-linked inhibitor of apoptosis (XIAP) siRNA
tgaaaaaggaataaattgttcca

SEQ ID NO: 12315 - DNA, 23 bp, Artificial Sequence
  X-linked inhibitor of apoptosis (XIAP) siRNA
gaaaaaggaataaattgttccat

SEQ ID NO: 12316 - DNA, 23 bp, Artificial Sequence
  X-linked inhibitor of apoptosis (XIAP) siRNA
aaaaaggaataaattgttccatg

SEQ ID NO: 12317 - DNA, 23 bp, Artificial Sequence
  X-linked inhibitor of apoptosis (XIAP) siRNA
aaaaggaataaattgttccatgc

SEQ ID NO: 12318 - DNA, 23 bp, Artificial Sequence
  X-linked inhibitor of apoptosis (XIAP) siRNA
aaaggaataaattgttccatgct

SEQ ID NO: 12319 - DNA, 23 bp, Artificial Sequence
  X-linked inhibitor of apoptosis (XIAP) siRNA
aaggaataaattgttccatgctg

SEQ ID NO: 12320 - DNA, 23 bp, Artificial Sequence
  X-linked inhibitor of apoptosis (XIAP) siRNA
aggaataaattgttccatgctgg

SEQ ID NO: 12321 - DNA, 23 bp, Artificial Sequence
  X-linked inhibitor of apoptosis (XIAP) siRNA
ggaataaattgttccatgctggt

SEQ ID NO: 12322 - DNA, 23 bp, Artificial Sequence
  X-linked inhibitor of apoptosis (XIAP) siRNA
gaataaattgttccatgctggtg

SEQ ID NO: 12323 - DNA, 23 bp, Artificial Sequence
  X-linked inhibitor of apoptosis (XIAP) siRNA
aataaattgttccatgctggtgg

SEQ ID NO: 12324 - DNA, 23 bp, Artificial Sequence
  X-linked inhibitor of apoptosis (XIAP) siRNA
ataaattgttccatgctggtgga

SEQ ID NO: 12325 - DNA, 23 bp, Artificial Sequence
  X-linked inhibitor of apoptosis (XIAP) siRNA
taaattgttccatgctggtggaa

SEQ ID NO: 12326 - DNA, 23 bp, Artificial Sequence
  X-linked inhibitor of apoptosis (XIAP) siRNA
aaattgttccatgctggtggaaa

SEQ ID NO: 12327 - DNA, 23 bp, Artificial Sequence
  X-linked inhibitor of apoptosis (XIAP) siRNA
aattgttccatgctggtggaaag

SEQ ID NO: 12328 - DNA, 23 bp, Artificial Sequence
  X-linked inhibitor of apoptosis (XIAP) siRNA
attgttccatgctggtggaaaga

SEQ ID NO: 12329 - DNA, 23 bp, Artificial Sequence
  X-linked inhibitor of apoptosis (XIAP) siRNA
ttgttccatgctggtggaaagat

SEQ ID NO: 12330 - DNA, 23 bp, Artificial Sequence
  X-linked inhibitor of apoptosis (XIAP) siRNA
tgttccatgctggtggaaagata

SEQ ID NO: 12331 - DNA, 23 bp, Artificial Sequence
  X-linked inhibitor of apoptosis (XIAP) siRNA
gttccatgctggtggaaagatag

SEQ ID NO: 12332 - DNA, 23 bp, Artificial Sequence
  X-linked inhibitor of apoptosis (XIAP) siRNA
ttccatgctggtggaaagataga

SEQ ID NO: 12333 - DNA, 23 bp, Artificial Sequence
  X-linked inhibitor of apoptosis (XIAP) siRNA
tccatgctggtggaaagatagag

SEQ ID NO: 12334 - DNA, 23 bp, Artificial Sequence
  X-linked inhibitor of apoptosis (XIAP) siRNA
ccatgctggtggaaagatagaga

SEQ ID NO: 12335 - DNA, 23 bp, Artificial Sequence
  X-linked inhibitor of apoptosis (XIAP) siRNA
catgctggtggaaagatagagat

SEQ ID NO: 12336 - DNA, 23 bp, Artificial Sequence
  X-linked inhibitor of apoptosis (XIAP) siRNA
atgctggtggaaagatagagatt

SEQ ID NO: 12337 - DNA, 23 bp, Artificial Sequence
  X-linked inhibitor of apoptosis (XIAP) siRNA
tgctggtggaaagatagagattg

SEQ ID NO: 12338 - DNA, 23 bp, Artificial Sequence
  X-linked inhibitor of apoptosis (XIAP) siRNA
gctggtggaaagatagagattgt

SEQ ID NO: 12339 - DNA, 23 bp, Artificial Sequence
  X-linked inhibitor of apoptosis (XIAP) siRNA
ctggtggaaagatagagattgtt

SEQ ID NO: 12340 - DNA, 23 bp, Artificial Sequence
  X-linked inhibitor of apoptosis (XIAP) siRNA
tggtggaaagatagagattgttt

SEQ ID NO: 12341 - DNA, 23 bp, Artificial Sequence
  X-linked inhibitor of apoptosis (XIAP) siRNA
ggtggaaagatagagattgtttt

SEQ ID NO: 12342 - DNA, 23 bp, Artificial Sequence
  X-linked inhibitor of apoptosis (XIAP) siRNA
gtggaaagatagagattgttttt

SEQ ID NO: 12343 - DNA, 23 bp, Artificial Sequence
  X-linked inhibitor of apoptosis (XIAP) siRNA
tggaaagatagagattgttttta

SEQ ID NO: 12344 - DNA, 23 bp, Artificial Sequence
  X-linked inhibitor of apoptosis (XIAP) siRNA
ggaaagatagagattgtttttag

SEQ ID NO: 12345 - DNA, 23 bp, Artificial Sequence
  X-linked inhibitor of apoptosis (XIAP) siRNA
gaaagatagagattgtttttaga

SEQ ID NO: 12346 - DNA, 23 bp, Artificial Sequence
  X-linked inhibitor of apoptosis (XIAP) siRNA
aaagatagagattgtttttagag

SEQ ID NO: 12347 - DNA, 23 bp, Artificial Sequence
  X-linked inhibitor of apoptosis (XIAP) siRNA
aagatagagattgtttttagagg

SEQ ID NO: 12348 - DNA, 23 bp, Artificial Sequence
  X-linked inhibitor of apoptosis (XIAP) siRNA
agatagagattgtttttagaggt

SEQ ID NO: 12349 - DNA, 23 bp, Artificial Sequence
  X-linked inhibitor of apoptosis (XIAP) siRNA
gatagagattgtttttagaggtt

SEQ ID NO: 12350 - DNA, 23 bp, Artificial Sequence
  X-linked inhibitor of apoptosis (XIAP) siRNA
atagagattgtttttagaggttg

SEQ ID NO: 12351 - DNA, 23 bp, Artificial Sequence
  X-linked inhibitor of apoptosis (XIAP) siRNA
tagagattgtttttagaggttgg

SEQ ID NO: 12352 - DNA, 23 bp, Artificial Sequence
  X-linked inhibitor of apoptosis (XIAP) siRNA
agagattgtttttagaggttggt

SEQ ID NO: 12353 - DNA, 23 bp, Artificial Sequence
  X-linked inhibitor of apoptosis (XIAP) siRNA
gagattgtttttagaggttggtt

SEQ ID NO: 12354 - DNA, 23 bp, Artificial Sequence
  X-linked inhibitor of apoptosis (XIAP) siRNA
agattgtttttagaggttggttg

SEQ ID NO: 12355 - DNA, 23 bp, Artificial Sequence
  X-linked inhibitor of apoptosis (XIAP) siRNA
gattgtttttagaggttggttgt

SEQ ID NO: 12356 - DNA, 23 bp, Artificial Sequence
  X-linked inhibitor of apoptosis (XIAP) siRNA
attgtttttagaggttggttgtt

SEQ ID NO: 12357 - DNA, 23 bp, Artificial Sequence
  X-linked inhibitor of apoptosis (XIAP) siRNA
ttgtttttagaggttggttgttg

SEQ ID NO: 12358 - DNA, 23 bp, Artificial Sequence
  X-linked inhibitor of apoptosis (XIAP) siRNA
tgtttttagaggttggttgttgt

SEQ ID NO: 12359 - DNA, 23 bp, Artificial Sequence
  X-linked inhibitor of apoptosis (XIAP) siRNA
gtttttagaggttggttgttgtg

SEQ ID NO: 12360 - DNA, 23 bp, Artificial Sequence
  X-linked inhibitor of apoptosis (XIAP) siRNA
tttttagaggttggttgttgtgt

SEQ ID NO: 12361 - DNA, 23 bp, Artificial Sequence
  X-linked inhibitor of apoptosis (XIAP) siRNA
ttttagaggttggttgttgtgtt

SEQ ID NO: 12362 - DNA, 23 bp, Artificial Sequence
  X-linked inhibitor of apoptosis (XIAP) siRNA
tttagaggttggttgttgtgttt

SEQ ID NO: 12363 - DNA, 23 bp, Artificial Sequence
  X-linked inhibitor of apoptosis (XIAP) siRNA
ttagaggttggttgttgtgtttt

SEQ ID NO: 12364 - DNA, 23 bp, Artificial Sequence
  X-linked inhibitor of apoptosis (XIAP) siRNA
tagaggttggttgttgtgtttta

SEQ ID NO: 12365 - DNA, 23 bp, Artificial Sequence
  X-linked inhibitor of apoptosis (XIAP) siRNA
agaggttggttgttgtgttttag

SEQ ID NO: 12366 - DNA, 23 bp, Artificial Sequence
  X-linked inhibitor of apoptosis (XIAP) siRNA
gaggttggttgttgtgttttagg

SEQ ID NO: 12367 - DNA, 23 bp, Artificial Sequence
  X-linked inhibitor of apoptosis (XIAP) siRNA
aggttggttgttgtgttttagga

SEQ ID NO: 12368 - DNA, 23 bp, Artificial Sequence
  X-linked inhibitor of apoptosis (XIAP) siRNA
ggttggttgttgtgttttaggat

SEQ ID NO: 12369 - DNA, 23 bp, Artificial Sequence
  X-linked inhibitor of apoptosis (XIAP) siRNA
gttggttgttgtgttttaggatt

SEQ ID NO: 12370 - DNA, 23 bp, Artificial Sequence
  X-linked inhibitor of apoptosis (XIAP) siRNA
ttggttgttgtgttttaggattc

SEQ ID NO: 12371 - DNA, 23 bp, Artificial Sequence
  X-linked inhibitor of apoptosis (XIAP) siRNA
tggttgttgtgttttaggattct

SEQ ID NO: 12372 - DNA, 23 bp, Artificial Sequence
  X-linked inhibitor of apoptosis (XIAP) siRNA
ggttgttgtgttttaggattctg

SEQ ID NO: 12373 - DNA, 23 bp, Artificial Sequence
  X-linked inhibitor of apoptosis (XIAP) siRNA
gttgttgtgttttaggattctgt

SEQ ID NO: 12374 - DNA, 23 bp, Artificial Sequence
  X-linked inhibitor of apoptosis (XIAP) siRNA
ttgttgtgttttaggattctgtc

SEQ ID NO: 12375 - DNA, 23 bp, Artificial Sequence
  X-linked inhibitor of apoptosis (XIAP) siRNA
tgttgtgttttaggattctgtcc

SEQ ID NO: 12376 - DNA, 23 bp, Artificial Sequence
  X-linked inhibitor of apoptosis (XIAP) siRNA
gttgtgttttaggattctgtcca

SEQ ID NO: 12377 - DNA, 23 bp, Artificial Sequence
  X-linked inhibitor of apoptosis (XIAP) siRNA
ttgtgttttaggattctgtccat

SEQ ID NO: 12378 - DNA, 23 bp, Artificial Sequence
  X-linked inhibitor of apoptosis (XIAP) siRNA
tgtgttttaggattctgtccatt

SEQ ID NO: 12379 - DNA, 23 bp, Artificial Sequence
  X-linked inhibitor of apoptosis (XIAP) siRNA
gtgttttaggattctgtccattt

SEQ ID NO: 12380 - DNA, 23 bp, Artificial Sequence
  X-linked inhibitor of apoptosis (XIAP) siRNA
tgttttaggattctgtccatttt

SEQ ID NO: 12381 - DNA, 23 bp, Artificial Sequence
  X-linked inhibitor of apoptosis (XIAP) siRNA
gttttaggattctgtccattttc

SEQ ID NO: 12382 - DNA, 23 bp, Artificial Sequence
  X-linked inhibitor of apoptosis (XIAP) siRNA
ttttaggattctgtccattttct

SEQ ID NO: 12383 - DNA, 23 bp, Artificial Sequence
  X-linked inhibitor of apoptosis (XIAP) siRNA
tttaggattctgtccattttctt

SEQ ID NO: 12384 - DNA, 23 bp, Artificial Sequence
  X-linked inhibitor of apoptosis (XIAP) siRNA
ttaggattctgtccattttcttt

SEQ ID NO: 12385 - DNA, 23 bp, Artificial Sequence
  X-linked inhibitor of apoptosis (XIAP) siRNA
taggattctgtccattttctttt

SEQ ID NO: 12386 - DNA, 23 bp, Artificial Sequence
  X-linked inhibitor of apoptosis (XIAP) siRNA
aggattctgtccattttctttta

SEQ ID NO: 12387 - DNA, 23 bp, Artificial Sequence
  X-linked inhibitor of apoptosis (XIAP) siRNA
ggattctgtccattttcttttaa

SEQ ID NO: 12388 - DNA, 23 bp, Artificial Sequence
  X-linked inhibitor of apoptosis (XIAP) siRNA
gattctgtccattttcttttaaa

SEQ ID NO: 12389 - DNA, 23 bp, Artificial Sequence
  X-linked inhibitor of apoptosis (XIAP) siRNA
attctgtccattttcttttaaag

SEQ ID NO: 12390 - DNA, 23 bp, Artificial Sequence
  X-linked inhibitor of apoptosis (XIAP) siRNA
ttctgtccattttcttttaaagt

SEQ ID NO: 12391 - DNA, 23 bp, Artificial Sequence
  X-linked inhibitor of apoptosis (XIAP) siRNA
tctgtccattttcttttaaagtt

SEQ ID NO: 12392 - DNA, 23 bp, Artificial Sequence
  X-linked inhibitor of apoptosis (XIAP) siRNA
ctgtccattttcttttaaagtta

SEQ ID NO: 12393 - DNA, 23 bp, Artificial Sequence
  X-linked inhibitor of apoptosis (XIAP) siRNA
tgtccattttcttttaaagttat

SEQ ID NO: 12394 - DNA, 23 bp, Artificial Sequence
  X-linked inhibitor of apoptosis (XIAP) siRNA
gtccattttcttttaaagttata

SEQ ID NO: 12395 - DNA, 23 bp, Artificial Sequence
  X-linked inhibitor of apoptosis (XIAP) siRNA
tccattttcttttaaagttataa

SEQ ID NO: 12396 - DNA, 23 bp, Artificial Sequence
  X-linked inhibitor of apoptosis (XIAP) siRNA
ccattttcttttaaagttataaa

SEQ ID NO: 12397 - DNA, 23 bp, Artificial Sequence
  X-linked inhibitor of apoptosis (XIAP) siRNA
cattttcttttaaagttataaac

SEQ ID NO: 12398 - DNA, 23 bp, Artificial Sequence
  X-linked inhibitor of apoptosis (XIAP) siRNA
attttcttttaaagttataaaca

SEQ ID NO: 12399 - DNA, 23 bp, Artificial Sequence
  X-linked inhibitor of apoptosis (XIAP) siRNA
ttttcttttaaagttataaacac

SEQ ID NO: 12400 - DNA, 23 bp, Artificial Sequence
  X-linked inhibitor of apoptosis (XIAP) siRNA
tttcttttaaagttataaacacg

SEQ ID NO: 12401 - DNA, 23 bp, Artificial Sequence
  X-linked inhibitor of apoptosis (XIAP) siRNA
ttcttttaaagttataaacacgt

SEQ ID NO: 12402 - DNA, 23 bp, Artificial Sequence
  X-linked inhibitor of apoptosis (XIAP) siRNA
tcttttaaagttataaacacgta

SEQ ID NO: 12403 - DNA, 23 bp, Artificial Sequence
  X-linked inhibitor of apoptosis (XIAP) siRNA
cttttaaagttataaacacgtac

SEQ ID NO: 12404 - DNA, 23 bp, Artificial Sequence
  X-linked inhibitor of apoptosis (XIAP) siRNA
ttttaaagttataaacacgtact

SEQ ID NO: 12405 - DNA, 23 bp, Artificial Sequence
  X-linked inhibitor of apoptosis (XIAP) siRNA
tttaaagttataaacacgtactt

SEQ ID NO: 12406 - DNA, 23 bp, Artificial Sequence
  X-linked inhibitor of apoptosis (XIAP) siRNA
ttaaagttataaacacgtacttg

SEQ ID NO: 12407 - DNA, 23 bp, Artificial Sequence
  X-linked inhibitor of apoptosis (XIAP) siRNA
taaagttataaacacgtacttgt

SEQ ID NO: 12408 - DNA, 23 bp, Artificial Sequence
  X-linked inhibitor of apoptosis (XIAP) siRNA
aaagttataaacacgtacttgtg

SEQ ID NO: 12409 - DNA, 23 bp, Artificial Sequence
  X-linked inhibitor of apoptosis (XIAP) siRNA
aagttataaacacgtacttgtgc

SEQ ID NO: 12410 - DNA, 23 bp, Artificial Sequence
  X-linked inhibitor of apoptosis (XIAP) siRNA
agttataaacacgtacttgtgcg

SEQ ID NO: 12411 - DNA, 23 bp, Artificial Sequence
  X-linked inhibitor of apoptosis (XIAP) siRNA
gttataaacacgtacttgtgcga

SEQ ID NO: 12412 - DNA, 23 bp, Artificial Sequence
  X-linked inhibitor of apoptosis (XIAP) siRNA
ttataaacacgtacttgtgcgaa

SEQ ID NO: 12413 - DNA, 23 bp, Artificial Sequence
  X-linked inhibitor of apoptosis (XIAP) siRNA
tataaacacgtacttgtgcgaat

SEQ ID NO: 12414 - DNA, 23 bp, Artificial Sequence
  X-linked inhibitor of apoptosis (XIAP) siRNA
ataaacacgtacttgtgcgaatt

SEQ ID NO: 12415 - DNA, 23 bp, Artificial Sequence
  X-linked inhibitor of apoptosis (XIAP) siRNA
taaacacgtacttgtgcgaatta

SEQ ID NO: 12416 - DNA, 23 bp, Artificial Sequence
  X-linked inhibitor of apoptosis (XIAP) siRNA
aaacacgtacttgtgcgaattat

SEQ ID NO: 12417 - DNA, 23 bp, Artificial Sequence
  X-linked inhibitor of apoptosis (XIAP) siRNA
aacacgtacttgtgcgaattatt

SEQ ID NO: 12418 - DNA, 23 bp, Artificial Sequence
  X-linked inhibitor of apoptosis (XIAP) siRNA
acacgtacttgtgcgaattattt

SEQ ID NO: 12419 - DNA, 23 bp, Artificial Sequence
  X-linked inhibitor of apoptosis (XIAP) siRNA
cacgtacttgtgcgaattatttt

SEQ ID NO: 12420 - DNA, 23 bp, Artificial Sequence
  X-linked inhibitor of apoptosis (XIAP) siRNA
acgtacttgtgcgaattattttt

SEQ ID NO: 12421 - DNA, 23 bp, Artificial Sequence
  X-linked inhibitor of apoptosis (XIAP) siRNA
cgtacttgtgcgaattatttttt

SEQ ID NO: 12422 - DNA, 23 bp, Artificial Sequence
  X-linked inhibitor of apoptosis (XIAP) siRNA
gtacttgtgcgaattattttttt

SEQ ID NO: 12423 - DNA, 23 bp, Artificial Sequence
  X-linked inhibitor of apoptosis (XIAP) siRNA
tacttgtgcgaattattttttta

SEQ ID NO: 12424 - DNA, 23 bp, Artificial Sequence
  X-linked inhibitor of apoptosis (XIAP) siRNA
acttgtgcgaattatttttttaa

SEQ ID NO: 12425 - DNA, 23 bp, Artificial Sequence
  X-linked inhibitor of apoptosis (XIAP) siRNA
cttgtgcgaattatttttttaaa

SEQ ID NO: 12426 - DNA, 23 bp, Artificial Sequence
  X-linked inhibitor of apoptosis (XIAP) siRNA
ttgtgcgaattatttttttaaag

SEQ ID NO: 12427 - DNA, 23 bp, Artificial Sequence
  X-linked inhibitor of apoptosis (XIAP) siRNA
tgtgcgaattatttttttaaagt

SEQ ID NO: 12428 - DNA, 23 bp, Artificial Sequence
  X-linked inhibitor of apoptosis (XIAP) siRNA
gtgcgaattatttttttaaagtg

SEQ ID NO: 12429 - DNA, 23 bp, Artificial Sequence
  X-linked inhibitor of apoptosis (XIAP) siRNA
tgcgaattatttttttaaagtga

SEQ ID NO: 12430 - DNA, 23 bp, Artificial Sequence
  X-linked inhibitor of apoptosis (XIAP) siRNA
gcgaattatttttttaaagtgat

SEQ ID NO: 12431 - DNA, 23 bp, Artificial Sequence
  X-linked inhibitor of apoptosis (XIAP) siRNA
cgaattatttttttaaagtgatt

SEQ ID NO: 12432 - DNA, 23 bp, Artificial Sequence
  X-linked inhibitor of apoptosis (XIAP) siRNA
gaattatttttttaaagtgattt

SEQ ID NO: 12433 - DNA, 23 bp, Artificial Sequence
  X-linked inhibitor of apoptosis (XIAP) siRNA
aattatttttttaaagtgatttg

SEQ ID NO: 12434 - DNA, 23 bp, Artificial Sequence
  X-linked inhibitor of apoptosis (XIAP) siRNA
attatttttttaaagtgatttgc

SEQ ID NO: 12435 - DNA, 23 bp, Artificial Sequence
  X-linked inhibitor of apoptosis (XIAP) siRNA
ttatttttttaaagtgatttgcc

SEQ ID NO: 12436 - DNA, 23 bp, Artificial Sequence
  X-linked inhibitor of apoptosis (XIAP) siRNA
tatttttttaaagtgatttgcca

SEQ ID NO: 12437 - DNA, 23 bp, Artificial Sequence
  X-linked inhibitor of apoptosis (XIAP) siRNA
atttttttaaagtgatttgccat

SEQ ID NO: 12438 - DNA, 23 bp, Artificial Sequence
  X-linked inhibitor of apoptosis (XIAP) siRNA
tttttttaaagtgatttgccatt

SEQ ID NO: 12439 - DNA, 23 bp, Artificial Sequence
  X-linked inhibitor of apoptosis (XIAP) siRNA
ttttttaaagtgatttgccattt

SEQ ID NO: 12440 - DNA, 23 bp, Artificial Sequence
  X-linked inhibitor of apoptosis (XIAP) siRNA
tttttaaagtgatttgccatttt

SEQ ID NO: 12441 - DNA, 23 bp, Artificial Sequence
  X-linked inhibitor of apoptosis (XIAP) siRNA
ttttaaagtgatttgccattttt

SEQ ID NO: 12442 - DNA, 23 bp, Artificial Sequence
  X-linked inhibitor of apoptosis (XIAP) siRNA
tttaaagtgatttgccatttttg

SEQ ID NO: 12443 - DNA, 23 bp, Artificial Sequence
  X-linked inhibitor of apoptosis (XIAP) siRNA
ttaaagtgatttgccatttttga

SEQ ID NO: 12444 - DNA, 23 bp, Artificial Sequence
  X-linked inhibitor of apoptosis (XIAP) siRNA
taaagtgatttgccatttttgaa

SEQ ID NO: 12445 - DNA, 23 bp, Artificial Sequence
  X-linked inhibitor of apoptosis (XIAP) siRNA
aaagtgatttgccatttttgaaa

SEQ ID NO: 12446 - DNA, 23 bp, Artificial Sequence
  X-linked inhibitor of apoptosis (XIAP) siRNA
aagtgatttgccatttttgaaag

SEQ ID NO: 12447 - DNA, 23 bp, Artificial Sequence
  X-linked inhibitor of apoptosis (XIAP) siRNA
agtgatttgccatttttgaaagc

SEQ ID NO: 12448 - DNA, 23 bp, Artificial Sequence
  X-linked inhibitor of apoptosis (XIAP) siRNA
gtgatttgccatttttgaaagcg

SEQ ID NO: 12449 - DNA, 23 bp, Artificial Sequence
  X-linked inhibitor of apoptosis (XIAP) siRNA
tgatttgccatttttgaaagcgt

SEQ ID NO: 12450 - DNA, 23 bp, Artificial Sequence
  X-linked inhibitor of apoptosis (XIAP) siRNA
gatttgccatttttgaaagcgta

SEQ ID NO: 12451 - DNA, 23 bp, Artificial Sequence
  X-linked inhibitor of apoptosis (XIAP) siRNA
atttgccatttttgaaagcgtat

SEQ ID NO: 12452 - DNA, 23 bp, Artificial Sequence
  X-linked inhibitor of apoptosis (XIAP) siRNA
tttgccatttttgaaagcgtatt

SEQ ID NO: 12453 - DNA, 23 bp, Artificial Sequence
  X-linked inhibitor of apoptosis (XIAP) siRNA
ttgccatttttgaaagcgtattt

SEQ ID NO: 12454 - DNA, 23 bp, Artificial Sequence
  X-linked inhibitor of apoptosis (XIAP) siRNA
tgccatttttgaaagcgtattta

SEQ ID NO: 12455 - DNA, 23 bp, Artificial Sequence
  X-linked inhibitor of apoptosis (XIAP) siRNA
gccatttttgaaagcgtatttaa

SEQ ID NO: 12456 - DNA, 23 bp, Artificial Sequence
  X-linked inhibitor of apoptosis (XIAP) siRNA
ccatttttgaaagcgtatttaat

SEQ ID NO: 12457 - DNA, 23 bp, Artificial Sequence
  X-linked inhibitor of apoptosis (XIAP) siRNA
catttttgaaagcgtatttaatg

SEQ ID NO: 12458 - DNA, 23 bp, Artificial Sequence
  X-linked inhibitor of apoptosis (XIAP) siRNA
atttttgaaagcgtatttaatga

SEQ ID NO: 12459 - DNA, 23 bp, Artificial Sequence
  X-linked inhibitor of apoptosis (XIAP) siRNA
tttttgaaagcgtatttaatgat

SEQ ID NO: 12460 - DNA, 23 bp, Artificial Sequence
  X-linked inhibitor of apoptosis (XIAP) siRNA
ttttgaaagcgtatttaatgata

SEQ ID NO: 12461 - DNA, 23 bp, Artificial Sequence
  X-linked inhibitor of apoptosis (XIAP) siRNA
tttgaaagcgtatttaatgatag

SEQ ID NO: 12462 - DNA, 23 bp, Artificial Sequence
  X-linked inhibitor of apoptosis (XIAP) siRNA
ttgaaagcgtatttaatgataga

SEQ ID NO: 12463 - DNA, 23 bp, Artificial Sequence
  X-linked inhibitor of apoptosis (XIAP) siRNA
tgaaagcgtatttaatgatagaa

SEQ ID NO: 12464 - DNA, 23 bp, Artificial Sequence
  X-linked inhibitor of apoptosis (XIAP) siRNA
gaaagcgtatttaatgatagaat

SEQ ID NO: 12465 - DNA, 23 bp, Artificial Sequence
  X-linked inhibitor of apoptosis (XIAP) siRNA
aaagcgtatttaatgatagaata

SEQ ID NO: 12466 - DNA, 23 bp, Artificial Sequence
  X-linked inhibitor of apoptosis (XIAP) siRNA
aagcgtatttaatgatagaatac

SEQ ID NO: 12467 - DNA, 23 bp, Artificial Sequence
  X-linked inhibitor of apoptosis (XIAP) siRNA
agcgtatttaatgatagaatact

SEQ ID NO: 12468 - DNA, 23 bp, Artificial Sequence
  X-linked inhibitor of apoptosis (XIAP) siRNA
gcgtatttaatgatagaatacta

SEQ ID NO: 12469 - DNA, 23 bp, Artificial Sequence
  X-linked inhibitor of apoptosis (XIAP) siRNA
cgtatttaatgatagaatactat

SEQ ID NO: 12470 - DNA, 23 bp, Artificial Sequence
  X-linked inhibitor of apoptosis (XIAP) siRNA
gtatttaatgatagaatactatc

SEQ ID NO: 12471 - DNA, 23 bp, Artificial Sequence
  X-linked inhibitor of apoptosis (XIAP) siRNA
tatttaatgatagaatactatcg

SEQ ID NO: 12472 - DNA, 23 bp, Artificial Sequence
  X-linked inhibitor of apoptosis (XIAP) siRNA
atttaatgatagaatactatcga

SEQ ID NO: 12473 - DNA, 23 bp, Artificial Sequence
  X-linked inhibitor of apoptosis (XIAP) siRNA
tttaatgatagaatactatcgag

SEQ ID NO: 12474 - DNA, 23 bp, Artificial Sequence
  X-linked inhibitor of apoptosis (XIAP) siRNA
ttaatgatagaatactatcgagc

SEQ ID NO: 12475 - DNA, 23 bp, Artificial Sequence
  X-linked inhibitor of apoptosis (XIAP) siRNA
taatgatagaatactatcgagcc

SEQ ID NO: 12476 - DNA, 23 bp, Artificial Sequence
  X-linked inhibitor of apoptosis (XIAP) siRNA
aatgatagaatactatcgagcca

SEQ ID NO: 12477 - DNA, 23 bp, Artificial Sequence
  X-linked inhibitor of apoptosis (XIAP) siRNA
atgatagaatactatcgagccaa

SEQ ID NO: 12478 - DNA, 23 bp, Artificial Sequence
  X-linked inhibitor of apoptosis (XIAP) siRNA
tgatagaatactatcgagccaac

SEQ ID NO: 12479 - DNA, 23 bp, Artificial Sequence
  X-linked inhibitor of apoptosis (XIAP) siRNA
gatagaatactatcgagccaaca

SEQ ID NO: 12480 - DNA, 23 bp, Artificial Sequence
  X-linked inhibitor of apoptosis (XIAP) siRNA
atagaatactatcgagccaacat

SEQ ID NO: 12481 - DNA, 23 bp, Artificial Sequence
  X-linked inhibitor of apoptosis (XIAP) siRNA
tagaatactatcgagccaacatg

SEQ ID NO: 12482 - DNA, 23 bp, Artificial Sequence
  X-linked inhibitor of apoptosis (XIAP) siRNA
agaatactatcgagccaacatgt

SEQ ID NO: 12483 - DNA, 23 bp, Artificial Sequence
  X-linked inhibitor of apoptosis (XIAP) siRNA
gaatactatcgagccaacatgta

SEQ ID NO: 12484 - DNA, 23 bp, Artificial Sequence
  X-linked inhibitor of apoptosis (XIAP) siRNA
aatactatcgagccaacatgtac

SEQ ID NO: 12485 - DNA, 23 bp, Artificial Sequence
  X-linked inhibitor of apoptosis (XIAP) siRNA
atactatcgagccaacatgtact

SEQ ID NO: 12486 - DNA, 23 bp, Artificial Sequence
  X-linked inhibitor of apoptosis (XIAP) siRNA
tactatcgagccaacatgtactg

SEQ ID NO: 12487 - DNA, 23 bp, Artificial Sequence
  X-linked inhibitor of apoptosis (XIAP) siRNA
actatcgagccaacatgtactga

SEQ ID NO: 12488 - DNA, 23 bp, Artificial Sequence
  X-linked inhibitor of apoptosis (XIAP) siRNA
ctatcgagccaacatgtactgac

SEQ ID NO: 12489 - DNA, 23 bp, Artificial Sequence
  X-linked inhibitor of apoptosis (XIAP) siRNA
tatcgagccaacatgtactgaca

SEQ ID NO: 12490 - DNA, 23 bp, Artificial Sequence
  X-linked inhibitor of apoptosis (XIAP) siRNA
atcgagccaacatgtactgacat

SEQ ID NO: 12491 - DNA, 23 bp, Artificial Sequence
  X-linked inhibitor of apoptosis (XIAP) siRNA
tcgagccaacatgtactgacatg

SEQ ID NO: 12492 - DNA, 23 bp, Artificial Sequence
  X-linked inhibitor of apoptosis (XIAP) siRNA
cgagccaacatgtactgacatgg

SEQ ID NO: 12493 - DNA, 23 bp, Artificial Sequence
  X-linked inhibitor of apoptosis (XIAP) siRNA
gagccaacatgtactgacatgga

SEQ ID NO: 12494 - DNA, 23 bp, Artificial Sequence
  X-linked inhibitor of apoptosis (XIAP) siRNA
agccaacatgtactgacatggaa

SEQ ID NO: 12495 - DNA, 23 bp, Artificial Sequence
  X-linked inhibitor of apoptosis (XIAP) siRNA
gccaacatgtactgacatggaaa

SEQ ID NO: 12496 - DNA, 23 bp, Artificial Sequence
  X-linked inhibitor of apoptosis (XIAP) siRNA
ccaacatgtactgacatggaaag

SEQ ID NO: 12497 - DNA, 23 bp, Artificial Sequence
  X-linked inhibitor of apoptosis (XIAP) siRNA
caacatgtactgacatggaaaga

SEQ ID NO: 12498 - DNA, 23 bp, Artificial Sequence
  X-linked inhibitor of apoptosis (XIAP) siRNA
aacatgtactgacatggaaagat

SEQ ID NO: 12499 - DNA, 23 bp, Artificial Sequence
  X-linked inhibitor of apoptosis (XIAP) siRNA
acatgtactgacatggaaagatg

SEQ ID NO: 12500 - DNA, 23 bp, Artificial Sequence
  X-linked inhibitor of apoptosis (XIAP) siRNA
catgtactgacatggaaagatgt

SEQ ID NO: 12501 - DNA, 23 bp, Artificial Sequence
  X-linked inhibitor of apoptosis (XIAP) siRNA
atgtactgacatggaaagatgtc

SEQ ID NO: 12502 - DNA, 23 bp, Artificial Sequence
  X-linked inhibitor of apoptosis (XIAP) siRNA
tgtactgacatggaaagatgtca

SEQ ID NO: 12503 - DNA, 23 bp, Artificial Sequence
  X-linked inhibitor of apoptosis (XIAP) siRNA
gtactgacatggaaagatgtcaa

SEQ ID NO: 12504 - DNA, 23 bp, Artificial Sequence
  X-linked inhibitor of apoptosis (XIAP) siRNA
tactgacatggaaagatgtcaaa

SEQ ID NO: 12505 - DNA, 23 bp, Artificial Sequence
  X-linked inhibitor of apoptosis (XIAP) siRNA
actgacatggaaagatgtcaaag

SEQ ID NO: 12506 - DNA, 23 bp, Artificial Sequence
  X-linked inhibitor of apoptosis (XIAP) siRNA
ctgacatggaaagatgtcaaaga

SEQ ID NO: 12507 - DNA, 23 bp, Artificial Sequence
  X-linked inhibitor of apoptosis (XIAP) siRNA
tgacatggaaagatgtcaaagat

SEQ ID NO: 12508 - DNA, 23 bp, Artificial Sequence
  X-linked inhibitor of apoptosis (XIAP) siRNA
gacatggaaagatgtcaaagata

SEQ ID NO: 12509 - DNA, 23 bp, Artificial Sequence
  X-linked inhibitor of apoptosis (XIAP) siRNA
acatggaaagatgtcaaagatat

SEQ ID NO: 12510 - DNA, 23 bp, Artificial Sequence
  X-linked inhibitor of apoptosis (XIAP) siRNA
catggaaagatgtcaaagatatg

SEQ ID NO: 12511 - DNA, 23 bp, Artificial Sequence
  X-linked inhibitor of apoptosis (XIAP) siRNA
atggaaagatgtcaaagatatgt

SEQ ID NO: 12512 - DNA, 23 bp, Artificial Sequence
  X-linked inhibitor of apoptosis (XIAP) siRNA
tggaaagatgtcaaagatatgtt

SEQ ID NO: 12513 - DNA, 23 bp, Artificial Sequence
  X-linked inhibitor of apoptosis (XIAP) siRNA
ggaaagatgtcaaagatatgtta

SEQ ID NO: 12514 - DNA, 23 bp, Artificial Sequence
  X-linked inhibitor of apoptosis (XIAP) siRNA
gaaagatgtcaaagatatgttaa

SEQ ID NO: 12515 - DNA, 23 bp, Artificial Sequence
  X-linked inhibitor of apoptosis (XIAP) siRNA
aaagatgtcaaagatatgttaag

SEQ ID NO: 12516 - DNA, 23 bp, Artificial Sequence
  X-linked inhibitor of apoptosis (XIAP) siRNA
aagatgtcaaagatatgttaagt

SEQ ID NO: 12517 - DNA, 23 bp, Artificial Sequence
  X-linked inhibitor of apoptosis (XIAP) siRNA
agatgtcaaagatatgttaagtg

SEQ ID NO: 12518 - DNA, 23 bp, Artificial Sequence
  X-linked inhibitor of apoptosis (XIAP) siRNA
gatgtcaaagatatgttaagtgt

SEQ ID NO: 12519 - DNA, 23 bp, Artificial Sequence
  X-linked inhibitor of apoptosis (XIAP) siRNA
atgtcaaagatatgttaagtgta

SEQ ID NO: 12520 - DNA, 23 bp, Artificial Sequence
  X-linked inhibitor of apoptosis (XIAP) siRNA
tgtcaaagatatgttaagtgtaa

SEQ ID NO: 12521 - DNA, 23 bp, Artificial Sequence
  X-linked inhibitor of apoptosis (XIAP) siRNA
gtcaaagatatgttaagtgtaaa

SEQ ID NO: 12522 - DNA, 23 bp, Artificial Sequence
  X-linked inhibitor of apoptosis (XIAP) siRNA
tcaaagatatgttaagtgtaaaa

SEQ ID NO: 12523 - DNA, 23 bp, Artificial Sequence
  X-linked inhibitor of apoptosis (XIAP) siRNA
caaagatatgttaagtgtaaaat

SEQ ID NO: 12524 - DNA, 23 bp, Artificial Sequence
  X-linked inhibitor of apoptosis (XIAP) siRNA
aaagatatgttaagtgtaaaatg

SEQ ID NO: 12525 - DNA, 23 bp, Artificial Sequence
  X-linked inhibitor of apoptosis (XIAP) siRNA
aagatatgttaagtgtaaaatgc

SEQ ID NO: 12526 - DNA, 23 bp, Artificial Sequence
  X-linked inhibitor of apoptosis (XIAP) siRNA
agatatgttaagtgtaaaatgca

SEQ ID NO: 12527 - DNA, 23 bp, Artificial Sequence
  X-linked inhibitor of apoptosis (XIAP) siRNA
gatatgttaagtgtaaaatgcaa

SEQ ID NO: 12528 - DNA, 23 bp, Artificial Sequence
  X-linked inhibitor of apoptosis (XIAP) siRNA
atatgttaagtgtaaaatgcaag

SEQ ID NO: 12529 - DNA, 23 bp, Artificial Sequence
  X-linked inhibitor of apoptosis (XIAP) siRNA
tatgttaagtgtaaaatgcaagt

SEQ ID NO: 12530 - DNA, 23 bp, Artificial Sequence
  X-linked inhibitor of apoptosis (XIAP) siRNA
atgttaagtgtaaaatgcaagtg

SEQ ID NO: 12531 - DNA, 23 bp, Artificial Sequence
  X-linked inhibitor of apoptosis (XIAP) siRNA
tgttaagtgtaaaatgcaagtgg

SEQ ID NO: 12532 - DNA, 23 bp, Artificial Sequence
  X-linked inhibitor of apoptosis (XIAP) siRNA
gttaagtgtaaaatgcaagtggc

SEQ ID NO: 12533 - DNA, 23 bp, Artificial Sequence
  X-linked inhibitor of apoptosis (XIAP) siRNA
ttaagtgtaaaatgcaagtggca

SEQ ID NO: 12534 - DNA, 23 bp, Artificial Sequence
  X-linked inhibitor of apoptosis (XIAP) siRNA
taagtgtaaaatgcaagtggcaa

SEQ ID NO: 12535 - DNA, 23 bp, Artificial Sequence
  X-linked inhibitor of apoptosis (XIAP) siRNA
aagtgtaaaatgcaagtggcaaa

SEQ ID NO: 12536 - DNA, 23 bp, Artificial Sequence
  X-linked inhibitor of apoptosis (XIAP) siRNA
agtgtaaaatgcaagtggcaaaa

SEQ ID NO: 12537 - DNA, 23 bp, Artificial Sequence
  X-linked inhibitor of apoptosis (XIAP) siRNA
gtgtaaaatgcaagtggcaaaac

SEQ ID NO: 12538 - DNA, 23 bp, Artificial Sequence
  X-linked inhibitor of apoptosis (XIAP) siRNA
tgtaaaatgcaagtggcaaaaca

SEQ ID NO: 12539 - DNA, 23 bp, Artificial Sequence
  X-linked inhibitor of apoptosis (XIAP) siRNA
gtaaaatgcaagtggcaaaacac

SEQ ID NO: 12540 - DNA, 23 bp, Artificial Sequence
  X-linked inhibitor of apoptosis (XIAP) siRNA
taaaatgcaagtggcaaaacact

SEQ ID NO: 12541 - DNA, 23 bp, Artificial Sequence
  X-linked inhibitor of apoptosis (XIAP) siRNA
aaaatgcaagtggcaaaacacta

SEQ ID NO: 12542 - DNA, 23 bp, Artificial Sequence
  X-linked inhibitor of apoptosis (XIAP) siRNA
aaatgcaagtggcaaaacactat

SEQ ID NO: 12543 - DNA, 23 bp, Artificial Sequence
  X-linked inhibitor of apoptosis (XIAP) siRNA
aatgcaagtggcaaaacactatg

SEQ ID NO: 12544 - DNA, 23 bp, Artificial Sequence
  X-linked inhibitor of apoptosis (XIAP) siRNA
atgcaagtggcaaaacactatgt

SEQ ID NO: 12545 - DNA, 23 bp, Artificial Sequence
  X-linked inhibitor of apoptosis (XIAP) siRNA
tgcaagtggcaaaacactatgta

SEQ ID NO: 12546 - DNA, 23 bp, Artificial Sequence
  X-linked inhibitor of apoptosis (XIAP) siRNA
gcaagtggcaaaacactatgtat

SEQ ID NO: 12547 - DNA, 23 bp, Artificial Sequence
  X-linked inhibitor of apoptosis (XIAP) siRNA
caagtggcaaaacactatgtata

SEQ ID NO: 12548 - DNA, 23 bp, Artificial Sequence
  X-linked inhibitor of apoptosis (XIAP) siRNA
aagtggcaaaacactatgtatag

SEQ ID NO: 12549 - DNA, 23 bp, Artificial Sequence
  X-linked inhibitor of apoptosis (XIAP) siRNA
agtggcaaaacactatgtatagt

SEQ ID NO: 12550 - DNA, 23 bp, Artificial Sequence
  X-linked inhibitor of apoptosis (XIAP) siRNA
gtggcaaaacactatgtatagtc

SEQ ID NO: 12551 - DNA, 23 bp, Artificial Sequence
  X-linked inhibitor of apoptosis (XIAP) siRNA
tggcaaaacactatgtatagtct

SEQ ID NO: 12552 - DNA, 23 bp, Artificial Sequence
  X-linked inhibitor of apoptosis (XIAP) siRNA
ggcaaaacactatgtatagtctg

SEQ ID NO: 12553 - DNA, 23 bp, Artificial Sequence
  X-linked inhibitor of apoptosis (XIAP) siRNA
gcaaaacactatgtatagtctga

SEQ ID NO: 12554 - DNA, 23 bp, Artificial Sequence
  X-linked inhibitor of apoptosis (XIAP) siRNA
caaaacactatgtatagtctgag

SEQ ID NO: 12555 - DNA, 23 bp, Artificial Sequence
  X-linked inhibitor of apoptosis (XIAP) siRNA
aaaacactatgtatagtctgagc

SEQ ID NO: 12556 - DNA, 23 bp, Artificial Sequence
  X-linked inhibitor of apoptosis (XIAP) siRNA
aaacactatgtatagtctgagcc

SEQ ID NO: 12557 - DNA, 23 bp, Artificial Sequence
  X-linked inhibitor of apoptosis (XIAP) siRNA
aacactatgtatagtctgagcca

SEQ ID NO: 12558 - DNA, 23 bp, Artificial Sequence
  X-linked inhibitor of apoptosis (XIAP) siRNA
acactatgtatagtctgagccag

SEQ ID NO: 12559 - DNA, 23 bp, Artificial Sequence
  X-linked inhibitor of apoptosis (XIAP) siRNA
cactatgtatagtctgagccaga

SEQ ID NO: 12560 - DNA, 23 bp, Artificial Sequence
  X-linked inhibitor of apoptosis (XIAP) siRNA
actatgtatagtctgagccagat

SEQ ID NO: 12561 - DNA, 23 bp, Artificial Sequence
  X-linked inhibitor of apoptosis (XIAP) siRNA
ctatgtatagtctgagccagatc

SEQ ID NO: 12562 - DNA, 23 bp, Artificial Sequence
  X-linked inhibitor of apoptosis (XIAP) siRNA
tatgtatagtctgagccagatca

SEQ ID NO: 12563 - DNA, 23 bp, Artificial Sequence
  X-linked inhibitor of apoptosis (XIAP) siRNA
atgtatagtctgagccagatcaa

SEQ ID NO: 12564 - DNA, 23 bp, Artificial Sequence
  X-linked inhibitor of apoptosis (XIAP) siRNA
tgtatagtctgagccagatcaaa

SEQ ID NO: 12565 - DNA, 23 bp, Artificial Sequence
  X-linked inhibitor of apoptosis (XIAP) siRNA
gtatagtctgagccagatcaaag

SEQ ID NO: 12566 - DNA, 23 bp, Artificial Sequence
  X-linked inhibitor of apoptosis (XIAP) siRNA
tatagtctgagccagatcaaagt

SEQ ID NO: 12567 - DNA, 23 bp, Artificial Sequence
  X-linked inhibitor of apoptosis (XIAP) siRNA
atagtctgagccagatcaaagta

SEQ ID NO: 12568 - DNA, 23 bp, Artificial Sequence
  X-linked inhibitor of apoptosis (XIAP) siRNA
tagtctgagccagatcaaagtat

SEQ ID NO: 12569 - DNA, 23 bp, Artificial Sequence
  X-linked inhibitor of apoptosis (XIAP) siRNA
agtctgagccagatcaaagtatg

SEQ ID NO: 12570 - DNA, 23 bp, Artificial Sequence
  X-linked inhibitor of apoptosis (XIAP) siRNA
gtctgagccagatcaaagtatgt

SEQ ID NO: 12571 - DNA, 23 bp, Artificial Sequence
  X-linked inhibitor of apoptosis (XIAP) siRNA
tctgagccagatcaaagtatgta

SEQ ID NO: 12572 - DNA, 23 bp, Artificial Sequence
  X-linked inhibitor of apoptosis (XIAP) siRNA
ctgagccagatcaaagtatgtat

SEQ ID NO: 12573 - DNA, 23 bp, Artificial Sequence
  X-linked inhibitor of apoptosis (XIAP) siRNA
tgagccagatcaaagtatgtatg

SEQ ID NO: 12574 - DNA, 23 bp, Artificial Sequence
  X-linked inhibitor of apoptosis (XIAP) siRNA
gagccagatcaaagtatgtatgt

SEQ ID NO: 12575 - DNA, 23 bp, Artificial Sequence
  X-linked inhibitor of apoptosis (XIAP) siRNA
agccagatcaaagtatgtatgtt

SEQ ID NO: 12576 - DNA, 23 bp, Artificial Sequence
  X-linked inhibitor of apoptosis (XIAP) siRNA
gccagatcaaagtatgtatgttt

SEQ ID NO: 12577 - DNA, 23 bp, Artificial Sequence
  X-linked inhibitor of apoptosis (XIAP) siRNA
ccagatcaaagtatgtatgtttt

SEQ ID NO: 12578 - DNA, 23 bp, Artificial Sequence
  X-linked inhibitor of apoptosis (XIAP) siRNA
cagatcaaagtatgtatgttttt

SEQ ID NO: 12579 - DNA, 23 bp, Artificial Sequence
  X-linked inhibitor of apoptosis (XIAP) siRNA
agatcaaagtatgtatgttttta

SEQ ID NO: 12580 - DNA, 23 bp, Artificial Sequence
  X-linked inhibitor of apoptosis (XIAP) siRNA
gatcaaagtatgtatgtttttaa

SEQ ID NO: 12581 - DNA, 23 bp, Artificial Sequence
  X-linked inhibitor of apoptosis (XIAP) siRNA
atcaaagtatgtatgtttttaat

SEQ ID NO: 12582 - DNA, 23 bp, Artificial Sequence
  X-linked inhibitor of apoptosis (XIAP) siRNA
tcaaagtatgtatgtttttaata

SEQ ID NO: 12583 - DNA, 23 bp, Artificial Sequence
  X-linked inhibitor of apoptosis (XIAP) siRNA
caaagtatgtatgtttttaatat

SEQ ID NO: 12584 - DNA, 23 bp, Artificial Sequence
  X-linked inhibitor of apoptosis (XIAP) siRNA
aaagtatgtatgtttttaatatg

SEQ ID NO: 12585 - DNA, 23 bp, Artificial Sequence
  X-linked inhibitor of apoptosis (XIAP) siRNA
aagtatgtatgtttttaatatgc

SEQ ID NO: 12586 - DNA, 23 bp, Artificial Sequence
  X-linked inhibitor of apoptosis (XIAP) siRNA
agtatgtatgtttttaatatgca

SEQ ID NO: 12587 - DNA, 23 bp, Artificial Sequence
  X-linked inhibitor of apoptosis (XIAP) siRNA
gtatgtatgtttttaatatgcat

SEQ ID NO: 12588 - DNA, 23 bp, Artificial Sequence
  X-linked inhibitor of apoptosis (XIAP) siRNA
tatgtatgtttttaatatgcata

SEQ ID NO: 12589 - DNA, 23 bp, Artificial Sequence
  X-linked inhibitor of apoptosis (XIAP) siRNA
atgtatgtttttaatatgcatag

SEQ ID NO: 12590 - DNA, 23 bp, Artificial Sequence
  X-linked inhibitor of apoptosis (XIAP) siRNA
tgtatgtttttaatatgcataga

SEQ ID NO: 12591 - DNA, 23 bp, Artificial Sequence
  X-linked inhibitor of apoptosis (XIAP) siRNA
gtatgtttttaatatgcatagaa

SEQ ID NO: 12592 - DNA, 23 bp, Artificial Sequence
  X-linked inhibitor of apoptosis (XIAP) siRNA
tatgtttttaatatgcatagaac

SEQ ID NO: 12593 - DNA, 23 bp, Artificial Sequence
  X-linked inhibitor of apoptosis (XIAP) siRNA
atgtttttaatatgcatagaaca

SEQ ID NO: 12594 - DNA, 23 bp, Artificial Sequence
  X-linked inhibitor of apoptosis (XIAP) siRNA
tgtttttaatatgcatagaacaa

SEQ ID NO: 12595 - DNA, 23 bp, Artificial Sequence
  X-linked inhibitor of apoptosis (XIAP) siRNA
gtttttaatatgcatagaacaaa

SEQ ID NO: 12596 - DNA, 23 bp, Artificial Sequence
  X-linked inhibitor of apoptosis (XIAP) siRNA
tttttaatatgcatagaacaaaa

SEQ ID NO: 12597 - DNA, 23 bp, Artificial Sequence
  X-linked inhibitor of apoptosis (XIAP) siRNA
ttttaatatgcatagaacaaaag

SEQ ID NO: 12598 - DNA, 23 bp, Artificial Sequence
  X-linked inhibitor of apoptosis (XIAP) siRNA
tttaatatgcatagaacaaaaga

SEQ ID NO: 12599 - DNA, 23 bp, Artificial Sequence
  X-linked inhibitor of apoptosis (XIAP) siRNA
ttaatatgcatagaacaaaagat

SEQ ID NO: 12600 - DNA, 23 bp, Artificial Sequence
  X-linked inhibitor of apoptosis (XIAP) siRNA
taatatgcatagaacaaaagatt

SEQ ID NO: 12601 - DNA, 23 bp, Artificial Sequence
  X-linked inhibitor of apoptosis (XIAP) siRNA
aatatgcatagaacaaaagattt

SEQ ID NO: 12602 - DNA, 23 bp, Artificial Sequence
  X-linked inhibitor of apoptosis (XIAP) siRNA
atatgcatagaacaaaagatttg

SEQ ID NO: 12603 - DNA, 23 bp, Artificial Sequence
  X-linked inhibitor of apoptosis (XIAP) siRNA
tatgcatagaacaaaagatttgg

SEQ ID NO: 12604 - DNA, 23 bp, Artificial Sequence
  X-linked inhibitor of apoptosis (XIAP) siRNA
atgcatagaacaaaagatttgga

SEQ ID NO: 12605 - DNA, 23 bp, Artificial Sequence
  X-linked inhibitor of apoptosis (XIAP) siRNA
tgcatagaacaaaagatttggaa

SEQ ID NO: 12606 - DNA, 23 bp, Artificial Sequence
  X-linked inhibitor of apoptosis (XIAP) siRNA
gcatagaacaaaagatttggaaa

SEQ ID NO: 12607 - DNA, 23 bp, Artificial Sequence
  X-linked inhibitor of apoptosis (XIAP) siRNA
catagaacaaaagatttggaaag

SEQ ID NO: 12608 - DNA, 23 bp, Artificial Sequence
  X-linked inhibitor of apoptosis (XIAP) siRNA
atagaacaaaagatttggaaaga

SEQ ID NO: 12609 - DNA, 23 bp, Artificial Sequence
  X-linked inhibitor of apoptosis (XIAP) siRNA
tagaacaaaagatttggaaagat

SEQ ID NO: 12610 - DNA, 23 bp, Artificial Sequence
  X-linked inhibitor of apoptosis (XIAP) siRNA
agaacaaaagatttggaaagata

SEQ ID NO: 12611 - DNA, 23 bp, Artificial Sequence
  X-linked inhibitor of apoptosis (XIAP) siRNA
gaacaaaagatttggaaagatat

SEQ ID NO: 12612 - DNA, 23 bp, Artificial Sequence
  X-linked inhibitor of apoptosis (XIAP) siRNA
aacaaaagatttggaaagatata

SEQ ID NO: 12613 - DNA, 23 bp, Artificial Sequence
  X-linked inhibitor of apoptosis (XIAP) siRNA
acaaaagatttggaaagatatac

SEQ ID NO: 12614 - DNA, 23 bp, Artificial Sequence
  X-linked inhibitor of apoptosis (XIAP) siRNA
caaaagatttggaaagatataca

SEQ ID NO: 12615 - DNA, 23 bp, Artificial Sequence
  X-linked inhibitor of apoptosis (XIAP) siRNA
aaaagatttggaaagatatacac

SEQ ID NO: 12616 - DNA, 23 bp, Artificial Sequence
  X-linked inhibitor of apoptosis (XIAP) siRNA
aaagatttggaaagatatacacc

SEQ ID NO: 12617 - DNA, 23 bp, Artificial Sequence
  X-linked inhibitor of apoptosis (XIAP) siRNA
aagatttggaaagatatacacca

SEQ ID NO: 12618 - DNA, 23 bp, Artificial Sequence
  X-linked inhibitor of apoptosis (XIAP) siRNA
agatttggaaagatatacaccaa

SEQ ID NO: 12619 - DNA, 23 bp, Artificial Sequence
  X-linked inhibitor of apoptosis (XIAP) siRNA
gatttggaaagatatacaccaaa

SEQ ID NO: 12620 - DNA, 23 bp, Artificial Sequence
  X-linked inhibitor of apoptosis (XIAP) siRNA
atttggaaagatatacaccaaac

SEQ ID NO: 12621 - DNA, 23 bp, Artificial Sequence
  X-linked inhibitor of apoptosis (XIAP) siRNA
tttggaaagatatacaccaaact

SEQ ID NO: 12622 - DNA, 23 bp, Artificial Sequence
  X-linked inhibitor of apoptosis (XIAP) siRNA
ttggaaagatatacaccaaactg

SEQ ID NO: 12623 - DNA, 23 bp, Artificial Sequence
  X-linked inhibitor of apoptosis (XIAP) siRNA
tggaaagatatacaccaaactgt

SEQ ID NO: 12624 - DNA, 23 bp, Artificial Sequence
  X-linked inhibitor of apoptosis (XIAP) siRNA
ggaaagatatacaccaaactgtt

SEQ ID NO: 12625 - DNA, 23 bp, Artificial Sequence
  X-linked inhibitor of apoptosis (XIAP) siRNA
gaaagatatacaccaaactgtta

SEQ ID NO: 12626 - DNA, 23 bp, Artificial Sequence
  X-linked inhibitor of apoptosis (XIAP) siRNA
aaagatatacaccaaactgttaa

SEQ ID NO: 12627 - DNA, 23 bp, Artificial Sequence
  X-linked inhibitor of apoptosis (XIAP) siRNA
aagatatacaccaaactgttaaa

SEQ ID NO: 12628 - DNA, 23 bp, Artificial Sequence
  X-linked inhibitor of apoptosis (XIAP) siRNA
agatatacaccaaactgttaaat

SEQ ID NO: 12629 - DNA, 23 bp, Artificial Sequence
  X-linked inhibitor of apoptosis (XIAP) siRNA
gatatacaccaaactgttaaatg

SEQ ID NO: 12630 - DNA, 23 bp, Artificial Sequence
  X-linked inhibitor of apoptosis (XIAP) siRNA
atatacaccaaactgttaaatgt

SEQ ID NO: 12631 - DNA, 23 bp, Artificial Sequence
  X-linked inhibitor of apoptosis (XIAP) siRNA
tatacaccaaactgttaaatgtg

SEQ ID NO: 12632 - DNA, 23 bp, Artificial Sequence
  X-linked inhibitor of apoptosis (XIAP) siRNA
atacaccaaactgttaaatgtgg

SEQ ID NO: 12633 - DNA, 23 bp, Artificial Sequence
  X-linked inhibitor of apoptosis (XIAP) siRNA
tacaccaaactgttaaatgtggt

SEQ ID NO: 12634 - DNA, 23 bp, Artificial Sequence
  X-linked inhibitor of apoptosis (XIAP) siRNA
acaccaaactgttaaatgtggtt

SEQ ID NO: 12635 - DNA, 23 bp, Artificial Sequence
  X-linked inhibitor of apoptosis (XIAP) siRNA
caccaaactgttaaatgtggttt

SEQ ID NO: 12636 - DNA, 23 bp, Artificial Sequence
  X-linked inhibitor of apoptosis (XIAP) siRNA
accaaactgttaaatgtggtttc

SEQ ID NO: 12637 - DNA, 23 bp, Artificial Sequence
  X-linked inhibitor of apoptosis (XIAP) siRNA
ccaaactgttaaatgtggtttct

SEQ ID NO: 12638 - DNA, 23 bp, Artificial Sequence
  X-linked inhibitor of apoptosis (XIAP) siRNA
caaactgttaaatgtggtttctc

SEQ ID NO: 12639 - DNA, 23 bp, Artificial Sequence
  X-linked inhibitor of apoptosis (XIAP) siRNA
aaactgttaaatgtggtttctct

SEQ ID NO: 12640 - DNA, 23 bp, Artificial Sequence
  X-linked inhibitor of apoptosis (XIAP) siRNA
aactgttaaatgtggtttctctt

SEQ ID NO: 12641 - DNA, 23 bp, Artificial Sequence
  X-linked inhibitor of apoptosis (XIAP) siRNA
actgttaaatgtggtttctcttc

SEQ ID NO: 12642 - DNA, 23 bp, Artificial Sequence
  X-linked inhibitor of apoptosis (XIAP) siRNA
ctgttaaatgtggtttctcttcg

SEQ ID NO: 12643 - DNA, 23 bp, Artificial Sequence
  X-linked inhibitor of apoptosis (XIAP) siRNA
tgttaaatgtggtttctcttcgg

SEQ ID NO: 12644 - DNA, 23 bp, Artificial Sequence
  X-linked inhibitor of apoptosis (XIAP) siRNA
gttaaatgtggtttctcttcggg

SEQ ID NO: 12645 - DNA, 23 bp, Artificial Sequence
  X-linked inhibitor of apoptosis (XIAP) siRNA
ttaaatgtggtttctcttcgggg

SEQ ID NO: 12646 - DNA, 23 bp, Artificial Sequence
  X-linked inhibitor of apoptosis (XIAP) siRNA
taaatgtggtttctcttcgggga

SEQ ID NO: 12647 - DNA, 23 bp, Artificial Sequence
  X-linked inhibitor of apoptosis (XIAP) siRNA
aaatgtggtttctcttcggggag

SEQ ID NO: 12648 - DNA, 23 bp, Artificial Sequence
  X-linked inhibitor of apoptosis (XIAP) siRNA
aatgtggtttctcttcggggagg

SEQ ID NO: 12649 - DNA, 23 bp, Artificial Sequence
  X-linked inhibitor of apoptosis (XIAP) siRNA
atgtggtttctcttcggggaggg

SEQ ID NO: 12650 - DNA, 23 bp, Artificial Sequence
  X-linked inhibitor of apoptosis (XIAP) siRNA
tgtggtttctcttcggggagggg

SEQ ID NO: 12651 - DNA, 23 bp, Artificial Sequence
  X-linked inhibitor of apoptosis (XIAP) siRNA
gtggtttctcttcggggaggggg

SEQ ID NO: 12652 - DNA, 23 bp, Artificial Sequence
  X-linked inhibitor of apoptosis (XIAP) siRNA
tggtttctcttcggggagggggg

SEQ ID NO: 12653 - DNA, 23 bp, Artificial Sequence
  X-linked inhibitor of apoptosis (XIAP) siRNA
ggtttctcttcggggaggggggg

SEQ ID NO: 12654 - DNA, 23 bp, Artificial Sequence
  X-linked inhibitor of apoptosis (XIAP) siRNA
gtttctcttcggggaggggggga

SEQ ID NO: 12655 - DNA, 23 bp, Artificial Sequence
  X-linked inhibitor of apoptosis (XIAP) siRNA
tttctcttcggggagggggggat

SEQ ID NO: 12656 - DNA, 23 bp, Artificial Sequence
  X-linked inhibitor of apoptosis (XIAP) siRNA
ttctcttcggggagggggggatt

SEQ ID NO: 12657 - DNA, 23 bp, Artificial Sequence
  X-linked inhibitor of apoptosis (XIAP) siRNA
tctcttcggggagggggggattg

SEQ ID NO: 12658 - DNA, 23 bp, Artificial Sequence
  X-linked inhibitor of apoptosis (XIAP) siRNA
ctcttcggggagggggggattgg

SEQ ID NO: 12659 - DNA, 23 bp, Artificial Sequence
  X-linked inhibitor of apoptosis (XIAP) siRNA
tcttcggggagggggggattggg

SEQ ID NO: 12660 - DNA, 23 bp, Artificial Sequence
  X-linked inhibitor of apoptosis (XIAP) siRNA
cttcggggagggggggattgggg

SEQ ID NO: 12661 - DNA, 23 bp, Artificial Sequence
  X-linked inhibitor of apoptosis (XIAP) siRNA
ttcggggagggggggattggggg

SEQ ID NO: 12662 - DNA, 23 bp, Artificial Sequence
  X-linked inhibitor of apoptosis (XIAP) siRNA
tcggggagggggggattggggga

SEQ ID NO: 12663 - DNA, 23 bp, Artificial Sequence
  X-linked inhibitor of apoptosis (XIAP) siRNA
cggggagggggggattgggggag

SEQ ID NO: 12664 - DNA, 23 bp, Artificial Sequence
  X-linked inhibitor of apoptosis (XIAP) siRNA
ggggagggggggattgggggagg

SEQ ID NO: 12665 - DNA, 23 bp, Artificial Sequence
  X-linked inhibitor of apoptosis (XIAP) siRNA
gggagggggggattgggggaggg

SEQ ID NO: 12666 - DNA, 23 bp, Artificial Sequence
  X-linked inhibitor of apoptosis (XIAP) siRNA
ggagggggggattgggggagggg

SEQ ID NO: 12667 - DNA, 23 bp, Artificial Sequence
  X-linked inhibitor of apoptosis (XIAP) siRNA
gagggggggattgggggaggggc

SEQ ID NO: 12668 - DNA, 23 bp, Artificial Sequence
  X-linked inhibitor of apoptosis (XIAP) siRNA
agggggggattgggggaggggcc

SEQ ID NO: 12669 - DNA, 23 bp, Artificial Sequence
  X-linked inhibitor of apoptosis (XIAP) siRNA
gggggggattgggggaggggccc

SEQ ID NO: 12670 - DNA, 23 bp, Artificial Sequence
  X-linked inhibitor of apoptosis (XIAP) siRNA
ggggggattgggggaggggcccc

SEQ ID NO: 12671 - DNA, 23 bp, Artificial Sequence
  X-linked inhibitor of apoptosis (XIAP) siRNA
gggggattgggggaggggcccca

SEQ ID NO: 12672 - DNA, 23 bp, Artificial Sequence
  X-linked inhibitor of apoptosis (XIAP) siRNA
ggggattgggggaggggccccag

SEQ ID NO: 12673 - DNA, 23 bp, Artificial Sequence
  X-linked inhibitor of apoptosis (XIAP) siRNA
gggattgggggaggggccccaga

SEQ ID NO: 12674 - DNA, 23 bp, Artificial Sequence
  X-linked inhibitor of apoptosis (XIAP) siRNA
ggattgggggaggggccccagag

SEQ ID NO: 12675 - DNA, 23 bp, Artificial Sequence
  X-linked inhibitor of apoptosis (XIAP) siRNA
gattgggggaggggccccagagg

SEQ ID NO: 12676 - DNA, 23 bp, Artificial Sequence
  X-linked inhibitor of apoptosis (XIAP) siRNA
attgggggaggggccccagaggg

SEQ ID NO: 12677 - DNA, 23 bp, Artificial Sequence
  X-linked inhibitor of apoptosis (XIAP) siRNA
ttgggggaggggccccagagggg

SEQ ID NO: 12678 - DNA, 23 bp, Artificial Sequence
  X-linked inhibitor of apoptosis (XIAP) siRNA
tgggggaggggccccagaggggt

SEQ ID NO: 12679 - DNA, 23 bp, Artificial Sequence
  X-linked inhibitor of apoptosis (XIAP) siRNA
gggggaggggccccagaggggtt

SEQ ID NO: 12680 - DNA, 23 bp, Artificial Sequence
  X-linked inhibitor of apoptosis (XIAP) siRNA
ggggaggggccccagaggggttt

SEQ ID NO: 12681 - DNA, 23 bp, Artificial Sequence
  X-linked inhibitor of apoptosis (XIAP) siRNA
gggaggggccccagaggggtttt

SEQ ID NO: 12682 - DNA, 23 bp, Artificial Sequence
  X-linked inhibitor of apoptosis (XIAP) siRNA
ggaggggccccagaggggtttta

SEQ ID NO: 12683 - DNA, 23 bp, Artificial Sequence
  X-linked inhibitor of apoptosis (XIAP) siRNA
gaggggccccagaggggttttat

SEQ ID NO: 12684 - DNA, 23 bp, Artificial Sequence
  X-linked inhibitor of apoptosis (XIAP) siRNA
aggggccccagaggggttttata

SEQ ID NO: 12685 - DNA, 23 bp, Artificial Sequence
  X-linked inhibitor of apoptosis (XIAP) siRNA
ggggccccagaggggttttatag

SEQ ID NO: 12686 - DNA, 23 bp, Artificial Sequence
  X-linked inhibitor of apoptosis (XIAP) siRNA
gggccccagaggggttttatagg

SEQ ID NO: 12687 - DNA, 23 bp, Artificial Sequence
  X-linked inhibitor of apoptosis (XIAP) siRNA
ggccccagaggggttttataggg

SEQ ID NO: 12688 - DNA, 23 bp, Artificial Sequence
  X-linked inhibitor of apoptosis (XIAP) siRNA
gccccagaggggttttatagggg

SEQ ID NO: 12689 - DNA, 23 bp, Artificial Sequence
  X-linked inhibitor of apoptosis (XIAP) siRNA
ccccagaggggttttataggggc

SEQ ID NO: 12690 - DNA, 23 bp, Artificial Sequence
  X-linked inhibitor of apoptosis (XIAP) siRNA
cccagaggggttttataggggcc

SEQ ID NO: 12691 - DNA, 23 bp, Artificial Sequence
  X-linked inhibitor of apoptosis (XIAP) siRNA
ccagaggggttttataggggcct

SEQ ID NO: 12692 - DNA, 23 bp, Artificial Sequence
  X-linked inhibitor of apoptosis (XIAP) siRNA
cagaggggttttataggggcctt

SEQ ID NO: 12693 - DNA, 23 bp, Artificial Sequence
  X-linked inhibitor of apoptosis (XIAP) siRNA
agaggggttttataggggccttt

SEQ ID NO: 12694 - DNA, 23 bp, Artificial Sequence
  X-linked inhibitor of apoptosis (XIAP) siRNA
gaggggttttataggggcctttt

SEQ ID NO: 12695 - DNA, 23 bp, Artificial Sequence
  X-linked inhibitor of apoptosis (XIAP) siRNA
aggggttttataggggccttttc

SEQ ID NO: 12696 - DNA, 23 bp, Artificial Sequence
  X-linked inhibitor of apoptosis (XIAP) siRNA
ggggttttataggggccttttca

SEQ ID NO: 12697 - DNA, 23 bp, Artificial Sequence
  X-linked inhibitor of apoptosis (XIAP) siRNA
gggttttataggggccttttcac

SEQ ID NO: 12698 - DNA, 23 bp, Artificial Sequence
  X-linked inhibitor of apoptosis (XIAP) siRNA
ggttttataggggccttttcact

SEQ ID NO: 12699 - DNA, 23 bp, Artificial Sequence
  X-linked inhibitor of apoptosis (XIAP) siRNA
gttttataggggccttttcactt

SEQ ID NO: 12700 - DNA, 23 bp, Artificial Sequence
  X-linked inhibitor of apoptosis (XIAP) siRNA
ttttataggggccttttcacttt

SEQ ID NO: 12701 - DNA, 23 bp, Artificial Sequence
  X-linked inhibitor of apoptosis (XIAP) siRNA
tttataggggccttttcactttc

SEQ ID NO: 12702 - DNA, 23 bp, Artificial Sequence
  X-linked inhibitor of apoptosis (XIAP) siRNA
ttataggggccttttcactttct

SEQ ID NO: 12703 - DNA, 23 bp, Artificial Sequence
  X-linked inhibitor of apoptosis (XIAP) siRNA
tataggggccttttcactttcta

SEQ ID NO: 12704 - DNA, 23 bp, Artificial Sequence
  X-linked inhibitor of apoptosis (XIAP) siRNA
ataggggccttttcactttctac

SEQ ID NO: 12705 - DNA, 23 bp, Artificial Sequence
  X-linked inhibitor of apoptosis (XIAP) siRNA
taggggccttttcactttctact

SEQ ID NO: 12706 - DNA, 23 bp, Artificial Sequence
  X-linked inhibitor of apoptosis (XIAP) siRNA
aggggccttttcactttctactt

SEQ ID NO: 12707 - DNA, 23 bp, Artificial Sequence
  X-linked inhibitor of apoptosis (XIAP) siRNA
ggggccttttcactttctacttt

SEQ ID NO: 12708 - DNA, 23 bp, Artificial Sequence
  X-linked inhibitor of apoptosis (XIAP) siRNA
gggccttttcactttctactttt

SEQ ID NO: 12709 - DNA, 23 bp, Artificial Sequence
  X-linked inhibitor of apoptosis (XIAP) siRNA
ggccttttcactttctacttttt

SEQ ID NO: 12710 - DNA, 23 bp, Artificial Sequence
  X-linked inhibitor of apoptosis (XIAP) siRNA
gccttttcactttctactttttt

SEQ ID NO: 12711 - DNA, 23 bp, Artificial Sequence
  X-linked inhibitor of apoptosis (XIAP) siRNA
ccttttcactttctacttttttc

SEQ ID NO: 12712 - DNA, 23 bp, Artificial Sequence
  X-linked inhibitor of apoptosis (XIAP) siRNA
cttttcactttctacttttttca

SEQ ID NO: 12713 - DNA, 23 bp, Artificial Sequence
  X-linked inhibitor of apoptosis (XIAP) siRNA
ttttcactttctacttttttcat

SEQ ID NO: 12714 - DNA, 23 bp, Artificial Sequence
  X-linked inhibitor of apoptosis (XIAP) siRNA
tttcactttctacttttttcatt

SEQ ID NO: 12715 - DNA, 23 bp, Artificial Sequence
  X-linked inhibitor of apoptosis (XIAP) siRNA
ttcactttctacttttttcattt

SEQ ID NO: 12716 - DNA, 23 bp, Artificial Sequence
  X-linked inhibitor of apoptosis (XIAP) siRNA
tcactttctacttttttcatttt

SEQ ID NO: 12717 - DNA, 23 bp, Artificial Sequence
  X-linked inhibitor of apoptosis (XIAP) siRNA
cactttctacttttttcattttg

SEQ ID NO: 12718 - DNA, 23 bp, Artificial Sequence
  X-linked inhibitor of apoptosis (XIAP) siRNA
actttctacttttttcattttgt

SEQ ID NO: 12719 - DNA, 23 bp, Artificial Sequence
  X-linked inhibitor of apoptosis (XIAP) siRNA
ctttctacttttttcattttgtt

SEQ ID NO: 12720 - DNA, 23 bp, Artificial Sequence
  X-linked inhibitor of apoptosis (XIAP) siRNA
tttctacttttttcattttgttc

SEQ ID NO: 12721 - DNA, 23 bp, Artificial Sequence
  X-linked inhibitor of apoptosis (XIAP) siRNA
ttctacttttttcattttgttct

SEQ ID NO: 12722 - DNA, 23 bp, Artificial Sequence
  X-linked inhibitor of apoptosis (XIAP) siRNA
tctacttttttcattttgttctg

SEQ ID NO: 12723 - DNA, 23 bp, Artificial Sequence
  X-linked inhibitor of apoptosis (XIAP) siRNA
ctacttttttcattttgttctgt

SEQ ID NO: 12724 - DNA, 23 bp, Artificial Sequence
  X-linked inhibitor of apoptosis (XIAP) siRNA
tacttttttcattttgttctgtt

SEQ ID NO: 12725 - DNA, 23 bp, Artificial Sequence
  X-linked inhibitor of apoptosis (XIAP) siRNA
acttttttcattttgttctgttc

SEQ ID NO: 12726 - DNA, 23 bp, Artificial Sequence
  X-linked inhibitor of apoptosis (XIAP) siRNA
cttttttcattttgttctgttcg

SEQ ID NO: 12727 - DNA, 23 bp, Artificial Sequence
  X-linked inhibitor of apoptosis (XIAP) siRNA
ttttttcattttgttctgttcga

SEQ ID NO: 12728 - DNA, 23 bp, Artificial Sequence
  X-linked inhibitor of apoptosis (XIAP) siRNA
tttttcattttgttctgttcgaa

SEQ ID NO: 12729 - DNA, 23 bp, Artificial Sequence
  X-linked inhibitor of apoptosis (XIAP) siRNA
ttttcattttgttctgttcgaat

SEQ ID NO: 12730 - DNA, 23 bp, Artificial Sequence
  X-linked inhibitor of apoptosis (XIAP) siRNA
tttcattttgttctgttcgaatt

SEQ ID NO: 12731 - DNA, 23 bp, Artificial Sequence
  X-linked inhibitor of apoptosis (XIAP) siRNA
ttcattttgttctgttcgaattt

SEQ ID NO: 12732 - DNA, 23 bp, Artificial Sequence
  X-linked inhibitor of apoptosis (XIAP) siRNA
tcattttgttctgttcgaatttt

SEQ ID NO: 12733 - DNA, 23 bp, Artificial Sequence
  X-linked inhibitor of apoptosis (XIAP) siRNA
cattttgttctgttcgaattttt

SEQ ID NO: 12734 - DNA, 23 bp, Artificial Sequence
  X-linked inhibitor of apoptosis (XIAP) siRNA
attttgttctgttcgaatttttt

SEQ ID NO: 12735 - DNA, 23 bp, Artificial Sequence
  X-linked inhibitor of apoptosis (XIAP) siRNA
ttttgttctgttcgaatttttta

SEQ ID NO: 12736 - DNA, 23 bp, Artificial Sequence
  X-linked inhibitor of apoptosis (XIAP) siRNA
tttgttctgttcgaattttttat

SEQ ID NO: 12737 - DNA, 23 bp, Artificial Sequence
  X-linked inhibitor of apoptosis (XIAP) siRNA
ttgttctgttcgaattttttata

SEQ ID NO: 12738 - DNA, 23 bp, Artificial Sequence
  X-linked inhibitor of apoptosis (XIAP) siRNA
tgttctgttcgaattttttataa

SEQ ID NO: 12739 - DNA, 23 bp, Artificial Sequence
  X-linked inhibitor of apoptosis (XIAP) siRNA
gttctgttcgaattttttataag

SEQ ID NO: 12740 - DNA, 23 bp, Artificial Sequence
  X-linked inhibitor of apoptosis (XIAP) siRNA
ttctgttcgaattttttataagt

SEQ ID NO: 12741 - DNA, 23 bp, Artificial Sequence
  X-linked inhibitor of apoptosis (XIAP) siRNA
tctgttcgaattttttataagta

SEQ ID NO: 12742 - DNA, 23 bp, Artificial Sequence
  X-linked inhibitor of apoptosis (XIAP) siRNA
ctgttcgaattttttataagtat

SEQ ID NO: 12743 - DNA, 23 bp, Artificial Sequence
  X-linked inhibitor of apoptosis (XIAP) siRNA
tgttcgaattttttataagtatg

SEQ ID NO: 12744 - DNA, 23 bp, Artificial Sequence
  X-linked inhibitor of apoptosis (XIAP) siRNA
gttcgaattttttataagtatgt

SEQ ID NO: 12745 - DNA, 23 bp, Artificial Sequence
  X-linked inhibitor of apoptosis (XIAP) siRNA
ttcgaattttttataagtatgta

SEQ ID NO: 12746 - DNA, 23 bp, Artificial Sequence
  X-linked inhibitor of apoptosis (XIAP) siRNA
tcgaattttttataagtatgtat

SEQ ID NO: 12747 - DNA, 23 bp, Artificial Sequence
  X-linked inhibitor of apoptosis (XIAP) siRNA
cgaattttttataagtatgtatt

SEQ ID NO: 12748 - DNA, 23 bp, Artificial Sequence
  X-linked inhibitor of apoptosis (XIAP) siRNA
gaattttttataagtatgtatta

SEQ ID NO: 12749 - DNA, 23 bp, Artificial Sequence
  X-linked inhibitor of apoptosis (XIAP) siRNA
aattttttataagtatgtattac

SEQ ID NO: 12750 - DNA, 23 bp, Artificial Sequence
  X-linked inhibitor of apoptosis (XIAP) siRNA
attttttataagtatgtattact

SEQ ID NO: 12751 - DNA, 23 bp, Artificial Sequence
  X-linked inhibitor of apoptosis (XIAP) siRNA
ttttttataagtatgtattactt

SEQ ID NO: 12752 - DNA, 23 bp, Artificial Sequence
  X-linked inhibitor of apoptosis (XIAP) siRNA
tttttataagtatgtattacttt

SEQ ID NO: 12753 - DNA, 23 bp, Artificial Sequence
  X-linked inhibitor of apoptosis (XIAP) siRNA
ttttataagtatgtattactttt

SEQ ID NO: 12754 - DNA, 23 bp, Artificial Sequence
  X-linked inhibitor of apoptosis (XIAP) siRNA
tttataagtatgtattacttttg

SEQ ID NO: 12755 - DNA, 23 bp, Artificial Sequence
  X-linked inhibitor of apoptosis (XIAP) siRNA
ttataagtatgtattacttttgt

SEQ ID NO: 12756 - DNA, 23 bp, Artificial Sequence
  X-linked inhibitor of apoptosis (XIAP) siRNA
tataagtatgtattacttttgta

SEQ ID NO: 12757 - DNA, 23 bp, Artificial Sequence
  X-linked inhibitor of apoptosis (XIAP) siRNA
ataagtatgtattacttttgtaa

SEQ ID NO: 12758 - DNA, 23 bp, Artificial Sequence
  X-linked inhibitor of apoptosis (XIAP) siRNA
taagtatgtattacttttgtaat

SEQ ID NO: 12759 - DNA, 23 bp, Artificial Sequence
  X-linked inhibitor of apoptosis (XIAP) siRNA
aagtatgtattacttttgtaatc

SEQ ID NO: 12760 - DNA, 23 bp, Artificial Sequence
  X-linked inhibitor of apoptosis (XIAP) siRNA
agtatgtattacttttgtaatca

SEQ ID NO: 12761 - DNA, 23 bp, Artificial Sequence
  X-linked inhibitor of apoptosis (XIAP) siRNA
gtatgtattacttttgtaatcag

SEQ ID NO: 12762 - DNA, 23 bp, Artificial Sequence
  X-linked inhibitor of apoptosis (XIAP) siRNA
tatgtattacttttgtaatcaga

SEQ ID NO: 12763 - DNA, 23 bp, Artificial Sequence
  X-linked inhibitor of apoptosis (XIAP) siRNA
atgtattacttttgtaatcagaa

SEQ ID NO: 12764 - DNA, 23 bp, Artificial Sequence
  X-linked inhibitor of apoptosis (XIAP) siRNA
tgtattacttttgtaatcagaat

SEQ ID NO: 12765 - DNA, 23 bp, Artificial Sequence
  X-linked inhibitor of apoptosis (XIAP) siRNA
gtattacttttgtaatcagaatt

SEQ ID NO: 12766 - DNA, 23 bp, Artificial Sequence
  X-linked inhibitor of apoptosis (XIAP) siRNA
tattacttttgtaatcagaattt

SEQ ID NO: 12767 - DNA, 23 bp, Artificial Sequence
  X-linked inhibitor of apoptosis (XIAP) siRNA
attacttttgtaatcagaatttt

SEQ ID NO: 12768 - DNA, 23 bp, Artificial Sequence
  X-linked inhibitor of apoptosis (XIAP) siRNA
ttacttttgtaatcagaattttt

SEQ ID NO: 12769 - DNA, 23 bp, Artificial Sequence
  X-linked inhibitor of apoptosis (XIAP) siRNA
tacttttgtaatcagaattttta

SEQ ID NO: 12770 - DNA, 23 bp, Artificial Sequence
  X-linked inhibitor of apoptosis (XIAP) siRNA
acttttgtaatcagaatttttag

SEQ ID NO: 12771 - DNA, 23 bp, Artificial Sequence
  X-linked inhibitor of apoptosis (XIAP) siRNA
cttttgtaatcagaatttttaga

SEQ ID NO: 12772 - DNA, 23 bp, Artificial Sequence
  X-linked inhibitor of apoptosis (XIAP) siRNA
ttttgtaatcagaatttttagaa

SEQ ID NO: 12773 - DNA, 23 bp, Artificial Sequence
  X-linked inhibitor of apoptosis (XIAP) siRNA
tttgtaatcagaatttttagaaa

SEQ ID NO: 12774 - DNA, 23 bp, Artificial Sequence
  X-linked inhibitor of apoptosis (XIAP) siRNA
ttgtaatcagaatttttagaaag

SEQ ID NO: 12775 - DNA, 23 bp, Artificial Sequence
  X-linked inhibitor of apoptosis (XIAP) siRNA
tgtaatcagaatttttagaaagt

SEQ ID NO: 12776 - DNA, 23 bp, Artificial Sequence
  X-linked inhibitor of apoptosis (XIAP) siRNA
gtaatcagaatttttagaaagta

SEQ ID NO: 12777 - DNA, 23 bp, Artificial Sequence
  X-linked inhibitor of apoptosis (XIAP) siRNA
taatcagaatttttagaaagtat

SEQ ID NO: 12778 - DNA, 23 bp, Artificial Sequence
  X-linked inhibitor of apoptosis (XIAP) siRNA
aatcagaatttttagaaagtatt

SEQ ID NO: 12779 - DNA, 23 bp, Artificial Sequence
  X-linked inhibitor of apoptosis (XIAP) siRNA
atcagaatttttagaaagtattt

SEQ ID NO: 12780 - DNA, 23 bp, Artificial Sequence
  X-linked inhibitor of apoptosis (XIAP) siRNA
tcagaatttttagaaagtatttt

SEQ ID NO: 12781 - DNA, 23 bp, Artificial Sequence
  X-linked inhibitor of apoptosis (XIAP) siRNA
cagaatttttagaaagtattttg

SEQ ID NO: 12782 - DNA, 23 bp, Artificial Sequence
  X-linked inhibitor of apoptosis (XIAP) siRNA
agaatttttagaaagtattttgc

SEQ ID NO: 12783 - DNA, 23 bp, Artificial Sequence
  X-linked inhibitor of apoptosis (XIAP) siRNA
gaatttttagaaagtattttgct

SEQ ID NO: 12784 - DNA, 23 bp, Artificial Sequence
  X-linked inhibitor of apoptosis (XIAP) siRNA
aatttttagaaagtattttgctg

SEQ ID NO: 12785 - DNA, 23 bp, Artificial Sequence
  X-linked inhibitor of apoptosis (XIAP) siRNA
atttttagaaagtattttgctga

SEQ ID NO: 12786 - DNA, 23 bp, Artificial Sequence
  X-linked inhibitor of apoptosis (XIAP) siRNA
tttttagaaagtattttgctgat

SEQ ID NO: 12787 - DNA, 23 bp, Artificial Sequence
  X-linked inhibitor of apoptosis (XIAP) siRNA
ttttagaaagtattttgctgatt

SEQ ID NO: 12788 - DNA, 23 bp, Artificial Sequence
  X-linked inhibitor of apoptosis (XIAP) siRNA
tttagaaagtattttgctgattt

SEQ ID NO: 12789 - DNA, 23 bp, Artificial Sequence
  X-linked inhibitor of apoptosis (XIAP) siRNA
ttagaaagtattttgctgattta

SEQ ID NO: 12790 - DNA, 23 bp, Artificial Sequence
  X-linked inhibitor of apoptosis (XIAP) siRNA
tagaaagtattttgctgatttaa

SEQ ID NO: 12791 - DNA, 23 bp, Artificial Sequence
  X-linked inhibitor of apoptosis (XIAP) siRNA
agaaagtattttgctgatttaaa

SEQ ID NO: 12792 - DNA, 23 bp, Artificial Sequence
  X-linked inhibitor of apoptosis (XIAP) siRNA
gaaagtattttgctgatttaaag

SEQ ID NO: 12793 - DNA, 23 bp, Artificial Sequence
  X-linked inhibitor of apoptosis (XIAP) siRNA
aaagtattttgctgatttaaagg

SEQ ID NO: 12794 - DNA, 23 bp, Artificial Sequence
  X-linked inhibitor of apoptosis (XIAP) siRNA
aagtattttgctgatttaaaggc

SEQ ID NO: 12795 - DNA, 23 bp, Artificial Sequence
  X-linked inhibitor of apoptosis (XIAP) siRNA
agtattttgctgatttaaaggct

SEQ ID NO: 12796 - DNA, 23 bp, Artificial Sequence
  X-linked inhibitor of apoptosis (XIAP) siRNA
gtattttgctgatttaaaggctt

SEQ ID NO: 12797 - DNA, 23 bp, Artificial Sequence
  X-linked inhibitor of apoptosis (XIAP) siRNA
tattttgctgatttaaaggctta

SEQ ID NO: 12798 - DNA, 23 bp, Artificial Sequence
  X-linked inhibitor of apoptosis (XIAP) siRNA
attttgctgatttaaaggcttag

SEQ ID NO: 12799 - DNA, 23 bp, Artificial Sequence
  X-linked inhibitor of apoptosis (XIAP) siRNA
ttttgctgatttaaaggcttagg

SEQ ID NO: 12800 - DNA, 23 bp, Artificial Sequence
  X-linked inhibitor of apoptosis (XIAP) siRNA
tttgctgatttaaaggcttaggc

SEQ ID NO: 12801 - DNA, 23 bp, Artificial Sequence
  X-linked inhibitor of apoptosis (XIAP) siRNA
ttgctgatttaaaggcttaggca

SEQ ID NO: 12802 - DNA, 23 bp, Artificial Sequence
  X-linked inhibitor of apoptosis (XIAP) siRNA
tgctgatttaaaggcttaggcat

SEQ ID NO: 12803 - DNA, 23 bp, Artificial Sequence
  X-linked inhibitor of apoptosis (XIAP) siRNA
gctgatttaaaggcttaggcatg

SEQ ID NO: 12804 - DNA, 23 bp, Artificial Sequence
  X-linked inhibitor of apoptosis (XIAP) siRNA
ctgatttaaaggcttaggcatgt

SEQ ID NO: 12805 - DNA, 23 bp, Artificial Sequence
  X-linked inhibitor of apoptosis (XIAP) siRNA
tgatttaaaggcttaggcatgtt

SEQ ID NO: 12806 - DNA, 23 bp, Artificial Sequence
  X-linked inhibitor of apoptosis (XIAP) siRNA
gatttaaaggcttaggcatgttc

SEQ ID NO: 12807 - DNA, 23 bp, Artificial Sequence
  X-linked inhibitor of apoptosis (XIAP) siRNA
atttaaaggcttaggcatgttca

SEQ ID NO: 12808 - DNA, 23 bp, Artificial Sequence
  X-linked inhibitor of apoptosis (XIAP) siRNA
tttaaaggcttaggcatgttcaa

SEQ ID NO: 12809 - DNA, 23 bp, Artificial Sequence
  X-linked inhibitor of apoptosis (XIAP) siRNA
ttaaaggcttaggcatgttcaaa

SEQ ID NO: 12810 - DNA, 23 bp, Artificial Sequence
  X-linked inhibitor of apoptosis (XIAP) siRNA
taaaggcttaggcatgttcaaac

SEQ ID NO: 12811 - DNA, 23 bp, Artificial Sequence
  X-linked inhibitor of apoptosis (XIAP) siRNA
aaaggcttaggcatgttcaaacg

SEQ ID NO: 12812 - DNA, 23 bp, Artificial Sequence
  X-linked inhibitor of apoptosis (XIAP) siRNA
aaggcttaggcatgttcaaacgc

SEQ ID NO: 12813 - DNA, 23 bp, Artificial Sequence
  X-linked inhibitor of apoptosis (XIAP) siRNA
aggcttaggcatgttcaaacgcc

SEQ ID NO: 12814 - DNA, 23 bp, Artificial Sequence
  X-linked inhibitor of apoptosis (XIAP) siRNA
ggcttaggcatgttcaaacgcct

SEQ ID NO: 12815 - DNA, 23 bp, Artificial Sequence
  X-linked inhibitor of apoptosis (XIAP) siRNA
gcttaggcatgttcaaacgcctg

SEQ ID NO: 12816 - DNA, 23 bp, Artificial Sequence
  X-linked inhibitor of apoptosis (XIAP) siRNA
cttaggcatgttcaaacgcctgc

SEQ ID NO: 12817 - DNA, 23 bp, Artificial Sequence
  X-linked inhibitor of apoptosis (XIAP) siRNA
ttaggcatgttcaaacgcctgca

SEQ ID NO: 12818 - DNA, 23 bp, Artificial Sequence
  X-linked inhibitor of apoptosis (XIAP) siRNA
taggcatgttcaaacgcctgcaa

SEQ ID NO: 12819 - DNA, 23 bp, Artificial Sequence
  X-linked inhibitor of apoptosis (XIAP) siRNA
aggcatgttcaaacgcctgcaaa

SEQ ID NO: 12820 - DNA, 23 bp, Artificial Sequence
  X-linked inhibitor of apoptosis (XIAP) siRNA
ggcatgttcaaacgcctgcaaaa

SEQ ID NO: 12821 - DNA, 23 bp, Artificial Sequence
  X-linked inhibitor of apoptosis (XIAP) siRNA
gcatgttcaaacgcctgcaaaac

SEQ ID NO: 12822 - DNA, 23 bp, Artificial Sequence
  X-linked inhibitor of apoptosis (XIAP) siRNA
catgttcaaacgcctgcaaaact

SEQ ID NO: 12823 - DNA, 23 bp, Artificial Sequence
  X-linked inhibitor of apoptosis (XIAP) siRNA
atgttcaaacgcctgcaaaacta

SEQ ID NO: 12824 - DNA, 23 bp, Artificial Sequence
  X-linked inhibitor of apoptosis (XIAP) siRNA
tgttcaaacgcctgcaaaactac

SEQ ID NO: 12825 - DNA, 23 bp, Artificial Sequence
  X-linked inhibitor of apoptosis (XIAP) siRNA
gttcaaacgcctgcaaaactact

SEQ ID NO: 12826 - DNA, 23 bp, Artificial Sequence
  X-linked inhibitor of apoptosis (XIAP) siRNA
ttcaaacgcctgcaaaactactt

SEQ ID NO: 12827 - DNA, 23 bp, Artificial Sequence
  X-linked inhibitor of apoptosis (XIAP) siRNA
tcaaacgcctgcaaaactactta

SEQ ID NO: 12828 - DNA, 23 bp, Artificial Sequence
  X-linked inhibitor of apoptosis (XIAP) siRNA
caaacgcctgcaaaactacttat

SEQ ID NO: 12829 - DNA, 23 bp, Artificial Sequence
  X-linked inhibitor of apoptosis (XIAP) siRNA
aaacgcctgcaaaactacttatc

SEQ ID NO: 12830 - DNA, 23 bp, Artificial Sequence
  X-linked inhibitor of apoptosis (XIAP) siRNA
aacgcctgcaaaactacttatca

SEQ ID NO: 12831 - DNA, 23 bp, Artificial Sequence
  X-linked inhibitor of apoptosis (XIAP) siRNA
acgcctgcaaaactacttatcac

SEQ ID NO: 12832 - DNA, 23 bp, Artificial Sequence
  X-linked inhibitor of apoptosis (XIAP) siRNA
cgcctgcaaaactacttatcact

SEQ ID NO: 12833 - DNA, 23 bp, Artificial Sequence
  X-linked inhibitor of apoptosis (XIAP) siRNA
gcctgcaaaactacttatcactc

SEQ ID NO: 12834 - DNA, 23 bp, Artificial Sequence
  X-linked inhibitor of apoptosis (XIAP) siRNA
cctgcaaaactacttatcactca

SEQ ID NO: 12835 - DNA, 23 bp, Artificial Sequence
  X-linked inhibitor of apoptosis (XIAP) siRNA
ctgcaaaactacttatcactcag

SEQ ID NO: 12836 - DNA, 23 bp, Artificial Sequence
  X-linked inhibitor of apoptosis (XIAP) siRNA
tgcaaaactacttatcactcagc

SEQ ID NO: 12837 - DNA, 23 bp, Artificial Sequence
  X-linked inhibitor of apoptosis (XIAP) siRNA
gcaaaactacttatcactcagct

SEQ ID NO: 12838 - DNA, 23 bp, Artificial Sequence
  X-linked inhibitor of apoptosis (XIAP) siRNA
caaaactacttatcactcagctt

SEQ ID NO: 12839 - DNA, 23 bp, Artificial Sequence
  X-linked inhibitor of apoptosis (XIAP) siRNA
aaaactacttatcactcagcttt

SEQ ID NO: 12840 - DNA, 23 bp, Artificial Sequence
  X-linked inhibitor of apoptosis (XIAP) siRNA
aaactacttatcactcagcttta

SEQ ID NO: 12841 - DNA, 23 bp, Artificial Sequence
  X-linked inhibitor of apoptosis (XIAP) siRNA
aactacttatcactcagctttag

SEQ ID NO: 12842 - DNA, 23 bp, Artificial Sequence
  X-linked inhibitor of apoptosis (XIAP) siRNA
actacttatcactcagctttagt

SEQ ID NO: 12843 - DNA, 23 bp, Artificial Sequence
  X-linked inhibitor of apoptosis (XIAP) siRNA
ctacttatcactcagctttagtt

SEQ ID NO: 12844 - DNA, 23 bp, Artificial Sequence
  X-linked inhibitor of apoptosis (XIAP) siRNA
tacttatcactcagctttagttt

SEQ ID NO: 12845 - DNA, 23 bp, Artificial Sequence
  X-linked inhibitor of apoptosis (XIAP) siRNA
acttatcactcagctttagtttt

SEQ ID NO: 12846 - DNA, 23 bp, Artificial Sequence
  X-linked inhibitor of apoptosis (XIAP) siRNA
cttatcactcagctttagttttt

SEQ ID NO: 12847 - DNA, 23 bp, Artificial Sequence
  X-linked inhibitor of apoptosis (XIAP) siRNA
ttatcactcagctttagtttttc

SEQ ID NO: 12848 - DNA, 23 bp, Artificial Sequence
  X-linked inhibitor of apoptosis (XIAP) siRNA
tatcactcagctttagtttttct

SEQ ID NO: 12849 - DNA, 23 bp, Artificial Sequence
  X-linked inhibitor of apoptosis (XIAP) siRNA
atcactcagctttagtttttcta

SEQ ID NO: 12850 - DNA, 23 bp, Artificial Sequence
  X-linked inhibitor of apoptosis (XIAP) siRNA
tcactcagctttagtttttctaa

SEQ ID NO: 12851 - DNA, 23 bp, Artificial Sequence
  X-linked inhibitor of apoptosis (XIAP) siRNA
cactcagctttagtttttctaat

SEQ ID NO: 12852 - DNA, 23 bp, Artificial Sequence
  X-linked inhibitor of apoptosis (XIAP) siRNA
actcagctttagtttttctaatc

SEQ ID NO: 12853 - DNA, 23 bp, Artificial Sequence
  X-linked inhibitor of apoptosis (XIAP) siRNA
ctcagctttagtttttctaatcc

SEQ ID NO: 12854 - DNA, 23 bp, Artificial Sequence
  X-linked inhibitor of apoptosis (XIAP) siRNA
tcagctttagtttttctaatcca

SEQ ID NO: 12855 - DNA, 23 bp, Artificial Sequence
  X-linked inhibitor of apoptosis (XIAP) siRNA
cagctttagtttttctaatccaa

SEQ ID NO: 12856 - DNA, 23 bp, Artificial Sequence
  X-linked inhibitor of apoptosis (XIAP) siRNA
agctttagtttttctaatccaag

SEQ ID NO: 12857 - DNA, 23 bp, Artificial Sequence
  X-linked inhibitor of apoptosis (XIAP) siRNA
gctttagtttttctaatccaaga

SEQ ID NO: 12858 - DNA, 23 bp, Artificial Sequence
  X-linked inhibitor of apoptosis (XIAP) siRNA
ctttagtttttctaatccaagaa

SEQ ID NO: 12859 - DNA, 23 bp, Artificial Sequence
  X-linked inhibitor of apoptosis (XIAP) siRNA
tttagtttttctaatccaagaag

SEQ ID NO: 12860 - DNA, 23 bp, Artificial Sequence
  X-linked inhibitor of apoptosis (XIAP) siRNA
ttagtttttctaatccaagaagg

SEQ ID NO: 12861 - DNA, 23 bp, Artificial Sequence
  X-linked inhibitor of apoptosis (XIAP) siRNA
tagtttttctaatccaagaaggc

SEQ ID NO: 12862 - DNA, 23 bp, Artificial Sequence
  X-linked inhibitor of apoptosis (XIAP) siRNA
agtttttctaatccaagaaggca

SEQ ID NO: 12863 - DNA, 23 bp, Artificial Sequence
  X-linked inhibitor of apoptosis (XIAP) siRNA
gtttttctaatccaagaaggcag

SEQ ID NO: 12864 - DNA, 23 bp, Artificial Sequence
  X-linked inhibitor of apoptosis (XIAP) siRNA
tttttctaatccaagaaggcagg

SEQ ID NO: 12865 - DNA, 23 bp, Artificial Sequence
  X-linked inhibitor of apoptosis (XIAP) siRNA
ttttctaatccaagaaggcaggg

SEQ ID NO: 12866 - DNA, 23 bp, Artificial Sequence
  X-linked inhibitor of apoptosis (XIAP) siRNA
tttctaatccaagaaggcagggc

SEQ ID NO: 12867 - DNA, 23 bp, Artificial Sequence
  X-linked inhibitor of apoptosis (XIAP) siRNA
ttctaatccaagaaggcagggca

SEQ ID NO: 12868 - DNA, 23 bp, Artificial Sequence
  X-linked inhibitor of apoptosis (XIAP) siRNA
tctaatccaagaaggcagggcag

SEQ ID NO: 12869 - DNA, 23 bp, Artificial Sequence
  X-linked inhibitor of apoptosis (XIAP) siRNA
ctaatccaagaaggcagggcagt

SEQ ID NO: 12870 - DNA, 23 bp, Artificial Sequence
  X-linked inhibitor of apoptosis (XIAP) siRNA
taatccaagaaggcagggcagtt

SEQ ID NO: 12871 - DNA, 23 bp, Artificial Sequence
  X-linked inhibitor of apoptosis (XIAP) siRNA
aatccaagaaggcagggcagtta

SEQ ID NO: 12872 - DNA, 23 bp, Artificial Sequence
  X-linked inhibitor of apoptosis (XIAP) siRNA
atccaagaaggcagggcagttaa

SEQ ID NO: 12873 - DNA, 23 bp, Artificial Sequence
  X-linked inhibitor of apoptosis (XIAP) siRNA
tccaagaaggcagggcagttaac

SEQ ID NO: 12874 - DNA, 23 bp, Artificial Sequence
  X-linked inhibitor of apoptosis (XIAP) siRNA
ccaagaaggcagggcagttaacc

SEQ ID NO: 12875 - DNA, 23 bp, Artificial Sequence
  X-linked inhibitor of apoptosis (XIAP) siRNA
caagaaggcagggcagttaacct

SEQ ID NO: 12876 - DNA, 23 bp, Artificial Sequence
  X-linked inhibitor of apoptosis (XIAP) siRNA
aagaaggcagggcagttaacctt

SEQ ID NO: 12877 - DNA, 23 bp, Artificial Sequence
  X-linked inhibitor of apoptosis (XIAP) siRNA
agaaggcagggcagttaaccttt

SEQ ID NO: 12878 - DNA, 23 bp, Artificial Sequence
  X-linked inhibitor of apoptosis (XIAP) siRNA
gaaggcagggcagttaacctttt

SEQ ID NO: 12879 - DNA, 23 bp, Artificial Sequence
  X-linked inhibitor of apoptosis (XIAP) siRNA
aaggcagggcagttaaccttttt

SEQ ID NO: 12880 - DNA, 23 bp, Artificial Sequence
  X-linked inhibitor of apoptosis (XIAP) siRNA
aggcagggcagttaacctttttg

SEQ ID NO: 12881 - DNA, 23 bp, Artificial Sequence
  X-linked inhibitor of apoptosis (XIAP) siRNA
ggcagggcagttaacctttttgg

SEQ ID NO: 12882 - DNA, 23 bp, Artificial Sequence
  X-linked inhibitor of apoptosis (XIAP) siRNA
gcagggcagttaacctttttggt

SEQ ID NO: 12883 - DNA, 23 bp, Artificial Sequence
  X-linked inhibitor of apoptosis (XIAP) siRNA
cagggcagttaacctttttggtg

SEQ ID NO: 12884 - DNA, 23 bp, Artificial Sequence
  X-linked inhibitor of apoptosis (XIAP) siRNA
agggcagttaacctttttggtgc

SEQ ID NO: 12885 - DNA, 23 bp, Artificial Sequence
  X-linked inhibitor of apoptosis (XIAP) siRNA
gggcagttaacctttttggtgcc

SEQ ID NO: 12886 - DNA, 23 bp, Artificial Sequence
  X-linked inhibitor of apoptosis (XIAP) siRNA
ggcagttaacctttttggtgcca

SEQ ID NO: 12887 - DNA, 23 bp, Artificial Sequence
  X-linked inhibitor of apoptosis (XIAP) siRNA
gcagttaacctttttggtgccaa

SEQ ID NO: 12888 - DNA, 23 bp, Artificial Sequence
  X-linked inhibitor of apoptosis (XIAP) siRNA
cagttaacctttttggtgccaat

SEQ ID NO: 12889 - DNA, 23 bp, Artificial Sequence
  X-linked inhibitor of apoptosis (XIAP) siRNA
agttaacctttttggtgccaatg

SEQ ID NO: 12890 - DNA, 23 bp, Artificial Sequence
  X-linked inhibitor of apoptosis (XIAP) siRNA
gttaacctttttggtgccaatgt

SEQ ID NO: 12891 - DNA, 23 bp, Artificial Sequence
  X-linked inhibitor of apoptosis (XIAP) siRNA
ttaacctttttggtgccaatgtg

SEQ ID NO: 12892 - DNA, 23 bp, Artificial Sequence
  X-linked inhibitor of apoptosis (XIAP) siRNA
taacctttttggtgccaatgtga

SEQ ID NO: 12893 - DNA, 23 bp, Artificial Sequence
  X-linked inhibitor of apoptosis (XIAP) siRNA
aacctttttggtgccaatgtgaa

SEQ ID NO: 12894 - DNA, 23 bp, Artificial Sequence
  X-linked inhibitor of apoptosis (XIAP) siRNA
acctttttggtgccaatgtgaaa

SEQ ID NO: 12895 - DNA, 23 bp, Artificial Sequence
  X-linked inhibitor of apoptosis (XIAP) siRNA
cctttttggtgccaatgtgaaat

SEQ ID NO: 12896 - DNA, 23 bp, Artificial Sequence
  X-linked inhibitor of apoptosis (XIAP) siRNA
ctttttggtgccaatgtgaaatg

SEQ ID NO: 12897 - DNA, 23 bp, Artificial Sequence
  X-linked inhibitor of apoptosis (XIAP) siRNA
tttttggtgccaatgtgaaatgt

SEQ ID NO: 12898 - DNA, 23 bp, Artificial Sequence
  X-linked inhibitor of apoptosis (XIAP) siRNA
ttttggtgccaatgtgaaatgta

SEQ ID NO: 12899 - DNA, 23 bp, Artificial Sequence
  X-linked inhibitor of apoptosis (XIAP) siRNA
tttggtgccaatgtgaaatgtaa

SEQ ID NO: 12900 - DNA, 23 bp, Artificial Sequence
  X-linked inhibitor of apoptosis (XIAP) siRNA
ttggtgccaatgtgaaatgtaaa

SEQ ID NO: 12901 - DNA, 23 bp, Artificial Sequence
  X-linked inhibitor of apoptosis (XIAP) siRNA
tggtgccaatgtgaaatgtaaat

SEQ ID NO: 12902 - DNA, 23 bp, Artificial Sequence
  X-linked inhibitor of apoptosis (XIAP) siRNA
ggtgccaatgtgaaatgtaaatg

SEQ ID NO: 12903 - DNA, 23 bp, Artificial Sequence
  X-linked inhibitor of apoptosis (XIAP) siRNA
gtgccaatgtgaaatgtaaatga

SEQ ID NO: 12904 - DNA, 23 bp, Artificial Sequence
  X-linked inhibitor of apoptosis (XIAP) siRNA
tgccaatgtgaaatgtaaatgat

SEQ ID NO: 12905 - DNA, 23 bp, Artificial Sequence
  X-linked inhibitor of apoptosis (XIAP) siRNA
gccaatgtgaaatgtaaatgatt

SEQ ID NO: 12906 - DNA, 23 bp, Artificial Sequence
  X-linked inhibitor of apoptosis (XIAP) siRNA
ccaatgtgaaatgtaaatgattt

SEQ ID NO: 12907 - DNA, 23 bp, Artificial Sequence
  X-linked inhibitor of apoptosis (XIAP) siRNA
caatgtgaaatgtaaatgatttt

SEQ ID NO: 12908 - DNA, 23 bp, Artificial Sequence
  X-linked inhibitor of apoptosis (XIAP) siRNA
aatgtgaaatgtaaatgatttta

SEQ ID NO: 12909 - DNA, 23 bp, Artificial Sequence
  X-linked inhibitor of apoptosis (XIAP) siRNA
atgtgaaatgtaaatgattttat

SEQ ID NO: 12910 - DNA, 23 bp, Artificial Sequence
  X-linked inhibitor of apoptosis (XIAP) siRNA
tgtgaaatgtaaatgattttatg

SEQ ID NO: 12911 - DNA, 23 bp, Artificial Sequence
  X-linked inhibitor of apoptosis (XIAP) siRNA
gtgaaatgtaaatgattttatgt

SEQ ID NO: 12912 - DNA, 23 bp, Artificial Sequence
  X-linked inhibitor of apoptosis (XIAP) siRNA
tgaaatgtaaatgattttatgtt

SEQ ID NO: 12913 - DNA, 23 bp, Artificial Sequence
  X-linked inhibitor of apoptosis (XIAP) siRNA
gaaatgtaaatgattttatgttt

SEQ ID NO: 12914 - DNA, 23 bp, Artificial Sequence
  X-linked inhibitor of apoptosis (XIAP) siRNA
aaatgtaaatgattttatgtttt

SEQ ID NO: 12915 - DNA, 23 bp, Artificial Sequence
  X-linked inhibitor of apoptosis (XIAP) siRNA
aatgtaaatgattttatgttttt

SEQ ID NO: 12916 - DNA, 23 bp, Artificial Sequence
  X-linked inhibitor of apoptosis (XIAP) siRNA
atgtaaatgattttatgtttttc

SEQ ID NO: 12917 - DNA, 23 bp, Artificial Sequence
  X-linked inhibitor of apoptosis (XIAP) siRNA
tgtaaatgattttatgtttttcc

SEQ ID NO: 12918 - DNA, 23 bp, Artificial Sequence
  X-linked inhibitor of apoptosis (XIAP) siRNA
gtaaatgattttatgtttttcct

SEQ ID NO: 12919 - DNA, 23 bp, Artificial Sequence
  X-linked inhibitor of apoptosis (XIAP) siRNA
taaatgattttatgtttttcctg

SEQ ID NO: 12920 - DNA, 23 bp, Artificial Sequence
  X-linked inhibitor of apoptosis (XIAP) siRNA
aaatgattttatgtttttcctgc

SEQ ID NO: 12921 - DNA, 23 bp, Artificial Sequence
  X-linked inhibitor of apoptosis (XIAP) siRNA
aatgattttatgtttttcctgct

SEQ ID NO: 12922 - DNA, 23 bp, Artificial Sequence
  X-linked inhibitor of apoptosis (XIAP) siRNA
atgattttatgtttttcctgctt

SEQ ID NO: 12923 - DNA, 23 bp, Artificial Sequence
  X-linked inhibitor of apoptosis (XIAP) siRNA
tgattttatgtttttcctgcttt

SEQ ID NO: 12924 - DNA, 23 bp, Artificial Sequence
  X-linked inhibitor of apoptosis (XIAP) siRNA
gattttatgtttttcctgctttg

SEQ ID NO: 12925 - DNA, 23 bp, Artificial Sequence
  X-linked inhibitor of apoptosis (XIAP) siRNA
attttatgtttttcctgctttgt

SEQ ID NO: 12926 - DNA, 23 bp, Artificial Sequence
  X-linked inhibitor of apoptosis (XIAP) siRNA
ttttatgtttttcctgctttgtg

SEQ ID NO: 12927 - DNA, 23 bp, Artificial Sequence
  X-linked inhibitor of apoptosis (XIAP) siRNA
tttatgtttttcctgctttgtgg

SEQ ID NO: 12928 - DNA, 23 bp, Artificial Sequence
  X-linked inhibitor of apoptosis (XIAP) siRNA
ttatgtttttcctgctttgtgga

SEQ ID NO: 12929 - DNA, 23 bp, Artificial Sequence
  X-linked inhibitor of apoptosis (XIAP) siRNA
tatgtttttcctgctttgtggat

SEQ ID NO: 12930 - DNA, 23 bp, Artificial Sequence
  X-linked inhibitor of apoptosis (XIAP) siRNA
atgtttttcctgctttgtggatg

SEQ ID NO: 12931 - DNA, 23 bp, Artificial Sequence
  X-linked inhibitor of apoptosis (XIAP) siRNA
tgtttttcctgctttgtggatga

SEQ ID NO: 12932 - DNA, 23 bp, Artificial Sequence
  X-linked inhibitor of apoptosis (XIAP) siRNA
gtttttcctgctttgtggatgaa

SEQ ID NO: 12933 - DNA, 23 bp, Artificial Sequence
  X-linked inhibitor of apoptosis (XIAP) siRNA
tttttcctgctttgtggatgaaa

SEQ ID NO: 12934 - DNA, 23 bp, Artificial Sequence
  X-linked inhibitor of apoptosis (XIAP) siRNA
ttttcctgctttgtggatgaaaa

SEQ ID NO: 12935 - DNA, 23 bp, Artificial Sequence
  X-linked inhibitor of apoptosis (XIAP) siRNA
tttcctgctttgtggatgaaaaa

SEQ ID NO: 12936 - DNA, 23 bp, Artificial Sequence
  X-linked inhibitor of apoptosis (XIAP) siRNA
ttcctgctttgtggatgaaaaat

SEQ ID NO: 12937 - DNA, 23 bp, Artificial Sequence
  X-linked inhibitor of apoptosis (XIAP) siRNA
tcctgctttgtggatgaaaaata

SEQ ID NO: 12938 - DNA, 23 bp, Artificial Sequence
  X-linked inhibitor of apoptosis (XIAP) siRNA
cctgctttgtggatgaaaaatat

SEQ ID NO: 12939 - DNA, 23 bp, Artificial Sequence
  X-linked inhibitor of apoptosis (XIAP) siRNA
ctgctttgtggatgaaaaatatt

SEQ ID NO: 12940 - DNA, 23 bp, Artificial Sequence
  X-linked inhibitor of apoptosis (XIAP) siRNA
tgctttgtggatgaaaaatattt

SEQ ID NO: 12941 - DNA, 23 bp, Artificial Sequence
  X-linked inhibitor of apoptosis (XIAP) siRNA
gctttgtggatgaaaaatatttc

SEQ ID NO: 12942 - DNA, 23 bp, Artificial Sequence
  X-linked inhibitor of apoptosis (XIAP) siRNA
ctttgtggatgaaaaatatttct

SEQ ID NO: 12943 - DNA, 23 bp, Artificial Sequence
  X-linked inhibitor of apoptosis (XIAP) siRNA
tttgtggatgaaaaatatttctg

SEQ ID NO: 12944 - DNA, 23 bp, Artificial Sequence
  X-linked inhibitor of apoptosis (XIAP) siRNA
ttgtggatgaaaaatatttctga

SEQ ID NO: 12945 - DNA, 23 bp, Artificial Sequence
  X-linked inhibitor of apoptosis (XIAP) siRNA
tgtggatgaaaaatatttctgag

SEQ ID NO: 12946 - DNA, 23 bp, Artificial Sequence
  X-linked inhibitor of apoptosis (XIAP) siRNA
gtggatgaaaaatatttctgagt

SEQ ID NO: 12947 - DNA, 23 bp, Artificial Sequence
  X-linked inhibitor of apoptosis (XIAP) siRNA
tggatgaaaaatatttctgagtg

SEQ ID NO: 12948 - DNA, 23 bp, Artificial Sequence
  X-linked inhibitor of apoptosis (XIAP) siRNA
ggatgaaaaatatttctgagtgg

SEQ ID NO: 12949 - DNA, 23 bp, Artificial Sequence
  X-linked inhibitor of apoptosis (XIAP) siRNA
gatgaaaaatatttctgagtggt

SEQ ID NO: 12950 - DNA, 23 bp, Artificial Sequence
  X-linked inhibitor of apoptosis (XIAP) siRNA
atgaaaaatatttctgagtggta

SEQ ID NO: 12951 - DNA, 23 bp, Artificial Sequence
  X-linked inhibitor of apoptosis (XIAP) siRNA
tgaaaaatatttctgagtggtag

SEQ ID NO: 12952 - DNA, 23 bp, Artificial Sequence
  X-linked inhibitor of apoptosis (XIAP) siRNA
gaaaaatatttctgagtggtagt

SEQ ID NO: 12953 - DNA, 23 bp, Artificial Sequence
  X-linked inhibitor of apoptosis (XIAP) siRNA
aaaaatatttctgagtggtagtt

SEQ ID NO: 12954 - DNA, 23 bp, Artificial Sequence
  X-linked inhibitor of apoptosis (XIAP) siRNA
aaaatatttctgagtggtagttt

SEQ ID NO: 12955 - DNA, 23 bp, Artificial Sequence
  X-linked inhibitor of apoptosis (XIAP) siRNA
aaatatttctgagtggtagtttt

SEQ ID NO: 12956 - DNA, 23 bp, Artificial Sequence
  X-linked inhibitor of apoptosis (XIAP) siRNA
aatatttctgagtggtagttttt

SEQ ID NO: 12957 - DNA, 23 bp, Artificial Sequence
  X-linked inhibitor of apoptosis (XIAP) siRNA
atatttctgagtggtagtttttt

SEQ ID NO: 12958 - DNA, 23 bp, Artificial Sequence
  X-linked inhibitor of apoptosis (XIAP) siRNA
tatttctgagtggtagttttttg

SEQ ID NO: 12959 - DNA, 23 bp, Artificial Sequence
  X-linked inhibitor of apoptosis (XIAP) siRNA
atttctgagtggtagttttttga

SEQ ID NO: 12960 - DNA, 23 bp, Artificial Sequence
  X-linked inhibitor of apoptosis (XIAP) siRNA
tttctgagtggtagttttttgac

SEQ ID NO: 12961 - DNA, 23 bp, Artificial Sequence
  X-linked inhibitor of apoptosis (XIAP) siRNA
ttctgagtggtagttttttgaca

SEQ ID NO: 12962 - DNA, 23 bp, Artificial Sequence
  X-linked inhibitor of apoptosis (XIAP) siRNA
tctgagtggtagttttttgacag

SEQ ID NO: 12963 - DNA, 23 bp, Artificial Sequence
  X-linked inhibitor of apoptosis (XIAP) siRNA
ctgagtggtagttttttgacagg

SEQ ID NO: 12964 - DNA, 23 bp, Artificial Sequence
  X-linked inhibitor of apoptosis (XIAP) siRNA
tgagtggtagttttttgacaggt

SEQ ID NO: 12965 - DNA, 23 bp, Artificial Sequence
  X-linked inhibitor of apoptosis (XIAP) siRNA
gagtggtagttttttgacaggta

SEQ ID NO: 12966 - DNA, 23 bp, Artificial Sequence
  X-linked inhibitor of apoptosis (XIAP) siRNA
agtggtagttttttgacaggtag

SEQ ID NO: 12967 - DNA, 23 bp, Artificial Sequence
  X-linked inhibitor of apoptosis (XIAP) siRNA
gtggtagttttttgacaggtaga

SEQ ID NO: 12968 - DNA, 23 bp, Artificial Sequence
  X-linked inhibitor of apoptosis (XIAP) siRNA
tggtagttttttgacaggtagac

SEQ ID NO: 12969 - DNA, 23 bp, Artificial Sequence
  X-linked inhibitor of apoptosis (XIAP) siRNA
ggtagttttttgacaggtagacc

SEQ ID NO: 12970 - DNA, 23 bp, Artificial Sequence
  X-linked inhibitor of apoptosis (XIAP) siRNA
gtagttttttgacaggtagacca

SEQ ID NO: 12971 - DNA, 23 bp, Artificial Sequence
  X-linked inhibitor of apoptosis (XIAP) siRNA
tagttttttgacaggtagaccat

SEQ ID NO: 12972 - DNA, 23 bp, Artificial Sequence
  X-linked inhibitor of apoptosis (XIAP) siRNA
agttttttgacaggtagaccatg

SEQ ID NO: 12973 - DNA, 23 bp, Artificial Sequence
  X-linked inhibitor of apoptosis (XIAP) siRNA
gttttttgacaggtagaccatgt

SEQ ID NO: 12974 - DNA, 23 bp, Artificial Sequence
  X-linked inhibitor of apoptosis (XIAP) siRNA
ttttttgacaggtagaccatgtc

SEQ ID NO: 12975 - DNA, 23 bp, Artificial Sequence
  X-linked inhibitor of apoptosis (XIAP) siRNA
tttttgacaggtagaccatgtct

SEQ ID NO: 12976 - DNA, 23 bp, Artificial Sequence
  X-linked inhibitor of apoptosis (XIAP) siRNA
ttttgacaggtagaccatgtctt

SEQ ID NO: 12977 - DNA, 23 bp, Artificial Sequence
  X-linked inhibitor of apoptosis (XIAP) siRNA
tttgacaggtagaccatgtctta

SEQ ID NO: 12978 - DNA, 23 bp, Artificial Sequence
  X-linked inhibitor of apoptosis (XIAP) siRNA
ttgacaggtagaccatgtcttat

SEQ ID NO: 12979 - DNA, 23 bp, Artificial Sequence
  X-linked inhibitor of apoptosis (XIAP) siRNA
tgacaggtagaccatgtcttatc

SEQ ID NO: 12980 - DNA, 23 bp, Artificial Sequence
  X-linked inhibitor of apoptosis (XIAP) siRNA
gacaggtagaccatgtcttatct

SEQ ID NO: 12981 - DNA, 23 bp, Artificial Sequence
  X-linked inhibitor of apoptosis (XIAP) siRNA
acaggtagaccatgtcttatctt

SEQ ID NO: 12982 - DNA, 23 bp, Artificial Sequence
  X-linked inhibitor of apoptosis (XIAP) siRNA
caggtagaccatgtcttatcttg

SEQ ID NO: 12983 - DNA, 23 bp, Artificial Sequence
  X-linked inhibitor of apoptosis (XIAP) siRNA
aggtagaccatgtcttatcttgt

SEQ ID NO: 12984 - DNA, 23 bp, Artificial Sequence
  X-linked inhibitor of apoptosis (XIAP) siRNA
ggtagaccatgtcttatcttgtt

SEQ ID NO: 12985 - DNA, 23 bp, Artificial Sequence
  X-linked inhibitor of apoptosis (XIAP) siRNA
gtagaccatgtcttatcttgttt

SEQ ID NO: 12986 - DNA, 23 bp, Artificial Sequence
  X-linked inhibitor of apoptosis (XIAP) siRNA
tagaccatgtcttatcttgtttc

SEQ ID NO: 12987 - DNA, 23 bp, Artificial Sequence
  X-linked inhibitor of apoptosis (XIAP) siRNA
agaccatgtcttatcttgtttca

SEQ ID NO: 12988 - DNA, 23 bp, Artificial Sequence
  X-linked inhibitor of apoptosis (XIAP) siRNA
gaccatgtcttatcttgtttcaa

SEQ ID NO: 12989 - DNA, 23 bp, Artificial Sequence
  X-linked inhibitor of apoptosis (XIAP) siRNA
accatgtcttatcttgtttcaaa

SEQ ID NO: 12990 - DNA, 23 bp, Artificial Sequence
  X-linked inhibitor of apoptosis (XIAP) siRNA
ccatgtcttatcttgtttcaaaa

SEQ ID NO: 12991 - DNA, 23 bp, Artificial Sequence
  X-linked inhibitor of apoptosis (XIAP) siRNA
catgtcttatcttgtttcaaaat

SEQ ID NO: 12992 - DNA, 23 bp, Artificial Sequence
  X-linked inhibitor of apoptosis (XIAP) siRNA
atgtcttatcttgtttcaaaata

SEQ ID NO: 12993 - DNA, 23 bp, Artificial Sequence
  X-linked inhibitor of apoptosis (XIAP) siRNA
tgtcttatcttgtttcaaaataa

SEQ ID NO: 12994 - DNA, 23 bp, Artificial Sequence
  X-linked inhibitor of apoptosis (XIAP) siRNA
gtcttatcttgtttcaaaataag

SEQ ID NO: 12995 - DNA, 23 bp, Artificial Sequence
  X-linked inhibitor of apoptosis (XIAP) siRNA
tcttatcttgtttcaaaataagt

SEQ ID NO: 12996 - DNA, 23 bp, Artificial Sequence
  X-linked inhibitor of apoptosis (XIAP) siRNA
cttatcttgtttcaaaataagta

SEQ ID NO: 12997 - DNA, 23 bp, Artificial Sequence
  X-linked inhibitor of apoptosis (XIAP) siRNA
ttatcttgtttcaaaataagtat

SEQ ID NO: 12998 - DNA, 23 bp, Artificial Sequence
  X-linked inhibitor of apoptosis (XIAP) siRNA
tatcttgtttcaaaataagtatt

SEQ ID NO: 12999 - DNA, 23 bp, Artificial Sequence
  X-linked inhibitor of apoptosis (XIAP) siRNA
atcttgtttcaaaataagtattt

SEQ ID NO: 13000 - DNA, 23 bp, Artificial Sequence
  X-linked inhibitor of apoptosis (XIAP) siRNA
tcttgtttcaaaataagtatttc

SEQ ID NO: 13001 - DNA, 23 bp, Artificial Sequence
  X-linked inhibitor of apoptosis (XIAP) siRNA
cttgtttcaaaataagtatttct

SEQ ID NO: 13002 - DNA, 23 bp, Artificial Sequence
  X-linked inhibitor of apoptosis (XIAP) siRNA
ttgtttcaaaataagtatttctg

SEQ ID NO: 13003 - DNA, 23 bp, Artificial Sequence
  X-linked inhibitor of apoptosis (XIAP) siRNA
tgtttcaaaataagtatttctga

SEQ ID NO: 13004 - DNA, 23 bp, Artificial Sequence
  X-linked inhibitor of apoptosis (XIAP) siRNA
gtttcaaaataagtatttctgat

SEQ ID NO: 13005 - DNA, 23 bp, Artificial Sequence
  X-linked inhibitor of apoptosis (XIAP) siRNA
tttcaaaataagtatttctgatt

SEQ ID NO: 13006 - DNA, 23 bp, Artificial Sequence
  X-linked inhibitor of apoptosis (XIAP) siRNA
ttcaaaataagtatttctgattt

SEQ ID NO: 13007 - DNA, 23 bp, Artificial Sequence
  X-linked inhibitor of apoptosis (XIAP) siRNA
tcaaaataagtatttctgatttt

SEQ ID NO: 13008 - DNA, 23 bp, Artificial Sequence
  X-linked inhibitor of apoptosis (XIAP) siRNA
caaaataagtatttctgattttg

SEQ ID NO: 13009 - DNA, 23 bp, Artificial Sequence
  X-linked inhibitor of apoptosis (XIAP) siRNA
aaaataagtatttctgattttgt

SEQ ID NO: 13010 - DNA, 23 bp, Artificial Sequence
  X-linked inhibitor of apoptosis (XIAP) siRNA
aaataagtatttctgattttgta

SEQ ID NO: 13011 - DNA, 23 bp, Artificial Sequence
  X-linked inhibitor of apoptosis (XIAP) siRNA
aataagtatttctgattttgtaa

SEQ ID NO: 13012 - DNA, 23 bp, Artificial Sequence
  X-linked inhibitor of apoptosis (XIAP) siRNA
ataagtatttctgattttgtaaa

SEQ ID NO: 13013 - DNA, 23 bp, Artificial Sequence
  X-linked inhibitor of apoptosis (XIAP) siRNA
taagtatttctgattttgtaaaa

SEQ ID NO: 13014 - DNA, 23 bp, Artificial Sequence
  X-linked inhibitor of apoptosis (XIAP) siRNA
aagtatttctgattttgtaaaat

SEQ ID NO: 13015 - DNA, 23 bp, Artificial Sequence
  X-linked inhibitor of apoptosis (XIAP) siRNA
agtatttctgattttgtaaaatg

SEQ ID NO: 13016 - DNA, 23 bp, Artificial Sequence
  X-linked inhibitor of apoptosis (XIAP) siRNA
gtatttctgattttgtaaaatga

SEQ ID NO: 13017 - DNA, 23 bp, Artificial Sequence
  X-linked inhibitor of apoptosis (XIAP) siRNA
tatttctgattttgtaaaatgaa

SEQ ID NO: 13018 - DNA, 23 bp, Artificial Sequence
  X-linked inhibitor of apoptosis (XIAP) siRNA
atttctgattttgtaaaatgaaa

SEQ ID NO: 13019 - DNA, 23 bp, Artificial Sequence
  X-linked inhibitor of apoptosis (XIAP) siRNA
tttctgattttgtaaaatgaaat

SEQ ID NO: 13020 - DNA, 23 bp, Artificial Sequence
  X-linked inhibitor of apoptosis (XIAP) siRNA
ttctgattttgtaaaatgaaata

SEQ ID NO: 13021 - DNA, 23 bp, Artificial Sequence
  X-linked inhibitor of apoptosis (XIAP) siRNA
tctgattttgtaaaatgaaatat

SEQ ID NO: 13022 - DNA, 23 bp, Artificial Sequence
  X-linked inhibitor of apoptosis (XIAP) siRNA
ctgattttgtaaaatgaaatata

SEQ ID NO: 13023 - DNA, 23 bp, Artificial Sequence
  X-linked inhibitor of apoptosis (XIAP) siRNA
tgattttgtaaaatgaaatataa

SEQ ID NO: 13024 - DNA, 23 bp, Artificial Sequence
  X-linked inhibitor of apoptosis (XIAP) siRNA
gattttgtaaaatgaaatataaa

SEQ ID NO: 13025 - DNA, 23 bp, Artificial Sequence
  X-linked inhibitor of apoptosis (XIAP) siRNA
attttgtaaaatgaaatataaaa

SEQ ID NO: 13026 - DNA, 23 bp, Artificial Sequence
  X-linked inhibitor of apoptosis (XIAP) siRNA
ttttgtaaaatgaaatataaaat

SEQ ID NO: 13027 - DNA, 23 bp, Artificial Sequence
  X-linked inhibitor of apoptosis (XIAP) siRNA
tttgtaaaatgaaatataaaata

SEQ ID NO: 13028 - DNA, 23 bp, Artificial Sequence
  X-linked inhibitor of apoptosis (XIAP) siRNA
ttgtaaaatgaaatataaaatat

SEQ ID NO: 13029 - DNA, 23 bp, Artificial Sequence
  X-linked inhibitor of apoptosis (XIAP) siRNA
tgtaaaatgaaatataaaatatg

SEQ ID NO: 13030 - DNA, 23 bp, Artificial Sequence
  X-linked inhibitor of apoptosis (XIAP) siRNA
gtaaaatgaaatataaaatatgt

SEQ ID NO: 13031 - DNA, 23 bp, Artificial Sequence
  X-linked inhibitor of apoptosis (XIAP) siRNA
taaaatgaaatataaaatatgtc

SEQ ID NO: 13032 - DNA, 23 bp, Artificial Sequence
  X-linked inhibitor of apoptosis (XIAP) siRNA
aaaatgaaatataaaatatgtct

SEQ ID NO: 13033 - DNA, 23 bp, Artificial Sequence
  X-linked inhibitor of apoptosis (XIAP) siRNA
aaatgaaatataaaatatgtctc

SEQ ID NO: 13034 - DNA, 23 bp, Artificial Sequence
  X-linked inhibitor of apoptosis (XIAP) siRNA
aatgaaatataaaatatgtctca

SEQ ID NO: 13035 - DNA, 23 bp, Artificial Sequence
  X-linked inhibitor of apoptosis (XIAP) siRNA
atgaaatataaaatatgtctcag

SEQ ID NO: 13036 - DNA, 23 bp, Artificial Sequence
  X-linked inhibitor of apoptosis (XIAP) siRNA
tgaaatataaaatatgtctcaga

SEQ ID NO: 13037 - DNA, 23 bp, Artificial Sequence
  X-linked inhibitor of apoptosis (XIAP) siRNA
gaaatataaaatatgtctcagat

SEQ ID NO: 13038 - DNA, 23 bp, Artificial Sequence
  X-linked inhibitor of apoptosis (XIAP) siRNA
aaatataaaatatgtctcagatc

SEQ ID NO: 13039 - DNA, 23 bp, Artificial Sequence
  X-linked inhibitor of apoptosis (XIAP) siRNA
aatataaaatatgtctcagatct

SEQ ID NO: 13040 - DNA, 23 bp, Artificial Sequence
  X-linked inhibitor of apoptosis (XIAP) siRNA
atataaaatatgtctcagatctt

SEQ ID NO: 13041 - DNA, 23 bp, Artificial Sequence
  X-linked inhibitor of apoptosis (XIAP) siRNA
tataaaatatgtctcagatcttc

SEQ ID NO: 13042 - DNA, 23 bp, Artificial Sequence
  X-linked inhibitor of apoptosis (XIAP) siRNA
ataaaatatgtctcagatcttcc

SEQ ID NO: 13043 - DNA, 23 bp, Artificial Sequence
  X-linked inhibitor of apoptosis (XIAP) siRNA
taaaatatgtctcagatcttcca

SEQ ID NO: 13044 - DNA, 23 bp, Artificial Sequence
  X-linked inhibitor of apoptosis (XIAP) siRNA
aaaatatgtctcagatcttccaa

SEQ ID NO: 13045 - DNA, 23 bp, Artificial Sequence
  X-linked inhibitor of apoptosis (XIAP) siRNA
aaatatgtctcagatcttccaat

SEQ ID NO: 13046 - DNA, 23 bp, Artificial Sequence
  X-linked inhibitor of apoptosis (XIAP) siRNA
aatatgtctcagatcttccaatt

SEQ ID NO: 13047 - DNA, 23 bp, Artificial Sequence
  X-linked inhibitor of apoptosis (XIAP) siRNA
atatgtctcagatcttccaatta

SEQ ID NO: 13048 - DNA, 23 bp, Artificial Sequence
  X-linked inhibitor of apoptosis (XIAP) siRNA
tatgtctcagatcttccaattaa

SEQ ID NO: 13049 - DNA, 23 bp, Artificial Sequence
  X-linked inhibitor of apoptosis (XIAP) siRNA
atgtctcagatcttccaattaat

SEQ ID NO: 13050 - DNA, 23 bp, Artificial Sequence
  X-linked inhibitor of apoptosis (XIAP) siRNA
tgtctcagatcttccaattaatt

SEQ ID NO: 13051 - DNA, 23 bp, Artificial Sequence
  X-linked inhibitor of apoptosis (XIAP) siRNA
gtctcagatcttccaattaatta

SEQ ID NO: 13052 - DNA, 23 bp, Artificial Sequence
  X-linked inhibitor of apoptosis (XIAP) siRNA
tctcagatcttccaattaattag

SEQ ID NO: 13053 - DNA, 23 bp, Artificial Sequence
  X-linked inhibitor of apoptosis (XIAP) siRNA
ctcagatcttccaattaattagt

SEQ ID NO: 13054 - DNA, 23 bp, Artificial Sequence
  X-linked inhibitor of apoptosis (XIAP) siRNA
tcagatcttccaattaattagta

SEQ ID NO: 13055 - DNA, 23 bp, Artificial Sequence
  X-linked inhibitor of apoptosis (XIAP) siRNA
cagatcttccaattaattagtaa

SEQ ID NO: 13056 - DNA, 23 bp, Artificial Sequence
  X-linked inhibitor of apoptosis (XIAP) siRNA
agatcttccaattaattagtaag

SEQ ID NO: 13057 - DNA, 23 bp, Artificial Sequence
  X-linked inhibitor of apoptosis (XIAP) siRNA
gatcttccaattaattagtaagg

SEQ ID NO: 13058 - DNA, 23 bp, Artificial Sequence
  X-linked inhibitor of apoptosis (XIAP) siRNA
atcttccaattaattagtaagga

SEQ ID NO: 13059 - DNA, 23 bp, Artificial Sequence
  X-linked inhibitor of apoptosis (XIAP) siRNA
tcttccaattaattagtaaggat

SEQ ID NO: 13060 - DNA, 23 bp, Artificial Sequence
  X-linked inhibitor of apoptosis (XIAP) siRNA
cttccaattaattagtaaggatt

SEQ ID NO: 13061 - DNA, 23 bp, Artificial Sequence
  X-linked inhibitor of apoptosis (XIAP) siRNA
ttccaattaattagtaaggattc

SEQ ID NO: 13062 - DNA, 23 bp, Artificial Sequence
  X-linked inhibitor of apoptosis (XIAP) siRNA
tccaattaattagtaaggattca

SEQ ID NO: 13063 - DNA, 23 bp, Artificial Sequence
  X-linked inhibitor of apoptosis (XIAP) siRNA
ccaattaattagtaaggattcat

SEQ ID NO: 13064 - DNA, 23 bp, Artificial Sequence
  X-linked inhibitor of apoptosis (XIAP) siRNA
caattaattagtaaggattcatc

SEQ ID NO: 13065 - DNA, 23 bp, Artificial Sequence
  X-linked inhibitor of apoptosis (XIAP) siRNA
aattaattagtaaggattcatcc

SEQ ID NO: 13066 - DNA, 23 bp, Artificial Sequence
  X-linked inhibitor of apoptosis (XIAP) siRNA
attaattagtaaggattcatcct

SEQ ID NO: 13067 - DNA, 23 bp, Artificial Sequence
  X-linked inhibitor of apoptosis (XIAP) siRNA
ttaattagtaaggattcatcctt

SEQ ID NO: 13068 - DNA, 23 bp, Artificial Sequence
  X-linked inhibitor of apoptosis (XIAP) siRNA
taattagtaaggattcatcctta

SEQ ID NO: 13069 - DNA, 23 bp, Artificial Sequence
  X-linked inhibitor of apoptosis (XIAP) siRNA
aattagtaaggattcatccttaa

SEQ ID NO: 13070 - DNA, 23 bp, Artificial Sequence
  X-linked inhibitor of apoptosis (XIAP) siRNA
attagtaaggattcatccttaat

SEQ ID NO: 13071 - DNA, 23 bp, Artificial Sequence
  X-linked inhibitor of apoptosis (XIAP) siRNA
ttagtaaggattcatccttaatc

SEQ ID NO: 13072 - DNA, 23 bp, Artificial Sequence
  X-linked inhibitor of apoptosis (XIAP) siRNA
tagtaaggattcatccttaatcc

SEQ ID NO: 13073 - DNA, 23 bp, Artificial Sequence
  X-linked inhibitor of apoptosis (XIAP) siRNA
agtaaggattcatccttaatcct

SEQ ID NO: 13074 - DNA, 23 bp, Artificial Sequence
  X-linked inhibitor of apoptosis (XIAP) siRNA
gtaaggattcatccttaatcctt

SEQ ID NO: 13075 - DNA, 23 bp, Artificial Sequence
  X-linked inhibitor of apoptosis (XIAP) siRNA
taaggattcatccttaatccttg

SEQ ID NO: 13076 - DNA, 23 bp, Artificial Sequence
  X-linked inhibitor of apoptosis (XIAP) siRNA
aaggattcatccttaatccttgc

SEQ ID NO: 13077 - DNA, 23 bp, Artificial Sequence
  X-linked inhibitor of apoptosis (XIAP) siRNA
aggattcatccttaatccttgct

SEQ ID NO: 13078 - DNA, 23 bp, Artificial Sequence
  X-linked inhibitor of apoptosis (XIAP) siRNA
ggattcatccttaatccttgcta

SEQ ID NO: 13079 - DNA, 23 bp, Artificial Sequence
  X-linked inhibitor of apoptosis (XIAP) siRNA
gattcatccttaatccttgctag

SEQ ID NO: 13080 - DNA, 23 bp, Artificial Sequence
  X-linked inhibitor of apoptosis (XIAP) siRNA
attcatccttaatccttgctagt

SEQ ID NO: 13081 - DNA, 23 bp, Artificial Sequence
  X-linked inhibitor of apoptosis (XIAP) siRNA
ttcatccttaatccttgctagtt

SEQ ID NO: 13082 - DNA, 23 bp, Artificial Sequence
  X-linked inhibitor of apoptosis (XIAP) siRNA
tcatccttaatccttgctagttt

SEQ ID NO: 13083 - DNA, 23 bp, Artificial Sequence
  X-linked inhibitor of apoptosis (XIAP) siRNA
catccttaatccttgctagttta

SEQ ID NO: 13084 - DNA, 23 bp, Artificial Sequence
  X-linked inhibitor of apoptosis (XIAP) siRNA
atccttaatccttgctagtttaa

SEQ ID NO: 13085 - DNA, 23 bp, Artificial Sequence
  X-linked inhibitor of apoptosis (XIAP) siRNA
tccttaatccttgctagtttaag

SEQ ID NO: 13086 - DNA, 23 bp, Artificial Sequence
  X-linked inhibitor of apoptosis (XIAP) siRNA
ccttaatccttgctagtttaagc

SEQ ID NO: 13087 - DNA, 23 bp, Artificial Sequence
  X-linked inhibitor of apoptosis (XIAP) siRNA
cttaatccttgctagtttaagcc

SEQ ID NO: 13088 - DNA, 23 bp, Artificial Sequence
  X-linked inhibitor of apoptosis (XIAP) siRNA
ttaatccttgctagtttaagcct

SEQ ID NO: 13089 - DNA, 23 bp, Artificial Sequence
  X-linked inhibitor of apoptosis (XIAP) siRNA
taatccttgctagtttaagcctg

SEQ ID NO: 13090 - DNA, 23 bp, Artificial Sequence
  X-linked inhibitor of apoptosis (XIAP) siRNA
aatccttgctagtttaagcctgc

SEQ ID NO: 13091 - DNA, 23 bp, Artificial Sequence
  X-linked inhibitor of apoptosis (XIAP) siRNA
atccttgctagtttaagcctgcc

SEQ ID NO: 13092 - DNA, 23 bp, Artificial Sequence
  X-linked inhibitor of apoptosis (XIAP) siRNA
tccttgctagtttaagcctgcct

SEQ ID NO: 13093 - DNA, 23 bp, Artificial Sequence
  X-linked inhibitor of apoptosis (XIAP) siRNA
ccttgctagtttaagcctgccta

SEQ ID NO: 13094 - DNA, 23 bp, Artificial Sequence
  X-linked inhibitor of apoptosis (XIAP) siRNA
cttgctagtttaagcctgcctaa

SEQ ID NO: 13095 - DNA, 23 bp, Artificial Sequence
  X-linked inhibitor of apoptosis (XIAP) siRNA
ttgctagtttaagcctgcctaag

SEQ ID NO: 13096 - DNA, 23 bp, Artificial Sequence
  X-linked inhibitor of apoptosis (XIAP) siRNA
tgctagtttaagcctgcctaagt

SEQ ID NO: 13097 - DNA, 23 bp, Artificial Sequence
  X-linked inhibitor of apoptosis (XIAP) siRNA
gctagtttaagcctgcctaagtc

SEQ ID NO: 13098 - DNA, 23 bp, Artificial Sequence
  X-linked inhibitor of apoptosis (XIAP) siRNA
ctagtttaagcctgcctaagtca

SEQ ID NO: 13099 - DNA, 23 bp, Artificial Sequence
  X-linked inhibitor of apoptosis (XIAP) siRNA
tagtttaagcctgcctaagtcac

SEQ ID NO: 13100 - DNA, 23 bp, Artificial Sequence
  X-linked inhibitor of apoptosis (XIAP) siRNA
agtttaagcctgcctaagtcact

SEQ ID NO: 13101 - DNA, 23 bp, Artificial Sequence
  X-linked inhibitor of apoptosis (XIAP) siRNA
gtttaagcctgcctaagtcactt

SEQ ID NO: 13102 - DNA, 23 bp, Artificial Sequence
  X-linked inhibitor of apoptosis (XIAP) siRNA
tttaagcctgcctaagtcacttt

SEQ ID NO: 13103 - DNA, 23 bp, Artificial Sequence
  X-linked inhibitor of apoptosis (XIAP) siRNA
ttaagcctgcctaagtcacttta

SEQ ID NO: 13104 - DNA, 23 bp, Artificial Sequence
  X-linked inhibitor of apoptosis (XIAP) siRNA
taagcctgcctaagtcactttac

SEQ ID NO: 13105 - DNA, 23 bp, Artificial Sequence
  X-linked inhibitor of apoptosis (XIAP) siRNA
aagcctgcctaagtcactttact

SEQ ID NO: 13106 - DNA, 23 bp, Artificial Sequence
  X-linked inhibitor of apoptosis (XIAP) siRNA
agcctgcctaagtcactttacta

SEQ ID NO: 13107 - DNA, 23 bp, Artificial Sequence
  X-linked inhibitor of apoptosis (XIAP) siRNA
gcctgcctaagtcactttactaa

SEQ ID NO: 13108 - DNA, 23 bp, Artificial Sequence
  X-linked inhibitor of apoptosis (XIAP) siRNA
cctgcctaagtcactttactaaa

SEQ ID NO: 13109 - DNA, 23 bp, Artificial Sequence
  X-linked inhibitor of apoptosis (XIAP) siRNA
ctgcctaagtcactttactaaaa

SEQ ID NO: 13110 - DNA, 23 bp, Artificial Sequence
  X-linked inhibitor of apoptosis (XIAP) siRNA
tgcctaagtcactttactaaaag

SEQ ID NO: 13111 - DNA, 23 bp, Artificial Sequence
  X-linked inhibitor of apoptosis (XIAP) siRNA
gcctaagtcactttactaaaaga

SEQ ID NO: 13112 - DNA, 23 bp, Artificial Sequence
  X-linked inhibitor of apoptosis (XIAP) siRNA
cctaagtcactttactaaaagat

SEQ ID NO: 13113 - DNA, 23 bp, Artificial Sequence
  X-linked inhibitor of apoptosis (XIAP) siRNA
ctaagtcactttactaaaagatc

SEQ ID NO: 13114 - DNA, 23 bp, Artificial Sequence
  X-linked inhibitor of apoptosis (XIAP) siRNA
taagtcactttactaaaagatct

SEQ ID NO: 13115 - DNA, 23 bp, Artificial Sequence
  X-linked inhibitor of apoptosis (XIAP) siRNA
aagtcactttactaaaagatctt

SEQ ID NO: 13116 - DNA, 23 bp, Artificial Sequence
  X-linked inhibitor of apoptosis (XIAP) siRNA
agtcactttactaaaagatcttt

SEQ ID NO: 13117 - DNA, 23 bp, Artificial Sequence
  X-linked inhibitor of apoptosis (XIAP) siRNA
gtcactttactaaaagatctttg

SEQ ID NO: 13118 - DNA, 23 bp, Artificial Sequence
  X-linked inhibitor of apoptosis (XIAP) siRNA
tcactttactaaaagatctttgt

SEQ ID NO: 13119 - DNA, 23 bp, Artificial Sequence
  X-linked inhibitor of apoptosis (XIAP) siRNA
cactttactaaaagatctttgtt

SEQ ID NO: 13120 - DNA, 23 bp, Artificial Sequence
  X-linked inhibitor of apoptosis (XIAP) siRNA
actttactaaaagatctttgtta

SEQ ID NO: 13121 - DNA, 23 bp, Artificial Sequence
  X-linked inhibitor of apoptosis (XIAP) siRNA
ctttactaaaagatctttgttaa

SEQ ID NO: 13122 - DNA, 23 bp, Artificial Sequence
  X-linked inhibitor of apoptosis (XIAP) siRNA
tttactaaaagatctttgttaac

SEQ ID NO: 13123 - DNA, 23 bp, Artificial Sequence
  X-linked inhibitor of apoptosis (XIAP) siRNA
ttactaaaagatctttgttaact

SEQ ID NO: 13124 - DNA, 23 bp, Artificial Sequence
  X-linked inhibitor of apoptosis (XIAP) siRNA
tactaaaagatctttgttaactc

SEQ ID NO: 13125 - DNA, 23 bp, Artificial Sequence
  X-linked inhibitor of apoptosis (XIAP) siRNA
actaaaagatctttgttaactca

SEQ ID NO: 13126 - DNA, 23 bp, Artificial Sequence
  X-linked inhibitor of apoptosis (XIAP) siRNA
ctaaaagatctttgttaactcag

SEQ ID NO: 13127 - DNA, 23 bp, Artificial Sequence
  X-linked inhibitor of apoptosis (XIAP) siRNA
taaaagatctttgttaactcagt

SEQ ID NO: 13128 - DNA, 23 bp, Artificial Sequence
  X-linked inhibitor of apoptosis (XIAP) siRNA
aaaagatctttgttaactcagta

SEQ ID NO: 13129 - DNA, 23 bp, Artificial Sequence
  X-linked inhibitor of apoptosis (XIAP) siRNA
aaagatctttgttaactcagtat

SEQ ID NO: 13130 - DNA, 23 bp, Artificial Sequence
  X-linked inhibitor of apoptosis (XIAP) siRNA
aagatctttgttaactcagtatt

SEQ ID NO: 13131 - DNA, 23 bp, Artificial Sequence
  X-linked inhibitor of apoptosis (XIAP) siRNA
agatctttgttaactcagtattt

SEQ ID NO: 13132 - DNA, 23 bp, Artificial Sequence
  X-linked inhibitor of apoptosis (XIAP) siRNA
gatctttgttaactcagtatttt

SEQ ID NO: 13133 - DNA, 23 bp, Artificial Sequence
  X-linked inhibitor of apoptosis (XIAP) siRNA
atctttgttaactcagtatttta

SEQ ID NO: 13134 - DNA, 23 bp, Artificial Sequence
  X-linked inhibitor of apoptosis (XIAP) siRNA
tctttgttaactcagtattttaa

SEQ ID NO: 13135 - DNA, 23 bp, Artificial Sequence
  X-linked inhibitor of apoptosis (XIAP) siRNA
ctttgttaactcagtattttaaa

SEQ ID NO: 13136 - DNA, 23 bp, Artificial Sequence
  X-linked inhibitor of apoptosis (XIAP) siRNA
tttgttaactcagtattttaaac

SEQ ID NO: 13137 - DNA, 23 bp, Artificial Sequence
  X-linked inhibitor of apoptosis (XIAP) siRNA
ttgttaactcagtattttaaaca

SEQ ID NO: 13138 - DNA, 23 bp, Artificial Sequence
  X-linked inhibitor of apoptosis (XIAP) siRNA
tgttaactcagtattttaaacat

SEQ ID NO: 13139 - DNA, 23 bp, Artificial Sequence
  X-linked inhibitor of apoptosis (XIAP) siRNA
gttaactcagtattttaaacatc

SEQ ID NO: 13140 - DNA, 23 bp, Artificial Sequence
  X-linked inhibitor of apoptosis (XIAP) siRNA
ttaactcagtattttaaacatct

SEQ ID NO: 13141 - DNA, 23 bp, Artificial Sequence
  X-linked inhibitor of apoptosis (XIAP) siRNA
taactcagtattttaaacatctg

SEQ ID NO: 13142 - DNA, 23 bp, Artificial Sequence
  X-linked inhibitor of apoptosis (XIAP) siRNA
aactcagtattttaaacatctgt

SEQ ID NO: 13143 - DNA, 23 bp, Artificial Sequence
  X-linked inhibitor of apoptosis (XIAP) siRNA
actcagtattttaaacatctgtc

SEQ ID NO: 13144 - DNA, 23 bp, Artificial Sequence
  X-linked inhibitor of apoptosis (XIAP) siRNA
ctcagtattttaaacatctgtca

SEQ ID NO: 13145 - DNA, 23 bp, Artificial Sequence
  X-linked inhibitor of apoptosis (XIAP) siRNA
tcagtattttaaacatctgtcag

SEQ ID NO: 13146 - DNA, 23 bp, Artificial Sequence
  X-linked inhibitor of apoptosis (XIAP) siRNA
cagtattttaaacatctgtcagc

SEQ ID NO: 13147 - DNA, 23 bp, Artificial Sequence
  X-linked inhibitor of apoptosis (XIAP) siRNA
agtattttaaacatctgtcagct

SEQ ID NO: 13148 - DNA, 23 bp, Artificial Sequence
  X-linked inhibitor of apoptosis (XIAP) siRNA
gtattttaaacatctgtcagctt

SEQ ID NO: 13149 - DNA, 23 bp, Artificial Sequence
  X-linked inhibitor of apoptosis (XIAP) siRNA
tattttaaacatctgtcagctta

SEQ ID NO: 13150 - DNA, 23 bp, Artificial Sequence
  X-linked inhibitor of apoptosis (XIAP) siRNA
attttaaacatctgtcagcttat

SEQ ID NO: 13151 - DNA, 23 bp, Artificial Sequence
  X-linked inhibitor of apoptosis (XIAP) siRNA
ttttaaacatctgtcagcttatg

SEQ ID NO: 13152 - DNA, 23 bp, Artificial Sequence
  X-linked inhibitor of apoptosis (XIAP) siRNA
tttaaacatctgtcagcttatgt

SEQ ID NO: 13153 - DNA, 23 bp, Artificial Sequence
  X-linked inhibitor of apoptosis (XIAP) siRNA
ttaaacatctgtcagcttatgta

SEQ ID NO: 13154 - DNA, 23 bp, Artificial Sequence
  X-linked inhibitor of apoptosis (XIAP) siRNA
taaacatctgtcagcttatgtag

SEQ ID NO: 13155 - DNA, 23 bp, Artificial Sequence
  X-linked inhibitor of apoptosis (XIAP) siRNA
aaacatctgtcagcttatgtagg

SEQ ID NO: 13156 - DNA, 23 bp, Artificial Sequence
  X-linked inhibitor of apoptosis (XIAP) siRNA
aacatctgtcagcttatgtaggt

SEQ ID NO: 13157 - DNA, 23 bp, Artificial Sequence
  X-linked inhibitor of apoptosis (XIAP) siRNA
acatctgtcagcttatgtaggta

SEQ ID NO: 13158 - DNA, 23 bp, Artificial Sequence
  X-linked inhibitor of apoptosis (XIAP) siRNA
catctgtcagcttatgtaggtaa

SEQ ID NO: 13159 - DNA, 23 bp, Artificial Sequence
  X-linked inhibitor of apoptosis (XIAP) siRNA
atctgtcagcttatgtaggtaaa

SEQ ID NO: 13160 - DNA, 23 bp, Artificial Sequence
  X-linked inhibitor of apoptosis (XIAP) siRNA
tctgtcagcttatgtaggtaaaa

SEQ ID NO: 13161 - DNA, 23 bp, Artificial Sequence
  X-linked inhibitor of apoptosis (XIAP) siRNA
ctgtcagcttatgtaggtaaaag

SEQ ID NO: 13162 - DNA, 23 bp, Artificial Sequence
  X-linked inhibitor of apoptosis (XIAP) siRNA
tgtcagcttatgtaggtaaaagt

SEQ ID NO: 13163 - DNA, 23 bp, Artificial Sequence
  X-linked inhibitor of apoptosis (XIAP) siRNA
gtcagcttatgtaggtaaaagta

SEQ ID NO: 13164 - DNA, 23 bp, Artificial Sequence
  X-linked inhibitor of apoptosis (XIAP) siRNA
tcagcttatgtaggtaaaagtag

SEQ ID NO: 13165 - DNA, 23 bp, Artificial Sequence
  X-linked inhibitor of apoptosis (XIAP) siRNA
cagcttatgtaggtaaaagtaga

SEQ ID NO: 13166 - DNA, 23 bp, Artificial Sequence
  X-linked inhibitor of apoptosis (XIAP) siRNA
agcttatgtaggtaaaagtagaa

SEQ ID NO: 13167 - DNA, 23 bp, Artificial Sequence
  X-linked inhibitor of apoptosis (XIAP) siRNA
gcttatgtaggtaaaagtagaag

SEQ ID NO: 13168 - DNA, 23 bp, Artificial Sequence
  X-linked inhibitor of apoptosis (XIAP) siRNA
cttatgtaggtaaaagtagaagc

SEQ ID NO: 13169 - DNA, 23 bp, Artificial Sequence
  X-linked inhibitor of apoptosis (XIAP) siRNA
ttatgtaggtaaaagtagaagca

SEQ ID NO: 13170 - DNA, 23 bp, Artificial Sequence
  X-linked inhibitor of apoptosis (XIAP) siRNA
tatgtaggtaaaagtagaagcat

SEQ ID NO: 13171 - DNA, 23 bp, Artificial Sequence
  X-linked inhibitor of apoptosis (XIAP) siRNA
atgtaggtaaaagtagaagcatg

SEQ ID NO: 13172 - DNA, 23 bp, Artificial Sequence
  X-linked inhibitor of apoptosis (XIAP) siRNA
tgtaggtaaaagtagaagcatgt

SEQ ID NO: 13173 - DNA, 23 bp, Artificial Sequence
  X-linked inhibitor of apoptosis (XIAP) siRNA
gtaggtaaaagtagaagcatgtt

SEQ ID NO: 13174 - DNA, 23 bp, Artificial Sequence
  X-linked inhibitor of apoptosis (XIAP) siRNA
taggtaaaagtagaagcatgttt

SEQ ID NO: 13175 - DNA, 23 bp, Artificial Sequence
  X-linked inhibitor of apoptosis (XIAP) siRNA
aggtaaaagtagaagcatgtttg

SEQ ID NO: 13176 - DNA, 23 bp, Artificial Sequence
  X-linked inhibitor of apoptosis (XIAP) siRNA
ggtaaaagtagaagcatgtttgt

SEQ ID NO: 13177 - DNA, 23 bp, Artificial Sequence
  X-linked inhibitor of apoptosis (XIAP) siRNA
gtaaaagtagaagcatgtttgta

SEQ ID NO: 13178 - DNA, 23 bp, Artificial Sequence
  X-linked inhibitor of apoptosis (XIAP) siRNA
taaaagtagaagcatgtttgtac

SEQ ID NO: 13179 - DNA, 23 bp, Artificial Sequence
  X-linked inhibitor of apoptosis (XIAP) siRNA
aaaagtagaagcatgtttgtaca

SEQ ID NO: 13180 - DNA, 23 bp, Artificial Sequence
  X-linked inhibitor of apoptosis (XIAP) siRNA
aaagtagaagcatgtttgtacac

SEQ ID NO: 13181 - DNA, 23 bp, Artificial Sequence
  X-linked inhibitor of apoptosis (XIAP) siRNA
aagtagaagcatgtttgtacact

SEQ ID NO: 13182 - DNA, 23 bp, Artificial Sequence
  X-linked inhibitor of apoptosis (XIAP) siRNA
agtagaagcatgtttgtacactg

SEQ ID NO: 13183 - DNA, 23 bp, Artificial Sequence
  X-linked inhibitor of apoptosis (XIAP) siRNA
gtagaagcatgtttgtacactgc

SEQ ID NO: 13184 - DNA, 23 bp, Artificial Sequence
  X-linked inhibitor of apoptosis (XIAP) siRNA
tagaagcatgtttgtacactgct

SEQ ID NO: 13185 - DNA, 23 bp, Artificial Sequence
  X-linked inhibitor of apoptosis (XIAP) siRNA
agaagcatgtttgtacactgctt

SEQ ID NO: 13186 - DNA, 23 bp, Artificial Sequence
  X-linked inhibitor of apoptosis (XIAP) siRNA
gaagcatgtttgtacactgcttg

SEQ ID NO: 13187 - DNA, 23 bp, Artificial Sequence
  X-linked inhibitor of apoptosis (XIAP) siRNA
aagcatgtttgtacactgcttgt

SEQ ID NO: 13188 - DNA, 23 bp, Artificial Sequence
  X-linked inhibitor of apoptosis (XIAP) siRNA
agcatgtttgtacactgcttgta

SEQ ID NO: 13189 - DNA, 23 bp, Artificial Sequence
  X-linked inhibitor of apoptosis (XIAP) siRNA
gcatgtttgtacactgcttgtag

SEQ ID NO: 13190 - DNA, 23 bp, Artificial Sequence
  X-linked inhibitor of apoptosis (XIAP) siRNA
catgtttgtacactgcttgtagt

SEQ ID NO: 13191 - DNA, 23 bp, Artificial Sequence
  X-linked inhibitor of apoptosis (XIAP) siRNA
atgtttgtacactgcttgtagtt

SEQ ID NO: 13192 - DNA, 23 bp, Artificial Sequence
  X-linked inhibitor of apoptosis (XIAP) siRNA
tgtttgtacactgcttgtagtta

SEQ ID NO: 13193 - DNA, 23 bp, Artificial Sequence
  X-linked inhibitor of apoptosis (XIAP) siRNA
gtttgtacactgcttgtagttat

SEQ ID NO: 13194 - DNA, 23 bp, Artificial Sequence
  X-linked inhibitor of apoptosis (XIAP) siRNA
tttgtacactgcttgtagttata

SEQ ID NO: 13195 - DNA, 23 bp, Artificial Sequence
  X-linked inhibitor of apoptosis (XIAP) siRNA
ttgtacactgcttgtagttatag

SEQ ID NO: 13196 - DNA, 23 bp, Artificial Sequence
  X-linked inhibitor of apoptosis (XIAP) siRNA
tgtacactgcttgtagttatagt

SEQ ID NO: 13197 - DNA, 23 bp, Artificial Sequence
  X-linked inhibitor of apoptosis (XIAP) siRNA
gtacactgcttgtagttatagtg

SEQ ID NO: 13198 - DNA, 23 bp, Artificial Sequence
  X-linked inhibitor of apoptosis (XIAP) siRNA
tacactgcttgtagttatagtga

SEQ ID NO: 13199 - DNA, 23 bp, Artificial Sequence
  X-linked inhibitor of apoptosis (XIAP) siRNA
acactgcttgtagttatagtgac

SEQ ID NO: 13200 - DNA, 23 bp, Artificial Sequence
  X-linked inhibitor of apoptosis (XIAP) siRNA
cactgcttgtagttatagtgaca

SEQ ID NO: 13201 - DNA, 23 bp, Artificial Sequence
  X-linked inhibitor of apoptosis (XIAP) siRNA
actgcttgtagttatagtgacag

SEQ ID NO: 13202 - DNA, 23 bp, Artificial Sequence
  X-linked inhibitor of apoptosis (XIAP) siRNA
ctgcttgtagttatagtgacagc

SEQ ID NO: 13203 - DNA, 23 bp, Artificial Sequence
  X-linked inhibitor of apoptosis (XIAP) siRNA
tgcttgtagttatagtgacagct

SEQ ID NO: 13204 - DNA, 23 bp, Artificial Sequence
  X-linked inhibitor of apoptosis (XIAP) siRNA
gcttgtagttatagtgacagctt

SEQ ID NO: 13205 - DNA, 23 bp, Artificial Sequence
  X-linked inhibitor of apoptosis (XIAP) siRNA
cttgtagttatagtgacagcttt

SEQ ID NO: 13206 - DNA, 23 bp, Artificial Sequence
  X-linked inhibitor of apoptosis (XIAP) siRNA
ttgtagttatagtgacagctttc

SEQ ID NO: 13207 - DNA, 23 bp, Artificial Sequence
  X-linked inhibitor of apoptosis (XIAP) siRNA
tgtagttatagtgacagctttcc

SEQ ID NO: 13208 - DNA, 23 bp, Artificial Sequence
  X-linked inhibitor of apoptosis (XIAP) siRNA
gtagttatagtgacagctttcca

SEQ ID NO: 13209 - DNA, 23 bp, Artificial Sequence
  X-linked inhibitor of apoptosis (XIAP) siRNA
tagttatagtgacagctttccat

SEQ ID NO: 13210 - DNA, 23 bp, Artificial Sequence
  X-linked inhibitor of apoptosis (XIAP) siRNA
agttatagtgacagctttccatg

SEQ ID NO: 13211 - DNA, 23 bp, Artificial Sequence
  X-linked inhibitor of apoptosis (XIAP) siRNA
gttatagtgacagctttccatgt

SEQ ID NO: 13212 - DNA, 23 bp, Artificial Sequence
  X-linked inhibitor of apoptosis (XIAP) siRNA
ttatagtgacagctttccatgtt

SEQ ID NO: 13213 - DNA, 23 bp, Artificial Sequence
  X-linked inhibitor of apoptosis (XIAP) siRNA
tatagtgacagctttccatgttg

SEQ ID NO: 13214 - DNA, 23 bp, Artificial Sequence
  X-linked inhibitor of apoptosis (XIAP) siRNA
atagtgacagctttccatgttga

SEQ ID NO: 13215 - DNA, 23 bp, Artificial Sequence
  X-linked inhibitor of apoptosis (XIAP) siRNA
tagtgacagctttccatgttgag

SEQ ID NO: 13216 - DNA, 23 bp, Artificial Sequence
  X-linked inhibitor of apoptosis (XIAP) siRNA
agtgacagctttccatgttgaga

SEQ ID NO: 13217 - DNA, 23 bp, Artificial Sequence
  X-linked inhibitor of apoptosis (XIAP) siRNA
gtgacagctttccatgttgagat

SEQ ID NO: 13218 - DNA, 23 bp, Artificial Sequence
  X-linked inhibitor of apoptosis (XIAP) siRNA
tgacagctttccatgttgagatt

SEQ ID NO: 13219 - DNA, 23 bp, Artificial Sequence
  X-linked inhibitor of apoptosis (XIAP) siRNA
gacagctttccatgttgagattc

SEQ ID NO: 13220 - DNA, 23 bp, Artificial Sequence
  X-linked inhibitor of apoptosis (XIAP) siRNA
acagctttccatgttgagattct

SEQ ID NO: 13221 - DNA, 23 bp, Artificial Sequence
  X-linked inhibitor of apoptosis (XIAP) siRNA
cagctttccatgttgagattctc

SEQ ID NO: 13222 - DNA, 23 bp, Artificial Sequence
  X-linked inhibitor of apoptosis (XIAP) siRNA
agctttccatgttgagattctca

SEQ ID NO: 13223 - DNA, 23 bp, Artificial Sequence
  X-linked inhibitor of apoptosis (XIAP) siRNA
gctttccatgttgagattctcat

SEQ ID NO: 13224 - DNA, 23 bp, Artificial Sequence
  X-linked inhibitor of apoptosis (XIAP) siRNA
ctttccatgttgagattctcata

SEQ ID NO: 13225 - DNA, 23 bp, Artificial Sequence
  X-linked inhibitor of apoptosis (XIAP) siRNA
tttccatgttgagattctcatat

SEQ ID NO: 13226 - DNA, 23 bp, Artificial Sequence
  X-linked inhibitor of apoptosis (XIAP) siRNA
ttccatgttgagattctcatatc

SEQ ID NO: 13227 - DNA, 23 bp, Artificial Sequence
  X-linked inhibitor of apoptosis (XIAP) siRNA
tccatgttgagattctcatatca

SEQ ID NO: 13228 - DNA, 23 bp, Artificial Sequence
  X-linked inhibitor of apoptosis (XIAP) siRNA
ccatgttgagattctcatatcat

SEQ ID NO: 13229 - DNA, 23 bp, Artificial Sequence
  X-linked inhibitor of apoptosis (XIAP) siRNA
catgttgagattctcatatcatc

SEQ ID NO: 13230 - DNA, 23 bp, Artificial Sequence
  X-linked inhibitor of apoptosis (XIAP) siRNA
atgttgagattctcatatcatct

SEQ ID NO: 13231 - DNA, 23 bp, Artificial Sequence
  X-linked inhibitor of apoptosis (XIAP) siRNA
tgttgagattctcatatcatctt

SEQ ID NO: 13232 - DNA, 23 bp, Artificial Sequence
  X-linked inhibitor of apoptosis (XIAP) siRNA
gttgagattctcatatcatcttg

SEQ ID NO: 13233 - DNA, 23 bp, Artificial Sequence
  X-linked inhibitor of apoptosis (XIAP) siRNA
ttgagattctcatatcatcttgt

SEQ ID NO: 13234 - DNA, 23 bp, Artificial Sequence
  X-linked inhibitor of apoptosis (XIAP) siRNA
tgagattctcatatcatcttgta

SEQ ID NO: 13235 - DNA, 23 bp, Artificial Sequence
  X-linked inhibitor of apoptosis (XIAP) siRNA
gagattctcatatcatcttgtat

SEQ ID NO: 13236 - DNA, 23 bp, Artificial Sequence
  X-linked inhibitor of apoptosis (XIAP) siRNA
agattctcatatcatcttgtatc

SEQ ID NO: 13237 - DNA, 23 bp, Artificial Sequence
  X-linked inhibitor of apoptosis (XIAP) siRNA
gattctcatatcatcttgtatct

SEQ ID NO: 13238 - DNA, 23 bp, Artificial Sequence
  X-linked inhibitor of apoptosis (XIAP) siRNA
attctcatatcatcttgtatctt

SEQ ID NO: 13239 - DNA, 23 bp, Artificial Sequence
  X-linked inhibitor of apoptosis (XIAP) siRNA
ttctcatatcatcttgtatctta

SEQ ID NO: 13240 - DNA, 23 bp, Artificial Sequence
  X-linked inhibitor of apoptosis (XIAP) siRNA
tctcatatcatcttgtatcttaa

SEQ ID NO: 13241 - DNA, 23 bp, Artificial Sequence
  X-linked inhibitor of apoptosis (XIAP) siRNA
ctcatatcatcttgtatcttaaa

SEQ ID NO: 13242 - DNA, 23 bp, Artificial Sequence
  X-linked inhibitor of apoptosis (XIAP) siRNA
tcatatcatcttgtatcttaaag

SEQ ID NO: 13243 - DNA, 23 bp, Artificial Sequence
  X-linked inhibitor of apoptosis (XIAP) siRNA
catatcatcttgtatcttaaagt

SEQ ID NO: 13244 - DNA, 23 bp, Artificial Sequence
  X-linked inhibitor of apoptosis (XIAP) siRNA
atatcatcttgtatcttaaagtt

SEQ ID NO: 13245 - DNA, 23 bp, Artificial Sequence
  X-linked inhibitor of apoptosis (XIAP) siRNA
tatcatcttgtatcttaaagttt

SEQ ID NO: 13246 - DNA, 23 bp, Artificial Sequence
  X-linked inhibitor of apoptosis (XIAP) siRNA
atcatcttgtatcttaaagtttc

SEQ ID NO: 13247 - DNA, 23 bp, Artificial Sequence
  X-linked inhibitor of apoptosis (XIAP) siRNA
tcatcttgtatcttaaagtttca

SEQ ID NO: 13248 - DNA, 23 bp, Artificial Sequence
  X-linked inhibitor of apoptosis (XIAP) siRNA
catcttgtatcttaaagtttcat

SEQ ID NO: 13249 - DNA, 23 bp, Artificial Sequence
  X-linked inhibitor of apoptosis (XIAP) siRNA
atcttgtatcttaaagtttcatg

SEQ ID NO: 13250 - DNA, 23 bp, Artificial Sequence
  X-linked inhibitor of apoptosis (XIAP) siRNA
tcttgtatcttaaagtttcatgt

SEQ ID NO: 13251 - DNA, 23 bp, Artificial Sequence
  X-linked inhibitor of apoptosis (XIAP) siRNA
cttgtatcttaaagtttcatgtg

SEQ ID NO: 13252 - DNA, 23 bp, Artificial Sequence
  X-linked inhibitor of apoptosis (XIAP) siRNA
ttgtatcttaaagtttcatgtga

SEQ ID NO: 13253 - DNA, 23 bp, Artificial Sequence
  X-linked inhibitor of apoptosis (XIAP) siRNA
tgtatcttaaagtttcatgtgag

SEQ ID NO: 13254 - DNA, 23 bp, Artificial Sequence
  X-linked inhibitor of apoptosis (XIAP) siRNA
gtatcttaaagtttcatgtgagt

SEQ ID NO: 13255 - DNA, 23 bp, Artificial Sequence
  X-linked inhibitor of apoptosis (XIAP) siRNA
tatcttaaagtttcatgtgagtt

SEQ ID NO: 13256 - DNA, 23 bp, Artificial Sequence
  X-linked inhibitor of apoptosis (XIAP) siRNA
atcttaaagtttcatgtgagttt

SEQ ID NO: 13257 - DNA, 23 bp, Artificial Sequence
  X-linked inhibitor of apoptosis (XIAP) siRNA
tcttaaagtttcatgtgagtttt

SEQ ID NO: 13258 - DNA, 23 bp, Artificial Sequence
  X-linked inhibitor of apoptosis (XIAP) siRNA
cttaaagtttcatgtgagttttt

SEQ ID NO: 13259 - DNA, 23 bp, Artificial Sequence
  X-linked inhibitor of apoptosis (XIAP) siRNA
ttaaagtttcatgtgagttttta

SEQ ID NO: 13260 - DNA, 23 bp, Artificial Sequence
  X-linked inhibitor of apoptosis (XIAP) siRNA
taaagtttcatgtgagtttttac

SEQ ID NO: 13261 - DNA, 23 bp, Artificial Sequence
  X-linked inhibitor of apoptosis (XIAP) siRNA
aaagtttcatgtgagtttttacc

SEQ ID NO: 13262 - DNA, 23 bp, Artificial Sequence
  X-linked inhibitor of apoptosis (XIAP) siRNA
aagtttcatgtgagtttttaccg

SEQ ID NO: 13263 - DNA, 23 bp, Artificial Sequence
  X-linked inhibitor of apoptosis (XIAP) siRNA
agtttcatgtgagtttttaccgt

SEQ ID NO: 13264 - DNA, 23 bp, Artificial Sequence
  X-linked inhibitor of apoptosis (XIAP) siRNA
gtttcatgtgagtttttaccgtt

SEQ ID NO: 13265 - DNA, 23 bp, Artificial Sequence
  X-linked inhibitor of apoptosis (XIAP) siRNA
tttcatgtgagtttttaccgtta

SEQ ID NO: 13266 - DNA, 23 bp, Artificial Sequence
  X-linked inhibitor of apoptosis (XIAP) siRNA
ttcatgtgagtttttaccgttag

SEQ ID NO: 13267 - DNA, 23 bp, Artificial Sequence
  X-linked inhibitor of apoptosis (XIAP) siRNA
tcatgtgagtttttaccgttagg

SEQ ID NO: 13268 - DNA, 23 bp, Artificial Sequence
  X-linked inhibitor of apoptosis (XIAP) siRNA
catgtgagtttttaccgttagga

SEQ ID NO: 13269 - DNA, 23 bp, Artificial Sequence
  X-linked inhibitor of apoptosis (XIAP) siRNA
atgtgagtttttaccgttaggat

SEQ ID NO: 13270 - DNA, 23 bp, Artificial Sequence
  X-linked inhibitor of apoptosis (XIAP) siRNA
tgtgagtttttaccgttaggatg

SEQ ID NO: 13271 - DNA, 23 bp, Artificial Sequence
  X-linked inhibitor of apoptosis (XIAP) siRNA
gtgagtttttaccgttaggatga

SEQ ID NO: 13272 - DNA, 23 bp, Artificial Sequence
  X-linked inhibitor of apoptosis (XIAP) siRNA
tgagtttttaccgttaggatgat

SEQ ID NO: 13273 - DNA, 23 bp, Artificial Sequence
  X-linked inhibitor of apoptosis (XIAP) siRNA
gagtttttaccgttaggatgatt

SEQ ID NO: 13274 - DNA, 23 bp, Artificial Sequence
  X-linked inhibitor of apoptosis (XIAP) siRNA
agtttttaccgttaggatgatta

SEQ ID NO: 13275 - DNA, 23 bp, Artificial Sequence
  X-linked inhibitor of apoptosis (XIAP) siRNA
gtttttaccgttaggatgattaa

SEQ ID NO: 13276 - DNA, 23 bp, Artificial Sequence
  X-linked inhibitor of apoptosis (XIAP) siRNA
tttttaccgttaggatgattaag

SEQ ID NO: 13277 - DNA, 23 bp, Artificial Sequence
  X-linked inhibitor of apoptosis (XIAP) siRNA
ttttaccgttaggatgattaaga

SEQ ID NO: 13278 - DNA, 23 bp, Artificial Sequence
  X-linked inhibitor of apoptosis (XIAP) siRNA
tttaccgttaggatgattaagat

SEQ ID NO: 13279 - DNA, 23 bp, Artificial Sequence
  X-linked inhibitor of apoptosis (XIAP) siRNA
ttaccgttaggatgattaagatg

SEQ ID NO: 13280 - DNA, 23 bp, Artificial Sequence
  X-linked inhibitor of apoptosis (XIAP) siRNA
taccgttaggatgattaagatgt

SEQ ID NO: 13281 - DNA, 23 bp, Artificial Sequence
  X-linked inhibitor of apoptosis (XIAP) siRNA
accgttaggatgattaagatgta

SEQ ID NO: 13282 - DNA, 23 bp, Artificial Sequence
  X-linked inhibitor of apoptosis (XIAP) siRNA
ccgttaggatgattaagatgtat

SEQ ID NO: 13283 - DNA, 23 bp, Artificial Sequence
  X-linked inhibitor of apoptosis (XIAP) siRNA
cgttaggatgattaagatgtata

SEQ ID NO: 13284 - DNA, 23 bp, Artificial Sequence
  X-linked inhibitor of apoptosis (XIAP) siRNA
gttaggatgattaagatgtatat

SEQ ID NO: 13285 - DNA, 23 bp, Artificial Sequence
  X-linked inhibitor of apoptosis (XIAP) siRNA
ttaggatgattaagatgtatata

SEQ ID NO: 13286 - DNA, 23 bp, Artificial Sequence
  X-linked inhibitor of apoptosis (XIAP) siRNA
taggatgattaagatgtatatag

SEQ ID NO: 13287 - DNA, 23 bp, Artificial Sequence
  X-linked inhibitor of apoptosis (XIAP) siRNA
aggatgattaagatgtatatagg

SEQ ID NO: 13288 - DNA, 23 bp, Artificial Sequence
  X-linked inhibitor of apoptosis (XIAP) siRNA
ggatgattaagatgtatatagga

SEQ ID NO: 13289 - DNA, 23 bp, Artificial Sequence
  X-linked inhibitor of apoptosis (XIAP) siRNA
gatgattaagatgtatataggac

SEQ ID NO: 13290 - DNA, 23 bp, Artificial Sequence
  X-linked inhibitor of apoptosis (XIAP) siRNA
atgattaagatgtatataggaca

SEQ ID NO: 13291 - DNA, 23 bp, Artificial Sequence
  X-linked inhibitor of apoptosis (XIAP) siRNA
tgattaagatgtatataggacaa

SEQ ID NO: 13292 - DNA, 23 bp, Artificial Sequence
  X-linked inhibitor of apoptosis (XIAP) siRNA
gattaagatgtatataggacaaa

SEQ ID NO: 13293 - DNA, 23 bp, Artificial Sequence
  X-linked inhibitor of apoptosis (XIAP) siRNA
attaagatgtatataggacaaaa

SEQ ID NO: 13294 - DNA, 23 bp, Artificial Sequence
  X-linked inhibitor of apoptosis (XIAP) siRNA
ttaagatgtatataggacaaaat

SEQ ID NO: 13295 - DNA, 23 bp, Artificial Sequence
  X-linked inhibitor of apoptosis (XIAP) siRNA
taagatgtatataggacaaaatg

SEQ ID NO: 13296 - DNA, 23 bp, Artificial Sequence
  X-linked inhibitor of apoptosis (XIAP) siRNA
aagatgtatataggacaaaatgt

SEQ ID NO: 13297 - DNA, 23 bp, Artificial Sequence
  X-linked inhibitor of apoptosis (XIAP) siRNA
agatgtatataggacaaaatgtt

SEQ ID NO: 13298 - DNA, 23 bp, Artificial Sequence
  X-linked inhibitor of apoptosis (XIAP) siRNA
gatgtatataggacaaaatgtta

SEQ ID NO: 13299 - DNA, 23 bp, Artificial Sequence
  X-linked inhibitor of apoptosis (XIAP) siRNA
atgtatataggacaaaatgttaa

SEQ ID NO: 13300 - DNA, 23 bp, Artificial Sequence
  X-linked inhibitor of apoptosis (XIAP) siRNA
tgtatataggacaaaatgttaag

SEQ ID NO: 13301 - DNA, 23 bp, Artificial Sequence
  X-linked inhibitor of apoptosis (XIAP) siRNA
gtatataggacaaaatgttaagt

SEQ ID NO: 13302 - DNA, 23 bp, Artificial Sequence
  X-linked inhibitor of apoptosis (XIAP) siRNA
tatataggacaaaatgttaagtc

SEQ ID NO: 13303 - DNA, 23 bp, Artificial Sequence
  X-linked inhibitor of apoptosis (XIAP) siRNA
atataggacaaaatgttaagtct

SEQ ID NO: 13304 - DNA, 23 bp, Artificial Sequence
  X-linked inhibitor of apoptosis (XIAP) siRNA
tataggacaaaatgttaagtctt

SEQ ID NO: 13305 - DNA, 23 bp, Artificial Sequence
  X-linked inhibitor of apoptosis (XIAP) siRNA
ataggacaaaatgttaagtcttt

SEQ ID NO: 13306 - DNA, 23 bp, Artificial Sequence
  X-linked inhibitor of apoptosis (XIAP) siRNA
taggacaaaatgttaagtctttc

SEQ ID NO: 13307 - DNA, 23 bp, Artificial Sequence
  X-linked inhibitor of apoptosis (XIAP) siRNA
aggacaaaatgttaagtctttcc

SEQ ID NO: 13308 - DNA, 23 bp, Artificial Sequence
  X-linked inhibitor of apoptosis (XIAP) siRNA
ggacaaaatgttaagtctttcct

SEQ ID NO: 13309 - DNA, 23 bp, Artificial Sequence
  X-linked inhibitor of apoptosis (XIAP) siRNA
gacaaaatgttaagtctttcctc

SEQ ID NO: 13310 - DNA, 23 bp, Artificial Sequence
  X-linked inhibitor of apoptosis (XIAP) siRNA
acaaaatgttaagtctttcctct

SEQ ID NO: 13311 - DNA, 23 bp, Artificial Sequence
  X-linked inhibitor of apoptosis (XIAP) siRNA
caaaatgttaagtctttcctcta

SEQ ID NO: 13312 - DNA, 23 bp, Artificial Sequence
  X-linked inhibitor of apoptosis (XIAP) siRNA
aaaatgttaagtctttcctctac

SEQ ID NO: 13313 - DNA, 23 bp, Artificial Sequence
  X-linked inhibitor of apoptosis (XIAP) siRNA
aaatgttaagtctttcctctacc

SEQ ID NO: 13314 - DNA, 23 bp, Artificial Sequence
  X-linked inhibitor of apoptosis (XIAP) siRNA
aatgttaagtctttcctctacct

SEQ ID NO: 13315 - DNA, 23 bp, Artificial Sequence
  X-linked inhibitor of apoptosis (XIAP) siRNA
atgttaagtctttcctctaccta

SEQ ID NO: 13316 - DNA, 23 bp, Artificial Sequence
  X-linked inhibitor of apoptosis (XIAP) siRNA
tgttaagtctttcctctacctac

SEQ ID NO: 13317 - DNA, 23 bp, Artificial Sequence
  X-linked inhibitor of apoptosis (XIAP) siRNA
gttaagtctttcctctacctaca

SEQ ID NO: 13318 - DNA, 23 bp, Artificial Sequence
  X-linked inhibitor of apoptosis (XIAP) siRNA
ttaagtctttcctctacctacat

SEQ ID NO: 13319 - DNA, 23 bp, Artificial Sequence
  X-linked inhibitor of apoptosis (XIAP) siRNA
taagtctttcctctacctacatt

SEQ ID NO: 13320 - DNA, 23 bp, Artificial Sequence
  X-linked inhibitor of apoptosis (XIAP) siRNA
aagtctttcctctacctacattt

SEQ ID NO: 13321 - DNA, 23 bp, Artificial Sequence
  X-linked inhibitor of apoptosis (XIAP) siRNA
agtctttcctctacctacatttg

SEQ ID NO: 13322 - DNA, 23 bp, Artificial Sequence
  X-linked inhibitor of apoptosis (XIAP) siRNA
gtctttcctctacctacatttgt

SEQ ID NO: 13323 - DNA, 23 bp, Artificial Sequence
  X-linked inhibitor of apoptosis (XIAP) siRNA
tctttcctctacctacatttgtt

SEQ ID NO: 13324 - DNA, 23 bp, Artificial Sequence
  X-linked inhibitor of apoptosis (XIAP) siRNA
ctttcctctacctacatttgttt

SEQ ID NO: 13325 - DNA, 23 bp, Artificial Sequence
  X-linked inhibitor of apoptosis (XIAP) siRNA
tttcctctacctacatttgtttt

SEQ ID NO: 13326 - DNA, 23 bp, Artificial Sequence
  X-linked inhibitor of apoptosis (XIAP) siRNA
ttcctctacctacatttgttttc

SEQ ID NO: 13327 - DNA, 23 bp, Artificial Sequence
  X-linked inhibitor of apoptosis (XIAP) siRNA
tcctctacctacatttgttttct

SEQ ID NO: 13328 - DNA, 23 bp, Artificial Sequence
  X-linked inhibitor of apoptosis (XIAP) siRNA
cctctacctacatttgttttctt

SEQ ID NO: 13329 - DNA, 23 bp, Artificial Sequence
  X-linked inhibitor of apoptosis (XIAP) siRNA
ctctacctacatttgttttcttg

SEQ ID NO: 13330 - DNA, 23 bp, Artificial Sequence
  X-linked inhibitor of apoptosis (XIAP) siRNA
tctacctacatttgttttcttgg

SEQ ID NO: 13331 - DNA, 23 bp, Artificial Sequence
  X-linked inhibitor of apoptosis (XIAP) siRNA
ctacctacatttgttttcttggc

SEQ ID NO: 13332 - DNA, 23 bp, Artificial Sequence
  X-linked inhibitor of apoptosis (XIAP) siRNA
tacctacatttgttttcttggct

SEQ ID NO: 13333 - DNA, 23 bp, Artificial Sequence
  X-linked inhibitor of apoptosis (XIAP) siRNA
acctacatttgttttcttggcta

SEQ ID NO: 13334 - DNA, 23 bp, Artificial Sequence
  X-linked inhibitor of apoptosis (XIAP) siRNA
cctacatttgttttcttggctag

SEQ ID NO: 13335 - DNA, 23 bp, Artificial Sequence
  X-linked inhibitor of apoptosis (XIAP) siRNA
ctacatttgttttcttggctagt

SEQ ID NO: 13336 - DNA, 23 bp, Artificial Sequence
  X-linked inhibitor of apoptosis (XIAP) siRNA
tacatttgttttcttggctagta

SEQ ID NO: 13337 - DNA, 23 bp, Artificial Sequence
  X-linked inhibitor of apoptosis (XIAP) siRNA
acatttgttttcttggctagtaa

SEQ ID NO: 13338 - DNA, 23 bp, Artificial Sequence
  X-linked inhibitor of apoptosis (XIAP) siRNA
catttgttttcttggctagtaat

SEQ ID NO: 13339 - DNA, 23 bp, Artificial Sequence
  X-linked inhibitor of apoptosis (XIAP) siRNA
atttgttttcttggctagtaata

SEQ ID NO: 13340 - DNA, 23 bp, Artificial Sequence
  X-linked inhibitor of apoptosis (XIAP) siRNA
tttgttttcttggctagtaatag

SEQ ID NO: 13341 - DNA, 23 bp, Artificial Sequence
  X-linked inhibitor of apoptosis (XIAP) siRNA
ttgttttcttggctagtaatagt

SEQ ID NO: 13342 - DNA, 23 bp, Artificial Sequence
  X-linked inhibitor of apoptosis (XIAP) siRNA
tgttttcttggctagtaatagta

SEQ ID NO: 13343 - DNA, 23 bp, Artificial Sequence
  X-linked inhibitor of apoptosis (XIAP) siRNA
gttttcttggctagtaatagtag

SEQ ID NO: 13344 - DNA, 23 bp, Artificial Sequence
  X-linked inhibitor of apoptosis (XIAP) siRNA
ttttcttggctagtaatagtagt

SEQ ID NO: 13345 - DNA, 23 bp, Artificial Sequence
  X-linked inhibitor of apoptosis (XIAP) siRNA
tttcttggctagtaatagtagta

SEQ ID NO: 13346 - DNA, 23 bp, Artificial Sequence
  X-linked inhibitor of apoptosis (XIAP) siRNA
ttcttggctagtaatagtagtag

SEQ ID NO: 13347 - DNA, 23 bp, Artificial Sequence
  X-linked inhibitor of apoptosis (XIAP) siRNA
tcttggctagtaatagtagtaga

SEQ ID NO: 13348 - DNA, 23 bp, Artificial Sequence
  X-linked inhibitor of apoptosis (XIAP) siRNA
cttggctagtaatagtagtagat

SEQ ID NO: 13349 - DNA, 23 bp, Artificial Sequence
  X-linked inhibitor of apoptosis (XIAP) siRNA
ttggctagtaatagtagtagata

SEQ ID NO: 13350 - DNA, 23 bp, Artificial Sequence
  X-linked inhibitor of apoptosis (XIAP) siRNA
tggctagtaatagtagtagatac

SEQ ID NO: 13351 - DNA, 23 bp, Artificial Sequence
  X-linked inhibitor of apoptosis (XIAP) siRNA
ggctagtaatagtagtagatact

SEQ ID NO: 13352 - DNA, 23 bp, Artificial Sequence
  X-linked inhibitor of apoptosis (XIAP) siRNA
gctagtaatagtagtagatactt

SEQ ID NO: 13353 - DNA, 23 bp, Artificial Sequence
  X-linked inhibitor of apoptosis (XIAP) siRNA
ctagtaatagtagtagatacttc

SEQ ID NO: 13354 - DNA, 23 bp, Artificial Sequence
  X-linked inhibitor of apoptosis (XIAP) siRNA
tagtaatagtagtagatacttct

SEQ ID NO: 13355 - DNA, 23 bp, Artificial Sequence
  X-linked inhibitor of apoptosis (XIAP) siRNA
agtaatagtagtagatacttctg

SEQ ID NO: 13356 - DNA, 23 bp, Artificial Sequence
  X-linked inhibitor of apoptosis (XIAP) siRNA
gtaatagtagtagatacttctga

SEQ ID NO: 13357 - DNA, 23 bp, Artificial Sequence
  X-linked inhibitor of apoptosis (XIAP) siRNA
taatagtagtagatacttctgaa

SEQ ID NO: 13358 - DNA, 23 bp, Artificial Sequence
  X-linked inhibitor of apoptosis (XIAP) siRNA
aatagtagtagatacttctgaaa

SEQ ID NO: 13359 - DNA, 23 bp, Artificial Sequence
  X-linked inhibitor of apoptosis (XIAP) siRNA
atagtagtagatacttctgaaat

SEQ ID NO: 13360 - DNA, 23 bp, Artificial Sequence
  X-linked inhibitor of apoptosis (XIAP) siRNA
tagtagtagatacttctgaaata

SEQ ID NO: 13361 - DNA, 23 bp, Artificial Sequence
  X-linked inhibitor of apoptosis (XIAP) siRNA
agtagtagatacttctgaaataa

SEQ ID NO: 13362 - DNA, 23 bp, Artificial Sequence
  X-linked inhibitor of apoptosis (XIAP) siRNA
gtagtagatacttctgaaataaa

SEQ ID NO: 13363 - DNA, 23 bp, Artificial Sequence
  X-linked inhibitor of apoptosis (XIAP) siRNA
tagtagatacttctgaaataaat

SEQ ID NO: 13364 - DNA, 23 bp, Artificial Sequence
  X-linked inhibitor of apoptosis (XIAP) siRNA
agtagatacttctgaaataaatg

SEQ ID NO: 13365 - DNA, 23 bp, Artificial Sequence
  X-linked inhibitor of apoptosis (XIAP) siRNA
gtagatacttctgaaataaatgt

SEQ ID NO: 13366 - DNA, 23 bp, Artificial Sequence
  X-linked inhibitor of apoptosis (XIAP) siRNA
tagatacttctgaaataaatgtt

SEQ ID NO: 13367 - DNA, 23 bp, Artificial Sequence
  X-linked inhibitor of apoptosis (XIAP) siRNA
agatacttctgaaataaatgttc

SEQ ID NO: 13368 - DNA, 23 bp, Artificial Sequence
  X-linked inhibitor of apoptosis (XIAP) siRNA
gatacttctgaaataaatgttct

SEQ ID NO: 13369 - DNA, 23 bp, Artificial Sequence
  X-linked inhibitor of apoptosis (XIAP) siRNA
atacttctgaaataaatgttctc

SEQ ID NO: 13370 - DNA, 23 bp, Artificial Sequence
  X-linked inhibitor of apoptosis (XIAP) siRNA
tacttctgaaataaatgttctct

SEQ ID NO: 13371 - DNA, 23 bp, Artificial Sequence
  X-linked inhibitor of apoptosis (XIAP) siRNA
acttctgaaataaatgttctctc

SEQ ID NO: 13372 - DNA, 23 bp, Artificial Sequence
  X-linked inhibitor of apoptosis (XIAP) siRNA
cttctgaaataaatgttctctca

SEQ ID NO: 13373 - DNA, 23 bp, Artificial Sequence
  X-linked inhibitor of apoptosis (XIAP) siRNA
ttctgaaataaatgttctctcaa

SEQ ID NO: 13374 - DNA, 23 bp, Artificial Sequence
  X-linked inhibitor of apoptosis (XIAP) siRNA
tctgaaataaatgttctctcaag

SEQ ID NO: 13375 - DNA, 23 bp, Artificial Sequence
  X-linked inhibitor of apoptosis (XIAP) siRNA
ctgaaataaatgttctctcaaga

SEQ ID NO: 13376 - DNA, 23 bp, Artificial Sequence
  X-linked inhibitor of apoptosis (XIAP) siRNA
tgaaataaatgttctctcaagat

SEQ ID NO: 13377 - DNA, 23 bp, Artificial Sequence
  X-linked inhibitor of apoptosis (XIAP) siRNA
gaaataaatgttctctcaagatc

SEQ ID NO: 13378 - DNA, 23 bp, Artificial Sequence
  X-linked inhibitor of apoptosis (XIAP) siRNA
aaataaatgttctctcaagatcc

SEQ ID NO: 13379 - DNA, 23 bp, Artificial Sequence
  X-linked inhibitor of apoptosis (XIAP) siRNA
aataaatgttctctcaagatcct

SEQ ID NO: 13380 - DNA, 23 bp, Artificial Sequence
  X-linked inhibitor of apoptosis (XIAP) siRNA
ataaatgttctctcaagatcctt

SEQ ID NO: 13381 - DNA, 23 bp, Artificial Sequence
  X-linked inhibitor of apoptosis (XIAP) siRNA
taaatgttctctcaagatcctta

SEQ ID NO: 13382 - DNA, 23 bp, Artificial Sequence
  X-linked inhibitor of apoptosis (XIAP) siRNA
aaatgttctctcaagatccttaa

SEQ ID NO: 13383 - DNA, 23 bp, Artificial Sequence
  X-linked inhibitor of apoptosis (XIAP) siRNA
aatgttctctcaagatccttaaa

SEQ ID NO: 13384 - DNA, 23 bp, Artificial Sequence
  X-linked inhibitor of apoptosis (XIAP) siRNA
atgttctctcaagatccttaaaa

SEQ ID NO: 13385 - DNA, 23 bp, Artificial Sequence
  X-linked inhibitor of apoptosis (XIAP) siRNA
tgttctctcaagatccttaaaac

SEQ ID NO: 13386 - DNA, 23 bp, Artificial Sequence
  X-linked inhibitor of apoptosis (XIAP) siRNA
gttctctcaagatccttaaaacc

SEQ ID NO: 13387 - DNA, 23 bp, Artificial Sequence
  X-linked inhibitor of apoptosis (XIAP) siRNA
ttctctcaagatccttaaaacct

SEQ ID NO: 13388 - DNA, 23 bp, Artificial Sequence
  X-linked inhibitor of apoptosis (XIAP) siRNA
tctctcaagatccttaaaacctc

SEQ ID NO: 13389 - DNA, 23 bp, Artificial Sequence
  X-linked inhibitor of apoptosis (XIAP) siRNA
ctctcaagatccttaaaacctct

SEQ ID NO: 13390 - DNA, 23 bp, Artificial Sequence
  X-linked inhibitor of apoptosis (XIAP) siRNA
tctcaagatccttaaaacctctt

SEQ ID NO: 13391 - DNA, 23 bp, Artificial Sequence
  X-linked inhibitor of apoptosis (XIAP) siRNA
ctcaagatccttaaaacctcttg

SEQ ID NO: 13392 - DNA, 23 bp, Artificial Sequence
  X-linked inhibitor of apoptosis (XIAP) siRNA
tcaagatccttaaaacctcttgg

SEQ ID NO: 13393 - DNA, 23 bp, Artificial Sequence
  X-linked inhibitor of apoptosis (XIAP) siRNA
caagatccttaaaacctcttgga

SEQ ID NO: 13394 - DNA, 23 bp, Artificial Sequence
  X-linked inhibitor of apoptosis (XIAP) siRNA
aagatccttaaaacctcttggaa

SEQ ID NO: 13395 - DNA, 23 bp, Artificial Sequence
  X-linked inhibitor of apoptosis (XIAP) siRNA
agatccttaaaacctcttggaaa

SEQ ID NO: 13396 - DNA, 23 bp, Artificial Sequence
  X-linked inhibitor of apoptosis (XIAP) siRNA
gatccttaaaacctcttggaaat

SEQ ID NO: 13397 - DNA, 23 bp, Artificial Sequence
  X-linked inhibitor of apoptosis (XIAP) siRNA
atccttaaaacctcttggaaatt

SEQ ID NO: 13398 - DNA, 23 bp, Artificial Sequence
  X-linked inhibitor of apoptosis (XIAP) siRNA
tccttaaaacctcttggaaatta

SEQ ID NO: 13399 - DNA, 23 bp, Artificial Sequence
  X-linked inhibitor of apoptosis (XIAP) siRNA
ccttaaaacctcttggaaattat

SEQ ID NO: 13400 - DNA, 23 bp, Artificial Sequence
  X-linked inhibitor of apoptosis (XIAP) siRNA
cttaaaacctcttggaaattata

SEQ ID NO: 13401 - DNA, 23 bp, Artificial Sequence
  X-linked inhibitor of apoptosis (XIAP) siRNA
ttaaaacctcttggaaattataa

SEQ ID NO: 13402 - DNA, 23 bp, Artificial Sequence
  X-linked inhibitor of apoptosis (XIAP) siRNA
taaaacctcttggaaattataaa

SEQ ID NO: 13403 - DNA, 23 bp, Artificial Sequence
  X-linked inhibitor of apoptosis (XIAP) siRNA
aaaacctcttggaaattataaaa

SEQ ID NO: 13404 - DNA, 23 bp, Artificial Sequence
  X-linked inhibitor of apoptosis (XIAP) siRNA
aaacctcttggaaattataaaaa

SEQ ID NO: 13405 - DNA, 23 bp, Artificial Sequence
  X-linked inhibitor of apoptosis (XIAP) siRNA
aacctcttggaaattataaaaat

SEQ ID NO: 13406 - DNA, 23 bp, Artificial Sequence
  X-linked inhibitor of apoptosis (XIAP) siRNA
acctcttggaaattataaaaata

SEQ ID NO: 13407 - DNA, 23 bp, Artificial Sequence
  X-linked inhibitor of apoptosis (XIAP) siRNA
cctcttggaaattataaaaatat

SEQ ID NO: 13408 - DNA, 23 bp, Artificial Sequence
  X-linked inhibitor of apoptosis (XIAP) siRNA
ctcttggaaattataaaaatatt

SEQ ID NO: 13409 - DNA, 23 bp, Artificial Sequence
  X-linked inhibitor of apoptosis (XIAP) siRNA
tcttggaaattataaaaatattg

SEQ ID NO: 13410 - DNA, 23 bp, Artificial Sequence
  X-linked inhibitor of apoptosis (XIAP) siRNA
cttggaaattataaaaatattgg

SEQ ID NO: 13411 - DNA, 23 bp, Artificial Sequence
  X-linked inhibitor of apoptosis (XIAP) siRNA
ttggaaattataaaaatattggc

SEQ ID NO: 13412 - DNA, 23 bp, Artificial Sequence
  X-linked inhibitor of apoptosis (XIAP) siRNA
tggaaattataaaaatattggca

SEQ ID NO: 13413 - DNA, 23 bp, Artificial Sequence
  X-linked inhibitor of apoptosis (XIAP) siRNA
ggaaattataaaaatattggcaa

SEQ ID NO: 13414 - DNA, 23 bp, Artificial Sequence
  X-linked inhibitor of apoptosis (XIAP) siRNA
gaaattataaaaatattggcaag

SEQ ID NO: 13415 - DNA, 23 bp, Artificial Sequence
  X-linked inhibitor of apoptosis (XIAP) siRNA
aaattataaaaatattggcaaga

SEQ ID NO: 13416 - DNA, 23 bp, Artificial Sequence
  X-linked inhibitor of apoptosis (XIAP) siRNA
aattataaaaatattggcaagaa

SEQ ID NO: 13417 - DNA, 23 bp, Artificial Sequence
  X-linked inhibitor of apoptosis (XIAP) siRNA
attataaaaatattggcaagaaa

SEQ ID NO: 13418 - DNA, 23 bp, Artificial Sequence
  X-linked inhibitor of apoptosis (XIAP) siRNA
ttataaaaatattggcaagaaaa

SEQ ID NO: 13419 - DNA, 23 bp, Artificial Sequence
  X-linked inhibitor of apoptosis (XIAP) siRNA
tataaaaatattggcaagaaaag

SEQ ID NO: 13420 - DNA, 23 bp, Artificial Sequence
  X-linked inhibitor of apoptosis (XIAP) siRNA
ataaaaatattggcaagaaaaga

SEQ ID NO: 13421 - DNA, 23 bp, Artificial Sequence
  X-linked inhibitor of apoptosis (XIAP) siRNA
taaaaatattggcaagaaaagaa

SEQ ID NO: 13422 - DNA, 23 bp, Artificial Sequence
  X-linked inhibitor of apoptosis (XIAP) siRNA
aaaaatattggcaagaaaagaag

SEQ ID NO: 13423 - DNA, 23 bp, Artificial Sequence
  X-linked inhibitor of apoptosis (XIAP) siRNA
aaaatattggcaagaaaagaaga

SEQ ID NO: 13424 - DNA, 23 bp, Artificial Sequence
  X-linked inhibitor of apoptosis (XIAP) siRNA
aaatattggcaagaaaagaagaa

SEQ ID NO: 13425 - DNA, 23 bp, Artificial Sequence
  X-linked inhibitor of apoptosis (XIAP) siRNA
aatattggcaagaaaagaagaat

SEQ ID NO: 13426 - DNA, 23 bp, Artificial Sequence
  X-linked inhibitor of apoptosis (XIAP) siRNA
atattggcaagaaaagaagaata

SEQ ID NO: 13427 - DNA, 23 bp, Artificial Sequence
  X-linked inhibitor of apoptosis (XIAP) siRNA
tattggcaagaaaagaagaatag

SEQ ID NO: 13428 - DNA, 23 bp, Artificial Sequence
  X-linked inhibitor of apoptosis (XIAP) siRNA
attggcaagaaaagaagaatagt

SEQ ID NO: 13429 - DNA, 23 bp, Artificial Sequence
  X-linked inhibitor of apoptosis (XIAP) siRNA
ttggcaagaaaagaagaatagtt

SEQ ID NO: 13430 - DNA, 23 bp, Artificial Sequence
  X-linked inhibitor of apoptosis (XIAP) siRNA
tggcaagaaaagaagaatagttg

SEQ ID NO: 13431 - DNA, 23 bp, Artificial Sequence
  X-linked inhibitor of apoptosis (XIAP) siRNA
ggcaagaaaagaagaatagttgt

SEQ ID NO: 13432 - DNA, 23 bp, Artificial Sequence
  X-linked inhibitor of apoptosis (XIAP) siRNA
gcaagaaaagaagaatagttgtt

SEQ ID NO: 13433 - DNA, 23 bp, Artificial Sequence
  X-linked inhibitor of apoptosis (XIAP) siRNA
caagaaaagaagaatagttgttt

SEQ ID NO: 13434 - DNA, 23 bp, Artificial Sequence
  X-linked inhibitor of apoptosis (XIAP) siRNA
aagaaaagaagaatagttgttta

SEQ ID NO: 13435 - DNA, 23 bp, Artificial Sequence
  X-linked inhibitor of apoptosis (XIAP) siRNA
agaaaagaagaatagttgtttaa

SEQ ID NO: 13436 - DNA, 23 bp, Artificial Sequence
  X-linked inhibitor of apoptosis (XIAP) siRNA
gaaaagaagaatagttgtttaaa

SEQ ID NO: 13437 - DNA, 23 bp, Artificial Sequence
  X-linked inhibitor of apoptosis (XIAP) siRNA
aaaagaagaatagttgtttaaat

SEQ ID NO: 13438 - DNA, 23 bp, Artificial Sequence
  X-linked inhibitor of apoptosis (XIAP) siRNA
aaagaagaatagttgtttaaata

SEQ ID NO: 13439 - DNA, 23 bp, Artificial Sequence
  X-linked inhibitor of apoptosis (XIAP) siRNA
aagaagaatagttgtttaaatat

SEQ ID NO: 13440 - DNA, 23 bp, Artificial Sequence
  X-linked inhibitor of apoptosis (XIAP) siRNA
agaagaatagttgtttaaatatt

SEQ ID NO: 13441 - DNA, 23 bp, Artificial Sequence
  X-linked inhibitor of apoptosis (XIAP) siRNA
gaagaatagttgtttaaatattt

SEQ ID NO: 13442 - DNA, 23 bp, Artificial Sequence
  X-linked inhibitor of apoptosis (XIAP) siRNA
aagaatagttgtttaaatatttt

SEQ ID NO: 13443 - DNA, 23 bp, Artificial Sequence
  X-linked inhibitor of apoptosis (XIAP) siRNA
agaatagttgtttaaatattttt

SEQ ID NO: 13444 - DNA, 23 bp, Artificial Sequence
  X-linked inhibitor of apoptosis (XIAP) siRNA
gaatagttgtttaaatatttttt

SEQ ID NO: 13445 - DNA, 23 bp, Artificial Sequence
  X-linked inhibitor of apoptosis (XIAP) siRNA
aatagttgtttaaatatttttta

SEQ ID NO: 13446 - DNA, 23 bp, Artificial Sequence
  X-linked inhibitor of apoptosis (XIAP) siRNA
atagttgtttaaatattttttaa

SEQ ID NO: 13447 - DNA, 23 bp, Artificial Sequence
  X-linked inhibitor of apoptosis (XIAP) siRNA
tagttgtttaaatattttttaaa

SEQ ID NO: 13448 - DNA, 23 bp, Artificial Sequence
  X-linked inhibitor of apoptosis (XIAP) siRNA
agttgtttaaatattttttaaaa

SEQ ID NO: 13449 - DNA, 23 bp, Artificial Sequence
  X-linked inhibitor of apoptosis (XIAP) siRNA
gttgtttaaatattttttaaaaa

SEQ ID NO: 13450 - DNA, 23 bp, Artificial Sequence
  X-linked inhibitor of apoptosis (XIAP) siRNA
ttgtttaaatattttttaaaaaa

SEQ ID NO: 13451 - DNA, 23 bp, Artificial Sequence
  X-linked inhibitor of apoptosis (XIAP) siRNA
tgtttaaatattttttaaaaaac

SEQ ID NO: 13452 - DNA, 23 bp, Artificial Sequence
  X-linked inhibitor of apoptosis (XIAP) siRNA
gtttaaatattttttaaaaaaca

SEQ ID NO: 13453 - DNA, 23 bp, Artificial Sequence
  X-linked inhibitor of apoptosis (XIAP) siRNA
tttaaatattttttaaaaaacac

SEQ ID NO: 13454 - DNA, 23 bp, Artificial Sequence
  X-linked inhibitor of apoptosis (XIAP) siRNA
ttaaatattttttaaaaaacact

SEQ ID NO: 13455 - DNA, 23 bp, Artificial Sequence
  X-linked inhibitor of apoptosis (XIAP) siRNA
taaatattttttaaaaaacactt

SEQ ID NO: 13456 - DNA, 23 bp, Artificial Sequence
  X-linked inhibitor of apoptosis (XIAP) siRNA
aaatattttttaaaaaacacttg

SEQ ID NO: 13457 - DNA, 23 bp, Artificial Sequence
  X-linked inhibitor of apoptosis (XIAP) siRNA
aatattttttaaaaaacacttga

SEQ ID NO: 13458 - DNA, 23 bp, Artificial Sequence
  X-linked inhibitor of apoptosis (XIAP) siRNA
atattttttaaaaaacacttgaa

SEQ ID NO: 13459 - DNA, 23 bp, Artificial Sequence
  X-linked inhibitor of apoptosis (XIAP) siRNA
tattttttaaaaaacacttgaat

SEQ ID NO: 13460 - DNA, 23 bp, Artificial Sequence
  X-linked inhibitor of apoptosis (XIAP) siRNA
attttttaaaaaacacttgaata

SEQ ID NO: 13461 - DNA, 23 bp, Artificial Sequence
  X-linked inhibitor of apoptosis (XIAP) siRNA
ttttttaaaaaacacttgaataa

SEQ ID NO: 13462 - DNA, 23 bp, Artificial Sequence
  X-linked inhibitor of apoptosis (XIAP) siRNA
tttttaaaaaacacttgaataag

SEQ ID NO: 13463 - DNA, 23 bp, Artificial Sequence
  X-linked inhibitor of apoptosis (XIAP) siRNA
ttttaaaaaacacttgaataaga

SEQ ID NO: 13464 - DNA, 23 bp, Artificial Sequence
  X-linked inhibitor of apoptosis (XIAP) siRNA
tttaaaaaacacttgaataagaa

SEQ ID NO: 13465 - DNA, 23 bp, Artificial Sequence
  X-linked inhibitor of apoptosis (XIAP) siRNA
ttaaaaaacacttgaataagaat

SEQ ID NO: 13466 - DNA, 23 bp, Artificial Sequence
  X-linked inhibitor of apoptosis (XIAP) siRNA
taaaaaacacttgaataagaatc

SEQ ID NO: 13467 - DNA, 23 bp, Artificial Sequence
  X-linked inhibitor of apoptosis (XIAP) siRNA
aaaaaacacttgaataagaatca

SEQ ID NO: 13468 - DNA, 23 bp, Artificial Sequence
  X-linked inhibitor of apoptosis (XIAP) siRNA
aaaaacacttgaataagaatcag

SEQ ID NO: 13469 - DNA, 23 bp, Artificial Sequence
  X-linked inhibitor of apoptosis (XIAP) siRNA
aaaacacttgaataagaatcagt

SEQ ID NO: 13470 - DNA, 23 bp, Artificial Sequence
  X-linked inhibitor of apoptosis (XIAP) siRNA
aaacacttgaataagaatcagta

SEQ ID NO: 13471 - DNA, 23 bp, Artificial Sequence
  X-linked inhibitor of apoptosis (XIAP) siRNA
aacacttgaataagaatcagtag

SEQ ID NO: 13472 - DNA, 23 bp, Artificial Sequence
  X-linked inhibitor of apoptosis (XIAP) siRNA
acacttgaataagaatcagtagg

SEQ ID NO: 13473 - DNA, 23 bp, Artificial Sequence
  X-linked inhibitor of apoptosis (XIAP) siRNA
cacttgaataagaatcagtaggg

SEQ ID NO: 13474 - DNA, 23 bp, Artificial Sequence
  X-linked inhibitor of apoptosis (XIAP) siRNA
acttgaataagaatcagtagggt

SEQ ID NO: 13475 - DNA, 23 bp, Artificial Sequence
  X-linked inhibitor of apoptosis (XIAP) siRNA
cttgaataagaatcagtagggta

SEQ ID NO: 13476 - DNA, 23 bp, Artificial Sequence
  X-linked inhibitor of apoptosis (XIAP) siRNA
ttgaataagaatcagtagggtat

SEQ ID NO: 13477 - DNA, 23 bp, Artificial Sequence
  X-linked inhibitor of apoptosis (XIAP) siRNA
tgaataagaatcagtagggtata

SEQ ID NO: 13478 - DNA, 23 bp, Artificial Sequence
  X-linked inhibitor of apoptosis (XIAP) siRNA
gaataagaatcagtagggtataa

SEQ ID NO: 13479 - DNA, 23 bp, Artificial Sequence
  X-linked inhibitor of apoptosis (XIAP) siRNA
aataagaatcagtagggtataaa

SEQ ID NO: 13480 - DNA, 23 bp, Artificial Sequence
  X-linked inhibitor of apoptosis (XIAP) siRNA
ataagaatcagtagggtataaac

SEQ ID NO: 13481 - DNA, 23 bp, Artificial Sequence
  X-linked inhibitor of apoptosis (XIAP) siRNA
taagaatcagtagggtataaact

SEQ ID NO: 13482 - DNA, 23 bp, Artificial Sequence
  X-linked inhibitor of apoptosis (XIAP) siRNA
aagaatcagtagggtataaacta

SEQ ID NO: 13483 - DNA, 23 bp, Artificial Sequence
  X-linked inhibitor of apoptosis (XIAP) siRNA
agaatcagtagggtataaactag

SEQ ID NO: 13484 - DNA, 23 bp, Artificial Sequence
  X-linked inhibitor of apoptosis (XIAP) siRNA
gaatcagtagggtataaactaga

SEQ ID NO: 13485 - DNA, 23 bp, Artificial Sequence
  X-linked inhibitor of apoptosis (XIAP) siRNA
aatcagtagggtataaactagaa

SEQ ID NO: 13486 - DNA, 23 bp, Artificial Sequence
  X-linked inhibitor of apoptosis (XIAP) siRNA
atcagtagggtataaactagaag

SEQ ID NO: 13487 - DNA, 23 bp, Artificial Sequence
  X-linked inhibitor of apoptosis (XIAP) siRNA
tcagtagggtataaactagaagt

SEQ ID NO: 13488 - DNA, 23 bp, Artificial Sequence
  X-linked inhibitor of apoptosis (XIAP) siRNA
cagtagggtataaactagaagtt

SEQ ID NO: 13489 - DNA, 23 bp, Artificial Sequence
  X-linked inhibitor of apoptosis (XIAP) siRNA
agtagggtataaactagaagttt

SEQ ID NO: 13490 - DNA, 23 bp, Artificial Sequence
  X-linked inhibitor of apoptosis (XIAP) siRNA
gtagggtataaactagaagttta

SEQ ID NO: 13491 - DNA, 23 bp, Artificial Sequence
  X-linked inhibitor of apoptosis (XIAP) siRNA
tagggtataaactagaagtttaa

SEQ ID NO: 13492 - DNA, 23 bp, Artificial Sequence
  X-linked inhibitor of apoptosis (XIAP) siRNA
agggtataaactagaagtttaaa

SEQ ID NO: 13493 - DNA, 23 bp, Artificial Sequence
  X-linked inhibitor of apoptosis (XIAP) siRNA
gggtataaactagaagtttaaaa

SEQ ID NO: 13494 - DNA, 23 bp, Artificial Sequence
  X-linked inhibitor of apoptosis (XIAP) siRNA
ggtataaactagaagtttaaaaa

SEQ ID NO: 13495 - DNA, 23 bp, Artificial Sequence
  X-linked inhibitor of apoptosis (XIAP) siRNA
gtataaactagaagtttaaaaat

SEQ ID NO: 13496 - DNA, 23 bp, Artificial Sequence
  X-linked inhibitor of apoptosis (XIAP) siRNA
tataaactagaagtttaaaaatg

SEQ ID NO: 13497 - DNA, 23 bp, Artificial Sequence
  X-linked inhibitor of apoptosis (XIAP) siRNA
ataaactagaagtttaaaaatgc

SEQ ID NO: 13498 - DNA, 23 bp, Artificial Sequence
  X-linked inhibitor of apoptosis (XIAP) siRNA
taaactagaagtttaaaaatgct

SEQ ID NO: 13499 - DNA, 23 bp, Artificial Sequence
  X-linked inhibitor of apoptosis (XIAP) siRNA
aaactagaagtttaaaaatgctt

SEQ ID NO: 13500 - DNA, 23 bp, Artificial Sequence
  X-linked inhibitor of apoptosis (XIAP) siRNA
aactagaagtttaaaaatgcttc

SEQ ID NO: 13501 - DNA, 23 bp, Artificial Sequence
  X-linked inhibitor of apoptosis (XIAP) siRNA
actagaagtttaaaaatgcttca

SEQ ID NO: 13502 - DNA, 23 bp, Artificial Sequence
  X-linked inhibitor of apoptosis (XIAP) siRNA
ctagaagtttaaaaatgcttcat

SEQ ID NO: 13503 - DNA, 23 bp, Artificial Sequence
  X-linked inhibitor of apoptosis (XIAP) siRNA
tagaagtttaaaaatgcttcata

SEQ ID NO: 13504 - DNA, 23 bp, Artificial Sequence
  X-linked inhibitor of apoptosis (XIAP) siRNA
agaagtttaaaaatgcttcatag

SEQ ID NO: 13505 - DNA, 23 bp, Artificial Sequence
  X-linked inhibitor of apoptosis (XIAP) siRNA
gaagtttaaaaatgcttcataga

SEQ ID NO: 13506 - DNA, 23 bp, Artificial Sequence
  X-linked inhibitor of apoptosis (XIAP) siRNA
aagtttaaaaatgcttcatagaa

SEQ ID NO: 13507 - DNA, 23 bp, Artificial Sequence
  X-linked inhibitor of apoptosis (XIAP) siRNA
agtttaaaaatgcttcatagaac

SEQ ID NO: 13508 - DNA, 23 bp, Artificial Sequence
  X-linked inhibitor of apoptosis (XIAP) siRNA
gtttaaaaatgcttcatagaacg

SEQ ID NO: 13509 - DNA, 23 bp, Artificial Sequence
  X-linked inhibitor of apoptosis (XIAP) siRNA
tttaaaaatgcttcatagaacgt

SEQ ID NO: 13510 - DNA, 23 bp, Artificial Sequence
  X-linked inhibitor of apoptosis (XIAP) siRNA
ttaaaaatgcttcatagaacgtc

SEQ ID NO: 13511 - DNA, 23 bp, Artificial Sequence
  X-linked inhibitor of apoptosis (XIAP) siRNA
taaaaatgcttcatagaacgtcc

SEQ ID NO: 13512 - DNA, 23 bp, Artificial Sequence
  X-linked inhibitor of apoptosis (XIAP) siRNA
aaaaatgcttcatagaacgtcca

SEQ ID NO: 13513 - DNA, 23 bp, Artificial Sequence
  X-linked inhibitor of apoptosis (XIAP) siRNA
aaaatgcttcatagaacgtccag

SEQ ID NO: 13514 - DNA, 23 bp, Artificial Sequence
  X-linked inhibitor of apoptosis (XIAP) siRNA
aaatgcttcatagaacgtccagg

SEQ ID NO: 13515 - DNA, 23 bp, Artificial Sequence
  X-linked inhibitor of apoptosis (XIAP) siRNA
aatgcttcatagaacgtccaggg

SEQ ID NO: 13516 - DNA, 23 bp, Artificial Sequence
  X-linked inhibitor of apoptosis (XIAP) siRNA
atgcttcatagaacgtccagggt

SEQ ID NO: 13517 - DNA, 23 bp, Artificial Sequence
  X-linked inhibitor of apoptosis (XIAP) siRNA
tgcttcatagaacgtccagggtt

SEQ ID NO: 13518 - DNA, 23 bp, Artificial Sequence
  X-linked inhibitor of apoptosis (XIAP) siRNA
gcttcatagaacgtccagggttt

SEQ ID NO: 13519 - DNA, 23 bp, Artificial Sequence
  X-linked inhibitor of apoptosis (XIAP) siRNA
cttcatagaacgtccagggttta

SEQ ID NO: 13520 - DNA, 23 bp, Artificial Sequence
  X-linked inhibitor of apoptosis (XIAP) siRNA
ttcatagaacgtccagggtttac

SEQ ID NO: 13521 - DNA, 23 bp, Artificial Sequence
  X-linked inhibitor of apoptosis (XIAP) siRNA
tcatagaacgtccagggtttaca

SEQ ID NO: 13522 - DNA, 23 bp, Artificial Sequence
  X-linked inhibitor of apoptosis (XIAP) siRNA
catagaacgtccagggtttacat

SEQ ID NO: 13523 - DNA, 23 bp, Artificial Sequence
  X-linked inhibitor of apoptosis (XIAP) siRNA
atagaacgtccagggtttacatt

SEQ ID NO: 13524 - DNA, 23 bp, Artificial Sequence
  X-linked inhibitor of apoptosis (XIAP) siRNA
tagaacgtccagggtttacatta

SEQ ID NO: 13525 - DNA, 23 bp, Artificial Sequence
  X-linked inhibitor of apoptosis (XIAP) siRNA
agaacgtccagggtttacattac

SEQ ID NO: 13526 - DNA, 23 bp, Artificial Sequence
  X-linked inhibitor of apoptosis (XIAP) siRNA
gaacgtccagggtttacattaca

SEQ ID NO: 13527 - DNA, 23 bp, Artificial Sequence
  X-linked inhibitor of apoptosis (XIAP) siRNA
aacgtccagggtttacattacaa

SEQ ID NO: 13528 - DNA, 23 bp, Artificial Sequence
  X-linked inhibitor of apoptosis (XIAP) siRNA
acgtccagggtttacattacaag

SEQ ID NO: 13529 - DNA, 23 bp, Artificial Sequence
  X-linked inhibitor of apoptosis (XIAP) siRNA
cgtccagggtttacattacaaga

SEQ ID NO: 13530 - DNA, 23 bp, Artificial Sequence
  X-linked inhibitor of apoptosis (XIAP) siRNA
gtccagggtttacattacaagat

SEQ ID NO: 13531 - DNA, 23 bp, Artificial Sequence
  X-linked inhibitor of apoptosis (XIAP) siRNA
tccagggtttacattacaagatt

SEQ ID NO: 13532 - DNA, 23 bp, Artificial Sequence
  X-linked inhibitor of apoptosis (XIAP) siRNA
ccagggtttacattacaagattc

SEQ ID NO: 13533 - DNA, 23 bp, Artificial Sequence
  X-linked inhibitor of apoptosis (XIAP) siRNA
cagggtttacattacaagattct

SEQ ID NO: 13534 - DNA, 23 bp, Artificial Sequence
  X-linked inhibitor of apoptosis (XIAP) siRNA
agggtttacattacaagattctc

SEQ ID NO: 13535 - DNA, 23 bp, Artificial Sequence
  X-linked inhibitor of apoptosis (XIAP) siRNA
gggtttacattacaagattctca

SEQ ID NO: 13536 - DNA, 23 bp, Artificial Sequence
  X-linked inhibitor of apoptosis (XIAP) siRNA
ggtttacattacaagattctcac

SEQ ID NO: 13537 - DNA, 23 bp, Artificial Sequence
  X-linked inhibitor of apoptosis (XIAP) siRNA
gtttacattacaagattctcaca

SEQ ID NO: 13538 - DNA, 23 bp, Artificial Sequence
  X-linked inhibitor of apoptosis (XIAP) siRNA
tttacattacaagattctcacaa

SEQ ID NO: 13539 - DNA, 23 bp, Artificial Sequence
  X-linked inhibitor of apoptosis (XIAP) siRNA
ttacattacaagattctcacaac

SEQ ID NO: 13540 - DNA, 23 bp, Artificial Sequence
  X-linked inhibitor of apoptosis (XIAP) siRNA
tacattacaagattctcacaaca

SEQ ID NO: 13541 - DNA, 23 bp, Artificial Sequence
  X-linked inhibitor of apoptosis (XIAP) siRNA
acattacaagattctcacaacaa

SEQ ID NO: 13542 - DNA, 23 bp, Artificial Sequence
  X-linked inhibitor of apoptosis (XIAP) siRNA
cattacaagattctcacaacaaa

SEQ ID NO: 13543 - DNA, 23 bp, Artificial Sequence
  X-linked inhibitor of apoptosis (XIAP) siRNA
attacaagattctcacaacaaac

SEQ ID NO: 13544 - DNA, 23 bp, Artificial Sequence
  X-linked inhibitor of apoptosis (XIAP) siRNA
ttacaagattctcacaacaaacc

SEQ ID NO: 13545 - DNA, 23 bp, Artificial Sequence
  X-linked inhibitor of apoptosis (XIAP) siRNA
tacaagattctcacaacaaacct

SEQ ID NO: 13546 - DNA, 23 bp, Artificial Sequence
  X-linked inhibitor of apoptosis (XIAP) siRNA
acaagattctcacaacaaaccta

SEQ ID NO: 13547 - DNA, 23 bp, Artificial Sequence
  X-linked inhibitor of apoptosis (XIAP) siRNA
caagattctcacaacaaacctat

SEQ ID NO: 13548 - DNA, 23 bp, Artificial Sequence
  X-linked inhibitor of apoptosis (XIAP) siRNA
aagattctcacaacaaacctatt

SEQ ID NO: 13549 - DNA, 23 bp, Artificial Sequence
  X-linked inhibitor of apoptosis (XIAP) siRNA
agattctcacaacaaacctattg

SEQ ID NO: 13550 - DNA, 23 bp, Artificial Sequence
  X-linked inhibitor of apoptosis (XIAP) siRNA
gattctcacaacaaacctattgt

SEQ ID NO: 13551 - DNA, 23 bp, Artificial Sequence
  X-linked inhibitor of apoptosis (XIAP) siRNA
attctcacaacaaacctattgta

SEQ ID NO: 13552 - DNA, 23 bp, Artificial Sequence
  X-linked inhibitor of apoptosis (XIAP) siRNA
ttctcacaacaaacctattgtag

SEQ ID NO: 13553 - DNA, 23 bp, Artificial Sequence
  X-linked inhibitor of apoptosis (XIAP) siRNA
tctcacaacaaacctattgtaga

SEQ ID NO: 13554 - DNA, 23 bp, Artificial Sequence
  X-linked inhibitor of apoptosis (XIAP) siRNA
ctcacaacaaacctattgtagag

SEQ ID NO: 13555 - DNA, 23 bp, Artificial Sequence
  X-linked inhibitor of apoptosis (XIAP) siRNA
tcacaacaaacctattgtagagg

SEQ ID NO: 13556 - DNA, 23 bp, Artificial Sequence
  X-linked inhibitor of apoptosis (XIAP) siRNA
cacaacaaacctattgtagaggt

SEQ ID NO: 13557 - DNA, 23 bp, Artificial Sequence
  X-linked inhibitor of apoptosis (XIAP) siRNA
acaacaaacctattgtagaggtg

SEQ ID NO: 13558 - DNA, 23 bp, Artificial Sequence
  X-linked inhibitor of apoptosis (XIAP) siRNA
caacaaacctattgtagaggtga

SEQ ID NO: 13559 - DNA, 23 bp, Artificial Sequence
  X-linked inhibitor of apoptosis (XIAP) siRNA
aacaaacctattgtagaggtgag

SEQ ID NO: 13560 - DNA, 23 bp, Artificial Sequence
  X-linked inhibitor of apoptosis (XIAP) siRNA
acaaacctattgtagaggtgagt

SEQ ID NO: 13561 - DNA, 23 bp, Artificial Sequence
  X-linked inhibitor of apoptosis (XIAP) siRNA
caaacctattgtagaggtgagta

SEQ ID NO: 13562 - DNA, 23 bp, Artificial Sequence
  X-linked inhibitor of apoptosis (XIAP) siRNA
aaacctattgtagaggtgagtaa

SEQ ID NO: 13563 - DNA, 23 bp, Artificial Sequence
  X-linked inhibitor of apoptosis (XIAP) siRNA
aacctattgtagaggtgagtaag

SEQ ID NO: 13564 - DNA, 23 bp, Artificial Sequence
  X-linked inhibitor of apoptosis (XIAP) siRNA
acctattgtagaggtgagtaagg

SEQ ID NO: 13565 - DNA, 23 bp, Artificial Sequence
  X-linked inhibitor of apoptosis (XIAP) siRNA
cctattgtagaggtgagtaaggc

SEQ ID NO: 13566 - DNA, 23 bp, Artificial Sequence
  X-linked inhibitor of apoptosis (XIAP) siRNA
ctattgtagaggtgagtaaggca

SEQ ID NO: 13567 - DNA, 23 bp, Artificial Sequence
  X-linked inhibitor of apoptosis (XIAP) siRNA
tattgtagaggtgagtaaggcat

SEQ ID NO: 13568 - DNA, 23 bp, Artificial Sequence
  X-linked inhibitor of apoptosis (XIAP) siRNA
attgtagaggtgagtaaggcatg

SEQ ID NO: 13569 - DNA, 23 bp, Artificial Sequence
  X-linked inhibitor of apoptosis (XIAP) siRNA
ttgtagaggtgagtaaggcatgt

SEQ ID NO: 13570 - DNA, 23 bp, Artificial Sequence
  X-linked inhibitor of apoptosis (XIAP) siRNA
tgtagaggtgagtaaggcatgtt

SEQ ID NO: 13571 - DNA, 23 bp, Artificial Sequence
  X-linked inhibitor of apoptosis (XIAP) siRNA
gtagaggtgagtaaggcatgtta

SEQ ID NO: 13572 - DNA, 23 bp, Artificial Sequence
  X-linked inhibitor of apoptosis (XIAP) siRNA
tagaggtgagtaaggcatgttac

SEQ ID NO: 13573 - DNA, 23 bp, Artificial Sequence
  X-linked inhibitor of apoptosis (XIAP) siRNA
agaggtgagtaaggcatgttact

SEQ ID NO: 13574 - DNA, 23 bp, Artificial Sequence
  X-linked inhibitor of apoptosis (XIAP) siRNA
gaggtgagtaaggcatgttacta

SEQ ID NO: 13575 - DNA, 23 bp, Artificial Sequence
  X-linked inhibitor of apoptosis (XIAP) siRNA
aggtgagtaaggcatgttactac

SEQ ID NO: 13576 - DNA, 23 bp, Artificial Sequence
  X-linked inhibitor of apoptosis (XIAP) siRNA
ggtgagtaaggcatgttactaca

SEQ ID NO: 13577 - DNA, 23 bp, Artificial Sequence
  X-linked inhibitor of apoptosis (XIAP) siRNA
gtgagtaaggcatgttactacag

SEQ ID NO: 13578 - DNA, 23 bp, Artificial Sequence
  X-linked inhibitor of apoptosis (XIAP) siRNA
tgagtaaggcatgttactacaga

SEQ ID NO: 13579 - DNA, 23 bp, Artificial Sequence
  X-linked inhibitor of apoptosis (XIAP) siRNA
gagtaaggcatgttactacagag

SEQ ID NO: 13580 - DNA, 23 bp, Artificial Sequence
  X-linked inhibitor of apoptosis (XIAP) siRNA
agtaaggcatgttactacagagg

SEQ ID NO: 13581 - DNA, 23 bp, Artificial Sequence
  X-linked inhibitor of apoptosis (XIAP) siRNA
gtaaggcatgttactacagagga

SEQ ID NO: 13582 - DNA, 23 bp, Artificial Sequence
  X-linked inhibitor of apoptosis (XIAP) siRNA
taaggcatgttactacagaggaa

SEQ ID NO: 13583 - DNA, 23 bp, Artificial Sequence
  X-linked inhibitor of apoptosis (XIAP) siRNA
aaggcatgttactacagaggaaa

SEQ ID NO: 13584 - DNA, 23 bp, Artificial Sequence
  X-linked inhibitor of apoptosis (XIAP) siRNA
aggcatgttactacagaggaaag

SEQ ID NO: 13585 - DNA, 23 bp, Artificial Sequence
  X-linked inhibitor of apoptosis (XIAP) siRNA
ggcatgttactacagaggaaagt

SEQ ID NO: 13586 - DNA, 23 bp, Artificial Sequence
  X-linked inhibitor of apoptosis (XIAP) siRNA
gcatgttactacagaggaaagtt

SEQ ID NO: 13587 - DNA, 23 bp, Artificial Sequence
  X-linked inhibitor of apoptosis (XIAP) siRNA
catgttactacagaggaaagttt

SEQ ID NO: 13588 - DNA, 23 bp, Artificial Sequence
  X-linked inhibitor of apoptosis (XIAP) siRNA
atgttactacagaggaaagtttg

SEQ ID NO: 13589 - DNA, 23 bp, Artificial Sequence
  X-linked inhibitor of apoptosis (XIAP) siRNA
tgttactacagaggaaagtttga

SEQ ID NO: 13590 - DNA, 23 bp, Artificial Sequence
  X-linked inhibitor of apoptosis (XIAP) siRNA
gttactacagaggaaagtttgag

SEQ ID NO: 13591 - DNA, 23 bp, Artificial Sequence
  X-linked inhibitor of apoptosis (XIAP) siRNA
ttactacagaggaaagtttgaga

SEQ ID NO: 13592 - DNA, 23 bp, Artificial Sequence
  X-linked inhibitor of apoptosis (XIAP) siRNA
tactacagaggaaagtttgagag

SEQ ID NO: 13593 - DNA, 23 bp, Artificial Sequence
  X-linked inhibitor of apoptosis (XIAP) siRNA
actacagaggaaagtttgagagt

SEQ ID NO: 13594 - DNA, 23 bp, Artificial Sequence
  X-linked inhibitor of apoptosis (XIAP) siRNA
ctacagaggaaagtttgagagta

SEQ ID NO: 13595 - DNA, 23 bp, Artificial Sequence
  X-linked inhibitor of apoptosis (XIAP) siRNA
tacagaggaaagtttgagagtaa

SEQ ID NO: 13596 - DNA, 23 bp, Artificial Sequence
  X-linked inhibitor of apoptosis (XIAP) siRNA
acagaggaaagtttgagagtaaa

SEQ ID NO: 13597 - DNA, 23 bp, Artificial Sequence
  X-linked inhibitor of apoptosis (XIAP) siRNA
cagaggaaagtttgagagtaaaa

SEQ ID NO: 13598 - DNA, 23 bp, Artificial Sequence
  X-linked inhibitor of apoptosis (XIAP) siRNA
agaggaaagtttgagagtaaaac

SEQ ID NO: 13599 - DNA, 23 bp, Artificial Sequence
  X-linked inhibitor of apoptosis (XIAP) siRNA
gaggaaagtttgagagtaaaact

SEQ ID NO: 13600 - DNA, 23 bp, Artificial Sequence
  X-linked inhibitor of apoptosis (XIAP) siRNA
aggaaagtttgagagtaaaactg

SEQ ID NO: 13601 - DNA, 23 bp, Artificial Sequence
  X-linked inhibitor of apoptosis (XIAP) siRNA
ggaaagtttgagagtaaaactgt

SEQ ID NO: 13602 - DNA, 23 bp, Artificial Sequence
  X-linked inhibitor of apoptosis (XIAP) siRNA
gaaagtttgagagtaaaactgta

SEQ ID NO: 13603 - DNA, 23 bp, Artificial Sequence
  X-linked inhibitor of apoptosis (XIAP) siRNA
aaagtttgagagtaaaactgtaa

SEQ ID NO: 13604 - DNA, 23 bp, Artificial Sequence
  X-linked inhibitor of apoptosis (XIAP) siRNA
aagtttgagagtaaaactgtaaa

SEQ ID NO: 13605 - DNA, 23 bp, Artificial Sequence
  X-linked inhibitor of apoptosis (XIAP) siRNA
agtttgagagtaaaactgtaaaa

SEQ ID NO: 13606 - DNA, 23 bp, Artificial Sequence
  X-linked inhibitor of apoptosis (XIAP) siRNA
gtttgagagtaaaactgtaaaaa

SEQ ID NO: 13607 - DNA, 23 bp, Artificial Sequence
  X-linked inhibitor of apoptosis (XIAP) siRNA
tttgagagtaaaactgtaaaaaa

SEQ ID NO: 13608 - DNA, 23 bp, Artificial Sequence
  X-linked inhibitor of apoptosis (XIAP) siRNA
ttgagagtaaaactgtaaaaaat

SEQ ID NO: 13609 - DNA, 23 bp, Artificial Sequence
  X-linked inhibitor of apoptosis (XIAP) siRNA
tgagagtaaaactgtaaaaaatt

SEQ ID NO: 13610 - DNA, 23 bp, Artificial Sequence
  X-linked inhibitor of apoptosis (XIAP) siRNA
gagagtaaaactgtaaaaaatta

SEQ ID NO: 13611 - DNA, 23 bp, Artificial Sequence
  X-linked inhibitor of apoptosis (XIAP) siRNA
agagtaaaactgtaaaaaattat

SEQ ID NO: 13612 - DNA, 23 bp, Artificial Sequence
  X-linked inhibitor of apoptosis (XIAP) siRNA
gagtaaaactgtaaaaaattata

SEQ ID NO: 13613 - DNA, 23 bp, Artificial Sequence
  X-linked inhibitor of apoptosis (XIAP) siRNA
agtaaaactgtaaaaaattatat

SEQ ID NO: 13614 - DNA, 23 bp, Artificial Sequence
  X-linked inhibitor of apoptosis (XIAP) siRNA
gtaaaactgtaaaaaattatatt

SEQ ID NO: 13615 - DNA, 23 bp, Artificial Sequence
  X-linked inhibitor of apoptosis (XIAP) siRNA
taaaactgtaaaaaattatattt

SEQ ID NO: 13616 - DNA, 23 bp, Artificial Sequence
  X-linked inhibitor of apoptosis (XIAP) siRNA
aaaactgtaaaaaattatatttt

SEQ ID NO: 13617 - DNA, 23 bp, Artificial Sequence
  X-linked inhibitor of apoptosis (XIAP) siRNA
aaactgtaaaaaattatattttt

SEQ ID NO: 13618 - DNA, 23 bp, Artificial Sequence
  X-linked inhibitor of apoptosis (XIAP) siRNA
aactgtaaaaaattatatttttg

SEQ ID NO: 13619 - DNA, 23 bp, Artificial Sequence
  X-linked inhibitor of apoptosis (XIAP) siRNA
actgtaaaaaattatatttttgt

SEQ ID NO: 13620 - DNA, 23 bp, Artificial Sequence
  X-linked inhibitor of apoptosis (XIAP) siRNA
ctgtaaaaaattatatttttgtt

SEQ ID NO: 13621 - DNA, 23 bp, Artificial Sequence
  X-linked inhibitor of apoptosis (XIAP) siRNA
tgtaaaaaattatatttttgttg

SEQ ID NO: 13622 - DNA, 23 bp, Artificial Sequence
  X-linked inhibitor of apoptosis (XIAP) siRNA
gtaaaaaattatatttttgttgt

SEQ ID NO: 13623 - DNA, 23 bp, Artificial Sequence
  X-linked inhibitor of apoptosis (XIAP) siRNA
taaaaaattatatttttgttgta

SEQ ID NO: 13624 - DNA, 23 bp, Artificial Sequence
  X-linked inhibitor of apoptosis (XIAP) siRNA
aaaaaattatatttttgttgtac

SEQ ID NO: 13625 - DNA, 23 bp, Artificial Sequence
  X-linked inhibitor of apoptosis (XIAP) siRNA
aaaaattatatttttgttgtact

SEQ ID NO: 13626 - DNA, 23 bp, Artificial Sequence
  X-linked inhibitor of apoptosis (XIAP) siRNA
aaaattatatttttgttgtactt

SEQ ID NO: 13627 - DNA, 23 bp, Artificial Sequence
  X-linked inhibitor of apoptosis (XIAP) siRNA
aaattatatttttgttgtacttt

SEQ ID NO: 13628 - DNA, 23 bp, Artificial Sequence
  X-linked inhibitor of apoptosis (XIAP) siRNA
aattatatttttgttgtactttc

SEQ ID NO: 13629 - DNA, 23 bp, Artificial Sequence
  X-linked inhibitor of apoptosis (XIAP) siRNA
attatatttttgttgtactttct

SEQ ID NO: 13630 - DNA, 23 bp, Artificial Sequence
  X-linked inhibitor of apoptosis (XIAP) siRNA
ttatatttttgttgtactttcta

SEQ ID NO: 13631 - DNA, 23 bp, Artificial Sequence
  X-linked inhibitor of apoptosis (XIAP) siRNA
tatatttttgttgtactttctaa

SEQ ID NO: 13632 - DNA, 23 bp, Artificial Sequence
  X-linked inhibitor of apoptosis (XIAP) siRNA
atatttttgttgtactttctaag

SEQ ID NO: 13633 - DNA, 23 bp, Artificial Sequence
  X-linked inhibitor of apoptosis (XIAP) siRNA
tatttttgttgtactttctaaga

SEQ ID NO: 13634 - DNA, 23 bp, Artificial Sequence
  X-linked inhibitor of apoptosis (XIAP) siRNA
atttttgttgtactttctaagag

SEQ ID NO: 13635 - DNA, 23 bp, Artificial Sequence
  X-linked inhibitor of apoptosis (XIAP) siRNA
tttttgttgtactttctaagaga

SEQ ID NO: 13636 - DNA, 23 bp, Artificial Sequence
  X-linked inhibitor of apoptosis (XIAP) siRNA
ttttgttgtactttctaagagaa

SEQ ID NO: 13637 - DNA, 23 bp, Artificial Sequence
  X-linked inhibitor of apoptosis (XIAP) siRNA
tttgttgtactttctaagagaaa

SEQ ID NO: 13638 - DNA, 23 bp, Artificial Sequence
  X-linked inhibitor of apoptosis (XIAP) siRNA
ttgttgtactttctaagagaaag

SEQ ID NO: 13639 - DNA, 23 bp, Artificial Sequence
  X-linked inhibitor of apoptosis (XIAP) siRNA
tgttgtactttctaagagaaaga

SEQ ID NO: 13640 - DNA, 23 bp, Artificial Sequence
  X-linked inhibitor of apoptosis (XIAP) siRNA
gttgtactttctaagagaaagag

SEQ ID NO: 13641 - DNA, 23 bp, Artificial Sequence
  X-linked inhibitor of apoptosis (XIAP) siRNA
ttgtactttctaagagaaagagt

SEQ ID NO: 13642 - DNA, 23 bp, Artificial Sequence
  X-linked inhibitor of apoptosis (XIAP) siRNA
tgtactttctaagagaaagagta

SEQ ID NO: 13643 - DNA, 23 bp, Artificial Sequence
  X-linked inhibitor of apoptosis (XIAP) siRNA
gtactttctaagagaaagagtat

SEQ ID NO: 13644 - DNA, 23 bp, Artificial Sequence
  X-linked inhibitor of apoptosis (XIAP) siRNA
tactttctaagagaaagagtatt

SEQ ID NO: 13645 - DNA, 23 bp, Artificial Sequence
  X-linked inhibitor of apoptosis (XIAP) siRNA
actttctaagagaaagagtattg

SEQ ID NO: 13646 - DNA, 23 bp, Artificial Sequence
  X-linked inhibitor of apoptosis (XIAP) siRNA
ctttctaagagaaagagtattgt

SEQ ID NO: 13647 - DNA, 23 bp, Artificial Sequence
  X-linked inhibitor of apoptosis (XIAP) siRNA
tttctaagagaaagagtattgtt

SEQ ID NO: 13648 - DNA, 23 bp, Artificial Sequence
  X-linked inhibitor of apoptosis (XIAP) siRNA
ttctaagagaaagagtattgtta

SEQ ID NO: 13649 - DNA, 23 bp, Artificial Sequence
  X-linked inhibitor of apoptosis (XIAP) siRNA
tctaagagaaagagtattgttat

SEQ ID NO: 13650 - DNA, 23 bp, Artificial Sequence
  X-linked inhibitor of apoptosis (XIAP) siRNA
ctaagagaaagagtattgttatg

SEQ ID NO: 13651 - DNA, 23 bp, Artificial Sequence
  X-linked inhibitor of apoptosis (XIAP) siRNA
taagagaaagagtattgttatgt

SEQ ID NO: 13652 - DNA, 23 bp, Artificial Sequence
  X-linked inhibitor of apoptosis (XIAP) siRNA
aagagaaagagtattgttatgtt

SEQ ID NO: 13653 - DNA, 23 bp, Artificial Sequence
  X-linked inhibitor of apoptosis (XIAP) siRNA
agagaaagagtattgttatgttc

SEQ ID NO: 13654 - DNA, 23 bp, Artificial Sequence
  X-linked inhibitor of apoptosis (XIAP) siRNA
gagaaagagtattgttatgttct

SEQ ID NO: 13655 - DNA, 23 bp, Artificial Sequence
  X-linked inhibitor of apoptosis (XIAP) siRNA
agaaagagtattgttatgttctc

SEQ ID NO: 13656 - DNA, 23 bp, Artificial Sequence
  X-linked inhibitor of apoptosis (XIAP) siRNA
gaaagagtattgttatgttctcc

SEQ ID NO: 13657 - DNA, 23 bp, Artificial Sequence
  X-linked inhibitor of apoptosis (XIAP) siRNA
aaagagtattgttatgttctcct

SEQ ID NO: 13658 - DNA, 23 bp, Artificial Sequence
  X-linked inhibitor of apoptosis (XIAP) siRNA
aagagtattgttatgttctccta

SEQ ID NO: 13659 - DNA, 23 bp, Artificial Sequence
  X-linked inhibitor of apoptosis (XIAP) siRNA
agagtattgttatgttctcctaa

SEQ ID NO: 13660 - DNA, 23 bp, Artificial Sequence
  X-linked inhibitor of apoptosis (XIAP) siRNA
gagtattgttatgttctcctaac

SEQ ID NO: 13661 - DNA, 23 bp, Artificial Sequence
  X-linked inhibitor of apoptosis (XIAP) siRNA
agtattgttatgttctcctaact

SEQ ID NO: 13662 - DNA, 23 bp, Artificial Sequence
  X-linked inhibitor of apoptosis (XIAP) siRNA
gtattgttatgttctcctaactt

SEQ ID NO: 13663 - DNA, 23 bp, Artificial Sequence
  X-linked inhibitor of apoptosis (XIAP) siRNA
tattgttatgttctcctaacttc

SEQ ID NO: 13664 - DNA, 23 bp, Artificial Sequence
  X-linked inhibitor of apoptosis (XIAP) siRNA
attgttatgttctcctaacttct

SEQ ID NO: 13665 - DNA, 23 bp, Artificial Sequence
  X-linked inhibitor of apoptosis (XIAP) siRNA
ttgttatgttctcctaacttctg

SEQ ID NO: 13666 - DNA, 23 bp, Artificial Sequence
  X-linked inhibitor of apoptosis (XIAP) siRNA
tgttatgttctcctaacttctgt

SEQ ID NO: 13667 - DNA, 23 bp, Artificial Sequence
  X-linked inhibitor of apoptosis (XIAP) siRNA
gttatgttctcctaacttctgtt

SEQ ID NO: 13668 - DNA, 23 bp, Artificial Sequence
  X-linked inhibitor of apoptosis (XIAP) siRNA
ttatgttctcctaacttctgttg

SEQ ID NO: 13669 - DNA, 23 bp, Artificial Sequence
  X-linked inhibitor of apoptosis (XIAP) siRNA
tatgttctcctaacttctgttga

SEQ ID NO: 13670 - DNA, 23 bp, Artificial Sequence
  X-linked inhibitor of apoptosis (XIAP) siRNA
atgttctcctaacttctgttgat

SEQ ID NO: 13671 - DNA, 23 bp, Artificial Sequence
  X-linked inhibitor of apoptosis (XIAP) siRNA
tgttctcctaacttctgttgatt

SEQ ID NO: 13672 - DNA, 23 bp, Artificial Sequence
  X-linked inhibitor of apoptosis (XIAP) siRNA
gttctcctaacttctgttgatta

SEQ ID NO: 13673 - DNA, 23 bp, Artificial Sequence
  X-linked inhibitor of apoptosis (XIAP) siRNA
ttctcctaacttctgttgattac

SEQ ID NO: 13674 - DNA, 23 bp, Artificial Sequence
  X-linked inhibitor of apoptosis (XIAP) siRNA
tctcctaacttctgttgattact

SEQ ID NO: 13675 - DNA, 23 bp, Artificial Sequence
  X-linked inhibitor of apoptosis (XIAP) siRNA
ctcctaacttctgttgattacta

SEQ ID NO: 13676 - DNA, 23 bp, Artificial Sequence
  X-linked inhibitor of apoptosis (XIAP) siRNA
tcctaacttctgttgattactac

SEQ ID NO: 13677 - DNA, 23 bp, Artificial Sequence
  X-linked inhibitor of apoptosis (XIAP) siRNA
cctaacttctgttgattactact

SEQ ID NO: 13678 - DNA, 23 bp, Artificial Sequence
  X-linked inhibitor of apoptosis (XIAP) siRNA
ctaacttctgttgattactactt

SEQ ID NO: 13679 - DNA, 23 bp, Artificial Sequence
  X-linked inhibitor of apoptosis (XIAP) siRNA
taacttctgttgattactacttt

SEQ ID NO: 13680 - DNA, 23 bp, Artificial Sequence
  X-linked inhibitor of apoptosis (XIAP) siRNA
aacttctgttgattactacttta

SEQ ID NO: 13681 - DNA, 23 bp, Artificial Sequence
  X-linked inhibitor of apoptosis (XIAP) siRNA
acttctgttgattactactttaa

SEQ ID NO: 13682 - DNA, 23 bp, Artificial Sequence
  X-linked inhibitor of apoptosis (XIAP) siRNA
cttctgttgattactactttaag

SEQ ID NO: 13683 - DNA, 23 bp, Artificial Sequence
  X-linked inhibitor of apoptosis (XIAP) siRNA
ttctgttgattactactttaagt

SEQ ID NO: 13684 - DNA, 23 bp, Artificial Sequence
  X-linked inhibitor of apoptosis (XIAP) siRNA
tctgttgattactactttaagtg

SEQ ID NO: 13685 - DNA, 23 bp, Artificial Sequence
  X-linked inhibitor of apoptosis (XIAP) siRNA
ctgttgattactactttaagtga

SEQ ID NO: 13686 - DNA, 23 bp, Artificial Sequence
  X-linked inhibitor of apoptosis (XIAP) siRNA
tgttgattactactttaagtgat

SEQ ID NO: 13687 - DNA, 23 bp, Artificial Sequence
  X-linked inhibitor of apoptosis (XIAP) siRNA
gttgattactactttaagtgata

SEQ ID NO: 13688 - DNA, 23 bp, Artificial Sequence
  X-linked inhibitor of apoptosis (XIAP) siRNA
ttgattactactttaagtgatat

SEQ ID NO: 13689 - DNA, 23 bp, Artificial Sequence
  X-linked inhibitor of apoptosis (XIAP) siRNA
tgattactactttaagtgatatt

SEQ ID NO: 13690 - DNA, 23 bp, Artificial Sequence
  X-linked inhibitor of apoptosis (XIAP) siRNA
gattactactttaagtgatattc

SEQ ID NO: 13691 - DNA, 23 bp, Artificial Sequence
  X-linked inhibitor of apoptosis (XIAP) siRNA
attactactttaagtgatattca

SEQ ID NO: 13692 - DNA, 23 bp, Artificial Sequence
  X-linked inhibitor of apoptosis (XIAP) siRNA
ttactactttaagtgatattcat

SEQ ID NO: 13693 - DNA, 23 bp, Artificial Sequence
  X-linked inhibitor of apoptosis (XIAP) siRNA
tactactttaagtgatattcatt

SEQ ID NO: 13694 - DNA, 23 bp, Artificial Sequence
  X-linked inhibitor of apoptosis (XIAP) siRNA
actactttaagtgatattcattt

SEQ ID NO: 13695 - DNA, 23 bp, Artificial Sequence
  X-linked inhibitor of apoptosis (XIAP) siRNA
ctactttaagtgatattcattta

SEQ ID NO: 13696 - DNA, 23 bp, Artificial Sequence
  X-linked inhibitor of apoptosis (XIAP) siRNA
tactttaagtgatattcatttaa

SEQ ID NO: 13697 - DNA, 23 bp, Artificial Sequence
  X-linked inhibitor of apoptosis (XIAP) siRNA
actttaagtgatattcatttaaa

SEQ ID NO: 13698 - DNA, 23 bp, Artificial Sequence
  X-linked inhibitor of apoptosis (XIAP) siRNA
ctttaagtgatattcatttaaaa

SEQ ID NO: 13699 - DNA, 23 bp, Artificial Sequence
  X-linked inhibitor of apoptosis (XIAP) siRNA
tttaagtgatattcatttaaaac

SEQ ID NO: 13700 - DNA, 23 bp, Artificial Sequence
  X-linked inhibitor of apoptosis (XIAP) siRNA
ttaagtgatattcatttaaaaca

SEQ ID NO: 13701 - DNA, 23 bp, Artificial Sequence
  X-linked inhibitor of apoptosis (XIAP) siRNA
taagtgatattcatttaaaacat

SEQ ID NO: 13702 - DNA, 23 bp, Artificial Sequence
  X-linked inhibitor of apoptosis (XIAP) siRNA
aagtgatattcatttaaaacatt

SEQ ID NO: 13703 - DNA, 23 bp, Artificial Sequence
  X-linked inhibitor of apoptosis (XIAP) siRNA
agtgatattcatttaaaacattg

SEQ ID NO: 13704 - DNA, 23 bp, Artificial Sequence
  X-linked inhibitor of apoptosis (XIAP) siRNA
gtgatattcatttaaaacattgc

SEQ ID NO: 13705 - DNA, 23 bp, Artificial Sequence
  X-linked inhibitor of apoptosis (XIAP) siRNA
tgatattcatttaaaacattgca

SEQ ID NO: 13706 - DNA, 23 bp, Artificial Sequence
  X-linked inhibitor of apoptosis (XIAP) siRNA
gatattcatttaaaacattgcaa

SEQ ID NO: 13707 - DNA, 23 bp, Artificial Sequence
  X-linked inhibitor of apoptosis (XIAP) siRNA
atattcatttaaaacattgcaaa

SEQ ID NO: 13708 - DNA, 23 bp, Artificial Sequence
  X-linked inhibitor of apoptosis (XIAP) siRNA
tattcatttaaaacattgcaaat

SEQ ID NO: 13709 - DNA, 23 bp, Artificial Sequence
  X-linked inhibitor of apoptosis (XIAP) siRNA
attcatttaaaacattgcaaatt

SEQ ID NO: 13710 - DNA, 23 bp, Artificial Sequence
  X-linked inhibitor of apoptosis (XIAP) siRNA
ttcatttaaaacattgcaaattt

SEQ ID NO: 13711 - DNA, 23 bp, Artificial Sequence
  X-linked inhibitor of apoptosis (XIAP) siRNA
tcatttaaaacattgcaaattta

SEQ ID NO: 13712 - DNA, 23 bp, Artificial Sequence
  X-linked inhibitor of apoptosis (XIAP) siRNA
catttaaaacattgcaaatttat

SEQ ID NO: 13713 - DNA, 23 bp, Artificial Sequence
  X-linked inhibitor of apoptosis (XIAP) siRNA
atttaaaacattgcaaatttatt

SEQ ID NO: 13714 - DNA, 23 bp, Artificial Sequence
  X-linked inhibitor of apoptosis (XIAP) siRNA
tttaaaacattgcaaatttattt

SEQ ID NO: 13715 - DNA, 23 bp, Artificial Sequence
  X-linked inhibitor of apoptosis (XIAP) siRNA
ttaaaacattgcaaatttatttt

SEQ ID NO: 13716 - DNA, 23 bp, Artificial Sequence
  X-linked inhibitor of apoptosis (XIAP) siRNA
taaaacattgcaaatttatttta

SEQ ID NO: 13717 - DNA, 23 bp, Artificial Sequence
  X-linked inhibitor of apoptosis (XIAP) siRNA
aaaacattgcaaatttattttat

SEQ ID NO: 13718 - DNA, 23 bp, Artificial Sequence
  X-linked inhibitor of apoptosis (XIAP) siRNA
aaacattgcaaatttattttatt

SEQ ID NO: 13719 - DNA, 23 bp, Artificial Sequence
  X-linked inhibitor of apoptosis (XIAP) siRNA
aacattgcaaatttattttattt

SEQ ID NO: 13720 - DNA, 23 bp, Artificial Sequence
  X-linked inhibitor of apoptosis (XIAP) siRNA
acattgcaaatttattttattta

SEQ ID NO: 13721 - DNA, 23 bp, Artificial Sequence
  X-linked inhibitor of apoptosis (XIAP) siRNA
cattgcaaatttattttatttat

SEQ ID NO: 13722 - DNA, 23 bp, Artificial Sequence
  X-linked inhibitor of apoptosis (XIAP) siRNA
attgcaaatttattttatttatt

SEQ ID NO: 13723 - DNA, 23 bp, Artificial Sequence
  X-linked inhibitor of apoptosis (XIAP) siRNA
ttgcaaatttattttatttattt

SEQ ID NO: 13724 - DNA, 23 bp, Artificial Sequence
  X-linked inhibitor of apoptosis (XIAP) siRNA
tgcaaatttattttatttattta

SEQ ID NO: 13725 - DNA, 23 bp, Artificial Sequence
  X-linked inhibitor of apoptosis (XIAP) siRNA
gcaaatttattttatttatttaa

SEQ ID NO: 13726 - DNA, 23 bp, Artificial Sequence
  X-linked inhibitor of apoptosis (XIAP) siRNA
caaatttattttatttatttaat

SEQ ID NO: 13727 - DNA, 23 bp, Artificial Sequence
  X-linked inhibitor of apoptosis (XIAP) siRNA
aaatttattttatttatttaatt

SEQ ID NO: 13728 - DNA, 23 bp, Artificial Sequence
  X-linked inhibitor of apoptosis (XIAP) siRNA
aatttattttatttatttaattt

SEQ ID NO: 13729 - DNA, 23 bp, Artificial Sequence
  X-linked inhibitor of apoptosis (XIAP) siRNA
atttattttatttatttaatttt

SEQ ID NO: 13730 - DNA, 23 bp, Artificial Sequence
  X-linked inhibitor of apoptosis (XIAP) siRNA
tttattttatttatttaattttc

SEQ ID NO: 13731 - DNA, 23 bp, Artificial Sequence
  X-linked inhibitor of apoptosis (XIAP) siRNA
ttattttatttatttaattttct

SEQ ID NO: 13732 - DNA, 23 bp, Artificial Sequence
  X-linked inhibitor of apoptosis (XIAP) siRNA
tattttatttatttaattttctt

SEQ ID NO: 13733 - DNA, 23 bp, Artificial Sequence
  X-linked inhibitor of apoptosis (XIAP) siRNA
attttatttatttaattttcttt

SEQ ID NO: 13734 - DNA, 23 bp, Artificial Sequence
  X-linked inhibitor of apoptosis (XIAP) siRNA
ttttatttatttaattttctttt

SEQ ID NO: 13735 - DNA, 23 bp, Artificial Sequence
  X-linked inhibitor of apoptosis (XIAP) siRNA
tttatttatttaattttcttttt

SEQ ID NO: 13736 - DNA, 23 bp, Artificial Sequence
  X-linked inhibitor of apoptosis (XIAP) siRNA
ttatttatttaattttctttttg

SEQ ID NO: 13737 - DNA, 23 bp, Artificial Sequence
  X-linked inhibitor of apoptosis (XIAP) siRNA
tatttatttaattttctttttga

SEQ ID NO: 13738 - DNA, 23 bp, Artificial Sequence
  X-linked inhibitor of apoptosis (XIAP) siRNA
atttatttaattttctttttgag

SEQ ID NO: 13739 - DNA, 23 bp, Artificial Sequence
  X-linked inhibitor of apoptosis (XIAP) siRNA
tttatttaattttctttttgaga

SEQ ID NO: 13740 - DNA, 23 bp, Artificial Sequence
  X-linked inhibitor of apoptosis (XIAP) siRNA
ttatttaattttctttttgagat

SEQ ID NO: 13741 - DNA, 23 bp, Artificial Sequence
  X-linked inhibitor of apoptosis (XIAP) siRNA
tatttaattttctttttgagatg

SEQ ID NO: 13742 - DNA, 23 bp, Artificial Sequence
  X-linked inhibitor of apoptosis (XIAP) siRNA
atttaattttctttttgagatgg

SEQ ID NO: 13743 - DNA, 23 bp, Artificial Sequence
  X-linked inhibitor of apoptosis (XIAP) siRNA
tttaattttctttttgagatgga

SEQ ID NO: 13744 - DNA, 23 bp, Artificial Sequence
  X-linked inhibitor of apoptosis (XIAP) siRNA
ttaattttctttttgagatggag

SEQ ID NO: 13745 - DNA, 23 bp, Artificial Sequence
  X-linked inhibitor of apoptosis (XIAP) siRNA
taattttctttttgagatggagt

SEQ ID NO: 13746 - DNA, 23 bp, Artificial Sequence
  X-linked inhibitor of apoptosis (XIAP) siRNA
aattttctttttgagatggagtc

SEQ ID NO: 13747 - DNA, 23 bp, Artificial Sequence
  X-linked inhibitor of apoptosis (XIAP) siRNA
attttctttttgagatggagtct

SEQ ID NO: 13748 - DNA, 23 bp, Artificial Sequence
  X-linked inhibitor of apoptosis (XIAP) siRNA
ttttctttttgagatggagtctt

SEQ ID NO: 13749 - DNA, 23 bp, Artificial Sequence
  X-linked inhibitor of apoptosis (XIAP) siRNA
tttctttttgagatggagtcttg

SEQ ID NO: 13750 - DNA, 23 bp, Artificial Sequence
  X-linked inhibitor of apoptosis (XIAP) siRNA
ttctttttgagatggagtcttgc

SEQ ID NO: 13751 - DNA, 23 bp, Artificial Sequence
  X-linked inhibitor of apoptosis (XIAP) siRNA
tctttttgagatggagtcttgct

SEQ ID NO: 13752 - DNA, 23 bp, Artificial Sequence
  X-linked inhibitor of apoptosis (XIAP) siRNA
ctttttgagatggagtcttgctt

SEQ ID NO: 13753 - DNA, 23 bp, Artificial Sequence
  X-linked inhibitor of apoptosis (XIAP) siRNA
tttttgagatggagtcttgcttg

SEQ ID NO: 13754 - DNA, 23 bp, Artificial Sequence
  X-linked inhibitor of apoptosis (XIAP) siRNA
ttttgagatggagtcttgcttgt

SEQ ID NO: 13755 - DNA, 23 bp, Artificial Sequence
  X-linked inhibitor of apoptosis (XIAP) siRNA
tttgagatggagtcttgcttgtc

SEQ ID NO: 13756 - DNA, 23 bp, Artificial Sequence
  X-linked inhibitor of apoptosis (XIAP) siRNA
ttgagatggagtcttgcttgtca

SEQ ID NO: 13757 - DNA, 23 bp, Artificial Sequence
  X-linked inhibitor of apoptosis (XIAP) siRNA
tgagatggagtcttgcttgtcac

SEQ ID NO: 13758 - DNA, 23 bp, Artificial Sequence
  X-linked inhibitor of apoptosis (XIAP) siRNA
gagatggagtcttgcttgtcacc

SEQ ID NO: 13759 - DNA, 23 bp, Artificial Sequence
  X-linked inhibitor of apoptosis (XIAP) siRNA
agatggagtcttgcttgtcaccc

SEQ ID NO: 13760 - DNA, 23 bp, Artificial Sequence
  X-linked inhibitor of apoptosis (XIAP) siRNA
gatggagtcttgcttgtcaccca

SEQ ID NO: 13761 - DNA, 23 bp, Artificial Sequence
  X-linked inhibitor of apoptosis (XIAP) siRNA
atggagtcttgcttgtcacccag

SEQ ID NO: 13762 - DNA, 23 bp, Artificial Sequence
  X-linked inhibitor of apoptosis (XIAP) siRNA
tggagtcttgcttgtcacccagg

SEQ ID NO: 13763 - DNA, 23 bp, Artificial Sequence
  X-linked inhibitor of apoptosis (XIAP) siRNA
ggagtcttgcttgtcacccaggc

SEQ ID NO: 13764 - DNA, 23 bp, Artificial Sequence
  X-linked inhibitor of apoptosis (XIAP) siRNA
gagtcttgcttgtcacccaggct

SEQ ID NO: 13765 - DNA, 23 bp, Artificial Sequence
  X-linked inhibitor of apoptosis (XIAP) siRNA
agtcttgcttgtcacccaggctg

SEQ ID NO: 13766 - DNA, 23 bp, Artificial Sequence
  X-linked inhibitor of apoptosis (XIAP) siRNA
gtcttgcttgtcacccaggctgg

SEQ ID NO: 13767 - DNA, 23 bp, Artificial Sequence
  X-linked inhibitor of apoptosis (XIAP) siRNA
tcttgcttgtcacccaggctgga

SEQ ID NO: 13768 - DNA, 23 bp, Artificial Sequence
  X-linked inhibitor of apoptosis (XIAP) siRNA
cttgcttgtcacccaggctggag

SEQ ID NO: 13769 - DNA, 23 bp, Artificial Sequence
  X-linked inhibitor of apoptosis (XIAP) siRNA
ttgcttgtcacccaggctggagt

SEQ ID NO: 13770 - DNA, 23 bp, Artificial Sequence
  X-linked inhibitor of apoptosis (XIAP) siRNA
tgcttgtcacccaggctggagtg

SEQ ID NO: 13771 - DNA, 23 bp, Artificial Sequence
  X-linked inhibitor of apoptosis (XIAP) siRNA
gcttgtcacccaggctggagtgc

SEQ ID NO: 13772 - DNA, 23 bp, Artificial Sequence
  X-linked inhibitor of apoptosis (XIAP) siRNA
cttgtcacccaggctggagtgca

SEQ ID NO: 13773 - DNA, 23 bp, Artificial Sequence
  X-linked inhibitor of apoptosis (XIAP) siRNA
ttgtcacccaggctggagtgcag

SEQ ID NO: 13774 - DNA, 23 bp, Artificial Sequence
  X-linked inhibitor of apoptosis (XIAP) siRNA
tgtcacccaggctggagtgcagt

SEQ ID NO: 13775 - DNA, 23 bp, Artificial Sequence
  X-linked inhibitor of apoptosis (XIAP) siRNA
gtcacccaggctggagtgcagtg

SEQ ID NO: 13776 - DNA, 23 bp, Artificial Sequence
  X-linked inhibitor of apoptosis (XIAP) siRNA
tcacccaggctggagtgcagtgg

SEQ ID NO: 13777 - DNA, 23 bp, Artificial Sequence
  X-linked inhibitor of apoptosis (XIAP) siRNA
cacccaggctggagtgcagtgga

SEQ ID NO: 13778 - DNA, 23 bp, Artificial Sequence
  X-linked inhibitor of apoptosis (XIAP) siRNA
acccaggctggagtgcagtggag

SEQ ID NO: 13779 - DNA, 23 bp, Artificial Sequence
  X-linked inhibitor of apoptosis (XIAP) siRNA
cccaggctggagtgcagtggagt

SEQ ID NO: 13780 - DNA, 23 bp, Artificial Sequence
  X-linked inhibitor of apoptosis (XIAP) siRNA
ccaggctggagtgcagtggagtg

SEQ ID NO: 13781 - DNA, 23 bp, Artificial Sequence
  X-linked inhibitor of apoptosis (XIAP) siRNA
caggctggagtgcagtggagtga

SEQ ID NO: 13782 - DNA, 23 bp, Artificial Sequence
  X-linked inhibitor of apoptosis (XIAP) siRNA
aggctggagtgcagtggagtgat

SEQ ID NO: 13783 - DNA, 23 bp, Artificial Sequence
  X-linked inhibitor of apoptosis (XIAP) siRNA
ggctggagtgcagtggagtgatc

SEQ ID NO: 13784 - DNA, 23 bp, Artificial Sequence
  X-linked inhibitor of apoptosis (XIAP) siRNA
gctggagtgcagtggagtgatct

SEQ ID NO: 13785 - DNA, 23 bp, Artificial Sequence
  X-linked inhibitor of apoptosis (XIAP) siRNA
ctggagtgcagtggagtgatctc

SEQ ID NO: 13786 - DNA, 23 bp, Artificial Sequence
  X-linked inhibitor of apoptosis (XIAP) siRNA
tggagtgcagtggagtgatctct

SEQ ID NO: 13787 - DNA, 23 bp, Artificial Sequence
  X-linked inhibitor of apoptosis (XIAP) siRNA
ggagtgcagtggagtgatctctg

SEQ ID NO: 13788 - DNA, 23 bp, Artificial Sequence
  X-linked inhibitor of apoptosis (XIAP) siRNA
gagtgcagtggagtgatctctgc

SEQ ID NO: 13789 - DNA, 23 bp, Artificial Sequence
  X-linked inhibitor of apoptosis (XIAP) siRNA
agtgcagtggagtgatctctgct

SEQ ID NO: 13790 - DNA, 23 bp, Artificial Sequence
  X-linked inhibitor of apoptosis (XIAP) siRNA
gtgcagtggagtgatctctgctc

SEQ ID NO: 13791 - DNA, 23 bp, Artificial Sequence
  X-linked inhibitor of apoptosis (XIAP) siRNA
tgcagtggagtgatctctgctca

SEQ ID NO: 13792 - DNA, 23 bp, Artificial Sequence
  X-linked inhibitor of apoptosis (XIAP) siRNA
gcagtggagtgatctctgctcac

SEQ ID NO: 13793 - DNA, 23 bp, Artificial Sequence
  X-linked inhibitor of apoptosis (XIAP) siRNA
cagtggagtgatctctgctcact

SEQ ID NO: 13794 - DNA, 23 bp, Artificial Sequence
  X-linked inhibitor of apoptosis (XIAP) siRNA
agtggagtgatctctgctcactg

SEQ ID NO: 13795 - DNA, 23 bp, Artificial Sequence
  X-linked inhibitor of apoptosis (XIAP) siRNA
gtggagtgatctctgctcactgc

SEQ ID NO: 13796 - DNA, 23 bp, Artificial Sequence
  X-linked inhibitor of apoptosis (XIAP) siRNA
tggagtgatctctgctcactgca

SEQ ID NO: 13797 - DNA, 23 bp, Artificial Sequence
  X-linked inhibitor of apoptosis (XIAP) siRNA
ggagtgatctctgctcactgcaa

SEQ ID NO: 13798 - DNA, 23 bp, Artificial Sequence
  X-linked inhibitor of apoptosis (XIAP) siRNA
gagtgatctctgctcactgcaac

SEQ ID NO: 13799 - DNA, 23 bp, Artificial Sequence
  X-linked inhibitor of apoptosis (XIAP) siRNA
agtgatctctgctcactgcaacc

SEQ ID NO: 13800 - DNA, 23 bp, Artificial Sequence
  X-linked inhibitor of apoptosis (XIAP) siRNA
gtgatctctgctcactgcaacct

SEQ ID NO: 13801 - DNA, 23 bp, Artificial Sequence
  X-linked inhibitor of apoptosis (XIAP) siRNA
tgatctctgctcactgcaacctc

SEQ ID NO: 13802 - DNA, 23 bp, Artificial Sequence
  X-linked inhibitor of apoptosis (XIAP) siRNA
gatctctgctcactgcaacctcc

SEQ ID NO: 13803 - DNA, 23 bp, Artificial Sequence
  X-linked inhibitor of apoptosis (XIAP) siRNA
atctctgctcactgcaacctccg

SEQ ID NO: 13804 - DNA, 23 bp, Artificial Sequence
  X-linked inhibitor of apoptosis (XIAP) siRNA
tctctgctcactgcaacctccgc

SEQ ID NO: 13805 - DNA, 23 bp, Artificial Sequence
  X-linked inhibitor of apoptosis (XIAP) siRNA
ctctgctcactgcaacctccgcc

SEQ ID NO: 13806 - DNA, 23 bp, Artificial Sequence
  X-linked inhibitor of apoptosis (XIAP) siRNA
tctgctcactgcaacctccgcct

SEQ ID NO: 13807 - DNA, 23 bp, Artificial Sequence
  X-linked inhibitor of apoptosis (XIAP) siRNA
ctgctcactgcaacctccgcctt

SEQ ID NO: 13808 - DNA, 23 bp, Artificial Sequence
  X-linked inhibitor of apoptosis (XIAP) siRNA
tgctcactgcaacctccgccttc

SEQ ID NO: 13809 - DNA, 23 bp, Artificial Sequence
  X-linked inhibitor of apoptosis (XIAP) siRNA
gctcactgcaacctccgccttct

SEQ ID NO: 13810 - DNA, 23 bp, Artificial Sequence
  X-linked inhibitor of apoptosis (XIAP) siRNA
ctcactgcaacctccgccttctg

SEQ ID NO: 13811 - DNA, 23 bp, Artificial Sequence
  X-linked inhibitor of apoptosis (XIAP) siRNA
tcactgcaacctccgccttctgg

SEQ ID NO: 13812 - DNA, 23 bp, Artificial Sequence
  X-linked inhibitor of apoptosis (XIAP) siRNA
cactgcaacctccgccttctggg

SEQ ID NO: 13813 - DNA, 23 bp, Artificial Sequence
  X-linked inhibitor of apoptosis (XIAP) siRNA
actgcaacctccgccttctgggt

SEQ ID NO: 13814 - DNA, 23 bp, Artificial Sequence
  X-linked inhibitor of apoptosis (XIAP) siRNA
ctgcaacctccgccttctgggtt

SEQ ID NO: 13815 - DNA, 23 bp, Artificial Sequence
  X-linked inhibitor of apoptosis (XIAP) siRNA
tgcaacctccgccttctgggttc

SEQ ID NO: 13816 - DNA, 23 bp, Artificial Sequence
  X-linked inhibitor of apoptosis (XIAP) siRNA
gcaacctccgccttctgggttca

SEQ ID NO: 13817 - DNA, 23 bp, Artificial Sequence
  X-linked inhibitor of apoptosis (XIAP) siRNA
caacctccgccttctgggttcaa

SEQ ID NO: 13818 - DNA, 23 bp, Artificial Sequence
  X-linked inhibitor of apoptosis (XIAP) siRNA
aacctccgccttctgggttcaag

SEQ ID NO: 13819 - DNA, 23 bp, Artificial Sequence
  X-linked inhibitor of apoptosis (XIAP) siRNA
acctccgccttctgggttcaagc

SEQ ID NO: 13820 - DNA, 23 bp, Artificial Sequence
  X-linked inhibitor of apoptosis (XIAP) siRNA
cctccgccttctgggttcaagcg

SEQ ID NO: 13821 - DNA, 23 bp, Artificial Sequence
  X-linked inhibitor of apoptosis (XIAP) siRNA
ctccgccttctgggttcaagcga

SEQ ID NO: 13822 - DNA, 23 bp, Artificial Sequence
  X-linked inhibitor of apoptosis (XIAP) siRNA
tccgccttctgggttcaagcgat

SEQ ID NO: 13823 - DNA, 23 bp, Artificial Sequence
  X-linked inhibitor of apoptosis (XIAP) siRNA
ccgccttctgggttcaagcgatt

SEQ ID NO: 13824 - DNA, 23 bp, Artificial Sequence
  X-linked inhibitor of apoptosis (XIAP) siRNA
cgccttctgggttcaagcgattc

SEQ ID NO: 13825 - DNA, 23 bp, Artificial Sequence
  X-linked inhibitor of apoptosis (XIAP) siRNA
gccttctgggttcaagcgattct

SEQ ID NO: 13826 - DNA, 23 bp, Artificial Sequence
  X-linked inhibitor of apoptosis (XIAP) siRNA
ccttctgggttcaagcgattctc

SEQ ID NO: 13827 - DNA, 23 bp, Artificial Sequence
  X-linked inhibitor of apoptosis (XIAP) siRNA
cttctgggttcaagcgattctcg

SEQ ID NO: 13828 - DNA, 23 bp, Artificial Sequence
  X-linked inhibitor of apoptosis (XIAP) siRNA
ttctgggttcaagcgattctcgt

SEQ ID NO: 13829 - DNA, 23 bp, Artificial Sequence
  X-linked inhibitor of apoptosis (XIAP) siRNA
tctgggttcaagcgattctcgtg

SEQ ID NO: 13830 - DNA, 23 bp, Artificial Sequence
  X-linked inhibitor of apoptosis (XIAP) siRNA
ctgggttcaagcgattctcgtgc

SEQ ID NO: 13831 - DNA, 23 bp, Artificial Sequence
  X-linked inhibitor of apoptosis (XIAP) siRNA
tgggttcaagcgattctcgtgcc

SEQ ID NO: 13832 - DNA, 23 bp, Artificial Sequence
  X-linked inhibitor of apoptosis (XIAP) siRNA
gggttcaagcgattctcgtgcct

SEQ ID NO: 13833 - DNA, 23 bp, Artificial Sequence
  X-linked inhibitor of apoptosis (XIAP) siRNA
ggttcaagcgattctcgtgcctc

SEQ ID NO: 13834 - DNA, 23 bp, Artificial Sequence
  X-linked inhibitor of apoptosis (XIAP) siRNA
gttcaagcgattctcgtgcctca

SEQ ID NO: 13835 - DNA, 23 bp, Artificial Sequence
  X-linked inhibitor of apoptosis (XIAP) siRNA
ttcaagcgattctcgtgcctcag

SEQ ID NO: 13836 - DNA, 23 bp, Artificial Sequence
  X-linked inhibitor of apoptosis (XIAP) siRNA
tcaagcgattctcgtgcctcagc

SEQ ID NO: 13837 - DNA, 23 bp, Artificial Sequence
  X-linked inhibitor of apoptosis (XIAP) siRNA
caagcgattctcgtgcctcagct

SEQ ID NO: 13838 - DNA, 23 bp, Artificial Sequence
  X-linked inhibitor of apoptosis (XIAP) siRNA
aagcgattctcgtgcctcagctt

SEQ ID NO: 13839 - DNA, 23 bp, Artificial Sequence
  X-linked inhibitor of apoptosis (XIAP) siRNA
agcgattctcgtgcctcagcttc

SEQ ID NO: 13840 - DNA, 23 bp, Artificial Sequence
  X-linked inhibitor of apoptosis (XIAP) siRNA
gcgattctcgtgcctcagcttcc

SEQ ID NO: 13841 - DNA, 23 bp, Artificial Sequence
  X-linked inhibitor of apoptosis (XIAP) siRNA
cgattctcgtgcctcagcttcct

SEQ ID NO: 13842 - DNA, 23 bp, Artificial Sequence
  X-linked inhibitor of apoptosis (XIAP) siRNA
gattctcgtgcctcagcttcctg

SEQ ID NO: 13843 - DNA, 23 bp, Artificial Sequence
  X-linked inhibitor of apoptosis (XIAP) siRNA
attctcgtgcctcagcttcctga

SEQ ID NO: 13844 - DNA, 23 bp, Artificial Sequence
  X-linked inhibitor of apoptosis (XIAP) siRNA
ttctcgtgcctcagcttcctgag

SEQ ID NO: 13845 - DNA, 23 bp, Artificial Sequence
  X-linked inhibitor of apoptosis (XIAP) siRNA
tctcgtgcctcagcttcctgagt

SEQ ID NO: 13846 - DNA, 23 bp, Artificial Sequence
  X-linked inhibitor of apoptosis (XIAP) siRNA
ctcgtgcctcagcttcctgagta

SEQ ID NO: 13847 - DNA, 23 bp, Artificial Sequence
  X-linked inhibitor of apoptosis (XIAP) siRNA
tcgtgcctcagcttcctgagtag

SEQ ID NO: 13848 - DNA, 23 bp, Artificial Sequence
  X-linked inhibitor of apoptosis (XIAP) siRNA
cgtgcctcagcttcctgagtagc

SEQ ID NO: 13849 - DNA, 23 bp, Artificial Sequence
  X-linked inhibitor of apoptosis (XIAP) siRNA
gtgcctcagcttcctgagtagct

SEQ ID NO: 13850 - DNA, 23 bp, Artificial Sequence
  X-linked inhibitor of apoptosis (XIAP) siRNA
tgcctcagcttcctgagtagctg

SEQ ID NO: 13851 - DNA, 23 bp, Artificial Sequence
  X-linked inhibitor of apoptosis (XIAP) siRNA
gcctcagcttcctgagtagctgg

SEQ ID NO: 13852 - DNA, 23 bp, Artificial Sequence
  X-linked inhibitor of apoptosis (XIAP) siRNA
cctcagcttcctgagtagctgga

SEQ ID NO: 13853 - DNA, 23 bp, Artificial Sequence
  X-linked inhibitor of apoptosis (XIAP) siRNA
ctcagcttcctgagtagctggaa

SEQ ID NO: 13854 - DNA, 23 bp, Artificial Sequence
  X-linked inhibitor of apoptosis (XIAP) siRNA
tcagcttcctgagtagctggaat

SEQ ID NO: 13855 - DNA, 23 bp, Artificial Sequence
  X-linked inhibitor of apoptosis (XIAP) siRNA
cagcttcctgagtagctggaatt

SEQ ID NO: 13856 - DNA, 23 bp, Artificial Sequence
  X-linked inhibitor of apoptosis (XIAP) siRNA
agcttcctgagtagctggaatta

SEQ ID NO: 13857 - DNA, 23 bp, Artificial Sequence
  X-linked inhibitor of apoptosis (XIAP) siRNA
gcttcctgagtagctggaattac

SEQ ID NO: 13858 - DNA, 23 bp, Artificial Sequence
  X-linked inhibitor of apoptosis (XIAP) siRNA
cttcctgagtagctggaattaca

SEQ ID NO: 13859 - DNA, 23 bp, Artificial Sequence
  X-linked inhibitor of apoptosis (XIAP) siRNA
ttcctgagtagctggaattacag

SEQ ID NO: 13860 - DNA, 23 bp, Artificial Sequence
  X-linked inhibitor of apoptosis (XIAP) siRNA
tcctgagtagctggaattacagg

SEQ ID NO: 13861 - DNA, 23 bp, Artificial Sequence
  X-linked inhibitor of apoptosis (XIAP) siRNA
cctgagtagctggaattacaggc

SEQ ID NO: 13862 - DNA, 23 bp, Artificial Sequence
  X-linked inhibitor of apoptosis (XIAP) siRNA
ctgagtagctggaattacaggca

SEQ ID NO: 13863 - DNA, 23 bp, Artificial Sequence
  X-linked inhibitor of apoptosis (XIAP) siRNA
tgagtagctggaattacaggcag

SEQ ID NO: 13864 - DNA, 23 bp, Artificial Sequence
  X-linked inhibitor of apoptosis (XIAP) siRNA
gagtagctggaattacaggcagg

SEQ ID NO: 13865 - DNA, 23 bp, Artificial Sequence
  X-linked inhibitor of apoptosis (XIAP) siRNA
agtagctggaattacaggcaggt

SEQ ID NO: 13866 - DNA, 23 bp, Artificial Sequence
  X-linked inhibitor of apoptosis (XIAP) siRNA
gtagctggaattacaggcaggtg

SEQ ID NO: 13867 - DNA, 23 bp, Artificial Sequence
  X-linked inhibitor of apoptosis (XIAP) siRNA
tagctggaattacaggcaggtgc

SEQ ID NO: 13868 - DNA, 23 bp, Artificial Sequence
  X-linked inhibitor of apoptosis (XIAP) siRNA
agctggaattacaggcaggtgcc

SEQ ID NO: 13869 - DNA, 23 bp, Artificial Sequence
  X-linked inhibitor of apoptosis (XIAP) siRNA
gctggaattacaggcaggtgcca

SEQ ID NO: 13870 - DNA, 23 bp, Artificial Sequence
  X-linked inhibitor of apoptosis (XIAP) siRNA
ctggaattacaggcaggtgccac

SEQ ID NO: 13871 - DNA, 23 bp, Artificial Sequence
  X-linked inhibitor of apoptosis (XIAP) siRNA
tggaattacaggcaggtgccacc

SEQ ID NO: 13872 - DNA, 23 bp, Artificial Sequence
  X-linked inhibitor of apoptosis (XIAP) siRNA
ggaattacaggcaggtgccacca

SEQ ID NO: 13873 - DNA, 23 bp, Artificial Sequence
  X-linked inhibitor of apoptosis (XIAP) siRNA
gaattacaggcaggtgccaccat

SEQ ID NO: 13874 - DNA, 23 bp, Artificial Sequence
  X-linked inhibitor of apoptosis (XIAP) siRNA
aattacaggcaggtgccaccatg

SEQ ID NO: 13875 - DNA, 23 bp, Artificial Sequence
  X-linked inhibitor of apoptosis (XIAP) siRNA
attacaggcaggtgccaccatgc

SEQ ID NO: 13876 - DNA, 23 bp, Artificial Sequence
  X-linked inhibitor of apoptosis (XIAP) siRNA
ttacaggcaggtgccaccatgcc

SEQ ID NO: 13877 - DNA, 23 bp, Artificial Sequence
  X-linked inhibitor of apoptosis (XIAP) siRNA
tacaggcaggtgccaccatgccc

SEQ ID NO: 13878 - DNA, 23 bp, Artificial Sequence
  X-linked inhibitor of apoptosis (XIAP) siRNA
acaggcaggtgccaccatgcccg

SEQ ID NO: 13879 - DNA, 23 bp, Artificial Sequence
  X-linked inhibitor of apoptosis (XIAP) siRNA
caggcaggtgccaccatgcccga

SEQ ID NO: 13880 - DNA, 23 bp, Artificial Sequence
  X-linked inhibitor of apoptosis (XIAP) siRNA
aggcaggtgccaccatgcccgac

SEQ ID NO: 13881 - DNA, 23 bp, Artificial Sequence
  X-linked inhibitor of apoptosis (XIAP) siRNA
ggcaggtgccaccatgcccgact

SEQ ID NO: 13882 - DNA, 23 bp, Artificial Sequence
  X-linked inhibitor of apoptosis (XIAP) siRNA
gcaggtgccaccatgcccgacta

SEQ ID NO: 13883 - DNA, 23 bp, Artificial Sequence
  X-linked inhibitor of apoptosis (XIAP) siRNA
caggtgccaccatgcccgactaa

SEQ ID NO: 13884 - DNA, 23 bp, Artificial Sequence
  X-linked inhibitor of apoptosis (XIAP) siRNA
aggtgccaccatgcccgactaat

SEQ ID NO: 13885 - DNA, 23 bp, Artificial Sequence
  X-linked inhibitor of apoptosis (XIAP) siRNA
ggtgccaccatgcccgactaatt

SEQ ID NO: 13886 - DNA, 23 bp, Artificial Sequence
  X-linked inhibitor of apoptosis (XIAP) siRNA
gtgccaccatgcccgactaattt

SEQ ID NO: 13887 - DNA, 23 bp, Artificial Sequence
  X-linked inhibitor of apoptosis (XIAP) siRNA
tgccaccatgcccgactaatttt

SEQ ID NO: 13888 - DNA, 23 bp, Artificial Sequence
  X-linked inhibitor of apoptosis (XIAP) siRNA
gccaccatgcccgactaattttt

SEQ ID NO: 13889 - DNA, 23 bp, Artificial Sequence
  X-linked inhibitor of apoptosis (XIAP) siRNA
ccaccatgcccgactaatttttt

SEQ ID NO: 13890 - DNA, 23 bp, Artificial Sequence
  X-linked inhibitor of apoptosis (XIAP) siRNA
caccatgcccgactaattttttt

SEQ ID NO: 13891 - DNA, 23 bp, Artificial Sequence
  X-linked inhibitor of apoptosis (XIAP) siRNA
accatgcccgactaatttttttt

SEQ ID NO: 13892 - DNA, 23 bp, Artificial Sequence
  X-linked inhibitor of apoptosis (XIAP) siRNA
ttttttttatttttagtagagac

SEQ ID NO: 13893 - DNA, 23 bp, Artificial Sequence
  X-linked inhibitor of apoptosis (XIAP) siRNA
tttttttatttttagtagagacg

SEQ ID NO: 13894 - DNA, 23 bp, Artificial Sequence
  X-linked inhibitor of apoptosis (XIAP) siRNA
ttttttatttttagtagagacgg

SEQ ID NO: 13895 - DNA, 23 bp, Artificial Sequence
  X-linked inhibitor of apoptosis (XIAP) siRNA
tttttatttttagtagagacggg

SEQ ID NO: 13896 - DNA, 23 bp, Artificial Sequence
  X-linked inhibitor of apoptosis (XIAP) siRNA
ttttatttttagtagagacgggg

SEQ ID NO: 13897 - DNA, 23 bp, Artificial Sequence
  X-linked inhibitor of apoptosis (XIAP) siRNA
tttatttttagtagagacggggt

SEQ ID NO: 13898 - DNA, 23 bp, Artificial Sequence
  X-linked inhibitor of apoptosis (XIAP) siRNA
ttatttttagtagagacggggtt

SEQ ID NO: 13899 - DNA, 23 bp, Artificial Sequence
  X-linked inhibitor of apoptosis (XIAP) siRNA
tatttttagtagagacggggttt

SEQ ID NO: 13900 - DNA, 23 bp, Artificial Sequence
  X-linked inhibitor of apoptosis (XIAP) siRNA
atttttagtagagacggggtttc

SEQ ID NO: 13901 - DNA, 23 bp, Artificial Sequence
  X-linked inhibitor of apoptosis (XIAP) siRNA
tttttagtagagacggggtttca

SEQ ID NO: 13902 - DNA, 23 bp, Artificial Sequence
  X-linked inhibitor of apoptosis (XIAP) siRNA
ttttagtagagacggggtttcac

SEQ ID NO: 13903 - DNA, 23 bp, Artificial Sequence
  X-linked inhibitor of apoptosis (XIAP) siRNA
tttagtagagacggggtttcacc

SEQ ID NO: 13904 - DNA, 23 bp, Artificial Sequence
  X-linked inhibitor of apoptosis (XIAP) siRNA
ttagtagagacggggtttcacca

SEQ ID NO: 13905 - DNA, 23 bp, Artificial Sequence
  X-linked inhibitor of apoptosis (XIAP) siRNA
tagtagagacggggtttcaccat

SEQ ID NO: 13906 - DNA, 23 bp, Artificial Sequence
  X-linked inhibitor of apoptosis (XIAP) siRNA
agtagagacggggtttcaccatg

SEQ ID NO: 13907 - DNA, 23 bp, Artificial Sequence
  X-linked inhibitor of apoptosis (XIAP) siRNA
gtagagacggggtttcaccatgt

SEQ ID NO: 13908 - DNA, 23 bp, Artificial Sequence
  X-linked inhibitor of apoptosis (XIAP) siRNA
tagagacggggtttcaccatgtt

SEQ ID NO: 13909 - DNA, 23 bp, Artificial Sequence
  X-linked inhibitor of apoptosis (XIAP) siRNA
agagacggggtttcaccatgttg

SEQ ID NO: 13910 - DNA, 23 bp, Artificial Sequence
  X-linked inhibitor of apoptosis (XIAP) siRNA
gagacggggtttcaccatgttgg

SEQ ID NO: 13911 - DNA, 23 bp, Artificial Sequence
  X-linked inhibitor of apoptosis (XIAP) siRNA
agacggggtttcaccatgttggc

SEQ ID NO: 13912 - DNA, 23 bp, Artificial Sequence
  X-linked inhibitor of apoptosis (XIAP) siRNA
gacggggtttcaccatgttggcc

SEQ ID NO: 13913 - DNA, 23 bp, Artificial Sequence
  X-linked inhibitor of apoptosis (XIAP) siRNA
acggggtttcaccatgttggcca

SEQ ID NO: 13914 - DNA, 23 bp, Artificial Sequence
  X-linked inhibitor of apoptosis (XIAP) siRNA
cggggtttcaccatgttggccag

SEQ ID NO: 13915 - DNA, 23 bp, Artificial Sequence
  X-linked inhibitor of apoptosis (XIAP) siRNA
ggggtttcaccatgttggccagg

SEQ ID NO: 13916 - DNA, 23 bp, Artificial Sequence
  X-linked inhibitor of apoptosis (XIAP) siRNA
gggtttcaccatgttggccaggc

SEQ ID NO: 13917 - DNA, 23 bp, Artificial Sequence
  X-linked inhibitor of apoptosis (XIAP) siRNA
ggtttcaccatgttggccaggct

SEQ ID NO: 13918 - DNA, 23 bp, Artificial Sequence
  X-linked inhibitor of apoptosis (XIAP) siRNA
gtttcaccatgttggccaggctg

SEQ ID NO: 13919 - DNA, 23 bp, Artificial Sequence
  X-linked inhibitor of apoptosis (XIAP) siRNA
tttcaccatgttggccaggctgg

SEQ ID NO: 13920 - DNA, 23 bp, Artificial Sequence
  X-linked inhibitor of apoptosis (XIAP) siRNA
ttcaccatgttggccaggctggt

SEQ ID NO: 13921 - DNA, 23 bp, Artificial Sequence
  X-linked inhibitor of apoptosis (XIAP) siRNA
tcaccatgttggccaggctggta

SEQ ID NO: 13922 - DNA, 23 bp, Artificial Sequence
  X-linked inhibitor of apoptosis (XIAP) siRNA
caccatgttggccaggctggtat

SEQ ID NO: 13923 - DNA, 23 bp, Artificial Sequence
  X-linked inhibitor of apoptosis (XIAP) siRNA
accatgttggccaggctggtatc

SEQ ID NO: 13924 - DNA, 23 bp, Artificial Sequence
  X-linked inhibitor of apoptosis (XIAP) siRNA
ccatgttggccaggctggtatca

SEQ ID NO: 13925 - DNA, 23 bp, Artificial Sequence
  X-linked inhibitor of apoptosis (XIAP) siRNA
catgttggccaggctggtatcaa

SEQ ID NO: 13926 - DNA, 23 bp, Artificial Sequence
  X-linked inhibitor of apoptosis (XIAP) siRNA
atgttggccaggctggtatcaaa

SEQ ID NO: 13927 - DNA, 23 bp, Artificial Sequence
  X-linked inhibitor of apoptosis (XIAP) siRNA
tgttggccaggctggtatcaaac

SEQ ID NO: 13928 - DNA, 23 bp, Artificial Sequence
  X-linked inhibitor of apoptosis (XIAP) siRNA
gttggccaggctggtatcaaact

SEQ ID NO: 13929 - DNA, 23 bp, Artificial Sequence
  X-linked inhibitor of apoptosis (XIAP) siRNA
ttggccaggctggtatcaaactc

SEQ ID NO: 13930 - DNA, 23 bp, Artificial Sequence
  X-linked inhibitor of apoptosis (XIAP) siRNA
tggccaggctggtatcaaactcc

SEQ ID NO: 13931 - DNA, 23 bp, Artificial Sequence
  X-linked inhibitor of apoptosis (XIAP) siRNA
ggccaggctggtatcaaactcct

SEQ ID NO: 13932 - DNA, 23 bp, Artificial Sequence
  X-linked inhibitor of apoptosis (XIAP) siRNA
gccaggctggtatcaaactcctg

SEQ ID NO: 13933 - DNA, 23 bp, Artificial Sequence
  X-linked inhibitor of apoptosis (XIAP) siRNA
ccaggctggtatcaaactcctga

SEQ ID NO: 13934 - DNA, 23 bp, Artificial Sequence
  X-linked inhibitor of apoptosis (XIAP) siRNA
caggctggtatcaaactcctgac

SEQ ID NO: 13935 - DNA, 23 bp, Artificial Sequence
  X-linked inhibitor of apoptosis (XIAP) siRNA
aggctggtatcaaactcctgacc

SEQ ID NO: 13936 - DNA, 23 bp, Artificial Sequence
  X-linked inhibitor of apoptosis (XIAP) siRNA
ggctggtatcaaactcctgacct

SEQ ID NO: 13937 - DNA, 23 bp, Artificial Sequence
  X-linked inhibitor of apoptosis (XIAP) siRNA
gctggtatcaaactcctgacctc

SEQ ID NO: 13938 - DNA, 23 bp, Artificial Sequence
  X-linked inhibitor of apoptosis (XIAP) siRNA
ctggtatcaaactcctgacctca

SEQ ID NO: 13939 - DNA, 23 bp, Artificial Sequence
  X-linked inhibitor of apoptosis (XIAP) siRNA
tggtatcaaactcctgacctcaa

SEQ ID NO: 13940 - DNA, 23 bp, Artificial Sequence
  X-linked inhibitor of apoptosis (XIAP) siRNA
ggtatcaaactcctgacctcaag

SEQ ID NO: 13941 - DNA, 23 bp, Artificial Sequence
  X-linked inhibitor of apoptosis (XIAP) siRNA
gtatcaaactcctgacctcaaga

SEQ ID NO: 13942 - DNA, 23 bp, Artificial Sequence
  X-linked inhibitor of apoptosis (XIAP) siRNA
tatcaaactcctgacctcaagag

SEQ ID NO: 13943 - DNA, 23 bp, Artificial Sequence
  X-linked inhibitor of apoptosis (XIAP) siRNA
atcaaactcctgacctcaagaga

SEQ ID NO: 13944 - DNA, 23 bp, Artificial Sequence
  X-linked inhibitor of apoptosis (XIAP) siRNA
tcaaactcctgacctcaagagat

SEQ ID NO: 13945 - DNA, 23 bp, Artificial Sequence
  X-linked inhibitor of apoptosis (XIAP) siRNA
caaactcctgacctcaagagatc

SEQ ID NO: 13946 - DNA, 23 bp, Artificial Sequence
  X-linked inhibitor of apoptosis (XIAP) siRNA
aaactcctgacctcaagagatcc

SEQ ID NO: 13947 - DNA, 23 bp, Artificial Sequence
  X-linked inhibitor of apoptosis (XIAP) siRNA
aactcctgacctcaagagatcca

SEQ ID NO: 13948 - DNA, 23 bp, Artificial Sequence
  X-linked inhibitor of apoptosis (XIAP) siRNA
actcctgacctcaagagatccac

SEQ ID NO: 13949 - DNA, 23 bp, Artificial Sequence
  X-linked inhibitor of apoptosis (XIAP) siRNA
ctcctgacctcaagagatccact

SEQ ID NO: 13950 - DNA, 23 bp, Artificial Sequence
  X-linked inhibitor of apoptosis (XIAP) siRNA
tcctgacctcaagagatccactc

SEQ ID NO: 13951 - DNA, 23 bp, Artificial Sequence
  X-linked inhibitor of apoptosis (XIAP) siRNA
cctgacctcaagagatccactcg

SEQ ID NO: 13952 - DNA, 23 bp, Artificial Sequence
  X-linked inhibitor of apoptosis (XIAP) siRNA
ctgacctcaagagatccactcgc

SEQ ID NO: 13953 - DNA, 23 bp, Artificial Sequence
  X-linked inhibitor of apoptosis (XIAP) siRNA
tgacctcaagagatccactcgcc

SEQ ID NO: 13954 - DNA, 23 bp, Artificial Sequence
  X-linked inhibitor of apoptosis (XIAP) siRNA
gacctcaagagatccactcgcct

SEQ ID NO: 13955 - DNA, 23 bp, Artificial Sequence
  X-linked inhibitor of apoptosis (XIAP) siRNA
acctcaagagatccactcgcctt

SEQ ID NO: 13956 - DNA, 23 bp, Artificial Sequence
  X-linked inhibitor of apoptosis (XIAP) siRNA
cctcaagagatccactcgccttg

SEQ ID NO: 13957 - DNA, 23 bp, Artificial Sequence
  X-linked inhibitor of apoptosis (XIAP) siRNA
ctcaagagatccactcgccttgc

SEQ ID NO: 13958 - DNA, 23 bp, Artificial Sequence
  X-linked inhibitor of apoptosis (XIAP) siRNA
tcaagagatccactcgccttgcc

SEQ ID NO: 13959 - DNA, 23 bp, Artificial Sequence
  X-linked inhibitor of apoptosis (XIAP) siRNA
caagagatccactcgccttgccc

SEQ ID NO: 13960 - DNA, 23 bp, Artificial Sequence
  X-linked inhibitor of apoptosis (XIAP) siRNA
aagagatccactcgccttgccct

SEQ ID NO: 13961 - DNA, 23 bp, Artificial Sequence
  X-linked inhibitor of apoptosis (XIAP) siRNA
agagatccactcgccttgccctc

SEQ ID NO: 13962 - DNA, 23 bp, Artificial Sequence
  X-linked inhibitor of apoptosis (XIAP) siRNA
gagatccactcgccttgccctcc

SEQ ID NO: 13963 - DNA, 23 bp, Artificial Sequence
  X-linked inhibitor of apoptosis (XIAP) siRNA
agatccactcgccttgccctccc

SEQ ID NO: 13964 - DNA, 23 bp, Artificial Sequence
  X-linked inhibitor of apoptosis (XIAP) siRNA
gatccactcgccttgccctccca

SEQ ID NO: 13965 - DNA, 23 bp, Artificial Sequence
  X-linked inhibitor of apoptosis (XIAP) siRNA
atccactcgccttgccctcccaa

SEQ ID NO: 13966 - DNA, 23 bp, Artificial Sequence
  X-linked inhibitor of apoptosis (XIAP) siRNA
tccactcgccttgccctcccaaa

SEQ ID NO: 13967 - DNA, 23 bp, Artificial Sequence
  X-linked inhibitor of apoptosis (XIAP) siRNA
ccactcgccttgccctcccaaag

SEQ ID NO: 13968 - DNA, 23 bp, Artificial Sequence
  X-linked inhibitor of apoptosis (XIAP) siRNA
cactcgccttgccctcccaaagt

SEQ ID NO: 13969 - DNA, 23 bp, Artificial Sequence
  X-linked inhibitor of apoptosis (XIAP) siRNA
actcgccttgccctcccaaagtg

SEQ ID NO: 13970 - DNA, 23 bp, Artificial Sequence
  X-linked inhibitor of apoptosis (XIAP) siRNA
ctcgccttgccctcccaaagtgc

SEQ ID NO: 13971 - DNA, 23 bp, Artificial Sequence
  X-linked inhibitor of apoptosis (XIAP) siRNA
tcgccttgccctcccaaagtgct

SEQ ID NO: 13972 - DNA, 23 bp, Artificial Sequence
  X-linked inhibitor of apoptosis (XIAP) siRNA
cgccttgccctcccaaagtgctg

SEQ ID NO: 13973 - DNA, 23 bp, Artificial Sequence
  X-linked inhibitor of apoptosis (XIAP) siRNA
gccttgccctcccaaagtgctgg

SEQ ID NO: 13974 - DNA, 23 bp, Artificial Sequence
  X-linked inhibitor of apoptosis (XIAP) siRNA
ccttgccctcccaaagtgctggg

SEQ ID NO: 13975 - DNA, 23 bp, Artificial Sequence
  X-linked inhibitor of apoptosis (XIAP) siRNA
cttgccctcccaaagtgctggga

SEQ ID NO: 13976 - DNA, 23 bp, Artificial Sequence
  X-linked inhibitor of apoptosis (XIAP) siRNA
ttgccctcccaaagtgctgggat

SEQ ID NO: 13977 - DNA, 23 bp, Artificial Sequence
  X-linked inhibitor of apoptosis (XIAP) siRNA
tgccctcccaaagtgctgggatt

SEQ ID NO: 13978 - DNA, 23 bp, Artificial Sequence
  X-linked inhibitor of apoptosis (XIAP) siRNA
gccctcccaaagtgctgggatta

SEQ ID NO: 13979 - DNA, 23 bp, Artificial Sequence
  X-linked inhibitor of apoptosis (XIAP) siRNA
ccctcccaaagtgctgggattac

SEQ ID NO: 13980 - DNA, 23 bp, Artificial Sequence
  X-linked inhibitor of apoptosis (XIAP) siRNA
cctcccaaagtgctgggattaca

SEQ ID NO: 13981 - DNA, 23 bp, Artificial Sequence
  X-linked inhibitor of apoptosis (XIAP) siRNA
ctcccaaagtgctgggattacag

SEQ ID NO: 13982 - DNA, 23 bp, Artificial Sequence
  X-linked inhibitor of apoptosis (XIAP) siRNA
tcccaaagtgctgggattacagg

SEQ ID NO: 13983 - DNA, 23 bp, Artificial Sequence
  X-linked inhibitor of apoptosis (XIAP) siRNA
cccaaagtgctgggattacaggc

SEQ ID NO: 13984 - DNA, 23 bp, Artificial Sequence
  X-linked inhibitor of apoptosis (XIAP) siRNA
ccaaagtgctgggattacaggct

SEQ ID NO: 13985 - DNA, 23 bp, Artificial Sequence
  X-linked inhibitor of apoptosis (XIAP) siRNA
caaagtgctgggattacaggctt

SEQ ID NO: 13986 - DNA, 23 bp, Artificial Sequence
  X-linked inhibitor of apoptosis (XIAP) siRNA
aaagtgctgggattacaggcttg

SEQ ID NO: 13987 - DNA, 23 bp, Artificial Sequence
  X-linked inhibitor of apoptosis (XIAP) siRNA
aagtgctgggattacaggcttga

SEQ ID NO: 13988 - DNA, 23 bp, Artificial Sequence
  X-linked inhibitor of apoptosis (XIAP) siRNA
agtgctgggattacaggcttgag

SEQ ID NO: 13989 - DNA, 23 bp, Artificial Sequence
  X-linked inhibitor of apoptosis (XIAP) siRNA
gtgctgggattacaggcttgagc

SEQ ID NO: 13990 - DNA, 23 bp, Artificial Sequence
  X-linked inhibitor of apoptosis (XIAP) siRNA
tgctgggattacaggcttgagcc

SEQ ID NO: 13991 - DNA, 23 bp, Artificial Sequence
  X-linked inhibitor of apoptosis (XIAP) siRNA
gctgggattacaggcttgagcca

SEQ ID NO: 13992 - DNA, 23 bp, Artificial Sequence
  X-linked inhibitor of apoptosis (XIAP) siRNA
ctgggattacaggcttgagccac

SEQ ID NO: 13993 - DNA, 23 bp, Artificial Sequence
  X-linked inhibitor of apoptosis (XIAP) siRNA
tgggattacaggcttgagccacc

SEQ ID NO: 13994 - DNA, 23 bp, Artificial Sequence
  X-linked inhibitor of apoptosis (XIAP) siRNA
gggattacaggcttgagccacca

SEQ ID NO: 13995 - DNA, 23 bp, Artificial Sequence
  X-linked inhibitor of apoptosis (XIAP) siRNA
ggattacaggcttgagccaccac

SEQ ID NO: 13996 - DNA, 23 bp, Artificial Sequence
  X-linked inhibitor of apoptosis (XIAP) siRNA
gattacaggcttgagccaccacg

SEQ ID NO: 13997 - DNA, 23 bp, Artificial Sequence
  X-linked inhibitor of apoptosis (XIAP) siRNA
attacaggcttgagccaccacgc

SEQ ID NO: 13998 - DNA, 23 bp, Artificial Sequence
  X-linked inhibitor of apoptosis (XIAP) siRNA
ttacaggcttgagccaccacgcc

SEQ ID NO: 13999 - DNA, 23 bp, Artificial Sequence
  X-linked inhibitor of apoptosis (XIAP) siRNA
tacaggcttgagccaccacgccc

SEQ ID NO: 14000 - DNA, 23 bp, Artificial Sequence
  X-linked inhibitor of apoptosis (XIAP) siRNA
acaggcttgagccaccacgcccg

SEQ ID NO: 14001 - DNA, 23 bp, Artificial Sequence
  X-linked inhibitor of apoptosis (XIAP) siRNA
caggcttgagccaccacgcccgg

SEQ ID NO: 14002 - DNA, 23 bp, Artificial Sequence
  X-linked inhibitor of apoptosis (XIAP) siRNA
aggcttgagccaccacgcccggc

SEQ ID NO: 14003 - DNA, 23 bp, Artificial Sequence
  X-linked inhibitor of apoptosis (XIAP) siRNA
ggcttgagccaccacgcccggct

SEQ ID NO: 14004 - DNA, 23 bp, Artificial Sequence
  X-linked inhibitor of apoptosis (XIAP) siRNA
gcttgagccaccacgcccggcta

SEQ ID NO: 14005 - DNA, 23 bp, Artificial Sequence
  X-linked inhibitor of apoptosis (XIAP) siRNA
cttgagccaccacgcccggctaa

SEQ ID NO: 14006 - DNA, 23 bp, Artificial Sequence
  X-linked inhibitor of apoptosis (XIAP) siRNA
ttgagccaccacgcccggctaaa

SEQ ID NO: 14007 - DNA, 23 bp, Artificial Sequence
  X-linked inhibitor of apoptosis (XIAP) siRNA
tgagccaccacgcccggctaaaa

SEQ ID NO: 14008 - DNA, 23 bp, Artificial Sequence
  X-linked inhibitor of apoptosis (XIAP) siRNA
gagccaccacgcccggctaaaac

SEQ ID NO: 14009 - DNA, 23 bp, Artificial Sequence
  X-linked inhibitor of apoptosis (XIAP) siRNA
agccaccacgcccggctaaaaca

SEQ ID NO: 14010 - DNA, 23 bp, Artificial Sequence
  X-linked inhibitor of apoptosis (XIAP) siRNA
gccaccacgcccggctaaaacat

SEQ ID NO: 14011 - DNA, 23 bp, Artificial Sequence
  X-linked inhibitor of apoptosis (XIAP) siRNA
ccaccacgcccggctaaaacatt

SEQ ID NO: 14012 - DNA, 23 bp, Artificial Sequence
  X-linked inhibitor of apoptosis (XIAP) siRNA
caccacgcccggctaaaacattg

SEQ ID NO: 14013 - DNA, 23 bp, Artificial Sequence
  X-linked inhibitor of apoptosis (XIAP) siRNA
accacgcccggctaaaacattgc

SEQ ID NO: 14014 - DNA, 23 bp, Artificial Sequence
  X-linked inhibitor of apoptosis (XIAP) siRNA
ccacgcccggctaaaacattgca

SEQ ID NO: 14015 - DNA, 23 bp, Artificial Sequence
  X-linked inhibitor of apoptosis (XIAP) siRNA
cacgcccggctaaaacattgcaa

SEQ ID NO: 14016 - DNA, 23 bp, Artificial Sequence
  X-linked inhibitor of apoptosis (XIAP) siRNA
acgcccggctaaaacattgcaaa

SEQ ID NO: 14017 - DNA, 23 bp, Artificial Sequence
  X-linked inhibitor of apoptosis (XIAP) siRNA
cgcccggctaaaacattgcaaat

SEQ ID NO: 14018 - DNA, 23 bp, Artificial Sequence
  X-linked inhibitor of apoptosis (XIAP) siRNA
gcccggctaaaacattgcaaatt

SEQ ID NO: 14019 - DNA, 23 bp, Artificial Sequence
  X-linked inhibitor of apoptosis (XIAP) siRNA
cccggctaaaacattgcaaattt

SEQ ID NO: 14020 - DNA, 23 bp, Artificial Sequence
  X-linked inhibitor of apoptosis (XIAP) siRNA
ccggctaaaacattgcaaattta

SEQ ID NO: 14021 - DNA, 23 bp, Artificial Sequence
  X-linked inhibitor of apoptosis (XIAP) siRNA
cggctaaaacattgcaaatttaa

SEQ ID NO: 14022 - DNA, 23 bp, Artificial Sequence
  X-linked inhibitor of apoptosis (XIAP) siRNA
ggctaaaacattgcaaatttaaa

SEQ ID NO: 14023 - DNA, 23 bp, Artificial Sequence
  X-linked inhibitor of apoptosis (XIAP) siRNA
gctaaaacattgcaaatttaaat

SEQ ID NO: 14024 - DNA, 23 bp, Artificial Sequence
  X-linked inhibitor of apoptosis (XIAP) siRNA
ctaaaacattgcaaatttaaatg

SEQ ID NO: 14025 - DNA, 23 bp, Artificial Sequence
  X-linked inhibitor of apoptosis (XIAP) siRNA
taaaacattgcaaatttaaatga

SEQ ID NO: 14026 - DNA, 23 bp, Artificial Sequence
  X-linked inhibitor of apoptosis (XIAP) siRNA
aaaacattgcaaatttaaatgag

SEQ ID NO: 14027 - DNA, 23 bp, Artificial Sequence
  X-linked inhibitor of apoptosis (XIAP) siRNA
aaacattgcaaatttaaatgaga

SEQ ID NO: 14028 - DNA, 23 bp, Artificial Sequence
  X-linked inhibitor of apoptosis (XIAP) siRNA
aacattgcaaatttaaatgagag

SEQ ID NO: 14029 - DNA, 23 bp, Artificial Sequence
  X-linked inhibitor of apoptosis (XIAP) siRNA
acattgcaaatttaaatgagagt

SEQ ID NO: 14030 - DNA, 23 bp, Artificial Sequence
  X-linked inhibitor of apoptosis (XIAP) siRNA
cattgcaaatttaaatgagagtt

SEQ ID NO: 14031 - DNA, 23 bp, Artificial Sequence
  X-linked inhibitor of apoptosis (XIAP) siRNA
attgcaaatttaaatgagagttt

SEQ ID NO: 14032 - DNA, 23 bp, Artificial Sequence
  X-linked inhibitor of apoptosis (XIAP) siRNA
ttgcaaatttaaatgagagtttt

SEQ ID NO: 14033 - DNA, 23 bp, Artificial Sequence
  X-linked inhibitor of apoptosis (XIAP) siRNA
tgcaaatttaaatgagagtttta

SEQ ID NO: 14034 - DNA, 23 bp, Artificial Sequence
  X-linked inhibitor of apoptosis (XIAP) siRNA
gcaaatttaaatgagagttttaa

SEQ ID NO: 14035 - DNA, 23 bp, Artificial Sequence
  X-linked inhibitor of apoptosis (XIAP) siRNA
caaatttaaatgagagttttaaa

SEQ ID NO: 14036 - DNA, 23 bp, Artificial Sequence
  X-linked inhibitor of apoptosis (XIAP) siRNA
aaatttaaatgagagttttaaaa

SEQ ID NO: 14037 - DNA, 23 bp, Artificial Sequence
  X-linked inhibitor of apoptosis (XIAP) siRNA
aatttaaatgagagttttaaaaa

SEQ ID NO: 14038 - DNA, 23 bp, Artificial Sequence
  X-linked inhibitor of apoptosis (XIAP) siRNA
atttaaatgagagttttaaaaat

SEQ ID NO: 14039 - DNA, 23 bp, Artificial Sequence
  X-linked inhibitor of apoptosis (XIAP) siRNA
tttaaatgagagttttaaaaatt

SEQ ID NO: 14040 - DNA, 23 bp, Artificial Sequence
  X-linked inhibitor of apoptosis (XIAP) siRNA
ttaaatgagagttttaaaaatta

SEQ ID NO: 14041 - DNA, 23 bp, Artificial Sequence
  X-linked inhibitor of apoptosis (XIAP) siRNA
taaatgagagttttaaaaattaa

SEQ ID NO: 14042 - DNA, 23 bp, Artificial Sequence
  X-linked inhibitor of apoptosis (XIAP) siRNA
aaatgagagttttaaaaattaaa

SEQ ID NO: 14043 - DNA, 23 bp, Artificial Sequence
  X-linked inhibitor of apoptosis (XIAP) siRNA
aatgagagttttaaaaattaaat

SEQ ID NO: 14044 - DNA, 23 bp, Artificial Sequence
  X-linked inhibitor of apoptosis (XIAP) siRNA
atgagagttttaaaaattaaata

SEQ ID NO: 14045 - DNA, 23 bp, Artificial Sequence
  X-linked inhibitor of apoptosis (XIAP) siRNA
tgagagttttaaaaattaaataa

SEQ ID NO: 14046 - DNA, 23 bp, Artificial Sequence
  X-linked inhibitor of apoptosis (XIAP) siRNA
gagagttttaaaaattaaataat

SEQ ID NO: 14047 - DNA, 23 bp, Artificial Sequence
  X-linked inhibitor of apoptosis (XIAP) siRNA
agagttttaaaaattaaataatg

SEQ ID NO: 14048 - DNA, 23 bp, Artificial Sequence
  X-linked inhibitor of apoptosis (XIAP) siRNA
gagttttaaaaattaaataatga

SEQ ID NO: 14049 - DNA, 23 bp, Artificial Sequence
  X-linked inhibitor of apoptosis (XIAP) siRNA
agttttaaaaattaaataatgac

SEQ ID NO: 14050 - DNA, 23 bp, Artificial Sequence
  X-linked inhibitor of apoptosis (XIAP) siRNA
gttttaaaaattaaataatgact

SEQ ID NO: 14051 - DNA, 23 bp, Artificial Sequence
  X-linked inhibitor of apoptosis (XIAP) siRNA
ttttaaaaattaaataatgactg

SEQ ID NO: 14052 - DNA, 23 bp, Artificial Sequence
  X-linked inhibitor of apoptosis (XIAP) siRNA
tttaaaaattaaataatgactgc

SEQ ID NO: 14053 - DNA, 23 bp, Artificial Sequence
  X-linked inhibitor of apoptosis (XIAP) siRNA
ttaaaaattaaataatgactgcc

SEQ ID NO: 14054 - DNA, 23 bp, Artificial Sequence
  X-linked inhibitor of apoptosis (XIAP) siRNA
taaaaattaaataatgactgccc

SEQ ID NO: 14055 - DNA, 23 bp, Artificial Sequence
  X-linked inhibitor of apoptosis (XIAP) siRNA
aaaaattaaataatgactgccct

SEQ ID NO: 14056 - DNA, 23 bp, Artificial Sequence
  X-linked inhibitor of apoptosis (XIAP) siRNA
aaaattaaataatgactgccctg

SEQ ID NO: 14057 - DNA, 23 bp, Artificial Sequence
  X-linked inhibitor of apoptosis (XIAP) siRNA
aaattaaataatgactgccctgt

SEQ ID NO: 14058 - DNA, 23 bp, Artificial Sequence
  X-linked inhibitor of apoptosis (XIAP) siRNA
aattaaataatgactgccctgtt

SEQ ID NO: 14059 - DNA, 23 bp, Artificial Sequence
  X-linked inhibitor of apoptosis (XIAP) siRNA
attaaataatgactgccctgttt

SEQ ID NO: 14060 - DNA, 23 bp, Artificial Sequence
  X-linked inhibitor of apoptosis (XIAP) siRNA
ttaaataatgactgccctgtttc

SEQ ID NO: 14061 - DNA, 23 bp, Artificial Sequence
  X-linked inhibitor of apoptosis (XIAP) siRNA
taaataatgactgccctgtttct

SEQ ID NO: 14062 - DNA, 23 bp, Artificial Sequence
  X-linked inhibitor of apoptosis (XIAP) siRNA
aaataatgactgccctgtttctg

SEQ ID NO: 14063 - DNA, 23 bp, Artificial Sequence
  X-linked inhibitor of apoptosis (XIAP) siRNA
aataatgactgccctgtttctgt

SEQ ID NO: 14064 - DNA, 23 bp, Artificial Sequence
  X-linked inhibitor of apoptosis (XIAP) siRNA
ataatgactgccctgtttctgtt

SEQ ID NO: 14065 - DNA, 23 bp, Artificial Sequence
  X-linked inhibitor of apoptosis (XIAP) siRNA
taatgactgccctgtttctgttt

SEQ ID NO: 14066 - DNA, 23 bp, Artificial Sequence
  X-linked inhibitor of apoptosis (XIAP) siRNA
aatgactgccctgtttctgtttt

SEQ ID NO: 14067 - DNA, 23 bp, Artificial Sequence
  X-linked inhibitor of apoptosis (XIAP) siRNA
atgactgccctgtttctgtttta

SEQ ID NO: 14068 - DNA, 23 bp, Artificial Sequence
  X-linked inhibitor of apoptosis (XIAP) siRNA
tgactgccctgtttctgttttag

SEQ ID NO: 14069 - DNA, 23 bp, Artificial Sequence
  X-linked inhibitor of apoptosis (XIAP) siRNA
gactgccctgtttctgttttagt

SEQ ID NO: 14070 - DNA, 23 bp, Artificial Sequence
  X-linked inhibitor of apoptosis (XIAP) siRNA
actgccctgtttctgttttagta

SEQ ID NO: 14071 - DNA, 23 bp, Artificial Sequence
  X-linked inhibitor of apoptosis (XIAP) siRNA
ctgccctgtttctgttttagtat

SEQ ID NO: 14072 - DNA, 23 bp, Artificial Sequence
  X-linked inhibitor of apoptosis (XIAP) siRNA
tgccctgtttctgttttagtatg

SEQ ID NO: 14073 - DNA, 23 bp, Artificial Sequence
  X-linked inhibitor of apoptosis (XIAP) siRNA
gccctgtttctgttttagtatgt

SEQ ID NO: 14074 - DNA, 23 bp, Artificial Sequence
  X-linked inhibitor of apoptosis (XIAP) siRNA
ccctgtttctgttttagtatgta

SEQ ID NO: 14075 - DNA, 23 bp, Artificial Sequence
  X-linked inhibitor of apoptosis (XIAP) siRNA
cctgtttctgttttagtatgtaa

SEQ ID NO: 14076 - DNA, 23 bp, Artificial Sequence
  X-linked inhibitor of apoptosis (XIAP) siRNA
ctgtttctgttttagtatgtaaa

SEQ ID NO: 14077 - DNA, 23 bp, Artificial Sequence
  X-linked inhibitor of apoptosis (XIAP) siRNA
tgtttctgttttagtatgtaaat

SEQ ID NO: 14078 - DNA, 23 bp, Artificial Sequence
  X-linked inhibitor of apoptosis (XIAP) siRNA
gtttctgttttagtatgtaaatc

SEQ ID NO: 14079 - DNA, 23 bp, Artificial Sequence
  X-linked inhibitor of apoptosis (XIAP) siRNA
tttctgttttagtatgtaaatcc

SEQ ID NO: 14080 - DNA, 23 bp, Artificial Sequence
  X-linked inhibitor of apoptosis (XIAP) siRNA
ttctgttttagtatgtaaatcct

SEQ ID NO: 14081 - DNA, 23 bp, Artificial Sequence
  X-linked inhibitor of apoptosis (XIAP) siRNA
tctgttttagtatgtaaatcctc

SEQ ID NO: 14082 - DNA, 23 bp, Artificial Sequence
  X-linked inhibitor of apoptosis (XIAP) siRNA
ctgttttagtatgtaaatcctca

SEQ ID NO: 14083 - DNA, 23 bp, Artificial Sequence
  X-linked inhibitor of apoptosis (XIAP) siRNA
tgttttagtatgtaaatcctcag

SEQ ID NO: 14084 - DNA, 23 bp, Artificial Sequence
  X-linked inhibitor of apoptosis (XIAP) siRNA
gttttagtatgtaaatcctcagt

SEQ ID NO: 14085 - DNA, 23 bp, Artificial Sequence
  X-linked inhibitor of apoptosis (XIAP) siRNA
ttttagtatgtaaatcctcagtt

SEQ ID NO: 14086 - DNA, 23 bp, Artificial Sequence
  X-linked inhibitor of apoptosis (XIAP) siRNA
tttagtatgtaaatcctcagttc

SEQ ID NO: 14087 - DNA, 23 bp, Artificial Sequence
  X-linked inhibitor of apoptosis (XIAP) siRNA
ttagtatgtaaatcctcagttct

SEQ ID NO: 14088 - DNA, 23 bp, Artificial Sequence
  X-linked inhibitor of apoptosis (XIAP) siRNA
tagtatgtaaatcctcagttctt

SEQ ID NO: 14089 - DNA, 23 bp, Artificial Sequence
  X-linked inhibitor of apoptosis (XIAP) siRNA
agtatgtaaatcctcagttcttc

SEQ ID NO: 14090 - DNA, 23 bp, Artificial Sequence
  X-linked inhibitor of apoptosis (XIAP) siRNA
gtatgtaaatcctcagttcttca

SEQ ID NO: 14091 - DNA, 23 bp, Artificial Sequence
  X-linked inhibitor of apoptosis (XIAP) siRNA
tatgtaaatcctcagttcttcac

SEQ ID NO: 14092 - DNA, 23 bp, Artificial Sequence
  X-linked inhibitor of apoptosis (XIAP) siRNA
atgtaaatcctcagttcttcacc

SEQ ID NO: 14093 - DNA, 23 bp, Artificial Sequence
  X-linked inhibitor of apoptosis (XIAP) siRNA
tgtaaatcctcagttcttcacct

SEQ ID NO: 14094 - DNA, 23 bp, Artificial Sequence
  X-linked inhibitor of apoptosis (XIAP) siRNA
gtaaatcctcagttcttcacctt

SEQ ID NO: 14095 - DNA, 23 bp, Artificial Sequence
  X-linked inhibitor of apoptosis (XIAP) siRNA
taaatcctcagttcttcaccttt

SEQ ID NO: 14096 - DNA, 23 bp, Artificial Sequence
  X-linked inhibitor of apoptosis (XIAP) siRNA
aaatcctcagttcttcacctttg

SEQ ID NO: 14097 - DNA, 23 bp, Artificial Sequence
  X-linked inhibitor of apoptosis (XIAP) siRNA
aatcctcagttcttcacctttgc

SEQ ID NO: 14098 - DNA, 23 bp, Artificial Sequence
  X-linked inhibitor of apoptosis (XIAP) siRNA
atcctcagttcttcacctttgca

SEQ ID NO: 14099 - DNA, 23 bp, Artificial Sequence
  X-linked inhibitor of apoptosis (XIAP) siRNA
tcctcagttcttcacctttgcac

SEQ ID NO: 14100 - DNA, 23 bp, Artificial Sequence
  X-linked inhibitor of apoptosis (XIAP) siRNA
cctcagttcttcacctttgcact

SEQ ID NO: 14101 - DNA, 23 bp, Artificial Sequence
  X-linked inhibitor of apoptosis (XIAP) siRNA
ctcagttcttcacctttgcactg

SEQ ID NO: 14102 - DNA, 23 bp, Artificial Sequence
  X-linked inhibitor of apoptosis (XIAP) siRNA
tcagttcttcacctttgcactgt

SEQ ID NO: 14103 - DNA, 23 bp, Artificial Sequence
  X-linked inhibitor of apoptosis (XIAP) siRNA
cagttcttcacctttgcactgtc

SEQ ID NO: 14104 - DNA, 23 bp, Artificial Sequence
  X-linked inhibitor of apoptosis (XIAP) siRNA
agttcttcacctttgcactgtct

SEQ ID NO: 14105 - DNA, 23 bp, Artificial Sequence
  X-linked inhibitor of apoptosis (XIAP) siRNA
gttcttcacctttgcactgtctg

SEQ ID NO: 14106 - DNA, 23 bp, Artificial Sequence
  X-linked inhibitor of apoptosis (XIAP) siRNA
ttcttcacctttgcactgtctgc

SEQ ID NO: 14107 - DNA, 23 bp, Artificial Sequence
  X-linked inhibitor of apoptosis (XIAP) siRNA
tcttcacctttgcactgtctgcc

SEQ ID NO: 14108 - DNA, 23 bp, Artificial Sequence
  X-linked inhibitor of apoptosis (XIAP) siRNA
cttcacctttgcactgtctgcca

SEQ ID NO: 14109 - DNA, 23 bp, Artificial Sequence
  X-linked inhibitor of apoptosis (XIAP) siRNA
ttcacctttgcactgtctgccac

SEQ ID NO: 14110 - DNA, 23 bp, Artificial Sequence
  X-linked inhibitor of apoptosis (XIAP) siRNA
tcacctttgcactgtctgccact

SEQ ID NO: 14111 - DNA, 23 bp, Artificial Sequence
  X-linked inhibitor of apoptosis (XIAP) siRNA
cacctttgcactgtctgccactt

SEQ ID NO: 14112 - DNA, 23 bp, Artificial Sequence
  X-linked inhibitor of apoptosis (XIAP) siRNA
acctttgcactgtctgccactta

SEQ ID NO: 14113 - DNA, 23 bp, Artificial Sequence
  X-linked inhibitor of apoptosis (XIAP) siRNA
cctttgcactgtctgccacttag

SEQ ID NO: 14114 - DNA, 23 bp, Artificial Sequence
  X-linked inhibitor of apoptosis (XIAP) siRNA
ctttgcactgtctgccacttagt

SEQ ID NO: 14115 - DNA, 23 bp, Artificial Sequence
  X-linked inhibitor of apoptosis (XIAP) siRNA
tttgcactgtctgccacttagtt

SEQ ID NO: 14116 - DNA, 23 bp, Artificial Sequence
  X-linked inhibitor of apoptosis (XIAP) siRNA
ttgcactgtctgccacttagttt

SEQ ID NO: 14117 - DNA, 23 bp, Artificial Sequence
  X-linked inhibitor of apoptosis (XIAP) siRNA
tgcactgtctgccacttagtttg

SEQ ID NO: 14118 - DNA, 23 bp, Artificial Sequence
  X-linked inhibitor of apoptosis (XIAP) siRNA
gcactgtctgccacttagtttgg

SEQ ID NO: 14119 - DNA, 23 bp, Artificial Sequence
  X-linked inhibitor of apoptosis (XIAP) siRNA
cactgtctgccacttagtttggt

SEQ ID NO: 14120 - DNA, 23 bp, Artificial Sequence
  X-linked inhibitor of apoptosis (XIAP) siRNA
actgtctgccacttagtttggtt

SEQ ID NO: 14121 - DNA, 23 bp, Artificial Sequence
  X-linked inhibitor of apoptosis (XIAP) siRNA
ctgtctgccacttagtttggtta

SEQ ID NO: 14122 - DNA, 23 bp, Artificial Sequence
  X-linked inhibitor of apoptosis (XIAP) siRNA
tgtctgccacttagtttggttat

SEQ ID NO: 14123 - DNA, 23 bp, Artificial Sequence
  X-linked inhibitor of apoptosis (XIAP) siRNA
gtctgccacttagtttggttata

SEQ ID NO: 14124 - DNA, 23 bp, Artificial Sequence
  X-linked inhibitor of apoptosis (XIAP) siRNA
tctgccacttagtttggttatat

SEQ ID NO: 14125 - DNA, 23 bp, Artificial Sequence
  X-linked inhibitor of apoptosis (XIAP) siRNA
ctgccacttagtttggttatata

SEQ ID NO: 14126 - DNA, 23 bp, Artificial Sequence
  X-linked inhibitor of apoptosis (XIAP) siRNA
tgccacttagtttggttatatag

SEQ ID NO: 14127 - DNA, 23 bp, Artificial Sequence
  X-linked inhibitor of apoptosis (XIAP) siRNA
gccacttagtttggttatatagt

SEQ ID NO: 14128 - DNA, 23 bp, Artificial Sequence
  X-linked inhibitor of apoptosis (XIAP) siRNA
ccacttagtttggttatatagtc

SEQ ID NO: 14129 - DNA, 23 bp, Artificial Sequence
  X-linked inhibitor of apoptosis (XIAP) siRNA
cacttagtttggttatatagtca

SEQ ID NO: 14130 - DNA, 23 bp, Artificial Sequence
  X-linked inhibitor of apoptosis (XIAP) siRNA
acttagtttggttatatagtcat

SEQ ID NO: 14131 - DNA, 23 bp, Artificial Sequence
  X-linked inhibitor of apoptosis (XIAP) siRNA
cttagtttggttatatagtcatt

SEQ ID NO: 14132 - DNA, 23 bp, Artificial Sequence
  X-linked inhibitor of apoptosis (XIAP) siRNA
ttagtttggttatatagtcatta

SEQ ID NO: 14133 - DNA, 23 bp, Artificial Sequence
  X-linked inhibitor of apoptosis (XIAP) siRNA
tagtttggttatatagtcattaa

SEQ ID NO: 14134 - DNA, 23 bp, Artificial Sequence
  X-linked inhibitor of apoptosis (XIAP) siRNA
agtttggttatatagtcattaac

SEQ ID NO: 14135 - DNA, 23 bp, Artificial Sequence
  X-linked inhibitor of apoptosis (XIAP) siRNA
gtttggttatatagtcattaact

SEQ ID NO: 14136 - DNA, 23 bp, Artificial Sequence
  X-linked inhibitor of apoptosis (XIAP) siRNA
tttggttatatagtcattaactt

SEQ ID NO: 14137 - DNA, 23 bp, Artificial Sequence
  X-linked inhibitor of apoptosis (XIAP) siRNA
ttggttatatagtcattaacttg

SEQ ID NO: 14138 - DNA, 23 bp, Artificial Sequence
  X-linked inhibitor of apoptosis (XIAP) siRNA
tggttatatagtcattaacttga

SEQ ID NO: 14139 - DNA, 23 bp, Artificial Sequence
  X-linked inhibitor of apoptosis (XIAP) siRNA
ggttatatagtcattaacttgaa

SEQ ID NO: 14140 - DNA, 23 bp, Artificial Sequence
  X-linked inhibitor of apoptosis (XIAP) siRNA
gttatatagtcattaacttgaat

SEQ ID NO: 14141 - DNA, 23 bp, Artificial Sequence
  X-linked inhibitor of apoptosis (XIAP) siRNA
ttatatagtcattaacttgaatt

SEQ ID NO: 14142 - DNA, 23 bp, Artificial Sequence
  X-linked inhibitor of apoptosis (XIAP) siRNA
tatatagtcattaacttgaattt

SEQ ID NO: 14143 - DNA, 23 bp, Artificial Sequence
  X-linked inhibitor of apoptosis (XIAP) siRNA
atatagtcattaacttgaatttg

SEQ ID NO: 14144 - DNA, 23 bp, Artificial Sequence
  X-linked inhibitor of apoptosis (XIAP) siRNA
tatagtcattaacttgaatttgg

SEQ ID NO: 14145 - DNA, 23 bp, Artificial Sequence
  X-linked inhibitor of apoptosis (XIAP) siRNA
atagtcattaacttgaatttggt

SEQ ID NO: 14146 - DNA, 23 bp, Artificial Sequence
  X-linked inhibitor of apoptosis (XIAP) siRNA
tagtcattaacttgaatttggtc

SEQ ID NO: 14147 - DNA, 23 bp, Artificial Sequence
  X-linked inhibitor of apoptosis (XIAP) siRNA
agtcattaacttgaatttggtct

SEQ ID NO: 14148 - DNA, 23 bp, Artificial Sequence
  X-linked inhibitor of apoptosis (XIAP) siRNA
gtcattaacttgaatttggtctg

SEQ ID NO: 14149 - DNA, 23 bp, Artificial Sequence
  X-linked inhibitor of apoptosis (XIAP) siRNA
tcattaacttgaatttggtctgt

SEQ ID NO: 14150 - DNA, 23 bp, Artificial Sequence
  X-linked inhibitor of apoptosis (XIAP) siRNA
cattaacttgaatttggtctgta

SEQ ID NO: 14151 - DNA, 23 bp, Artificial Sequence
  X-linked inhibitor of apoptosis (XIAP) siRNA
attaacttgaatttggtctgtat

SEQ ID NO: 14152 - DNA, 23 bp, Artificial Sequence
  X-linked inhibitor of apoptosis (XIAP) siRNA
ttaacttgaatttggtctgtata

SEQ ID NO: 14153 - DNA, 23 bp, Artificial Sequence
  X-linked inhibitor of apoptosis (XIAP) siRNA
taacttgaatttggtctgtatag

SEQ ID NO: 14154 - DNA, 23 bp, Artificial Sequence
  X-linked inhibitor of apoptosis (XIAP) siRNA
aacttgaatttggtctgtatagt

SEQ ID NO: 14155 - DNA, 23 bp, Artificial Sequence
  X-linked inhibitor of apoptosis (XIAP) siRNA
acttgaatttggtctgtatagtc

SEQ ID NO: 14156 - DNA, 23 bp, Artificial Sequence
  X-linked inhibitor of apoptosis (XIAP) siRNA
cttgaatttggtctgtatagtct

SEQ ID NO: 14157 - DNA, 23 bp, Artificial Sequence
  X-linked inhibitor of apoptosis (XIAP) siRNA
ttgaatttggtctgtatagtcta

SEQ ID NO: 14158 - DNA, 23 bp, Artificial Sequence
  X-linked inhibitor of apoptosis (XIAP) siRNA
tgaatttggtctgtatagtctag

SEQ ID NO: 14159 - DNA, 23 bp, Artificial Sequence
  X-linked inhibitor of apoptosis (XIAP) siRNA
gaatttggtctgtatagtctaga

SEQ ID NO: 14160 - DNA, 23 bp, Artificial Sequence
  X-linked inhibitor of apoptosis (XIAP) siRNA
aatttggtctgtatagtctagac

SEQ ID NO: 14161 - DNA, 23 bp, Artificial Sequence
  X-linked inhibitor of apoptosis (XIAP) siRNA
atttggtctgtatagtctagact

SEQ ID NO: 14162 - DNA, 23 bp, Artificial Sequence
  X-linked inhibitor of apoptosis (XIAP) siRNA
tttggtctgtatagtctagactt

SEQ ID NO: 14163 - DNA, 23 bp, Artificial Sequence
  X-linked inhibitor of apoptosis (XIAP) siRNA
ttggtctgtatagtctagacttt

SEQ ID NO: 14164 - DNA, 23 bp, Artificial Sequence
  X-linked inhibitor of apoptosis (XIAP) siRNA
tggtctgtatagtctagacttta

SEQ ID NO: 14165 - DNA, 23 bp, Artificial Sequence
  X-linked inhibitor of apoptosis (XIAP) siRNA
ggtctgtatagtctagactttaa

SEQ ID NO: 14166 - DNA, 23 bp, Artificial Sequence
  X-linked inhibitor of apoptosis (XIAP) siRNA
gtctgtatagtctagactttaaa

SEQ ID NO: 14167 - DNA, 23 bp, Artificial Sequence
  X-linked inhibitor of apoptosis (XIAP) siRNA
tctgtatagtctagactttaaat

SEQ ID NO: 14168 - DNA, 23 bp, Artificial Sequence
  X-linked inhibitor of apoptosis (XIAP) siRNA
ctgtatagtctagactttaaatt

SEQ ID NO: 14169 - DNA, 23 bp, Artificial Sequence
  X-linked inhibitor of apoptosis (XIAP) siRNA
tgtatagtctagactttaaattt

SEQ ID NO: 14170 - DNA, 23 bp, Artificial Sequence
  X-linked inhibitor of apoptosis (XIAP) siRNA
gtatagtctagactttaaattta

SEQ ID NO: 14171 - DNA, 23 bp, Artificial Sequence
  X-linked inhibitor of apoptosis (XIAP) siRNA
tatagtctagactttaaatttaa

SEQ ID NO: 14172 - DNA, 23 bp, Artificial Sequence
  X-linked inhibitor of apoptosis (XIAP) siRNA
atagtctagactttaaatttaaa

SEQ ID NO: 14173 - DNA, 23 bp, Artificial Sequence
  X-linked inhibitor of apoptosis (XIAP) siRNA
tagtctagactttaaatttaaag

SEQ ID NO: 14174 - DNA, 23 bp, Artificial Sequence
  X-linked inhibitor of apoptosis (XIAP) siRNA
agtctagactttaaatttaaagt

SEQ ID NO: 14175 - DNA, 23 bp, Artificial Sequence
  X-linked inhibitor of apoptosis (XIAP) siRNA
gtctagactttaaatttaaagtt

SEQ ID NO: 14176 - DNA, 23 bp, Artificial Sequence
  X-linked inhibitor of apoptosis (XIAP) siRNA
tctagactttaaatttaaagttt

SEQ ID NO: 14177 - DNA, 23 bp, Artificial Sequence
  X-linked inhibitor of apoptosis (XIAP) siRNA
ctagactttaaatttaaagtttt

SEQ ID NO: 14178 - DNA, 23 bp, Artificial Sequence
  X-linked inhibitor of apoptosis (XIAP) siRNA
tagactttaaatttaaagttttc

SEQ ID NO: 14179 - DNA, 23 bp, Artificial Sequence
  X-linked inhibitor of apoptosis (XIAP) siRNA
agactttaaatttaaagttttct

SEQ ID NO: 14180 - DNA, 23 bp, Artificial Sequence
  X-linked inhibitor of apoptosis (XIAP) siRNA
gactttaaatttaaagttttcta

SEQ ID NO: 14181 - DNA, 23 bp, Artificial Sequence
  X-linked inhibitor of apoptosis (XIAP) siRNA
actttaaatttaaagttttctac

SEQ ID NO: 14182 - DNA, 23 bp, Artificial Sequence
  X-linked inhibitor of apoptosis (XIAP) siRNA
ctttaaatttaaagttttctaca

SEQ ID NO: 14183 - DNA, 23 bp, Artificial Sequence
  X-linked inhibitor of apoptosis (XIAP) siRNA
tttaaatttaaagttttctacaa

SEQ ID NO: 14184 - DNA, 23 bp, Artificial Sequence
  X-linked inhibitor of apoptosis (XIAP) siRNA
ttaaatttaaagttttctacaag

SEQ ID NO: 14185 - DNA, 23 bp, Artificial Sequence
  X-linked inhibitor of apoptosis (XIAP) siRNA
taaatttaaagttttctacaagg

SEQ ID NO: 14186 - DNA, 23 bp, Artificial Sequence
  X-linked inhibitor of apoptosis (XIAP) siRNA
aaatttaaagttttctacaaggg

SEQ ID NO: 14187 - DNA, 23 bp, Artificial Sequence
  X-linked inhibitor of apoptosis (XIAP) siRNA
aatttaaagttttctacaagggg

SEQ ID NO: 14188 - DNA, 23 bp, Artificial Sequence
  X-linked inhibitor of apoptosis (XIAP) siRNA
atttaaagttttctacaagggga

SEQ ID NO: 14189 - DNA, 23 bp, Artificial Sequence
  X-linked inhibitor of apoptosis (XIAP) siRNA
tttaaagttttctacaaggggag

SEQ ID NO: 14190 - DNA, 23 bp, Artificial Sequence
  X-linked inhibitor of apoptosis (XIAP) siRNA
ttaaagttttctacaaggggaga

SEQ ID NO: 14191 - DNA, 23 bp, Artificial Sequence
  X-linked inhibitor of apoptosis (XIAP) siRNA
taaagttttctacaaggggagaa

SEQ ID NO: 14192 - DNA, 23 bp, Artificial Sequence
  X-linked inhibitor of apoptosis (XIAP) siRNA
aaagttttctacaaggggagaaa

SEQ ID NO: 14193 - DNA, 23 bp, Artificial Sequence
  X-linked inhibitor of apoptosis (XIAP) siRNA
aagttttctacaaggggagaaaa

SEQ ID NO: 14194 - DNA, 23 bp, Artificial Sequence
  X-linked inhibitor of apoptosis (XIAP) siRNA
agttttctacaaggggagaaaag

SEQ ID NO: 14195 - DNA, 23 bp, Artificial Sequence
  X-linked inhibitor of apoptosis (XIAP) siRNA
gttttctacaaggggagaaaagt

SEQ ID NO: 14196 - DNA, 23 bp, Artificial Sequence
  X-linked inhibitor of apoptosis (XIAP) siRNA
ttttctacaaggggagaaaagtg

SEQ ID NO: 14197 - DNA, 23 bp, Artificial Sequence
  X-linked inhibitor of apoptosis (XIAP) siRNA
tttctacaaggggagaaaagtgt

SEQ ID NO: 14198 - DNA, 23 bp, Artificial Sequence
  X-linked inhibitor of apoptosis (XIAP) siRNA
ttctacaaggggagaaaagtgtt

SEQ ID NO: 14199 - DNA, 23 bp, Artificial Sequence
  X-linked inhibitor of apoptosis (XIAP) siRNA
tctacaaggggagaaaagtgtta

SEQ ID NO: 14200 - DNA, 23 bp, Artificial Sequence
  X-linked inhibitor of apoptosis (XIAP) siRNA
ctacaaggggagaaaagtgttaa

SEQ ID NO: 14201 - DNA, 23 bp, Artificial Sequence
  X-linked inhibitor of apoptosis (XIAP) siRNA
tacaaggggagaaaagtgttaaa

SEQ ID NO: 14202 - DNA, 23 bp, Artificial Sequence
  X-linked inhibitor of apoptosis (XIAP) siRNA
acaaggggagaaaagtgttaaaa

SEQ ID NO: 14203 - DNA, 23 bp, Artificial Sequence
  X-linked inhibitor of apoptosis (XIAP) siRNA
caaggggagaaaagtgttaaaat

SEQ ID NO: 14204 - DNA, 23 bp, Artificial Sequence
  X-linked inhibitor of apoptosis (XIAP) siRNA
aaggggagaaaagtgttaaaatt

SEQ ID NO: 14205 - DNA, 23 bp, Artificial Sequence
  X-linked inhibitor of apoptosis (XIAP) siRNA
aggggagaaaagtgttaaaattt

SEQ ID NO: 14206 - DNA, 23 bp, Artificial Sequence
  X-linked inhibitor of apoptosis (XIAP) siRNA
ggggagaaaagtgttaaaatttt

SEQ ID NO: 14207 - DNA, 23 bp, Artificial Sequence
  X-linked inhibitor of apoptosis (XIAP) siRNA
gggagaaaagtgttaaaattttt

SEQ ID NO: 14208 - DNA, 23 bp, Artificial Sequence
  X-linked inhibitor of apoptosis (XIAP) siRNA
ggagaaaagtgttaaaattttta

SEQ ID NO: 14209 - DNA, 23 bp, Artificial Sequence
  X-linked inhibitor of apoptosis (XIAP) siRNA
gagaaaagtgttaaaatttttaa

SEQ ID NO: 14210 - DNA, 23 bp, Artificial Sequence
  X-linked inhibitor of apoptosis (XIAP) siRNA
agaaaagtgttaaaatttttaaa

SEQ ID NO: 14211 - DNA, 23 bp, Artificial Sequence
  X-linked inhibitor of apoptosis (XIAP) siRNA
gaaaagtgttaaaatttttaaaa

SEQ ID NO: 14212 - DNA, 23 bp, Artificial Sequence
  X-linked inhibitor of apoptosis (XIAP) siRNA
aaaagtgttaaaatttttaaaat

SEQ ID NO: 14213 - DNA, 23 bp, Artificial Sequence
  X-linked inhibitor of apoptosis (XIAP) siRNA
aaagtgttaaaatttttaaaata

SEQ ID NO: 14214 - DNA, 23 bp, Artificial Sequence
  X-linked inhibitor of apoptosis (XIAP) siRNA
aagtgttaaaatttttaaaatat

SEQ ID NO: 14215 - DNA, 23 bp, Artificial Sequence
  X-linked inhibitor of apoptosis (XIAP) siRNA
agtgttaaaatttttaaaatatg

SEQ ID NO: 14216 - DNA, 23 bp, Artificial Sequence
  X-linked inhibitor of apoptosis (XIAP) siRNA
gtgttaaaatttttaaaatatgt

SEQ ID NO: 14217 - DNA, 23 bp, Artificial Sequence
  X-linked inhibitor of apoptosis (XIAP) siRNA
tgttaaaatttttaaaatatgtt

SEQ ID NO: 14218 - DNA, 23 bp, Artificial Sequence
  X-linked inhibitor of apoptosis (XIAP) siRNA
gttaaaatttttaaaatatgttt

SEQ ID NO: 14219 - DNA, 23 bp, Artificial Sequence
  X-linked inhibitor of apoptosis (XIAP) siRNA
ttaaaatttttaaaatatgtttt

SEQ ID NO: 14220 - DNA, 23 bp, Artificial Sequence
  X-linked inhibitor of apoptosis (XIAP) siRNA
taaaatttttaaaatatgttttc

SEQ ID NO: 14221 - DNA, 23 bp, Artificial Sequence
  X-linked inhibitor of apoptosis (XIAP) siRNA
aaaatttttaaaatatgttttcc

SEQ ID NO: 14222 - DNA, 23 bp, Artificial Sequence
  X-linked inhibitor of apoptosis (XIAP) siRNA
aaatttttaaaatatgttttcca

SEQ ID NO: 14223 - DNA, 23 bp, Artificial Sequence
  X-linked inhibitor of apoptosis (XIAP) siRNA
aatttttaaaatatgttttccag

SEQ ID NO: 14224 - DNA, 23 bp, Artificial Sequence
  X-linked inhibitor of apoptosis (XIAP) siRNA
atttttaaaatatgttttccagg

SEQ ID NO: 14225 - DNA, 23 bp, Artificial Sequence
  X-linked inhibitor of apoptosis (XIAP) siRNA
tttttaaaatatgttttccagga

SEQ ID NO: 14226 - DNA, 23 bp, Artificial Sequence
  X-linked inhibitor of apoptosis (XIAP) siRNA
ttttaaaatatgttttccaggac

SEQ ID NO: 14227 - DNA, 23 bp, Artificial Sequence
  X-linked inhibitor of apoptosis (XIAP) siRNA
tttaaaatatgttttccaggaca

SEQ ID NO: 14228 - DNA, 23 bp, Artificial Sequence
  X-linked inhibitor of apoptosis (XIAP) siRNA
ttaaaatatgttttccaggacac

SEQ ID NO: 14229 - DNA, 23 bp, Artificial Sequence
  X-linked inhibitor of apoptosis (XIAP) siRNA
taaaatatgttttccaggacact

SEQ ID NO: 14230 - DNA, 23 bp, Artificial Sequence
  X-linked inhibitor of apoptosis (XIAP) siRNA
aaaatatgttttccaggacactt

SEQ ID NO: 14231 - DNA, 23 bp, Artificial Sequence
  X-linked inhibitor of apoptosis (XIAP) siRNA
aaatatgttttccaggacacttc

SEQ ID NO: 14232 - DNA, 23 bp, Artificial Sequence
  X-linked inhibitor of apoptosis (XIAP) siRNA
aatatgttttccaggacacttca

SEQ ID NO: 14233 - DNA, 23 bp, Artificial Sequence
  X-linked inhibitor of apoptosis (XIAP) siRNA
atatgttttccaggacacttcac

SEQ ID NO: 14234 - DNA, 23 bp, Artificial Sequence
  X-linked inhibitor of apoptosis (XIAP) siRNA
tatgttttccaggacacttcact

SEQ ID NO: 14235 - DNA, 23 bp, Artificial Sequence
  X-linked inhibitor of apoptosis (XIAP) siRNA
atgttttccaggacacttcactt

SEQ ID NO: 14236 - DNA, 23 bp, Artificial Sequence
  X-linked inhibitor of apoptosis (XIAP) siRNA
tgttttccaggacacttcacttc

SEQ ID NO: 14237 - DNA, 23 bp, Artificial Sequence
  X-linked inhibitor of apoptosis (XIAP) siRNA
gttttccaggacacttcacttcc

SEQ ID NO: 14238 - DNA, 23 bp, Artificial Sequence
  X-linked inhibitor of apoptosis (XIAP) siRNA
ttttccaggacacttcacttcca

SEQ ID NO: 14239 - DNA, 23 bp, Artificial Sequence
  X-linked inhibitor of apoptosis (XIAP) siRNA
tttccaggacacttcacttccaa

SEQ ID NO: 14240 - DNA, 23 bp, Artificial Sequence
  X-linked inhibitor of apoptosis (XIAP) siRNA
ttccaggacacttcacttccaag

SEQ ID NO: 14241 - DNA, 23 bp, Artificial Sequence
  X-linked inhibitor of apoptosis (XIAP) siRNA
tccaggacacttcacttccaagt

SEQ ID NO: 14242 - DNA, 23 bp, Artificial Sequence
  X-linked inhibitor of apoptosis (XIAP) siRNA
ccaggacacttcacttccaagtc

SEQ ID NO: 14243 - DNA, 23 bp, Artificial Sequence
  X-linked inhibitor of apoptosis (XIAP) siRNA
caggacacttcacttccaagtca

SEQ ID NO: 14244 - DNA, 23 bp, Artificial Sequence
  X-linked inhibitor of apoptosis (XIAP) siRNA
aggacacttcacttccaagtcag

SEQ ID NO: 14245 - DNA, 23 bp, Artificial Sequence
  X-linked inhibitor of apoptosis (XIAP) siRNA
ggacacttcacttccaagtcagg

SEQ ID NO: 14246 - DNA, 23 bp, Artificial Sequence
  X-linked inhibitor of apoptosis (XIAP) siRNA
gacacttcacttccaagtcaggt

SEQ ID NO: 14247 - DNA, 23 bp, Artificial Sequence
  X-linked inhibitor of apoptosis (XIAP) siRNA
acacttcacttccaagtcaggta

SEQ ID NO: 14248 - DNA, 23 bp, Artificial Sequence
  X-linked inhibitor of apoptosis (XIAP) siRNA
cacttcacttccaagtcaggtag

SEQ ID NO: 14249 - DNA, 23 bp, Artificial Sequence
  X-linked inhibitor of apoptosis (XIAP) siRNA
acttcacttccaagtcaggtagg

SEQ ID NO: 14250 - DNA, 23 bp, Artificial Sequence
  X-linked inhibitor of apoptosis (XIAP) siRNA
cttcacttccaagtcaggtaggt

SEQ ID NO: 14251 - DNA, 23 bp, Artificial Sequence
  X-linked inhibitor of apoptosis (XIAP) siRNA
ttcacttccaagtcaggtaggta

SEQ ID NO: 14252 - DNA, 23 bp, Artificial Sequence
  X-linked inhibitor of apoptosis (XIAP) siRNA
tcacttccaagtcaggtaggtag

SEQ ID NO: 14253 - DNA, 23 bp, Artificial Sequence
  X-linked inhibitor of apoptosis (XIAP) siRNA
cacttccaagtcaggtaggtagt

SEQ ID NO: 14254 - DNA, 23 bp, Artificial Sequence
  X-linked inhibitor of apoptosis (XIAP) siRNA
acttccaagtcaggtaggtagtt

SEQ ID NO: 14255 - DNA, 23 bp, Artificial Sequence
  X-linked inhibitor of apoptosis (XIAP) siRNA
cttccaagtcaggtaggtagttc

SEQ ID NO: 14256 - DNA, 23 bp, Artificial Sequence
  X-linked inhibitor of apoptosis (XIAP) siRNA
ttccaagtcaggtaggtagttca

SEQ ID NO: 14257 - DNA, 23 bp, Artificial Sequence
  X-linked inhibitor of apoptosis (XIAP) siRNA
tccaagtcaggtaggtagttcaa

SEQ ID NO: 14258 - DNA, 23 bp, Artificial Sequence
  X-linked inhibitor of apoptosis (XIAP) siRNA
ccaagtcaggtaggtagttcaat

SEQ ID NO: 14259 - DNA, 23 bp, Artificial Sequence
  X-linked inhibitor of apoptosis (XIAP) siRNA
caagtcaggtaggtagttcaatc

SEQ ID NO: 14260 - DNA, 23 bp, Artificial Sequence
  X-linked inhibitor of apoptosis (XIAP) siRNA
aagtcaggtaggtagttcaatct

SEQ ID NO: 14261 - DNA, 23 bp, Artificial Sequence
  X-linked inhibitor of apoptosis (XIAP) siRNA
agtcaggtaggtagttcaatcta

SEQ ID NO: 14262 - DNA, 23 bp, Artificial Sequence
  X-linked inhibitor of apoptosis (XIAP) siRNA
gtcaggtaggtagttcaatctag

SEQ ID NO: 14263 - DNA, 23 bp, Artificial Sequence
  X-linked inhibitor of apoptosis (XIAP) siRNA
tcaggtaggtagttcaatctagt

SEQ ID NO: 14264 - DNA, 23 bp, Artificial Sequence
  X-linked inhibitor of apoptosis (XIAP) siRNA
caggtaggtagttcaatctagtt

SEQ ID NO: 14265 - DNA, 23 bp, Artificial Sequence
  X-linked inhibitor of apoptosis (XIAP) siRNA
aggtaggtagttcaatctagttg

SEQ ID NO: 14266 - DNA, 23 bp, Artificial Sequence
  X-linked inhibitor of apoptosis (XIAP) siRNA
ggtaggtagttcaatctagttgt

SEQ ID NO: 14267 - DNA, 23 bp, Artificial Sequence
  X-linked inhibitor of apoptosis (XIAP) siRNA
gtaggtagttcaatctagttgtt

SEQ ID NO: 14268 - DNA, 23 bp, Artificial Sequence
  X-linked inhibitor of apoptosis (XIAP) siRNA
taggtagttcaatctagttgtta

SEQ ID NO: 14269 - DNA, 23 bp, Artificial Sequence
  X-linked inhibitor of apoptosis (XIAP) siRNA
aggtagttcaatctagttgttag

SEQ ID NO: 14270 - DNA, 23 bp, Artificial Sequence
  X-linked inhibitor of apoptosis (XIAP) siRNA
ggtagttcaatctagttgttagc

SEQ ID NO: 14271 - DNA, 23 bp, Artificial Sequence
  X-linked inhibitor of apoptosis (XIAP) siRNA
gtagttcaatctagttgttagcc

SEQ ID NO: 14272 - DNA, 23 bp, Artificial Sequence
  X-linked inhibitor of apoptosis (XIAP) siRNA
tagttcaatctagttgttagcca

SEQ ID NO: 14273 - DNA, 23 bp, Artificial Sequence
  X-linked inhibitor of apoptosis (XIAP) siRNA
agttcaatctagttgttagccaa

SEQ ID NO: 14274 - DNA, 23 bp, Artificial Sequence
  X-linked inhibitor of apoptosis (XIAP) siRNA
gttcaatctagttgttagccaag

SEQ ID NO: 14275 - DNA, 23 bp, Artificial Sequence
  X-linked inhibitor of apoptosis (XIAP) siRNA
ttcaatctagttgttagccaagg

SEQ ID NO: 14276 - DNA, 23 bp, Artificial Sequence
  X-linked inhibitor of apoptosis (XIAP) siRNA
tcaatctagttgttagccaagga

SEQ ID NO: 14277 - DNA, 23 bp, Artificial Sequence
  X-linked inhibitor of apoptosis (XIAP) siRNA
caatctagttgttagccaaggac

SEQ ID NO: 14278 - DNA, 23 bp, Artificial Sequence
  X-linked inhibitor of apoptosis (XIAP) siRNA
aatctagttgttagccaaggact

SEQ ID NO: 14279 - DNA, 23 bp, Artificial Sequence
  X-linked inhibitor of apoptosis (XIAP) siRNA
atctagttgttagccaaggactc

SEQ ID NO: 14280 - DNA, 23 bp, Artificial Sequence
  X-linked inhibitor of apoptosis (XIAP) siRNA
tctagttgttagccaaggactca

SEQ ID NO: 14281 - DNA, 23 bp, Artificial Sequence
  X-linked inhibitor of apoptosis (XIAP) siRNA
ctagttgttagccaaggactcaa

SEQ ID NO: 14282 - DNA, 23 bp, Artificial Sequence
  X-linked inhibitor of apoptosis (XIAP) siRNA
tagttgttagccaaggactcaag

SEQ ID NO: 14283 - DNA, 23 bp, Artificial Sequence
  X-linked inhibitor of apoptosis (XIAP) siRNA
agttgttagccaaggactcaagg

SEQ ID NO: 14284 - DNA, 23 bp, Artificial Sequence
  X-linked inhibitor of apoptosis (XIAP) siRNA
gttgttagccaaggactcaagga

SEQ ID NO: 14285 - DNA, 23 bp, Artificial Sequence
  X-linked inhibitor of apoptosis (XIAP) siRNA
ttgttagccaaggactcaaggac

SEQ ID NO: 14286 - DNA, 23 bp, Artificial Sequence
  X-linked inhibitor of apoptosis (XIAP) siRNA
tgttagccaaggactcaaggact

SEQ ID NO: 14287 - DNA, 23 bp, Artificial Sequence
  X-linked inhibitor of apoptosis (XIAP) siRNA
gttagccaaggactcaaggactg

SEQ ID NO: 14288 - DNA, 23 bp, Artificial Sequence
  X-linked inhibitor of apoptosis (XIAP) siRNA
ttagccaaggactcaaggactga

SEQ ID NO: 14289 - DNA, 23 bp, Artificial Sequence
  X-linked inhibitor of apoptosis (XIAP) siRNA
tagccaaggactcaaggactgaa

SEQ ID NO: 14290 - DNA, 23 bp, Artificial Sequence
  X-linked inhibitor of apoptosis (XIAP) siRNA
agccaaggactcaaggactgaat

SEQ ID NO: 14291 - DNA, 23 bp, Artificial Sequence
  X-linked inhibitor of apoptosis (XIAP) siRNA
gccaaggactcaaggactgaatt

SEQ ID NO: 14292 - DNA, 23 bp, Artificial Sequence
  X-linked inhibitor of apoptosis (XIAP) siRNA
ccaaggactcaaggactgaattg

SEQ ID NO: 14293 - DNA, 23 bp, Artificial Sequence
  X-linked inhibitor of apoptosis (XIAP) siRNA
caaggactcaaggactgaattgt

SEQ ID NO: 14294 - DNA, 23 bp, Artificial Sequence
  X-linked inhibitor of apoptosis (XIAP) siRNA
aaggactcaaggactgaattgtt

SEQ ID NO: 14295 - DNA, 23 bp, Artificial Sequence
  X-linked inhibitor of apoptosis (XIAP) siRNA
aggactcaaggactgaattgttt

SEQ ID NO: 14296 - DNA, 23 bp, Artificial Sequence
  X-linked inhibitor of apoptosis (XIAP) siRNA
ggactcaaggactgaattgtttt

SEQ ID NO: 14297 - DNA, 23 bp, Artificial Sequence
  X-linked inhibitor of apoptosis (XIAP) siRNA
gactcaaggactgaattgtttta

SEQ ID NO: 14298 - DNA, 23 bp, Artificial Sequence
  X-linked inhibitor of apoptosis (XIAP) siRNA
actcaaggactgaattgttttaa

SEQ ID NO: 14299 - DNA, 23 bp, Artificial Sequence
  X-linked inhibitor of apoptosis (XIAP) siRNA
ctcaaggactgaattgttttaac

SEQ ID NO: 14300 - DNA, 23 bp, Artificial Sequence
  X-linked inhibitor of apoptosis (XIAP) siRNA
tcaaggactgaattgttttaaca

SEQ ID NO: 14301 - DNA, 23 bp, Artificial Sequence
  X-linked inhibitor of apoptosis (XIAP) siRNA
caaggactgaattgttttaacat

SEQ ID NO: 14302 - DNA, 23 bp, Artificial Sequence
  X-linked inhibitor of apoptosis (XIAP) siRNA
aaggactgaattgttttaacata

SEQ ID NO: 14303 - DNA, 23 bp, Artificial Sequence
  X-linked inhibitor of apoptosis (XIAP) siRNA
aggactgaattgttttaacataa

SEQ ID NO: 14304 - DNA, 23 bp, Artificial Sequence
  X-linked inhibitor of apoptosis (XIAP) siRNA
ggactgaattgttttaacataag

SEQ ID NO: 14305 - DNA, 23 bp, Artificial Sequence
  X-linked inhibitor of apoptosis (XIAP) siRNA
gactgaattgttttaacataagg

SEQ ID NO: 14306 - DNA, 23 bp, Artificial Sequence
  X-linked inhibitor of apoptosis (XIAP) siRNA
actgaattgttttaacataaggc

SEQ ID NO: 14307 - DNA, 23 bp, Artificial Sequence
  X-linked inhibitor of apoptosis (XIAP) siRNA
ctgaattgttttaacataaggct

SEQ ID NO: 14308 - DNA, 23 bp, Artificial Sequence
  X-linked inhibitor of apoptosis (XIAP) siRNA
tgaattgttttaacataaggctt

SEQ ID NO: 14309 - DNA, 23 bp, Artificial Sequence
  X-linked inhibitor of apoptosis (XIAP) siRNA
gaattgttttaacataaggcttt

SEQ ID NO: 14310 - DNA, 23 bp, Artificial Sequence
  X-linked inhibitor of apoptosis (XIAP) siRNA
aattgttttaacataaggctttt

SEQ ID NO: 14311 - DNA, 23 bp, Artificial Sequence
  X-linked inhibitor of apoptosis (XIAP) siRNA
attgttttaacataaggcttttc

SEQ ID NO: 14312 - DNA, 23 bp, Artificial Sequence
  X-linked inhibitor of apoptosis (XIAP) siRNA
ttgttttaacataaggcttttcc

SEQ ID NO: 14313 - DNA, 23 bp, Artificial Sequence
  X-linked inhibitor of apoptosis (XIAP) siRNA
tgttttaacataaggcttttcct

SEQ ID NO: 14314 - DNA, 23 bp, Artificial Sequence
  X-linked inhibitor of apoptosis (XIAP) siRNA
gttttaacataaggcttttcctg

SEQ ID NO: 14315 - DNA, 23 bp, Artificial Sequence
  X-linked inhibitor of apoptosis (XIAP) siRNA
ttttaacataaggcttttcctgt

SEQ ID NO: 14316 - DNA, 23 bp, Artificial Sequence
  X-linked inhibitor of apoptosis (XIAP) siRNA
tttaacataaggcttttcctgtt

SEQ ID NO: 14317 - DNA, 23 bp, Artificial Sequence
  X-linked inhibitor of apoptosis (XIAP) siRNA
ttaacataaggcttttcctgttc

SEQ ID NO: 14318 - DNA, 23 bp, Artificial Sequence
  X-linked inhibitor of apoptosis (XIAP) siRNA
taacataaggcttttcctgttct

SEQ ID NO: 14319 - DNA, 23 bp, Artificial Sequence
  X-linked inhibitor of apoptosis (XIAP) siRNA
aacataaggcttttcctgttctg

SEQ ID NO: 14320 - DNA, 23 bp, Artificial Sequence
  X-linked inhibitor of apoptosis (XIAP) siRNA
acataaggcttttcctgttctgg

SEQ ID NO: 14321 - DNA, 23 bp, Artificial Sequence
  X-linked inhibitor of apoptosis (XIAP) siRNA
cataaggcttttcctgttctggg

SEQ ID NO: 14322 - DNA, 23 bp, Artificial Sequence
  X-linked inhibitor of apoptosis (XIAP) siRNA
ataaggcttttcctgttctggga

SEQ ID NO: 14323 - DNA, 23 bp, Artificial Sequence
  X-linked inhibitor of apoptosis (XIAP) siRNA
taaggcttttcctgttctgggag

SEQ ID NO: 14324 - DNA, 23 bp, Artificial Sequence
  X-linked inhibitor of apoptosis (XIAP) siRNA
aaggcttttcctgttctgggagc

SEQ ID NO: 14325 - DNA, 23 bp, Artificial Sequence
  X-linked inhibitor of apoptosis (XIAP) siRNA
aggcttttcctgttctgggagcc

SEQ ID NO: 14326 - DNA, 23 bp, Artificial Sequence
  X-linked inhibitor of apoptosis (XIAP) siRNA
ggcttttcctgttctgggagccg

SEQ ID NO: 14327 - DNA, 23 bp, Artificial Sequence
  X-linked inhibitor of apoptosis (XIAP) siRNA
gcttttcctgttctgggagccgc

SEQ ID NO: 14328 - DNA, 23 bp, Artificial Sequence
  X-linked inhibitor of apoptosis (XIAP) siRNA
cttttcctgttctgggagccgca

SEQ ID NO: 14329 - DNA, 23 bp, Artificial Sequence
  X-linked inhibitor of apoptosis (XIAP) siRNA
ttttcctgttctgggagccgcac

SEQ ID NO: 14330 - DNA, 23 bp, Artificial Sequence
  X-linked inhibitor of apoptosis (XIAP) siRNA
tttcctgttctgggagccgcact

SEQ ID NO: 14331 - DNA, 23 bp, Artificial Sequence
  X-linked inhibitor of apoptosis (XIAP) siRNA
ttcctgttctgggagccgcactt

SEQ ID NO: 14332 - DNA, 23 bp, Artificial Sequence
  X-linked inhibitor of apoptosis (XIAP) siRNA
tcctgttctgggagccgcacttc

SEQ ID NO: 14333 - DNA, 23 bp, Artificial Sequence
  X-linked inhibitor of apoptosis (XIAP) siRNA
cctgttctgggagccgcacttca

SEQ ID NO: 14334 - DNA, 23 bp, Artificial Sequence
  X-linked inhibitor of apoptosis (XIAP) siRNA
ctgttctgggagccgcacttcat

SEQ ID NO: 14335 - DNA, 23 bp, Artificial Sequence
  X-linked inhibitor of apoptosis (XIAP) siRNA
tgttctgggagccgcacttcatt

SEQ ID NO: 14336 - DNA, 23 bp, Artificial Sequence
  X-linked inhibitor of apoptosis (XIAP) siRNA
gttctgggagccgcacttcatta

SEQ ID NO: 14337 - DNA, 23 bp, Artificial Sequence
  X-linked inhibitor of apoptosis (XIAP) siRNA
ttctgggagccgcacttcattaa

SEQ ID NO: 14338 - DNA, 23 bp, Artificial Sequence
  X-linked inhibitor of apoptosis (XIAP) siRNA
tctgggagccgcacttcattaaa

SEQ ID NO: 14339 - DNA, 23 bp, Artificial Sequence
  X-linked inhibitor of apoptosis (XIAP) siRNA
ctgggagccgcacttcattaaaa

SEQ ID NO: 14340 - DNA, 23 bp, Artificial Sequence
  X-linked inhibitor of apoptosis (XIAP) siRNA
tgggagccgcacttcattaaaat

SEQ ID NO: 14341 - DNA, 23 bp, Artificial Sequence
  X-linked inhibitor of apoptosis (XIAP) siRNA
gggagccgcacttcattaaaatt

SEQ ID NO: 14342 - DNA, 23 bp, Artificial Sequence
  X-linked inhibitor of apoptosis (XIAP) siRNA
ggagccgcacttcattaaaattc

SEQ ID NO: 14343 - DNA, 23 bp, Artificial Sequence
  X-linked inhibitor of apoptosis (XIAP) siRNA
gagccgcacttcattaaaattct

SEQ ID NO: 14344 - DNA, 23 bp, Artificial Sequence
  X-linked inhibitor of apoptosis (XIAP) siRNA
agccgcacttcattaaaattctt

SEQ ID NO: 14345 - DNA, 23 bp, Artificial Sequence
  X-linked inhibitor of apoptosis (XIAP) siRNA
gccgcacttcattaaaattcttc

SEQ ID NO: 14346 - DNA, 23 bp, Artificial Sequence
  X-linked inhibitor of apoptosis (XIAP) siRNA
ccgcacttcattaaaattcttct

SEQ ID NO: 14347 - DNA, 23 bp, Artificial Sequence
  X-linked inhibitor of apoptosis (XIAP) siRNA
cgcacttcattaaaattcttcta

SEQ ID NO: 14348 - DNA, 23 bp, Artificial Sequence
  X-linked inhibitor of apoptosis (XIAP) siRNA
gcacttcattaaaattcttctaa

SEQ ID NO: 14349 - DNA, 23 bp, Artificial Sequence
  X-linked inhibitor of apoptosis (XIAP) siRNA
cacttcattaaaattcttctaaa

SEQ ID NO: 14350 - DNA, 23 bp, Artificial Sequence
  X-linked inhibitor of apoptosis (XIAP) siRNA
acttcattaaaattcttctaaaa

SEQ ID NO: 14351 - DNA, 23 bp, Artificial Sequence
  X-linked inhibitor of apoptosis (XIAP) siRNA
cttcattaaaattcttctaaaac

SEQ ID NO: 14352 - DNA, 23 bp, Artificial Sequence
  X-linked inhibitor of apoptosis (XIAP) siRNA
ttcattaaaattcttctaaaact

SEQ ID NO: 14353 - DNA, 23 bp, Artificial Sequence
  X-linked inhibitor of apoptosis (XIAP) siRNA
tcattaaaattcttctaaaactt

SEQ ID NO: 14354 - DNA, 23 bp, Artificial Sequence
  X-linked inhibitor of apoptosis (XIAP) siRNA
cattaaaattcttctaaaacttg

SEQ ID NO: 14355 - DNA, 23 bp, Artificial Sequence
  X-linked inhibitor of apoptosis (XIAP) siRNA
attaaaattcttctaaaacttgt

SEQ ID NO: 14356 - DNA, 23 bp, Artificial Sequence
  X-linked inhibitor of apoptosis (XIAP) siRNA
ttaaaattcttctaaaacttgta

SEQ ID NO: 14357 - DNA, 23 bp, Artificial Sequence
  X-linked inhibitor of apoptosis (XIAP) siRNA
taaaattcttctaaaacttgtat

SEQ ID NO: 14358 - DNA, 23 bp, Artificial Sequence
  X-linked inhibitor of apoptosis (XIAP) siRNA
aaaattcttctaaaacttgtatg

SEQ ID NO: 14359 - DNA, 23 bp, Artificial Sequence
  X-linked inhibitor of apoptosis (XIAP) siRNA
aaattcttctaaaacttgtatgt

SEQ ID NO: 14360 - DNA, 23 bp, Artificial Sequence
  X-linked inhibitor of apoptosis (XIAP) siRNA
aattcttctaaaacttgtatgtt

SEQ ID NO: 14361 - DNA, 23 bp, Artificial Sequence
  X-linked inhibitor of apoptosis (XIAP) siRNA
attcttctaaaacttgtatgttt

SEQ ID NO: 14362 - DNA, 23 bp, Artificial Sequence
  X-linked inhibitor of apoptosis (XIAP) siRNA
ttcttctaaaacttgtatgttta

SEQ ID NO: 14363 - DNA, 23 bp, Artificial Sequence
  X-linked inhibitor of apoptosis (XIAP) siRNA
tcttctaaaacttgtatgtttag

SEQ ID NO: 14364 - DNA, 23 bp, Artificial Sequence
  X-linked inhibitor of apoptosis (XIAP) siRNA
cttctaaaacttgtatgtttaga

SEQ ID NO: 14365 - DNA, 23 bp, Artificial Sequence
  X-linked inhibitor of apoptosis (XIAP) siRNA
ttctaaaacttgtatgtttagag

SEQ ID NO: 14366 - DNA, 23 bp, Artificial Sequence
  X-linked inhibitor of apoptosis (XIAP) siRNA
tctaaaacttgtatgtttagagt

SEQ ID NO: 14367 - DNA, 23 bp, Artificial Sequence
  X-linked inhibitor of apoptosis (XIAP) siRNA
ctaaaacttgtatgtttagagtt

SEQ ID NO: 14368 - DNA, 23 bp, Artificial Sequence
  X-linked inhibitor of apoptosis (XIAP) siRNA
taaaacttgtatgtttagagtta

SEQ ID NO: 14369 - DNA, 23 bp, Artificial Sequence
  X-linked inhibitor of apoptosis (XIAP) siRNA
aaaacttgtatgtttagagttaa

SEQ ID NO: 14370 - DNA, 23 bp, Artificial Sequence
  X-linked inhibitor of apoptosis (XIAP) siRNA
aaacttgtatgtttagagttaag

SEQ ID NO: 14371 - DNA, 23 bp, Artificial Sequence
  X-linked inhibitor of apoptosis (XIAP) siRNA
aacttgtatgtttagagttaagc

SEQ ID NO: 14372 - DNA, 23 bp, Artificial Sequence
  X-linked inhibitor of apoptosis (XIAP) siRNA
acttgtatgtttagagttaagca

SEQ ID NO: 14373 - DNA, 23 bp, Artificial Sequence
  X-linked inhibitor of apoptosis (XIAP) siRNA
cttgtatgtttagagttaagcaa

SEQ ID NO: 14374 - DNA, 23 bp, Artificial Sequence
  X-linked inhibitor of apoptosis (XIAP) siRNA
ttgtatgtttagagttaagcaag

SEQ ID NO: 14375 - DNA, 23 bp, Artificial Sequence
  X-linked inhibitor of apoptosis (XIAP) siRNA
tgtatgtttagagttaagcaaga

SEQ ID NO: 14376 - DNA, 23 bp, Artificial Sequence
  X-linked inhibitor of apoptosis (XIAP) siRNA
gtatgtttagagttaagcaagac

SEQ ID NO: 14377 - DNA, 23 bp, Artificial Sequence
  X-linked inhibitor of apoptosis (XIAP) siRNA
tatgtttagagttaagcaagact

SEQ ID NO: 14378 - DNA, 23 bp, Artificial Sequence
  X-linked inhibitor of apoptosis (XIAP) siRNA
atgtttagagttaagcaagactt

SEQ ID NO: 14379 - DNA, 23 bp, Artificial Sequence
  X-linked inhibitor of apoptosis (XIAP) siRNA
tgtttagagttaagcaagacttt

SEQ ID NO: 14380 - DNA, 23 bp, Artificial Sequence
  X-linked inhibitor of apoptosis (XIAP) siRNA
gtttagagttaagcaagactttt

SEQ ID NO: 14381 - DNA, 23 bp, Artificial Sequence
  X-linked inhibitor of apoptosis (XIAP) siRNA
tttagagttaagcaagacttttt

SEQ ID NO: 14382 - DNA, 23 bp, Artificial Sequence
  X-linked inhibitor of apoptosis (XIAP) siRNA
ttagagttaagcaagactttttt

SEQ ID NO: 14383 - DNA, 23 bp, Artificial Sequence
  X-linked inhibitor of apoptosis (XIAP) siRNA
tagagttaagcaagacttttttt

SEQ ID NO: 14384 - DNA, 23 bp, Artificial Sequence
  X-linked inhibitor of apoptosis (XIAP) siRNA
agagttaagcaagactttttttc

SEQ ID NO: 14385 - DNA, 23 bp, Artificial Sequence
  X-linked inhibitor of apoptosis (XIAP) siRNA
gagttaagcaagactttttttct

SEQ ID NO: 14386 - DNA, 23 bp, Artificial Sequence
  X-linked inhibitor of apoptosis (XIAP) siRNA
agttaagcaagactttttttctt

SEQ ID NO: 14387 - DNA, 23 bp, Artificial Sequence
  X-linked inhibitor of apoptosis (XIAP) siRNA
gttaagcaagactttttttcttc

SEQ ID NO: 14388 - DNA, 23 bp, Artificial Sequence
  X-linked inhibitor of apoptosis (XIAP) siRNA
ttaagcaagactttttttcttcc

SEQ ID NO: 14389 - DNA, 23 bp, Artificial Sequence
  X-linked inhibitor of apoptosis (XIAP) siRNA
taagcaagactttttttcttcct

SEQ ID NO: 14390 - DNA, 23 bp, Artificial Sequence
  X-linked inhibitor of apoptosis (XIAP) siRNA
aagcaagactttttttcttcctc

SEQ ID NO: 14391 - DNA, 23 bp, Artificial Sequence
  X-linked inhibitor of apoptosis (XIAP) siRNA
agcaagactttttttcttcctct

SEQ ID NO: 14392 - DNA, 23 bp, Artificial Sequence
  X-linked inhibitor of apoptosis (XIAP) siRNA
gcaagactttttttcttcctctc

SEQ ID NO: 14393 - DNA, 23 bp, Artificial Sequence
  X-linked inhibitor of apoptosis (XIAP) siRNA
caagactttttttcttcctctcc

SEQ ID NO: 14394 - DNA, 23 bp, Artificial Sequence
  X-linked inhibitor of apoptosis (XIAP) siRNA
aagactttttttcttcctctcca

SEQ ID NO: 14395 - DNA, 23 bp, Artificial Sequence
  X-linked inhibitor of apoptosis (XIAP) siRNA
agactttttttcttcctctccat

SEQ ID NO: 14396 - DNA, 23 bp, Artificial Sequence
  X-linked inhibitor of apoptosis (XIAP) siRNA
gactttttttcttcctctccatg

SEQ ID NO: 14397 - DNA, 23 bp, Artificial Sequence
  X-linked inhibitor of apoptosis (XIAP) siRNA
actttttttcttcctctccatga

SEQ ID NO: 14398 - DNA, 23 bp, Artificial Sequence
  X-linked inhibitor of apoptosis (XIAP) siRNA
ctttttttcttcctctccatgag

SEQ ID NO: 14399 - DNA, 23 bp, Artificial Sequence
  X-linked inhibitor of apoptosis (XIAP) siRNA
tttttttcttcctctccatgagt

SEQ ID NO: 14400 - DNA, 23 bp, Artificial Sequence
  X-linked inhibitor of apoptosis (XIAP) siRNA
ttttttcttcctctccatgagtt

SEQ ID NO: 14401 - DNA, 23 bp, Artificial Sequence
  X-linked inhibitor of apoptosis (XIAP) siRNA
tttttcttcctctccatgagttg

SEQ ID NO: 14402 - DNA, 23 bp, Artificial Sequence
  X-linked inhibitor of apoptosis (XIAP) siRNA
ttttcttcctctccatgagttgt

SEQ ID NO: 14403 - DNA, 23 bp, Artificial Sequence
  X-linked inhibitor of apoptosis (XIAP) siRNA
tttcttcctctccatgagttgtg

SEQ ID NO: 14404 - DNA, 23 bp, Artificial Sequence
  X-linked inhibitor of apoptosis (XIAP) siRNA
ttcttcctctccatgagttgtga

SEQ ID NO: 14405 - DNA, 23 bp, Artificial Sequence
  X-linked inhibitor of apoptosis (XIAP) siRNA
tcttcctctccatgagttgtgaa

SEQ ID NO: 14406 - DNA, 23 bp, Artificial Sequence
  X-linked inhibitor of apoptosis (XIAP) siRNA
cttcctctccatgagttgtgaaa

SEQ ID NO: 14407 - DNA, 23 bp, Artificial Sequence
  X-linked inhibitor of apoptosis (XIAP) siRNA
ttcctctccatgagttgtgaaat

SEQ ID NO: 14408 - DNA, 23 bp, Artificial Sequence
  X-linked inhibitor of apoptosis (XIAP) siRNA
tcctctccatgagttgtgaaatt

SEQ ID NO: 14409 - DNA, 23 bp, Artificial Sequence
  X-linked inhibitor of apoptosis (XIAP) siRNA
cctctccatgagttgtgaaattt

SEQ ID NO: 14410 - DNA, 23 bp, Artificial Sequence
  X-linked inhibitor of apoptosis (XIAP) siRNA
ctctccatgagttgtgaaattta

SEQ ID NO: 14411 - DNA, 23 bp, Artificial Sequence
  X-linked inhibitor of apoptosis (XIAP) siRNA
tctccatgagttgtgaaatttaa

SEQ ID NO: 14412 - DNA, 23 bp, Artificial Sequence
  X-linked inhibitor of apoptosis (XIAP) siRNA
ctccatgagttgtgaaatttaat

SEQ ID NO: 14413 - DNA, 23 bp, Artificial Sequence
  X-linked inhibitor of apoptosis (XIAP) siRNA
tccatgagttgtgaaatttaatg

SEQ ID NO: 14414 - DNA, 23 bp, Artificial Sequence
  X-linked inhibitor of apoptosis (XIAP) siRNA
ccatgagttgtgaaatttaatgc

SEQ ID NO: 14415 - DNA, 23 bp, Artificial Sequence
  X-linked inhibitor of apoptosis (XIAP) siRNA
catgagttgtgaaatttaatgca

SEQ ID NO: 14416 - DNA, 23 bp, Artificial Sequence
  X-linked inhibitor of apoptosis (XIAP) siRNA
atgagttgtgaaatttaatgcac

SEQ ID NO: 14417 - DNA, 23 bp, Artificial Sequence
  X-linked inhibitor of apoptosis (XIAP) siRNA
tgagttgtgaaatttaatgcaca

SEQ ID NO: 14418 - DNA, 23 bp, Artificial Sequence
  X-linked inhibitor of apoptosis (XIAP) siRNA
gagttgtgaaatttaatgcacaa

SEQ ID NO: 14419 - DNA, 23 bp, Artificial Sequence
  X-linked inhibitor of apoptosis (XIAP) siRNA
agttgtgaaatttaatgcacaac

SEQ ID NO: 14420 - DNA, 23 bp, Artificial Sequence
  X-linked inhibitor of apoptosis (XIAP) siRNA
gttgtgaaatttaatgcacaacg

SEQ ID NO: 14421 - DNA, 23 bp, Artificial Sequence
  X-linked inhibitor of apoptosis (XIAP) siRNA
ttgtgaaatttaatgcacaacgc

SEQ ID NO: 14422 - DNA, 23 bp, Artificial Sequence
  X-linked inhibitor of apoptosis (XIAP) siRNA
tgtgaaatttaatgcacaacgct

SEQ ID NO: 14423 - DNA, 23 bp, Artificial Sequence
  X-linked inhibitor of apoptosis (XIAP) siRNA
gtgaaatttaatgcacaacgctg

SEQ ID NO: 14424 - DNA, 23 bp, Artificial Sequence
  X-linked inhibitor of apoptosis (XIAP) siRNA
tgaaatttaatgcacaacgctga

SEQ ID NO: 14425 - DNA, 23 bp, Artificial Sequence
  X-linked inhibitor of apoptosis (XIAP) siRNA
gaaatttaatgcacaacgctgat

SEQ ID NO: 14426 - DNA, 23 bp, Artificial Sequence
  X-linked inhibitor of apoptosis (XIAP) siRNA
aaatttaatgcacaacgctgatg

SEQ ID NO: 14427 - DNA, 23 bp, Artificial Sequence
  X-linked inhibitor of apoptosis (XIAP) siRNA
aatttaatgcacaacgctgatgt

SEQ ID NO: 14428 - DNA, 23 bp, Artificial Sequence
  X-linked inhibitor of apoptosis (XIAP) siRNA
atttaatgcacaacgctgatgtg

SEQ ID NO: 14429 - DNA, 23 bp, Artificial Sequence
  X-linked inhibitor of apoptosis (XIAP) siRNA
tttaatgcacaacgctgatgtgg

SEQ ID NO: 14430 - DNA, 23 bp, Artificial Sequence
  X-linked inhibitor of apoptosis (XIAP) siRNA
ttaatgcacaacgctgatgtggc

SEQ ID NO: 14431 - DNA, 23 bp, Artificial Sequence
  X-linked inhibitor of apoptosis (XIAP) siRNA
taatgcacaacgctgatgtggct

SEQ ID NO: 14432 - DNA, 23 bp, Artificial Sequence
  X-linked inhibitor of apoptosis (XIAP) siRNA
aatgcacaacgctgatgtggcta

SEQ ID NO: 14433 - DNA, 23 bp, Artificial Sequence
  X-linked inhibitor of apoptosis (XIAP) siRNA
atgcacaacgctgatgtggctaa

SEQ ID NO: 14434 - DNA, 23 bp, Artificial Sequence
  X-linked inhibitor of apoptosis (XIAP) siRNA
tgcacaacgctgatgtggctaac

SEQ ID NO: 14435 - DNA, 23 bp, Artificial Sequence
  X-linked inhibitor of apoptosis (XIAP) siRNA
gcacaacgctgatgtggctaaca

SEQ ID NO: 14436 - DNA, 23 bp, Artificial Sequence
  X-linked inhibitor of apoptosis (XIAP) siRNA
cacaacgctgatgtggctaacaa

SEQ ID NO: 14437 - DNA, 23 bp, Artificial Sequence
  X-linked inhibitor of apoptosis (XIAP) siRNA
acaacgctgatgtggctaacaag

SEQ ID NO: 14438 - DNA, 23 bp, Artificial Sequence
  X-linked inhibitor of apoptosis (XIAP) siRNA
caacgctgatgtggctaacaagt

SEQ ID NO: 14439 - DNA, 23 bp, Artificial Sequence
  X-linked inhibitor of apoptosis (XIAP) siRNA
aacgctgatgtggctaacaagtt

SEQ ID NO: 14440 - DNA, 23 bp, Artificial Sequence
  X-linked inhibitor of apoptosis (XIAP) siRNA
acgctgatgtggctaacaagttt

SEQ ID NO: 14441 - DNA, 23 bp, Artificial Sequence
  X-linked inhibitor of apoptosis (XIAP) siRNA
cgctgatgtggctaacaagttta

SEQ ID NO: 14442 - DNA, 23 bp, Artificial Sequence
  X-linked inhibitor of apoptosis (XIAP) siRNA
gctgatgtggctaacaagtttat

SEQ ID NO: 14443 - DNA, 23 bp, Artificial Sequence
  X-linked inhibitor of apoptosis (XIAP) siRNA
ctgatgtggctaacaagtttatt

SEQ ID NO: 14444 - DNA, 23 bp, Artificial Sequence
  X-linked inhibitor of apoptosis (XIAP) siRNA
tgatgtggctaacaagtttattt

SEQ ID NO: 14445 - DNA, 23 bp, Artificial Sequence
  X-linked inhibitor of apoptosis (XIAP) siRNA
gatgtggctaacaagtttatttt

SEQ ID NO: 14446 - DNA, 23 bp, Artificial Sequence
  X-linked inhibitor of apoptosis (XIAP) siRNA
atgtggctaacaagtttatttta

SEQ ID NO: 14447 - DNA, 23 bp, Artificial Sequence
  X-linked inhibitor of apoptosis (XIAP) siRNA
tgtggctaacaagtttattttaa

SEQ ID NO: 14448 - DNA, 23 bp, Artificial Sequence
  X-linked inhibitor of apoptosis (XIAP) siRNA
gtggctaacaagtttattttaag

SEQ ID NO: 14449 - DNA, 23 bp, Artificial Sequence
  X-linked inhibitor of apoptosis (XIAP) siRNA
tggctaacaagtttattttaaga

SEQ ID NO: 14450 - DNA, 23 bp, Artificial Sequence
  X-linked inhibitor of apoptosis (XIAP) siRNA
ggctaacaagtttattttaagaa

SEQ ID NO: 14451 - DNA, 23 bp, Artificial Sequence
  X-linked inhibitor of apoptosis (XIAP) siRNA
gctaacaagtttattttaagaat

SEQ ID NO: 14452 - DNA, 23 bp, Artificial Sequence
  X-linked inhibitor of apoptosis (XIAP) siRNA
ctaacaagtttattttaagaatt

SEQ ID NO: 14453 - DNA, 23 bp, Artificial Sequence
  X-linked inhibitor of apoptosis (XIAP) siRNA
taacaagtttattttaagaattg

SEQ ID NO: 14454 - DNA, 23 bp, Artificial Sequence
  X-linked inhibitor of apoptosis (XIAP) siRNA
aacaagtttattttaagaattgt

SEQ ID NO: 14455 - DNA, 23 bp, Artificial Sequence
  X-linked inhibitor of apoptosis (XIAP) siRNA
acaagtttattttaagaattgtt

SEQ ID NO: 14456 - DNA, 23 bp, Artificial Sequence
  X-linked inhibitor of apoptosis (XIAP) siRNA
caagtttattttaagaattgttt

SEQ ID NO: 14457 - DNA, 23 bp, Artificial Sequence
  X-linked inhibitor of apoptosis (XIAP) siRNA
aagtttattttaagaattgttta

SEQ ID NO: 14458 - DNA, 23 bp, Artificial Sequence
  X-linked inhibitor of apoptosis (XIAP) siRNA
agtttattttaagaattgtttag

SEQ ID NO: 14459 - DNA, 23 bp, Artificial Sequence
  X-linked inhibitor of apoptosis (XIAP) siRNA
gtttattttaagaattgtttaga

SEQ ID NO: 14460 - DNA, 23 bp, Artificial Sequence
  X-linked inhibitor of apoptosis (XIAP) siRNA
tttattttaagaattgtttagaa

SEQ ID NO: 14461 - DNA, 23 bp, Artificial Sequence
  X-linked inhibitor of apoptosis (XIAP) siRNA
ttattttaagaattgtttagaaa

SEQ ID NO: 14462 - DNA, 23 bp, Artificial Sequence
  X-linked inhibitor of apoptosis (XIAP) siRNA
tattttaagaattgtttagaaat

SEQ ID NO: 14463 - DNA, 23 bp, Artificial Sequence
  X-linked inhibitor of apoptosis (XIAP) siRNA
attttaagaattgtttagaaatg

SEQ ID NO: 14464 - DNA, 23 bp, Artificial Sequence
  X-linked inhibitor of apoptosis (XIAP) siRNA
ttttaagaattgtttagaaatgc

SEQ ID NO: 14465 - DNA, 23 bp, Artificial Sequence
  X-linked inhibitor of apoptosis (XIAP) siRNA
tttaagaattgtttagaaatgct

SEQ ID NO: 14466 - DNA, 23 bp, Artificial Sequence
  X-linked inhibitor of apoptosis (XIAP) siRNA
ttaagaattgtttagaaatgctg

SEQ ID NO: 14467 - DNA, 23 bp, Artificial Sequence
  X-linked inhibitor of apoptosis (XIAP) siRNA
taagaattgtttagaaatgctgt

SEQ ID NO: 14468 - DNA, 23 bp, Artificial Sequence
  X-linked inhibitor of apoptosis (XIAP) siRNA
aagaattgtttagaaatgctgtt

SEQ ID NO: 14469 - DNA, 23 bp, Artificial Sequence
  X-linked inhibitor of apoptosis (XIAP) siRNA
agaattgtttagaaatgctgttg

SEQ ID NO: 14470 - DNA, 23 bp, Artificial Sequence
  X-linked inhibitor of apoptosis (XIAP) siRNA
gaattgtttagaaatgctgttgc

SEQ ID NO: 14471 - DNA, 23 bp, Artificial Sequence
  X-linked inhibitor of apoptosis (XIAP) siRNA
aattgtttagaaatgctgttgct

SEQ ID NO: 14472 - DNA, 23 bp, Artificial Sequence
  X-linked inhibitor of apoptosis (XIAP) siRNA
attgtttagaaatgctgttgctt

SEQ ID NO: 14473 - DNA, 23 bp, Artificial Sequence
  X-linked inhibitor of apoptosis (XIAP) siRNA
ttgtttagaaatgctgttgcttc

SEQ ID NO: 14474 - DNA, 23 bp, Artificial Sequence
  X-linked inhibitor of apoptosis (XIAP) siRNA
tgtttagaaatgctgttgcttca

SEQ ID NO: 14475 - DNA, 23 bp, Artificial Sequence
  X-linked inhibitor of apoptosis (XIAP) siRNA
gtttagaaatgctgttgcttcag

SEQ ID NO: 14476 - DNA, 23 bp, Artificial Sequence
  X-linked inhibitor of apoptosis (XIAP) siRNA
tttagaaatgctgttgcttcagg

SEQ ID NO: 14477 - DNA, 23 bp, Artificial Sequence
  X-linked inhibitor of apoptosis (XIAP) siRNA
ttagaaatgctgttgcttcaggt

SEQ ID NO: 14478 - DNA, 23 bp, Artificial Sequence
  X-linked inhibitor of apoptosis (XIAP) siRNA
tagaaatgctgttgcttcaggtt

SEQ ID NO: 14479 - DNA, 23 bp, Artificial Sequence
  X-linked inhibitor of apoptosis (XIAP) siRNA
agaaatgctgttgcttcaggttc

SEQ ID NO: 14480 - DNA, 23 bp, Artificial Sequence
  X-linked inhibitor of apoptosis (XIAP) siRNA
gaaatgctgttgcttcaggttct

SEQ ID NO: 14481 - DNA, 23 bp, Artificial Sequence
  X-linked inhibitor of apoptosis (XIAP) siRNA
aaatgctgttgcttcaggttctt

SEQ ID NO: 14482 - DNA, 23 bp, Artificial Sequence
  X-linked inhibitor of apoptosis (XIAP) siRNA
aatgctgttgcttcaggttctta

SEQ ID NO: 14483 - DNA, 23 bp, Artificial Sequence
  X-linked inhibitor of apoptosis (XIAP) siRNA
atgctgttgcttcaggttcttaa

SEQ ID NO: 14484 - DNA, 23 bp, Artificial Sequence
  X-linked inhibitor of apoptosis (XIAP) siRNA
tgctgttgcttcaggttcttaaa

SEQ ID NO: 14485 - DNA, 23 bp, Artificial Sequence
  X-linked inhibitor of apoptosis (XIAP) siRNA
gctgttgcttcaggttcttaaaa

SEQ ID NO: 14486 - DNA, 23 bp, Artificial Sequence
  X-linked inhibitor of apoptosis (XIAP) siRNA
ctgttgcttcaggttcttaaaat

SEQ ID NO: 14487 - DNA, 23 bp, Artificial Sequence
  X-linked inhibitor of apoptosis (XIAP) siRNA
tgttgcttcaggttcttaaaatc

SEQ ID NO: 14488 - DNA, 23 bp, Artificial Sequence
  X-linked inhibitor of apoptosis (XIAP) siRNA
gttgcttcaggttcttaaaatca

SEQ ID NO: 14489 - DNA, 23 bp, Artificial Sequence
  X-linked inhibitor of apoptosis (XIAP) siRNA
ttgcttcaggttcttaaaatcac

SEQ ID NO: 14490 - DNA, 23 bp, Artificial Sequence
  X-linked inhibitor of apoptosis (XIAP) siRNA
tgcttcaggttcttaaaatcact

SEQ ID NO: 14491 - DNA, 23 bp, Artificial Sequence
  X-linked inhibitor of apoptosis (XIAP) siRNA
gcttcaggttcttaaaatcactc

SEQ ID NO: 14492 - DNA, 23 bp, Artificial Sequence
  X-linked inhibitor of apoptosis (XIAP) siRNA
cttcaggttcttaaaatcactca

SEQ ID NO: 14493 - DNA, 23 bp, Artificial Sequence
  X-linked inhibitor of apoptosis (XIAP) siRNA
ttcaggttcttaaaatcactcag

SEQ ID NO: 14494 - DNA, 23 bp, Artificial Sequence
  X-linked inhibitor of apoptosis (XIAP) siRNA
tcaggttcttaaaatcactcagc

SEQ ID NO: 14495 - DNA, 23 bp, Artificial Sequence
  X-linked inhibitor of apoptosis (XIAP) siRNA
caggttcttaaaatcactcagca

SEQ ID NO: 14496 - DNA, 23 bp, Artificial Sequence
  X-linked inhibitor of apoptosis (XIAP) siRNA
aggttcttaaaatcactcagcac

SEQ ID NO: 14497 - DNA, 23 bp, Artificial Sequence
  X-linked inhibitor of apoptosis (XIAP) siRNA
ggttcttaaaatcactcagcact

SEQ ID NO: 14498 - DNA, 23 bp, Artificial Sequence
  X-linked inhibitor of apoptosis (XIAP) siRNA
gttcttaaaatcactcagcactc

SEQ ID NO: 14499 - DNA, 23 bp, Artificial Sequence
  X-linked inhibitor of apoptosis (XIAP) siRNA
ttcttaaaatcactcagcactcc

SEQ ID NO: 14500 - DNA, 23 bp, Artificial Sequence
  X-linked inhibitor of apoptosis (XIAP) siRNA
tcttaaaatcactcagcactcca

SEQ ID NO: 14501 - DNA, 23 bp, Artificial Sequence
  X-linked inhibitor of apoptosis (XIAP) siRNA
cttaaaatcactcagcactccaa

SEQ ID NO: 14502 - DNA, 23 bp, Artificial Sequence
  X-linked inhibitor of apoptosis (XIAP) siRNA
ttaaaatcactcagcactccaac

SEQ ID NO: 14503 - DNA, 23 bp, Artificial Sequence
  X-linked inhibitor of apoptosis (XIAP) siRNA
taaaatcactcagcactccaact

SEQ ID NO: 14504 - DNA, 23 bp, Artificial Sequence
  X-linked inhibitor of apoptosis (XIAP) siRNA
aaaatcactcagcactccaactt

SEQ ID NO: 14505 - DNA, 23 bp, Artificial Sequence
  X-linked inhibitor of apoptosis (XIAP) siRNA
aaatcactcagcactccaacttc

SEQ ID NO: 14506 - DNA, 23 bp, Artificial Sequence
  X-linked inhibitor of apoptosis (XIAP) siRNA
aatcactcagcactccaacttct

SEQ ID NO: 14507 - DNA, 23 bp, Artificial Sequence
  X-linked inhibitor of apoptosis (XIAP) siRNA
atcactcagcactccaacttcta

SEQ ID NO: 14508 - DNA, 23 bp, Artificial Sequence
  X-linked inhibitor of apoptosis (XIAP) siRNA
tcactcagcactccaacttctaa

SEQ ID NO: 14509 - DNA, 23 bp, Artificial Sequence
  X-linked inhibitor of apoptosis (XIAP) siRNA
cactcagcactccaacttctaat

SEQ ID NO: 14510 - DNA, 23 bp, Artificial Sequence
  X-linked inhibitor of apoptosis (XIAP) siRNA
actcagcactccaacttctaatc

SEQ ID NO: 14511 - DNA, 23 bp, Artificial Sequence
  X-linked inhibitor of apoptosis (XIAP) siRNA
ctcagcactccaacttctaatca

SEQ ID NO: 14512 - DNA, 23 bp, Artificial Sequence
  X-linked inhibitor of apoptosis (XIAP) siRNA
tcagcactccaacttctaatcaa

SEQ ID NO: 14513 - DNA, 23 bp, Artificial Sequence
  X-linked inhibitor of apoptosis (XIAP) siRNA
cagcactccaacttctaatcaaa

SEQ ID NO: 14514 - DNA, 23 bp, Artificial Sequence
  X-linked inhibitor of apoptosis (XIAP) siRNA
agcactccaacttctaatcaaat

SEQ ID NO: 14515 - DNA, 23 bp, Artificial Sequence
  X-linked inhibitor of apoptosis (XIAP) siRNA
gcactccaacttctaatcaaatt

SEQ ID NO: 14516 - DNA, 23 bp, Artificial Sequence
  X-linked inhibitor of apoptosis (XIAP) siRNA
cactccaacttctaatcaaattt

SEQ ID NO: 14517 - DNA, 23 bp, Artificial Sequence
  X-linked inhibitor of apoptosis (XIAP) siRNA
actccaacttctaatcaaatttt

SEQ ID NO: 14518 - DNA, 23 bp, Artificial Sequence
  X-linked inhibitor of apoptosis (XIAP) siRNA
ctccaacttctaatcaaattttt

SEQ ID NO: 14519 - DNA, 23 bp, Artificial Sequence
  X-linked inhibitor of apoptosis (XIAP) siRNA
tccaacttctaatcaaatttttg

SEQ ID NO: 14520 - DNA, 23 bp, Artificial Sequence
  X-linked inhibitor of apoptosis (XIAP) siRNA
ccaacttctaatcaaatttttgg

SEQ ID NO: 14521 - DNA, 23 bp, Artificial Sequence
  X-linked inhibitor of apoptosis (XIAP) siRNA
caacttctaatcaaatttttgga

SEQ ID NO: 14522 - DNA, 23 bp, Artificial Sequence
  X-linked inhibitor of apoptosis (XIAP) siRNA
aacttctaatcaaatttttggag

SEQ ID NO: 14523 - DNA, 23 bp, Artificial Sequence
  X-linked inhibitor of apoptosis (XIAP) siRNA
acttctaatcaaatttttggaga

SEQ ID NO: 14524 - DNA, 23 bp, Artificial Sequence
  X-linked inhibitor of apoptosis (XIAP) siRNA
cttctaatcaaatttttggagac

SEQ ID NO: 14525 - DNA, 23 bp, Artificial Sequence
  X-linked inhibitor of apoptosis (XIAP) siRNA
ttctaatcaaatttttggagact

SEQ ID NO: 14526 - DNA, 23 bp, Artificial Sequence
  X-linked inhibitor of apoptosis (XIAP) siRNA
tctaatcaaatttttggagactt

SEQ ID NO: 14527 - DNA, 23 bp, Artificial Sequence
  X-linked inhibitor of apoptosis (XIAP) siRNA
ctaatcaaatttttggagactta

SEQ ID NO: 14528 - DNA, 23 bp, Artificial Sequence
  X-linked inhibitor of apoptosis (XIAP) siRNA
taatcaaatttttggagacttaa

SEQ ID NO: 14529 - DNA, 23 bp, Artificial Sequence
  X-linked inhibitor of apoptosis (XIAP) siRNA
aatcaaatttttggagacttaac

SEQ ID NO: 14530 - DNA, 23 bp, Artificial Sequence
  X-linked inhibitor of apoptosis (XIAP) siRNA
atcaaatttttggagacttaaca

SEQ ID NO: 14531 - DNA, 23 bp, Artificial Sequence
  X-linked inhibitor of apoptosis (XIAP) siRNA
tcaaatttttggagacttaacag

SEQ ID NO: 14532 - DNA, 23 bp, Artificial Sequence
  X-linked inhibitor of apoptosis (XIAP) siRNA
caaatttttggagacttaacagc

SEQ ID NO: 14533 - DNA, 23 bp, Artificial Sequence
  X-linked inhibitor of apoptosis (XIAP) siRNA
aaatttttggagacttaacagca

SEQ ID NO: 14534 - DNA, 23 bp, Artificial Sequence
  X-linked inhibitor of apoptosis (XIAP) siRNA
aatttttggagacttaacagcat

SEQ ID NO: 14535 - DNA, 23 bp, Artificial Sequence
  X-linked inhibitor of apoptosis (XIAP) siRNA
atttttggagacttaacagcatt

SEQ ID NO: 14536 - DNA, 23 bp, Artificial Sequence
  X-linked inhibitor of apoptosis (XIAP) siRNA
tttttggagacttaacagcattt

SEQ ID NO: 14537 - DNA, 23 bp, Artificial Sequence
  X-linked inhibitor of apoptosis (XIAP) siRNA
ttttggagacttaacagcatttg

SEQ ID NO: 14538 - DNA, 23 bp, Artificial Sequence
  X-linked inhibitor of apoptosis (XIAP) siRNA
tttggagacttaacagcatttgt

SEQ ID NO: 14539 - DNA, 23 bp, Artificial Sequence
  X-linked inhibitor of apoptosis (XIAP) siRNA
ttggagacttaacagcatttgtc

SEQ ID NO: 14540 - DNA, 23 bp, Artificial Sequence
  X-linked inhibitor of apoptosis (XIAP) siRNA
tggagacttaacagcatttgtct

SEQ ID NO: 14541 - DNA, 23 bp, Artificial Sequence
  X-linked inhibitor of apoptosis (XIAP) siRNA
ggagacttaacagcatttgtctg

SEQ ID NO: 14542 - DNA, 23 bp, Artificial Sequence
  X-linked inhibitor of apoptosis (XIAP) siRNA
gagacttaacagcatttgtctgt

SEQ ID NO: 14543 - DNA, 23 bp, Artificial Sequence
  X-linked inhibitor of apoptosis (XIAP) siRNA
agacttaacagcatttgtctgtg

SEQ ID NO: 14544 - DNA, 23 bp, Artificial Sequence
  X-linked inhibitor of apoptosis (XIAP) siRNA
gacttaacagcatttgtctgtgt

SEQ ID NO: 14545 - DNA, 23 bp, Artificial Sequence
  X-linked inhibitor of apoptosis (XIAP) siRNA
acttaacagcatttgtctgtgtt

SEQ ID NO: 14546 - DNA, 23 bp, Artificial Sequence
  X-linked inhibitor of apoptosis (XIAP) siRNA
cttaacagcatttgtctgtgttt

SEQ ID NO: 14547 - DNA, 23 bp, Artificial Sequence
  X-linked inhibitor of apoptosis (XIAP) siRNA
ttaacagcatttgtctgtgtttg

SEQ ID NO: 14548 - DNA, 23 bp, Artificial Sequence
  X-linked inhibitor of apoptosis (XIAP) siRNA
taacagcatttgtctgtgtttga

SEQ ID NO: 14549 - DNA, 23 bp, Artificial Sequence
  X-linked inhibitor of apoptosis (XIAP) siRNA
aacagcatttgtctgtgtttgaa

SEQ ID NO: 14550 - DNA, 23 bp, Artificial Sequence
  X-linked inhibitor of apoptosis (XIAP) siRNA
acagcatttgtctgtgtttgaac

SEQ ID NO: 14551 - DNA, 23 bp, Artificial Sequence
  X-linked inhibitor of apoptosis (XIAP) siRNA
cagcatttgtctgtgtttgaact

SEQ ID NO: 14552 - DNA, 23 bp, Artificial Sequence
  X-linked inhibitor of apoptosis (XIAP) siRNA
agcatttgtctgtgtttgaacta

SEQ ID NO: 14553 - DNA, 23 bp, Artificial Sequence
  X-linked inhibitor of apoptosis (XIAP) siRNA
gcatttgtctgtgtttgaactat

SEQ ID NO: 14554 - DNA, 23 bp, Artificial Sequence
  X-linked inhibitor of apoptosis (XIAP) siRNA
catttgtctgtgtttgaactata

SEQ ID NO: 14555 - DNA, 23 bp, Artificial Sequence
  X-linked inhibitor of apoptosis (XIAP) siRNA
atttgtctgtgtttgaactataa

SEQ ID NO: 14556 - DNA, 23 bp, Artificial Sequence
  X-linked inhibitor of apoptosis (XIAP) siRNA
tttgtctgtgtttgaactataaa

SEQ ID NO: 14557 - DNA, 23 bp, Artificial Sequence
  X-linked inhibitor of apoptosis (XIAP) siRNA
ttgtctgtgtttgaactataaaa

SEQ ID NO: 14558 - DNA, 23 bp, Artificial Sequence
  X-linked inhibitor of apoptosis (XIAP) siRNA
tgtctgtgtttgaactataaaaa

SEQ ID NO: 14559 - DNA, 23 bp, Artificial Sequence
  X-linked inhibitor of apoptosis (XIAP) siRNA
gtctgtgtttgaactataaaaag

SEQ ID NO: 14560 - DNA, 23 bp, Artificial Sequence
  X-linked inhibitor of apoptosis (XIAP) siRNA
tctgtgtttgaactataaaaagc

SEQ ID NO: 14561 - DNA, 23 bp, Artificial Sequence
  X-linked inhibitor of apoptosis (XIAP) siRNA
ctgtgtttgaactataaaaagca

SEQ ID NO: 14562 - DNA, 23 bp, Artificial Sequence
  X-linked inhibitor of apoptosis (XIAP) siRNA
tgtgtttgaactataaaaagcac

SEQ ID NO: 14563 - DNA, 23 bp, Artificial Sequence
  X-linked inhibitor of apoptosis (XIAP) siRNA
gtgtttgaactataaaaagcacc

SEQ ID NO: 14564 - DNA, 23 bp, Artificial Sequence
  X-linked inhibitor of apoptosis (XIAP) siRNA
tgtttgaactataaaaagcaccg

SEQ ID NO: 14565 - DNA, 23 bp, Artificial Sequence
  X-linked inhibitor of apoptosis (XIAP) siRNA
gtttgaactataaaaagcaccgg

SEQ ID NO: 14566 - DNA, 23 bp, Artificial Sequence
  X-linked inhibitor of apoptosis (XIAP) siRNA
tttgaactataaaaagcaccgga

SEQ ID NO: 14567 - DNA, 23 bp, Artificial Sequence
  X-linked inhibitor of apoptosis (XIAP) siRNA
ttgaactataaaaagcaccggat

SEQ ID NO: 14568 - DNA, 23 bp, Artificial Sequence
  X-linked inhibitor of apoptosis (XIAP) siRNA
tgaactataaaaagcaccggatc

SEQ ID NO: 14569 - DNA, 23 bp, Artificial Sequence
  X-linked inhibitor of apoptosis (XIAP) siRNA
gaactataaaaagcaccggatct

SEQ ID NO: 14570 - DNA, 23 bp, Artificial Sequence
  X-linked inhibitor of apoptosis (XIAP) siRNA
aactataaaaagcaccggatctt

SEQ ID NO: 14571 - DNA, 23 bp, Artificial Sequence
  X-linked inhibitor of apoptosis (XIAP) siRNA
actataaaaagcaccggatcttt

SEQ ID NO: 14572 - DNA, 23 bp, Artificial Sequence
  X-linked inhibitor of apoptosis (XIAP) siRNA
ctataaaaagcaccggatctttt

SEQ ID NO: 14573 - DNA, 23 bp, Artificial Sequence
  X-linked inhibitor of apoptosis (XIAP) siRNA
tataaaaagcaccggatcttttc

SEQ ID NO: 14574 - DNA, 23 bp, Artificial Sequence
  X-linked inhibitor of apoptosis (XIAP) siRNA
ataaaaagcaccggatcttttcc

SEQ ID NO: 14575 - DNA, 23 bp, Artificial Sequence
  X-linked inhibitor of apoptosis (XIAP) siRNA
taaaaagcaccggatcttttcca

SEQ ID NO: 14576 - DNA, 23 bp, Artificial Sequence
  X-linked inhibitor of apoptosis (XIAP) siRNA
aaaaagcaccggatcttttccat

SEQ ID NO: 14577 - DNA, 23 bp, Artificial Sequence
  X-linked inhibitor of apoptosis (XIAP) siRNA
aaaagcaccggatcttttccatc

SEQ ID NO: 14578 - DNA, 23 bp, Artificial Sequence
  X-linked inhibitor of apoptosis (XIAP) siRNA
aaagcaccggatcttttccatct

SEQ ID NO: 14579 - DNA, 23 bp, Artificial Sequence
  X-linked inhibitor of apoptosis (XIAP) siRNA
aagcaccggatcttttccatcta

SEQ ID NO: 14580 - DNA, 23 bp, Artificial Sequence
  X-linked inhibitor of apoptosis (XIAP) siRNA
agcaccggatcttttccatctaa

SEQ ID NO: 14581 - DNA, 23 bp, Artificial Sequence
  X-linked inhibitor of apoptosis (XIAP) siRNA
gcaccggatcttttccatctaat

SEQ ID NO: 14582 - DNA, 23 bp, Artificial Sequence
  X-linked inhibitor of apoptosis (XIAP) siRNA
caccggatcttttccatctaatt

SEQ ID NO: 14583 - DNA, 23 bp, Artificial Sequence
  X-linked inhibitor of apoptosis (XIAP) siRNA
accggatcttttccatctaattc

SEQ ID NO: 14584 - DNA, 23 bp, Artificial Sequence
  X-linked inhibitor of apoptosis (XIAP) siRNA
ccggatcttttccatctaattcc

SEQ ID NO: 14585 - DNA, 23 bp, Artificial Sequence
  X-linked inhibitor of apoptosis (XIAP) siRNA
cggatcttttccatctaattccg

SEQ ID NO: 14586 - DNA, 23 bp, Artificial Sequence
  X-linked inhibitor of apoptosis (XIAP) siRNA
ggatcttttccatctaattccgc

SEQ ID NO: 14587 - DNA, 23 bp, Artificial Sequence
  X-linked inhibitor of apoptosis (XIAP) siRNA
gatcttttccatctaattccgca

SEQ ID NO: 14588 - DNA, 23 bp, Artificial Sequence
  X-linked inhibitor of apoptosis (XIAP) siRNA
atcttttccatctaattccgcaa

SEQ ID NO: 14589 - DNA, 23 bp, Artificial Sequence
  X-linked inhibitor of apoptosis (XIAP) siRNA
tcttttccatctaattccgcaaa

SEQ ID NO: 14590 - DNA, 23 bp, Artificial Sequence
  X-linked inhibitor of apoptosis (XIAP) siRNA
cttttccatctaattccgcaaaa

SEQ ID NO: 14591 - DNA, 23 bp, Artificial Sequence
  X-linked inhibitor of apoptosis (XIAP) siRNA
ttttccatctaattccgcaaaaa

SEQ ID NO: 14592 - DNA, 23 bp, Artificial Sequence
  X-linked inhibitor of apoptosis (XIAP) siRNA
tttccatctaattccgcaaaaat

SEQ ID NO: 14593 - DNA, 23 bp, Artificial Sequence
  X-linked inhibitor of apoptosis (XIAP) siRNA
ttccatctaattccgcaaaaatt

SEQ ID NO: 14594 - DNA, 23 bp, Artificial Sequence
  X-linked inhibitor of apoptosis (XIAP) siRNA
tccatctaattccgcaaaaattg

SEQ ID NO: 14595 - DNA, 23 bp, Artificial Sequence
  X-linked inhibitor of apoptosis (XIAP) siRNA
ccatctaattccgcaaaaattga

SEQ ID NO: 14596 - DNA, 23 bp, Artificial Sequence
  X-linked inhibitor of apoptosis (XIAP) siRNA
catctaattccgcaaaaattgat

SEQ ID NO: 14597 - DNA, 23 bp, Artificial Sequence
  X-linked inhibitor of apoptosis (XIAP) siRNA
atctaattccgcaaaaattgatc

SEQ ID NO: 14598 - DNA, 23 bp, Artificial Sequence
  X-linked inhibitor of apoptosis (XIAP) siRNA
tctaattccgcaaaaattgatca

SEQ ID NO: 14599 - DNA, 23 bp, Artificial Sequence
  X-linked inhibitor of apoptosis (XIAP) siRNA
ctaattccgcaaaaattgatcat

SEQ ID NO: 14600 - DNA, 23 bp, Artificial Sequence
  X-linked inhibitor of apoptosis (XIAP) siRNA
taattccgcaaaaattgatcatt

SEQ ID NO: 14601 - DNA, 23 bp, Artificial Sequence
  X-linked inhibitor of apoptosis (XIAP) siRNA
aattccgcaaaaattgatcattt

SEQ ID NO: 14602 - DNA, 23 bp, Artificial Sequence
  X-linked inhibitor of apoptosis (XIAP) siRNA
attccgcaaaaattgatcatttg

SEQ ID NO: 14603 - DNA, 23 bp, Artificial Sequence
  X-linked inhibitor of apoptosis (XIAP) siRNA
ttccgcaaaaattgatcatttgc

SEQ ID NO: 14604 - DNA, 23 bp, Artificial Sequence
  X-linked inhibitor of apoptosis (XIAP) siRNA
tccgcaaaaattgatcatttgca

SEQ ID NO: 14605 - DNA, 23 bp, Artificial Sequence
  X-linked inhibitor of apoptosis (XIAP) siRNA
ccgcaaaaattgatcatttgcaa

SEQ ID NO: 14606 - DNA, 23 bp, Artificial Sequence
  X-linked inhibitor of apoptosis (XIAP) siRNA
cgcaaaaattgatcatttgcaaa

SEQ ID NO: 14607 - DNA, 23 bp, Artificial Sequence
  X-linked inhibitor of apoptosis (XIAP) siRNA
gcaaaaattgatcatttgcaaag

SEQ ID NO: 14608 - DNA, 23 bp, Artificial Sequence
  X-linked inhibitor of apoptosis (XIAP) siRNA
caaaaattgatcatttgcaaagt

SEQ ID NO: 14609 - DNA, 23 bp, Artificial Sequence
  X-linked inhibitor of apoptosis (XIAP) siRNA
aaaaattgatcatttgcaaagtc

SEQ ID NO: 14610 - DNA, 23 bp, Artificial Sequence
  X-linked inhibitor of apoptosis (XIAP) siRNA
aaaattgatcatttgcaaagtca

SEQ ID NO: 14611 - DNA, 23 bp, Artificial Sequence
  X-linked inhibitor of apoptosis (XIAP) siRNA
aaattgatcatttgcaaagtcaa

SEQ ID NO: 14612 - DNA, 23 bp, Artificial Sequence
  X-linked inhibitor of apoptosis (XIAP) siRNA
aattgatcatttgcaaagtcaaa

SEQ ID NO: 14613 - DNA, 23 bp, Artificial Sequence
  X-linked inhibitor of apoptosis (XIAP) siRNA
attgatcatttgcaaagtcaaaa

SEQ ID NO: 14614 - DNA, 23 bp, Artificial Sequence
  X-linked inhibitor of apoptosis (XIAP) siRNA
ttgatcatttgcaaagtcaaaac

SEQ ID NO: 14615 - DNA, 23 bp, Artificial Sequence
  X-linked inhibitor of apoptosis (XIAP) siRNA
tgatcatttgcaaagtcaaaact

SEQ ID NO: 14616 - DNA, 23 bp, Artificial Sequence
  X-linked inhibitor of apoptosis (XIAP) siRNA
gatcatttgcaaagtcaaaacta

SEQ ID NO: 14617 - DNA, 23 bp, Artificial Sequence
  X-linked inhibitor of apoptosis (XIAP) siRNA
atcatttgcaaagtcaaaactat

SEQ ID NO: 14618 - DNA, 23 bp, Artificial Sequence
  X-linked inhibitor of apoptosis (XIAP) siRNA
tcatttgcaaagtcaaaactata

SEQ ID NO: 14619 - DNA, 23 bp, Artificial Sequence
  X-linked inhibitor of apoptosis (XIAP) siRNA
catttgcaaagtcaaaactatag

SEQ ID NO: 14620 - DNA, 23 bp, Artificial Sequence
  X-linked inhibitor of apoptosis (XIAP) siRNA
atttgcaaagtcaaaactatagc

SEQ ID NO: 14621 - DNA, 23 bp, Artificial Sequence
  X-linked inhibitor of apoptosis (XIAP) siRNA
tttgcaaagtcaaaactatagcc

SEQ ID NO: 14622 - DNA, 23 bp, Artificial Sequence
  X-linked inhibitor of apoptosis (XIAP) siRNA
ttgcaaagtcaaaactatagcca

SEQ ID NO: 14623 - DNA, 23 bp, Artificial Sequence
  X-linked inhibitor of apoptosis (XIAP) siRNA
tgcaaagtcaaaactatagccat

SEQ ID NO: 14624 - DNA, 23 bp, Artificial Sequence
  X-linked inhibitor of apoptosis (XIAP) siRNA
gcaaagtcaaaactatagccata

SEQ ID NO: 14625 - DNA, 23 bp, Artificial Sequence
  X-linked inhibitor of apoptosis (XIAP) siRNA
caaagtcaaaactatagccatat

SEQ ID NO: 14626 - DNA, 23 bp, Artificial Sequence
  X-linked inhibitor of apoptosis (XIAP) siRNA
aaagtcaaaactatagccatatc

SEQ ID NO: 14627 - DNA, 23 bp, Artificial Sequence
  X-linked inhibitor of apoptosis (XIAP) siRNA
aagtcaaaactatagccatatcc

SEQ ID NO: 14628 - DNA, 23 bp, Artificial Sequence
  X-linked inhibitor of apoptosis (XIAP) siRNA
agtcaaaactatagccatatcca

SEQ ID NO: 14629 - DNA, 23 bp, Artificial Sequence
  X-linked inhibitor of apoptosis (XIAP) siRNA
gtcaaaactatagccatatccaa

SEQ ID NO: 14630 - DNA, 23 bp, Artificial Sequence
  X-linked inhibitor of apoptosis (XIAP) siRNA
tcaaaactatagccatatccaaa

SEQ ID NO: 14631 - DNA, 23 bp, Artificial Sequence
  X-linked inhibitor of apoptosis (XIAP) siRNA
caaaactatagccatatccaaat

SEQ ID NO: 14632 - DNA, 23 bp, Artificial Sequence
  X-linked inhibitor of apoptosis (XIAP) siRNA
aaaactatagccatatccaaatc

SEQ ID NO: 14633 - DNA, 23 bp, Artificial Sequence
  X-linked inhibitor of apoptosis (XIAP) siRNA
aaactatagccatatccaaatct

SEQ ID NO: 14634 - DNA, 23 bp, Artificial Sequence
  X-linked inhibitor of apoptosis (XIAP) siRNA
aactatagccatatccaaatctt

SEQ ID NO: 14635 - DNA, 23 bp, Artificial Sequence
  X-linked inhibitor of apoptosis (XIAP) siRNA
actatagccatatccaaatcttt

SEQ ID NO: 14636 - DNA, 23 bp, Artificial Sequence
  X-linked inhibitor of apoptosis (XIAP) siRNA
ctatagccatatccaaatctttt

SEQ ID NO: 14637 - DNA, 23 bp, Artificial Sequence
  X-linked inhibitor of apoptosis (XIAP) siRNA
tatagccatatccaaatcttttc

SEQ ID NO: 14638 - DNA, 23 bp, Artificial Sequence
  X-linked inhibitor of apoptosis (XIAP) siRNA
atagccatatccaaatcttttcc

SEQ ID NO: 14639 - DNA, 23 bp, Artificial Sequence
  X-linked inhibitor of apoptosis (XIAP) siRNA
tagccatatccaaatcttttccc

SEQ ID NO: 14640 - DNA, 23 bp, Artificial Sequence
  X-linked inhibitor of apoptosis (XIAP) siRNA
agccatatccaaatcttttcccc

SEQ ID NO: 14641 - DNA, 23 bp, Artificial Sequence
  X-linked inhibitor of apoptosis (XIAP) siRNA
gccatatccaaatcttttccccc

SEQ ID NO: 14642 - DNA, 23 bp, Artificial Sequence
  X-linked inhibitor of apoptosis (XIAP) siRNA
ccatatccaaatcttttccccct

SEQ ID NO: 14643 - DNA, 23 bp, Artificial Sequence
  X-linked inhibitor of apoptosis (XIAP) siRNA
catatccaaatcttttccccctc

SEQ ID NO: 14644 - DNA, 23 bp, Artificial Sequence
  X-linked inhibitor of apoptosis (XIAP) siRNA
atatccaaatcttttccccctcc

SEQ ID NO: 14645 - DNA, 23 bp, Artificial Sequence
  X-linked inhibitor of apoptosis (XIAP) siRNA
tatccaaatcttttccccctccc

SEQ ID NO: 14646 - DNA, 23 bp, Artificial Sequence
  X-linked inhibitor of apoptosis (XIAP) siRNA
atccaaatcttttccccctccca

SEQ ID NO: 14647 - DNA, 23 bp, Artificial Sequence
  X-linked inhibitor of apoptosis (XIAP) siRNA
tccaaatcttttccccctcccaa

SEQ ID NO: 14648 - DNA, 23 bp, Artificial Sequence
  X-linked inhibitor of apoptosis (XIAP) siRNA
ccaaatcttttccccctcccaag

SEQ ID NO: 14649 - DNA, 23 bp, Artificial Sequence
  X-linked inhibitor of apoptosis (XIAP) siRNA
caaatcttttccccctcccaaga

SEQ ID NO: 14650 - DNA, 23 bp, Artificial Sequence
  X-linked inhibitor of apoptosis (XIAP) siRNA
aaatcttttccccctcccaagag

SEQ ID NO: 14651 - DNA, 23 bp, Artificial Sequence
  X-linked inhibitor of apoptosis (XIAP) siRNA
aatcttttccccctcccaagagt

SEQ ID NO: 14652 - DNA, 23 bp, Artificial Sequence
  X-linked inhibitor of apoptosis (XIAP) siRNA
atcttttccccctcccaagagtt

SEQ ID NO: 14653 - DNA, 23 bp, Artificial Sequence
  X-linked inhibitor of apoptosis (XIAP) siRNA
tcttttccccctcccaagagttc

SEQ ID NO: 14654 - DNA, 23 bp, Artificial Sequence
  X-linked inhibitor of apoptosis (XIAP) siRNA
cttttccccctcccaagagttct

SEQ ID NO: 14655 - DNA, 23 bp, Artificial Sequence
  X-linked inhibitor of apoptosis (XIAP) siRNA
ttttccccctcccaagagttctc

SEQ ID NO: 14656 - DNA, 23 bp, Artificial Sequence
  X-linked inhibitor of apoptosis (XIAP) siRNA
tttccccctcccaagagttctca

SEQ ID NO: 14657 - DNA, 23 bp, Artificial Sequence
  X-linked inhibitor of apoptosis (XIAP) siRNA
ttccccctcccaagagttctcag

SEQ ID NO: 14658 - DNA, 23 bp, Artificial Sequence
  X-linked inhibitor of apoptosis (XIAP) siRNA
tccccctcccaagagttctcagt

SEQ ID NO: 14659 - DNA, 23 bp, Artificial Sequence
  X-linked inhibitor of apoptosis (XIAP) siRNA
ccccctcccaagagttctcagtg

SEQ ID NO: 14660 - DNA, 23 bp, Artificial Sequence
  X-linked inhibitor of apoptosis (XIAP) siRNA
cccctcccaagagttctcagtgt

SEQ ID NO: 14661 - DNA, 23 bp, Artificial Sequence
  X-linked inhibitor of apoptosis (XIAP) siRNA
ccctcccaagagttctcagtgtc

SEQ ID NO: 14662 - DNA, 23 bp, Artificial Sequence
  X-linked inhibitor of apoptosis (XIAP) siRNA
cctcccaagagttctcagtgtct

SEQ ID NO: 14663 - DNA, 23 bp, Artificial Sequence
  X-linked inhibitor of apoptosis (XIAP) siRNA
ctcccaagagttctcagtgtcta

SEQ ID NO: 14664 - DNA, 23 bp, Artificial Sequence
  X-linked inhibitor of apoptosis (XIAP) siRNA
tcccaagagttctcagtgtctac

SEQ ID NO: 14665 - DNA, 23 bp, Artificial Sequence
  X-linked inhibitor of apoptosis (XIAP) siRNA
cccaagagttctcagtgtctaca

SEQ ID NO: 14666 - DNA, 23 bp, Artificial Sequence
  X-linked inhibitor of apoptosis (XIAP) siRNA
ccaagagttctcagtgtctacat

SEQ ID NO: 14667 - DNA, 23 bp, Artificial Sequence
  X-linked inhibitor of apoptosis (XIAP) siRNA
caagagttctcagtgtctacatg

SEQ ID NO: 14668 - DNA, 23 bp, Artificial Sequence
  X-linked inhibitor of apoptosis (XIAP) siRNA
aagagttctcagtgtctacatgt

SEQ ID NO: 14669 - DNA, 23 bp, Artificial Sequence
  X-linked inhibitor of apoptosis (XIAP) siRNA
agagttctcagtgtctacatgta

SEQ ID NO: 14670 - DNA, 23 bp, Artificial Sequence
  X-linked inhibitor of apoptosis (XIAP) siRNA
gagttctcagtgtctacatgtag

SEQ ID NO: 14671 - DNA, 23 bp, Artificial Sequence
  X-linked inhibitor of apoptosis (XIAP) siRNA
agttctcagtgtctacatgtaga

SEQ ID NO: 14672 - DNA, 23 bp, Artificial Sequence
  X-linked inhibitor of apoptosis (XIAP) siRNA
gttctcagtgtctacatgtagac

SEQ ID NO: 14673 - DNA, 23 bp, Artificial Sequence
  X-linked inhibitor of apoptosis (XIAP) siRNA
ttctcagtgtctacatgtagact

SEQ ID NO: 14674 - DNA, 23 bp, Artificial Sequence
  X-linked inhibitor of apoptosis (XIAP) siRNA
tctcagtgtctacatgtagacta

SEQ ID NO: 14675 - DNA, 23 bp, Artificial Sequence
  X-linked inhibitor of apoptosis (XIAP) siRNA
ctcagtgtctacatgtagactat

SEQ ID NO: 14676 - DNA, 23 bp, Artificial Sequence
  X-linked inhibitor of apoptosis (XIAP) siRNA
tcagtgtctacatgtagactatt

SEQ ID NO: 14677 - DNA, 23 bp, Artificial Sequence
  X-linked inhibitor of apoptosis (XIAP) siRNA
cagtgtctacatgtagactattc

SEQ ID NO: 14678 - DNA, 23 bp, Artificial Sequence
  X-linked inhibitor of apoptosis (XIAP) siRNA
agtgtctacatgtagactattcc

SEQ ID NO: 14679 - DNA, 23 bp, Artificial Sequence
  X-linked inhibitor of apoptosis (XIAP) siRNA
gtgtctacatgtagactattcct

SEQ ID NO: 14680 - DNA, 23 bp, Artificial Sequence
  X-linked inhibitor of apoptosis (XIAP) siRNA
tgtctacatgtagactattcctt

SEQ ID NO: 14681 - DNA, 23 bp, Artificial Sequence
  X-linked inhibitor of apoptosis (XIAP) siRNA
gtctacatgtagactattccttt

SEQ ID NO: 14682 - DNA, 23 bp, Artificial Sequence
  X-linked inhibitor of apoptosis (XIAP) siRNA
tctacatgtagactattcctttt

SEQ ID NO: 14683 - DNA, 23 bp, Artificial Sequence
  X-linked inhibitor of apoptosis (XIAP) siRNA
ctacatgtagactattccttttc

SEQ ID NO: 14684 - DNA, 23 bp, Artificial Sequence
  X-linked inhibitor of apoptosis (XIAP) siRNA
tacatgtagactattccttttct

SEQ ID NO: 14685 - DNA, 23 bp, Artificial Sequence
  X-linked inhibitor of apoptosis (XIAP) siRNA
acatgtagactattccttttctg

SEQ ID NO: 14686 - DNA, 23 bp, Artificial Sequence
  X-linked inhibitor of apoptosis (XIAP) siRNA
catgtagactattccttttctgt

SEQ ID NO: 14687 - DNA, 23 bp, Artificial Sequence
  X-linked inhibitor of apoptosis (XIAP) siRNA
atgtagactattccttttctgta

SEQ ID NO: 14688 - DNA, 23 bp, Artificial Sequence
  X-linked inhibitor of apoptosis (XIAP) siRNA
tgtagactattccttttctgtat

SEQ ID NO: 14689 - DNA, 23 bp, Artificial Sequence
  X-linked inhibitor of apoptosis (XIAP) siRNA
gtagactattccttttctgtata

SEQ ID NO: 14690 - DNA, 23 bp, Artificial Sequence
  X-linked inhibitor of apoptosis (XIAP) siRNA
tagactattccttttctgtataa

SEQ ID NO: 14691 - DNA, 23 bp, Artificial Sequence
  X-linked inhibitor of apoptosis (XIAP) siRNA
agactattccttttctgtataaa

SEQ ID NO: 14692 - DNA, 23 bp, Artificial Sequence
  X-linked inhibitor of apoptosis (XIAP) siRNA
gactattccttttctgtataaag

SEQ ID NO: 14693 - DNA, 23 bp, Artificial Sequence
  X-linked inhibitor of apoptosis (XIAP) siRNA
actattccttttctgtataaagt

SEQ ID NO: 14694 - DNA, 23 bp, Artificial Sequence
  X-linked inhibitor of apoptosis (XIAP) siRNA
ctattccttttctgtataaagtt

SEQ ID NO: 14695 - DNA, 23 bp, Artificial Sequence
  X-linked inhibitor of apoptosis (XIAP) siRNA
tattccttttctgtataaagttc

SEQ ID NO: 14696 - DNA, 23 bp, Artificial Sequence
  X-linked inhibitor of apoptosis (XIAP) siRNA
attccttttctgtataaagttca

SEQ ID NO: 14697 - DNA, 23 bp, Artificial Sequence
  X-linked inhibitor of apoptosis (XIAP) siRNA
ttccttttctgtataaagttcac

SEQ ID NO: 14698 - DNA, 23 bp, Artificial Sequence
  X-linked inhibitor of apoptosis (XIAP) siRNA
tccttttctgtataaagttcact

SEQ ID NO: 14699 - DNA, 23 bp, Artificial Sequence
  X-linked inhibitor of apoptosis (XIAP) siRNA
ccttttctgtataaagttcactc

SEQ ID NO: 14700 - DNA, 23 bp, Artificial Sequence
  X-linked inhibitor of apoptosis (XIAP) siRNA
cttttctgtataaagttcactct

SEQ ID NO: 14701 - DNA, 23 bp, Artificial Sequence
  X-linked inhibitor of apoptosis (XIAP) siRNA
ttttctgtataaagttcactcta

SEQ ID NO: 14702 - DNA, 23 bp, Artificial Sequence
  X-linked inhibitor of apoptosis (XIAP) siRNA
tttctgtataaagttcactctag

SEQ ID NO: 14703 - DNA, 23 bp, Artificial Sequence
  X-linked inhibitor of apoptosis (XIAP) siRNA
ttctgtataaagttcactctagg

SEQ ID NO: 14704 - DNA, 23 bp, Artificial Sequence
  X-linked inhibitor of apoptosis (XIAP) siRNA
tctgtataaagttcactctagga

SEQ ID NO: 14705 - DNA, 23 bp, Artificial Sequence
  X-linked inhibitor of apoptosis (XIAP) siRNA
ctgtataaagttcactctaggat

SEQ ID NO: 14706 - DNA, 23 bp, Artificial Sequence
  X-linked inhibitor of apoptosis (XIAP) siRNA
tgtataaagttcactctaggatt

SEQ ID NO: 14707 - DNA, 23 bp, Artificial Sequence
  X-linked inhibitor of apoptosis (XIAP) siRNA
gtataaagttcactctaggattt

SEQ ID NO: 14708 - DNA, 23 bp, Artificial Sequence
  X-linked inhibitor of apoptosis (XIAP) siRNA
tataaagttcactctaggatttc

SEQ ID NO: 14709 - DNA, 23 bp, Artificial Sequence
  X-linked inhibitor of apoptosis (XIAP) siRNA
ataaagttcactctaggatttca

SEQ ID NO: 14710 - DNA, 23 bp, Artificial Sequence
  X-linked inhibitor of apoptosis (XIAP) siRNA
taaagttcactctaggatttcaa

SEQ ID NO: 14711 - DNA, 23 bp, Artificial Sequence
  X-linked inhibitor of apoptosis (XIAP) siRNA
aaagttcactctaggatttcaag

SEQ ID NO: 14712 - DNA, 23 bp, Artificial Sequence
  X-linked inhibitor of apoptosis (XIAP) siRNA
aagttcactctaggatttcaagt

SEQ ID NO: 14713 - DNA, 23 bp, Artificial Sequence
  X-linked inhibitor of apoptosis (XIAP) siRNA
agttcactctaggatttcaagtc

SEQ ID NO: 14714 - DNA, 23 bp, Artificial Sequence
  X-linked inhibitor of apoptosis (XIAP) siRNA
gttcactctaggatttcaagtca

SEQ ID NO: 14715 - DNA, 23 bp, Artificial Sequence
  X-linked inhibitor of apoptosis (XIAP) siRNA
ttcactctaggatttcaagtcac

SEQ ID NO: 14716 - DNA, 23 bp, Artificial Sequence
  X-linked inhibitor of apoptosis (XIAP) siRNA
tcactctaggatttcaagtcacc

SEQ ID NO: 14717 - DNA, 23 bp, Artificial Sequence
  X-linked inhibitor of apoptosis (XIAP) siRNA
cactctaggatttcaagtcacca

SEQ ID NO: 14718 - DNA, 23 bp, Artificial Sequence
  X-linked inhibitor of apoptosis (XIAP) siRNA
actctaggatttcaagtcaccac

SEQ ID NO: 14719 - DNA, 23 bp, Artificial Sequence
  X-linked inhibitor of apoptosis (XIAP) siRNA
ctctaggatttcaagtcaccact

SEQ ID NO: 14720 - DNA, 23 bp, Artificial Sequence
  X-linked inhibitor of apoptosis (XIAP) siRNA
tctaggatttcaagtcaccactt

SEQ ID NO: 14721 - DNA, 23 bp, Artificial Sequence
  X-linked inhibitor of apoptosis (XIAP) siRNA
ctaggatttcaagtcaccactta

SEQ ID NO: 14722 - DNA, 23 bp, Artificial Sequence
  X-linked inhibitor of apoptosis (XIAP) siRNA
taggatttcaagtcaccacttat

SEQ ID NO: 14723 - DNA, 23 bp, Artificial Sequence
  X-linked inhibitor of apoptosis (XIAP) siRNA
aggatttcaagtcaccacttatt

SEQ ID NO: 14724 - DNA, 23 bp, Artificial Sequence
  X-linked inhibitor of apoptosis (XIAP) siRNA
ggatttcaagtcaccacttattt

SEQ ID NO: 14725 - DNA, 23 bp, Artificial Sequence
  X-linked inhibitor of apoptosis (XIAP) siRNA
gatttcaagtcaccacttatttt

SEQ ID NO: 14726 - DNA, 23 bp, Artificial Sequence
  X-linked inhibitor of apoptosis (XIAP) siRNA
atttcaagtcaccacttatttta

SEQ ID NO: 14727 - DNA, 23 bp, Artificial Sequence
  X-linked inhibitor of apoptosis (XIAP) siRNA
tttcaagtcaccacttattttac

SEQ ID NO: 14728 - DNA, 23 bp, Artificial Sequence
  X-linked inhibitor of apoptosis (XIAP) siRNA
ttcaagtcaccacttattttaca

SEQ ID NO: 14729 - DNA, 23 bp, Artificial Sequence
  X-linked inhibitor of apoptosis (XIAP) siRNA
tcaagtcaccacttattttacat

SEQ ID NO: 14730 - DNA, 23 bp, Artificial Sequence
  X-linked inhibitor of apoptosis (XIAP) siRNA
caagtcaccacttattttacatt

SEQ ID NO: 14731 - DNA, 23 bp, Artificial Sequence
  X-linked inhibitor of apoptosis (XIAP) siRNA
aagtcaccacttattttacattt

SEQ ID NO: 14732 - DNA, 23 bp, Artificial Sequence
  X-linked inhibitor of apoptosis (XIAP) siRNA
agtcaccacttattttacatttt

SEQ ID NO: 14733 - DNA, 23 bp, Artificial Sequence
  X-linked inhibitor of apoptosis (XIAP) siRNA
gtcaccacttattttacatttta

SEQ ID NO: 14734 - DNA, 23 bp, Artificial Sequence
  X-linked inhibitor of apoptosis (XIAP) siRNA
tcaccacttattttacattttag

SEQ ID NO: 14735 - DNA, 23 bp, Artificial Sequence
  X-linked inhibitor of apoptosis (XIAP) siRNA
caccacttattttacattttagt

SEQ ID NO: 14736 - DNA, 23 bp, Artificial Sequence
  X-linked inhibitor of apoptosis (XIAP) siRNA
accacttattttacattttagtc

SEQ ID NO: 14737 - DNA, 23 bp, Artificial Sequence
  X-linked inhibitor of apoptosis (XIAP) siRNA
ccacttattttacattttagtca

SEQ ID NO: 14738 - DNA, 23 bp, Artificial Sequence
  X-linked inhibitor of apoptosis (XIAP) siRNA
cacttattttacattttagtcat

SEQ ID NO: 14739 - DNA, 23 bp, Artificial Sequence
  X-linked inhibitor of apoptosis (XIAP) siRNA
acttattttacattttagtcatg

SEQ ID NO: 14740 - DNA, 23 bp, Artificial Sequence
  X-linked inhibitor of apoptosis (XIAP) siRNA
cttattttacattttagtcatgc

SEQ ID NO: 14741 - DNA, 23 bp, Artificial Sequence
  X-linked inhibitor of apoptosis (XIAP) siRNA
ttattttacattttagtcatgca

SEQ ID NO: 14742 - DNA, 23 bp, Artificial Sequence
  X-linked inhibitor of apoptosis (XIAP) siRNA
tattttacattttagtcatgcaa

SEQ ID NO: 14743 - DNA, 23 bp, Artificial Sequence
  X-linked inhibitor of apoptosis (XIAP) siRNA
attttacattttagtcatgcaaa

SEQ ID NO: 14744 - DNA, 23 bp, Artificial Sequence
  X-linked inhibitor of apoptosis (XIAP) siRNA
ttttacattttagtcatgcaaag

SEQ ID NO: 14745 - DNA, 23 bp, Artificial Sequence
  X-linked inhibitor of apoptosis (XIAP) siRNA
tttacattttagtcatgcaaaga

SEQ ID NO: 14746 - DNA, 23 bp, Artificial Sequence
  X-linked inhibitor of apoptosis (XIAP) siRNA
ttacattttagtcatgcaaagat

SEQ ID NO: 14747 - DNA, 23 bp, Artificial Sequence
  X-linked inhibitor of apoptosis (XIAP) siRNA
tacattttagtcatgcaaagatt

SEQ ID NO: 14748 - DNA, 23 bp, Artificial Sequence
  X-linked inhibitor of apoptosis (XIAP) siRNA
acattttagtcatgcaaagattc

SEQ ID NO: 14749 - DNA, 23 bp, Artificial Sequence
  X-linked inhibitor of apoptosis (XIAP) siRNA
cattttagtcatgcaaagattca

SEQ ID NO: 14750 - DNA, 23 bp, Artificial Sequence
  X-linked inhibitor of apoptosis (XIAP) siRNA
attttagtcatgcaaagattcaa

SEQ ID NO: 14751 - DNA, 23 bp, Artificial Sequence
  X-linked inhibitor of apoptosis (XIAP) siRNA
ttttagtcatgcaaagattcaag

SEQ ID NO: 14752 - DNA, 23 bp, Artificial Sequence
  X-linked inhibitor of apoptosis (XIAP) siRNA
tttagtcatgcaaagattcaagt

SEQ ID NO: 14753 - DNA, 23 bp, Artificial Sequence
  X-linked inhibitor of apoptosis (XIAP) siRNA
ttagtcatgcaaagattcaagta

SEQ ID NO: 14754 - DNA, 23 bp, Artificial Sequence
  X-linked inhibitor of apoptosis (XIAP) siRNA
tagtcatgcaaagattcaagtag

SEQ ID NO: 14755 - DNA, 23 bp, Artificial Sequence
  X-linked inhibitor of apoptosis (XIAP) siRNA
agtcatgcaaagattcaagtagt

SEQ ID NO: 14756 - DNA, 23 bp, Artificial Sequence
  X-linked inhibitor of apoptosis (XIAP) siRNA
gtcatgcaaagattcaagtagtt

SEQ ID NO: 14757 - DNA, 23 bp, Artificial Sequence
  X-linked inhibitor of apoptosis (XIAP) siRNA
tcatgcaaagattcaagtagttt

SEQ ID NO: 14758 - DNA, 23 bp, Artificial Sequence
  X-linked inhibitor of apoptosis (XIAP) siRNA
catgcaaagattcaagtagtttt

SEQ ID NO: 14759 - DNA, 23 bp, Artificial Sequence
  X-linked inhibitor of apoptosis (XIAP) siRNA
atgcaaagattcaagtagttttg

SEQ ID NO: 14760 - DNA, 23 bp, Artificial Sequence
  X-linked inhibitor of apoptosis (XIAP) siRNA
tgcaaagattcaagtagttttgc

SEQ ID NO: 14761 - DNA, 23 bp, Artificial Sequence
  X-linked inhibitor of apoptosis (XIAP) siRNA
gcaaagattcaagtagttttgca

SEQ ID NO: 14762 - DNA, 23 bp, Artificial Sequence
  X-linked inhibitor of apoptosis (XIAP) siRNA
caaagattcaagtagttttgcaa

SEQ ID NO: 14763 - DNA, 23 bp, Artificial Sequence
  X-linked inhibitor of apoptosis (XIAP) siRNA
aaagattcaagtagttttgcaat

SEQ ID NO: 14764 - DNA, 23 bp, Artificial Sequence
  X-linked inhibitor of apoptosis (XIAP) siRNA
aagattcaagtagttttgcaata

SEQ ID NO: 14765 - DNA, 23 bp, Artificial Sequence
  X-linked inhibitor of apoptosis (XIAP) siRNA
agattcaagtagttttgcaataa

SEQ ID NO: 14766 - DNA, 23 bp, Artificial Sequence
  X-linked inhibitor of apoptosis (XIAP) siRNA
gattcaagtagttttgcaataag

SEQ ID NO: 14767 - DNA, 23 bp, Artificial Sequence
  X-linked inhibitor of apoptosis (XIAP) siRNA
attcaagtagttttgcaataagt

SEQ ID NO: 14768 - DNA, 23 bp, Artificial Sequence
  X-linked inhibitor of apoptosis (XIAP) siRNA
ttcaagtagttttgcaataagta

SEQ ID NO: 14769 - DNA, 23 bp, Artificial Sequence
  X-linked inhibitor of apoptosis (XIAP) siRNA
tcaagtagttttgcaataagtac

SEQ ID NO: 14770 - DNA, 23 bp, Artificial Sequence
  X-linked inhibitor of apoptosis (XIAP) siRNA
caagtagttttgcaataagtact

SEQ ID NO: 14771 - DNA, 23 bp, Artificial Sequence
  X-linked inhibitor of apoptosis (XIAP) siRNA
aagtagttttgcaataagtactt

SEQ ID NO: 14772 - DNA, 23 bp, Artificial Sequence
  X-linked inhibitor of apoptosis (XIAP) siRNA
agtagttttgcaataagtactta

SEQ ID NO: 14773 - DNA, 23 bp, Artificial Sequence
  X-linked inhibitor of apoptosis (XIAP) siRNA
gtagttttgcaataagtacttat

SEQ ID NO: 14774 - DNA, 23 bp, Artificial Sequence
  X-linked inhibitor of apoptosis (XIAP) siRNA
tagttttgcaataagtacttatc

SEQ ID NO: 14775 - DNA, 23 bp, Artificial Sequence
  X-linked inhibitor of apoptosis (XIAP) siRNA
agttttgcaataagtacttatct

SEQ ID NO: 14776 - DNA, 23 bp, Artificial Sequence
  X-linked inhibitor of apoptosis (XIAP) siRNA
gttttgcaataagtacttatctt

SEQ ID NO: 14777 - DNA, 23 bp, Artificial Sequence
  X-linked inhibitor of apoptosis (XIAP) siRNA
ttttgcaataagtacttatcttt

SEQ ID NO: 14778 - DNA, 23 bp, Artificial Sequence
  X-linked inhibitor of apoptosis (XIAP) siRNA
tttgcaataagtacttatcttta

SEQ ID NO: 14779 - DNA, 23 bp, Artificial Sequence
  X-linked inhibitor of apoptosis (XIAP) siRNA
ttgcaataagtacttatctttat

SEQ ID NO: 14780 - DNA, 23 bp, Artificial Sequence
  X-linked inhibitor of apoptosis (XIAP) siRNA
tgcaataagtacttatctttatt

SEQ ID NO: 14781 - DNA, 23 bp, Artificial Sequence
  X-linked inhibitor of apoptosis (XIAP) siRNA
gcaataagtacttatctttattt

SEQ ID NO: 14782 - DNA, 23 bp, Artificial Sequence
  X-linked inhibitor of apoptosis (XIAP) siRNA
caataagtacttatctttatttg

SEQ ID NO: 14783 - DNA, 23 bp, Artificial Sequence
  X-linked inhibitor of apoptosis (XIAP) siRNA
aataagtacttatctttatttgt

SEQ ID NO: 14784 - DNA, 23 bp, Artificial Sequence
  X-linked inhibitor of apoptosis (XIAP) siRNA
ataagtacttatctttatttgta

SEQ ID NO: 14785 - DNA, 23 bp, Artificial Sequence
  X-linked inhibitor of apoptosis (XIAP) siRNA
taagtacttatctttatttgtaa

SEQ ID NO: 14786 - DNA, 23 bp, Artificial Sequence
  X-linked inhibitor of apoptosis (XIAP) siRNA
aagtacttatctttatttgtaat

SEQ ID NO: 14787 - DNA, 23 bp, Artificial Sequence
  X-linked inhibitor of apoptosis (XIAP) siRNA
agtacttatctttatttgtaata

SEQ ID NO: 14788 - DNA, 23 bp, Artificial Sequence
  X-linked inhibitor of apoptosis (XIAP) siRNA
gtacttatctttatttgtaataa

SEQ ID NO: 14789 - DNA, 23 bp, Artificial Sequence
  X-linked inhibitor of apoptosis (XIAP) siRNA
tacttatctttatttgtaataat

SEQ ID NO: 14790 - DNA, 23 bp, Artificial Sequence
  X-linked inhibitor of apoptosis (XIAP) siRNA
acttatctttatttgtaataatt

SEQ ID NO: 14791 - DNA, 23 bp, Artificial Sequence
  X-linked inhibitor of apoptosis (XIAP) siRNA
cttatctttatttgtaataattt

SEQ ID NO: 14792 - DNA, 23 bp, Artificial Sequence
  X-linked inhibitor of apoptosis (XIAP) siRNA
ttatctttatttgtaataattta

SEQ ID NO: 14793 - DNA, 23 bp, Artificial Sequence
  X-linked inhibitor of apoptosis (XIAP) siRNA
tatctttatttgtaataatttag

SEQ ID NO: 14794 - DNA, 23 bp, Artificial Sequence
  X-linked inhibitor of apoptosis (XIAP) siRNA
atctttatttgtaataatttagt

SEQ ID NO: 14795 - DNA, 23 bp, Artificial Sequence
  X-linked inhibitor of apoptosis (XIAP) siRNA
tctttatttgtaataatttagtc

SEQ ID NO: 14796 - DNA, 23 bp, Artificial Sequence
  X-linked inhibitor of apoptosis (XIAP) siRNA
ctttatttgtaataatttagtct

SEQ ID NO: 14797 - DNA, 23 bp, Artificial Sequence
  X-linked inhibitor of apoptosis (XIAP) siRNA
tttatttgtaataatttagtctg

SEQ ID NO: 14798 - DNA, 23 bp, Artificial Sequence
  X-linked inhibitor of apoptosis (XIAP) siRNA
ttatttgtaataatttagtctgc

SEQ ID NO: 14799 - DNA, 23 bp, Artificial Sequence
  X-linked inhibitor of apoptosis (XIAP) siRNA
tatttgtaataatttagtctgct

SEQ ID NO: 14800 - DNA, 23 bp, Artificial Sequence
  X-linked inhibitor of apoptosis (XIAP) siRNA
atttgtaataatttagtctgctg

SEQ ID NO: 14801 - DNA, 23 bp, Artificial Sequence
  X-linked inhibitor of apoptosis (XIAP) siRNA
tttgtaataatttagtctgctga

SEQ ID NO: 14802 - DNA, 23 bp, Artificial Sequence
  X-linked inhibitor of apoptosis (XIAP) siRNA
ttgtaataatttagtctgctgat

SEQ ID NO: 14803 - DNA, 23 bp, Artificial Sequence
  X-linked inhibitor of apoptosis (XIAP) siRNA
tgtaataatttagtctgctgatc

SEQ ID NO: 14804 - DNA, 23 bp, Artificial Sequence
  X-linked inhibitor of apoptosis (XIAP) siRNA
gtaataatttagtctgctgatca

SEQ ID NO: 14805 - DNA, 23 bp, Artificial Sequence
  X-linked inhibitor of apoptosis (XIAP) siRNA
taataatttagtctgctgatcaa

SEQ ID NO: 14806 - DNA, 23 bp, Artificial Sequence
  X-linked inhibitor of apoptosis (XIAP) siRNA
aataatttagtctgctgatcaaa

SEQ ID NO: 14807 - DNA, 23 bp, Artificial Sequence
  X-linked inhibitor of apoptosis (XIAP) siRNA
ataatttagtctgctgatcaaaa

SEQ ID NO: 14808 - DNA, 23 bp, Artificial Sequence
  X-linked inhibitor of apoptosis (XIAP) siRNA
taatttagtctgctgatcaaaag

SEQ ID NO: 14809 - DNA, 23 bp, Artificial Sequence
  X-linked inhibitor of apoptosis (XIAP) siRNA
aatttagtctgctgatcaaaagc

SEQ ID NO: 14810 - DNA, 23 bp, Artificial Sequence
  X-linked inhibitor of apoptosis (XIAP) siRNA
atttagtctgctgatcaaaagca

SEQ ID NO: 14811 - DNA, 23 bp, Artificial Sequence
  X-linked inhibitor of apoptosis (XIAP) siRNA
tttagtctgctgatcaaaagcat

SEQ ID NO: 14812 - DNA, 23 bp, Artificial Sequence
  X-linked inhibitor of apoptosis (XIAP) siRNA
ttagtctgctgatcaaaagcatt

SEQ ID NO: 14813 - DNA, 23 bp, Artificial Sequence
  X-linked inhibitor of apoptosis (XIAP) siRNA
tagtctgctgatcaaaagcattg

SEQ ID NO: 14814 - DNA, 23 bp, Artificial Sequence
  X-linked inhibitor of apoptosis (XIAP) siRNA
agtctgctgatcaaaagcattgt

SEQ ID NO: 14815 - DNA, 23 bp, Artificial Sequence
  X-linked inhibitor of apoptosis (XIAP) siRNA
gtctgctgatcaaaagcattgtc

SEQ ID NO: 14816 - DNA, 23 bp, Artificial Sequence
  X-linked inhibitor of apoptosis (XIAP) siRNA
tctgctgatcaaaagcattgtct

SEQ ID NO: 14817 - DNA, 23 bp, Artificial Sequence
  X-linked inhibitor of apoptosis (XIAP) siRNA
ctgctgatcaaaagcattgtctt

SEQ ID NO: 14818 - DNA, 23 bp, Artificial Sequence
  X-linked inhibitor of apoptosis (XIAP) siRNA
tgctgatcaaaagcattgtctta

SEQ ID NO: 14819 - DNA, 23 bp, Artificial Sequence
  X-linked inhibitor of apoptosis (XIAP) siRNA
gctgatcaaaagcattgtcttaa

SEQ ID NO: 14820 - DNA, 23 bp, Artificial Sequence
  X-linked inhibitor of apoptosis (XIAP) siRNA
ctgatcaaaagcattgtcttaat

SEQ ID NO: 14821 - DNA, 23 bp, Artificial Sequence
  X-linked inhibitor of apoptosis (XIAP) siRNA
tgatcaaaagcattgtcttaatt

SEQ ID NO: 14822 - DNA, 23 bp, Artificial Sequence
  X-linked inhibitor of apoptosis (XIAP) siRNA
gatcaaaagcattgtcttaattt

SEQ ID NO: 14823 - DNA, 23 bp, Artificial Sequence
  X-linked inhibitor of apoptosis (XIAP) siRNA
atcaaaagcattgtcttaatttt

SEQ ID NO: 14824 - DNA, 23 bp, Artificial Sequence
  X-linked inhibitor of apoptosis (XIAP) siRNA
tcaaaagcattgtcttaattttt

SEQ ID NO: 14825 - DNA, 23 bp, Artificial Sequence
  X-linked inhibitor of apoptosis (XIAP) siRNA
caaaagcattgtcttaatttttg

SEQ ID NO: 14826 - DNA, 23 bp, Artificial Sequence
  X-linked inhibitor of apoptosis (XIAP) siRNA
aaaagcattgtcttaatttttga

SEQ ID NO: 14827 - DNA, 23 bp, Artificial Sequence
  X-linked inhibitor of apoptosis (XIAP) siRNA
aaagcattgtcttaatttttgag

SEQ ID NO: 14828 - DNA, 23 bp, Artificial Sequence
  X-linked inhibitor of apoptosis (XIAP) siRNA
aagcattgtcttaatttttgaga

SEQ ID NO: 14829 - DNA, 23 bp, Artificial Sequence
  X-linked inhibitor of apoptosis (XIAP) siRNA
agcattgtcttaatttttgagaa

SEQ ID NO: 14830 - DNA, 23 bp, Artificial Sequence
  X-linked inhibitor of apoptosis (XIAP) siRNA
gcattgtcttaatttttgagaac

SEQ ID NO: 14831 - DNA, 23 bp, Artificial Sequence
  X-linked inhibitor of apoptosis (XIAP) siRNA
cattgtcttaatttttgagaact

SEQ ID NO: 14832 - DNA, 23 bp, Artificial Sequence
  X-linked inhibitor of apoptosis (XIAP) siRNA
attgtcttaatttttgagaactg

SEQ ID NO: 14833 - DNA, 23 bp, Artificial Sequence
  X-linked inhibitor of apoptosis (XIAP) siRNA
ttgtcttaatttttgagaactgg

SEQ ID NO: 14834 - DNA, 23 bp, Artificial Sequence
  X-linked inhibitor of apoptosis (XIAP) siRNA
tgtcttaatttttgagaactggt

SEQ ID NO: 14835 - DNA, 23 bp, Artificial Sequence
  X-linked inhibitor of apoptosis (XIAP) siRNA
gtcttaatttttgagaactggtt

SEQ ID NO: 14836 - DNA, 23 bp, Artificial Sequence
  X-linked inhibitor of apoptosis (XIAP) siRNA
tcttaatttttgagaactggttt

SEQ ID NO: 14837 - DNA, 23 bp, Artificial Sequence
  X-linked inhibitor of apoptosis (XIAP) siRNA
cttaatttttgagaactggtttt

SEQ ID NO: 14838 - DNA, 23 bp, Artificial Sequence
  X-linked inhibitor of apoptosis (XIAP) siRNA
ttaatttttgagaactggtttta

SEQ ID NO: 14839 - DNA, 23 bp, Artificial Sequence
  X-linked inhibitor of apoptosis (XIAP) siRNA
taatttttgagaactggttttag

SEQ ID NO: 14840 - DNA, 23 bp, Artificial Sequence
  X-linked inhibitor of apoptosis (XIAP) siRNA
aatttttgagaactggttttagc

SEQ ID NO: 14841 - DNA, 23 bp, Artificial Sequence
  X-linked inhibitor of apoptosis (XIAP) siRNA
atttttgagaactggttttagca

SEQ ID NO: 14842 - DNA, 23 bp, Artificial Sequence
  X-linked inhibitor of apoptosis (XIAP) siRNA
tttttgagaactggttttagcat

SEQ ID NO: 14843 - DNA, 23 bp, Artificial Sequence
  X-linked inhibitor of apoptosis (XIAP) siRNA
ttttgagaactggttttagcatt

SEQ ID NO: 14844 - DNA, 23 bp, Artificial Sequence
  X-linked inhibitor of apoptosis (XIAP) siRNA
tttgagaactggttttagcattt

SEQ ID NO: 14845 - DNA, 23 bp, Artificial Sequence
  X-linked inhibitor of apoptosis (XIAP) siRNA
ttgagaactggttttagcattta

SEQ ID NO: 14846 - DNA, 23 bp, Artificial Sequence
  X-linked inhibitor of apoptosis (XIAP) siRNA
tgagaactggttttagcatttac

SEQ ID NO: 14847 - DNA, 23 bp, Artificial Sequence
  X-linked inhibitor of apoptosis (XIAP) siRNA
gagaactggttttagcatttaca

SEQ ID NO: 14848 - DNA, 23 bp, Artificial Sequence
  X-linked inhibitor of apoptosis (XIAP) siRNA
agaactggttttagcatttacaa

SEQ ID NO: 14849 - DNA, 23 bp, Artificial Sequence
  X-linked inhibitor of apoptosis (XIAP) siRNA
gaactggttttagcatttacaaa

SEQ ID NO: 14850 - DNA, 23 bp, Artificial Sequence
  X-linked inhibitor of apoptosis (XIAP) siRNA
aactggttttagcatttacaaac

SEQ ID NO: 14851 - DNA, 23 bp, Artificial Sequence
  X-linked inhibitor of apoptosis (XIAP) siRNA
actggttttagcatttacaaact

SEQ ID NO: 14852 - DNA, 23 bp, Artificial Sequence
  X-linked inhibitor of apoptosis (XIAP) siRNA
ctggttttagcatttacaaacta

SEQ ID NO: 14853 - DNA, 23 bp, Artificial Sequence
  X-linked inhibitor of apoptosis (XIAP) siRNA
tggttttagcatttacaaactaa

SEQ ID NO: 14854 - DNA, 23 bp, Artificial Sequence
  X-linked inhibitor of apoptosis (XIAP) siRNA
ggttttagcatttacaaactaaa

SEQ ID NO: 14855 - DNA, 23 bp, Artificial Sequence
  X-linked inhibitor of apoptosis (XIAP) siRNA
gttttagcatttacaaactaaat

SEQ ID NO: 14856 - DNA, 23 bp, Artificial Sequence
  X-linked inhibitor of apoptosis (XIAP) siRNA
ttttagcatttacaaactaaatt

SEQ ID NO: 14857 - DNA, 23 bp, Artificial Sequence
  X-linked inhibitor of apoptosis (XIAP) siRNA
tttagcatttacaaactaaattc

SEQ ID NO: 14858 - DNA, 23 bp, Artificial Sequence
  X-linked inhibitor of apoptosis (XIAP) siRNA
ttagcatttacaaactaaattcc

SEQ ID NO: 14859 - DNA, 23 bp, Artificial Sequence
  X-linked inhibitor of apoptosis (XIAP) siRNA
tagcatttacaaactaaattcca

SEQ ID NO: 14860 - DNA, 23 bp, Artificial Sequence
  X-linked inhibitor of apoptosis (XIAP) siRNA
agcatttacaaactaaattccag

SEQ ID NO: 14861 - DNA, 23 bp, Artificial Sequence
  X-linked inhibitor of apoptosis (XIAP) siRNA
gcatttacaaactaaattccagt

SEQ ID NO: 14862 - DNA, 23 bp, Artificial Sequence
  X-linked inhibitor of apoptosis (XIAP) siRNA
catttacaaactaaattccagtt

SEQ ID NO: 14863 - DNA, 23 bp, Artificial Sequence
  X-linked inhibitor of apoptosis (XIAP) siRNA
atttacaaactaaattccagtta

SEQ ID NO: 14864 - DNA, 23 bp, Artificial Sequence
  X-linked inhibitor of apoptosis (XIAP) siRNA
tttacaaactaaattccagttaa

SEQ ID NO: 14865 - DNA, 23 bp, Artificial Sequence
  X-linked inhibitor of apoptosis (XIAP) siRNA
ttacaaactaaattccagttaat

SEQ ID NO: 14866 - DNA, 23 bp, Artificial Sequence
  X-linked inhibitor of apoptosis (XIAP) siRNA
tacaaactaaattccagttaatt

SEQ ID NO: 14867 - DNA, 23 bp, Artificial Sequence
  X-linked inhibitor of apoptosis (XIAP) siRNA
acaaactaaattccagttaatta

SEQ ID NO: 14868 - DNA, 23 bp, Artificial Sequence
  X-linked inhibitor of apoptosis (XIAP) siRNA
caaactaaattccagttaattaa

SEQ ID NO: 14869 - DNA, 23 bp, Artificial Sequence
  X-linked inhibitor of apoptosis (XIAP) siRNA
aaactaaattccagttaattaat

SEQ ID NO: 14870 - DNA, 23 bp, Artificial Sequence
  X-linked inhibitor of apoptosis (XIAP) siRNA
aactaaattccagttaattaatt

SEQ ID NO: 14871 - DNA, 23 bp, Artificial Sequence
  X-linked inhibitor of apoptosis (XIAP) siRNA
actaaattccagttaattaatta

SEQ ID NO: 14872 - DNA, 23 bp, Artificial Sequence
  X-linked inhibitor of apoptosis (XIAP) siRNA
ctaaattccagttaattaattaa

SEQ ID NO: 14873 - DNA, 23 bp, Artificial Sequence
  X-linked inhibitor of apoptosis (XIAP) siRNA
taaattccagttaattaattaat

SEQ ID NO: 14874 - DNA, 23 bp, Artificial Sequence
  X-linked inhibitor of apoptosis (XIAP) siRNA
aaattccagttaattaattaata

SEQ ID NO: 14875 - DNA, 23 bp, Artificial Sequence
  X-linked inhibitor of apoptosis (XIAP) siRNA
aattccagttaattaattaatag

SEQ ID NO: 14876 - DNA, 23 bp, Artificial Sequence
  X-linked inhibitor of apoptosis (XIAP) siRNA
attccagttaattaattaatagc

SEQ ID NO: 14877 - DNA, 23 bp, Artificial Sequence
  X-linked inhibitor of apoptosis (XIAP) siRNA
ttccagttaattaattaatagct

SEQ ID NO: 14878 - DNA, 23 bp, Artificial Sequence
  X-linked inhibitor of apoptosis (XIAP) siRNA
tccagttaattaattaatagctt

SEQ ID NO: 14879 - DNA, 23 bp, Artificial Sequence
  X-linked inhibitor of apoptosis (XIAP) siRNA
ccagttaattaattaatagcttt

SEQ ID NO: 14880 - DNA, 23 bp, Artificial Sequence
  X-linked inhibitor of apoptosis (XIAP) siRNA
cagttaattaattaatagcttta

SEQ ID NO: 14881 - DNA, 23 bp, Artificial Sequence
  X-linked inhibitor of apoptosis (XIAP) siRNA
agttaattaattaatagctttat

SEQ ID NO: 14882 - DNA, 23 bp, Artificial Sequence
  X-linked inhibitor of apoptosis (XIAP) siRNA
gttaattaattaatagctttata

SEQ ID NO: 14883 - DNA, 23 bp, Artificial Sequence
  X-linked inhibitor of apoptosis (XIAP) siRNA
ttaattaattaatagctttatat

SEQ ID NO: 14884 - DNA, 23 bp, Artificial Sequence
  X-linked inhibitor of apoptosis (XIAP) siRNA
taattaattaatagctttatatt

SEQ ID NO: 14885 - DNA, 23 bp, Artificial Sequence
  X-linked inhibitor of apoptosis (XIAP) siRNA
aattaattaatagctttatattg

SEQ ID NO: 14886 - DNA, 23 bp, Artificial Sequence
  X-linked inhibitor of apoptosis (XIAP) siRNA
attaattaatagctttatattgc

SEQ ID NO: 14887 - DNA, 23 bp, Artificial Sequence
  X-linked inhibitor of apoptosis (XIAP) siRNA
ttaattaatagctttatattgcc

SEQ ID NO: 14888 - DNA, 23 bp, Artificial Sequence
  X-linked inhibitor of apoptosis (XIAP) siRNA
taattaatagctttatattgcct

SEQ ID NO: 14889 - DNA, 23 bp, Artificial Sequence
  X-linked inhibitor of apoptosis (XIAP) siRNA
aattaatagctttatattgcctt

SEQ ID NO: 14890 - DNA, 23 bp, Artificial Sequence
  X-linked inhibitor of apoptosis (XIAP) siRNA
attaatagctttatattgccttt

SEQ ID NO: 14891 - DNA, 23 bp, Artificial Sequence
  X-linked inhibitor of apoptosis (XIAP) siRNA
ttaatagctttatattgcctttc

SEQ ID NO: 14892 - DNA, 23 bp, Artificial Sequence
  X-linked inhibitor of apoptosis (XIAP) siRNA
taatagctttatattgcctttcc

SEQ ID NO: 14893 - DNA, 23 bp, Artificial Sequence
  X-linked inhibitor of apoptosis (XIAP) siRNA
aatagctttatattgcctttcct

SEQ ID NO: 14894 - DNA, 23 bp, Artificial Sequence
  X-linked inhibitor of apoptosis (XIAP) siRNA
atagctttatattgcctttcctg

SEQ ID NO: 14895 - DNA, 23 bp, Artificial Sequence
  X-linked inhibitor of apoptosis (XIAP) siRNA
tagctttatattgcctttcctgc

SEQ ID NO: 14896 - DNA, 23 bp, Artificial Sequence
  X-linked inhibitor of apoptosis (XIAP) siRNA
agctttatattgcctttcctgct

SEQ ID NO: 14897 - DNA, 23 bp, Artificial Sequence
  X-linked inhibitor of apoptosis (XIAP) siRNA
gctttatattgcctttcctgcta

SEQ ID NO: 14898 - DNA, 23 bp, Artificial Sequence
  X-linked inhibitor of apoptosis (XIAP) siRNA
ctttatattgcctttcctgctac

SEQ ID NO: 14899 - DNA, 23 bp, Artificial Sequence
  X-linked inhibitor of apoptosis (XIAP) siRNA
tttatattgcctttcctgctaca

SEQ ID NO: 14900 - DNA, 23 bp, Artificial Sequence
  X-linked inhibitor of apoptosis (XIAP) siRNA
ttatattgcctttcctgctacat

SEQ ID NO: 14901 - DNA, 23 bp, Artificial Sequence
  X-linked inhibitor of apoptosis (XIAP) siRNA
tatattgcctttcctgctacatt

SEQ ID NO: 14902 - DNA, 23 bp, Artificial Sequence
  X-linked inhibitor of apoptosis (XIAP) siRNA
atattgcctttcctgctacattt

SEQ ID NO: 14903 - DNA, 23 bp, Artificial Sequence
  X-linked inhibitor of apoptosis (XIAP) siRNA
tattgcctttcctgctacatttg

SEQ ID NO: 14904 - DNA, 23 bp, Artificial Sequence
  X-linked inhibitor of apoptosis (XIAP) siRNA
attgcctttcctgctacatttgg

SEQ ID NO: 14905 - DNA, 23 bp, Artificial Sequence
  X-linked inhibitor of apoptosis (XIAP) siRNA
ttgcctttcctgctacatttggt

SEQ ID NO: 14906 - DNA, 23 bp, Artificial Sequence
  X-linked inhibitor of apoptosis (XIAP) siRNA
tgcctttcctgctacatttggtt

SEQ ID NO: 14907 - DNA, 23 bp, Artificial Sequence
  X-linked inhibitor of apoptosis (XIAP) siRNA
gcctttcctgctacatttggttt

SEQ ID NO: 14908 - DNA, 23 bp, Artificial Sequence
  X-linked inhibitor of apoptosis (XIAP) siRNA
cctttcctgctacatttggtttt

SEQ ID NO: 14909 - DNA, 23 bp, Artificial Sequence
  X-linked inhibitor of apoptosis (XIAP) siRNA
ctttcctgctacatttggttttt

SEQ ID NO: 14910 - DNA, 23 bp, Artificial Sequence
  X-linked inhibitor of apoptosis (XIAP) siRNA
tttcctgctacatttggtttttt

SEQ ID NO: 14911 - DNA, 23 bp, Artificial Sequence
  X-linked inhibitor of apoptosis (XIAP) siRNA
ttcctgctacatttggttttttc

SEQ ID NO: 14912 - DNA, 23 bp, Artificial Sequence
  X-linked inhibitor of apoptosis (XIAP) siRNA
tcctgctacatttggttttttcc

SEQ ID NO: 14913 - DNA, 23 bp, Artificial Sequence
  X-linked inhibitor of apoptosis (XIAP) siRNA
cctgctacatttggttttttccc

SEQ ID NO: 14914 - DNA, 23 bp, Artificial Sequence
  X-linked inhibitor of apoptosis (XIAP) siRNA
ctgctacatttggttttttcccc

SEQ ID NO: 14915 - DNA, 23 bp, Artificial Sequence
  X-linked inhibitor of apoptosis (XIAP) siRNA
tgctacatttggttttttcccct

SEQ ID NO: 14916 - DNA, 23 bp, Artificial Sequence
  X-linked inhibitor of apoptosis (XIAP) siRNA
gctacatttggttttttcccctg

SEQ ID NO: 14917 - DNA, 23 bp, Artificial Sequence
  X-linked inhibitor of apoptosis (XIAP) siRNA
ctacatttggttttttcccctgt

SEQ ID NO: 14918 - DNA, 23 bp, Artificial Sequence
  X-linked inhibitor of apoptosis (XIAP) siRNA
tacatttggttttttcccctgtc

SEQ ID NO: 14919 - DNA, 23 bp, Artificial Sequence
  X-linked inhibitor of apoptosis (XIAP) siRNA
acatttggttttttcccctgtcc

SEQ ID NO: 14920 - DNA, 23 bp, Artificial Sequence
  X-linked inhibitor of apoptosis (XIAP) siRNA
catttggttttttcccctgtccc

SEQ ID NO: 14921 - DNA, 23 bp, Artificial Sequence
  X-linked inhibitor of apoptosis (XIAP) siRNA
atttggttttttcccctgtccct

SEQ ID NO: 14922 - DNA, 23 bp, Artificial Sequence
  X-linked inhibitor of apoptosis (XIAP) siRNA
tttggttttttcccctgtccctt

SEQ ID NO: 14923 - DNA, 23 bp, Artificial Sequence
  X-linked inhibitor of apoptosis (XIAP) siRNA
ttggttttttcccctgtcccttt

SEQ ID NO: 14924 - DNA, 23 bp, Artificial Sequence
  X-linked inhibitor of apoptosis (XIAP) siRNA
tggttttttcccctgtccctttg

SEQ ID NO: 14925 - DNA, 23 bp, Artificial Sequence
  X-linked inhibitor of apoptosis (XIAP) siRNA
ggttttttcccctgtccctttga

SEQ ID NO: 14926 - DNA, 23 bp, Artificial Sequence
  X-linked inhibitor of apoptosis (XIAP) siRNA
gttttttcccctgtccctttgat

SEQ ID NO: 14927 - DNA, 23 bp, Artificial Sequence
  X-linked inhibitor of apoptosis (XIAP) siRNA
ttttttcccctgtccctttgatt

SEQ ID NO: 14928 - DNA, 23 bp, Artificial Sequence
  X-linked inhibitor of apoptosis (XIAP) siRNA
tttttcccctgtccctttgatta

SEQ ID NO: 14929 - DNA, 23 bp, Artificial Sequence
  X-linked inhibitor of apoptosis (XIAP) siRNA
ttttcccctgtccctttgattac

SEQ ID NO: 14930 - DNA, 23 bp, Artificial Sequence
  X-linked inhibitor of apoptosis (XIAP) siRNA
tttcccctgtccctttgattacg

SEQ ID NO: 14931 - DNA, 23 bp, Artificial Sequence
  X-linked inhibitor of apoptosis (XIAP) siRNA
ttcccctgtccctttgattacgg

SEQ ID NO: 14932 - DNA, 23 bp, Artificial Sequence
  X-linked inhibitor of apoptosis (XIAP) siRNA
tcccctgtccctttgattacggg

SEQ ID NO: 14933 - DNA, 23 bp, Artificial Sequence
  X-linked inhibitor of apoptosis (XIAP) siRNA
cccctgtccctttgattacgggc

SEQ ID NO: 14934 - DNA, 23 bp, Artificial Sequence
  X-linked inhibitor of apoptosis (XIAP) siRNA
ccctgtccctttgattacgggct

SEQ ID NO: 14935 - DNA, 23 bp, Artificial Sequence
  X-linked inhibitor of apoptosis (XIAP) siRNA
cctgtccctttgattacgggcta

SEQ ID NO: 14936 - DNA, 23 bp, Artificial Sequence
  X-linked inhibitor of apoptosis (XIAP) siRNA
ctgtccctttgattacgggctaa

SEQ ID NO: 14937 - DNA, 23 bp, Artificial Sequence
  X-linked inhibitor of apoptosis (XIAP) siRNA
tgtccctttgattacgggctaag

SEQ ID NO: 14938 - DNA, 23 bp, Artificial Sequence
  X-linked inhibitor of apoptosis (XIAP) siRNA
gtccctttgattacgggctaagg

SEQ ID NO: 14939 - DNA, 23 bp, Artificial Sequence
  X-linked inhibitor of apoptosis (XIAP) siRNA
tccctttgattacgggctaaggt

SEQ ID NO: 14940 - DNA, 23 bp, Artificial Sequence
  X-linked inhibitor of apoptosis (XIAP) siRNA
ccctttgattacgggctaaggta

SEQ ID NO: 14941 - DNA, 23 bp, Artificial Sequence
  X-linked inhibitor of apoptosis (XIAP) siRNA
cctttgattacgggctaaggtag

SEQ ID NO: 14942 - DNA, 23 bp, Artificial Sequence
  X-linked inhibitor of apoptosis (XIAP) siRNA
ctttgattacgggctaaggtagg

SEQ ID NO: 14943 - DNA, 23 bp, Artificial Sequence
  X-linked inhibitor of apoptosis (XIAP) siRNA
tttgattacgggctaaggtaggg

SEQ ID NO: 14944 - DNA, 23 bp, Artificial Sequence
  X-linked inhibitor of apoptosis (XIAP) siRNA
ttgattacgggctaaggtagggt

SEQ ID NO: 14945 - DNA, 23 bp, Artificial Sequence
  X-linked inhibitor of apoptosis (XIAP) siRNA
tgattacgggctaaggtagggta

SEQ ID NO: 14946 - DNA, 23 bp, Artificial Sequence
  X-linked inhibitor of apoptosis (XIAP) siRNA
gattacgggctaaggtagggtag

SEQ ID NO: 14947 - DNA, 23 bp, Artificial Sequence
  X-linked inhibitor of apoptosis (XIAP) siRNA
attacgggctaaggtagggtaga

SEQ ID NO: 14948 - DNA, 23 bp, Artificial Sequence
  X-linked inhibitor of apoptosis (XIAP) siRNA
ttacgggctaaggtagggtagag

SEQ ID NO: 14949 - DNA, 23 bp, Artificial Sequence
  X-linked inhibitor of apoptosis (XIAP) siRNA
tacgggctaaggtagggtagagt

SEQ ID NO: 14950 - DNA, 23 bp, Artificial Sequence
  X-linked inhibitor of apoptosis (XIAP) siRNA
acgggctaaggtagggtagagtg

SEQ ID NO: 14951 - DNA, 23 bp, Artificial Sequence
  X-linked inhibitor of apoptosis (XIAP) siRNA
cgggctaaggtagggtagagtgg

SEQ ID NO: 14952 - DNA, 23 bp, Artificial Sequence
  X-linked inhibitor of apoptosis (XIAP) siRNA
gggctaaggtagggtagagtggg

SEQ ID NO: 14953 - DNA, 23 bp, Artificial Sequence
  X-linked inhibitor of apoptosis (XIAP) siRNA
ggctaaggtagggtagagtgggt

SEQ ID NO: 14954 - DNA, 23 bp, Artificial Sequence
  X-linked inhibitor of apoptosis (XIAP) siRNA
gctaaggtagggtagagtgggtg

SEQ ID NO: 14955 - DNA, 23 bp, Artificial Sequence
  X-linked inhibitor of apoptosis (XIAP) siRNA
ctaaggtagggtagagtgggtgt

SEQ ID NO: 14956 - DNA, 23 bp, Artificial Sequence
  X-linked inhibitor of apoptosis (XIAP) siRNA
taaggtagggtagagtgggtgta

SEQ ID NO: 14957 - DNA, 23 bp, Artificial Sequence
  X-linked inhibitor of apoptosis (XIAP) siRNA
aaggtagggtagagtgggtgtag

SEQ ID NO: 14958 - DNA, 23 bp, Artificial Sequence
  X-linked inhibitor of apoptosis (XIAP) siRNA
aggtagggtagagtgggtgtagt

SEQ ID NO: 14959 - DNA, 23 bp, Artificial Sequence
  X-linked inhibitor of apoptosis (XIAP) siRNA
ggtagggtagagtgggtgtagtg

SEQ ID NO: 14960 - DNA, 23 bp, Artificial Sequence
  X-linked inhibitor of apoptosis (XIAP) siRNA
gtagggtagagtgggtgtagtga

SEQ ID NO: 14961 - DNA, 23 bp, Artificial Sequence
  X-linked inhibitor of apoptosis (XIAP) siRNA
tagggtagagtgggtgtagtgag

SEQ ID NO: 14962 - DNA, 23 bp, Artificial Sequence
  X-linked inhibitor of apoptosis (XIAP) siRNA
agggtagagtgggtgtagtgagt

SEQ ID NO: 14963 - DNA, 23 bp, Artificial Sequence
  X-linked inhibitor of apoptosis (XIAP) siRNA
gggtagagtgggtgtagtgagtg

SEQ ID NO: 14964 - DNA, 23 bp, Artificial Sequence
  X-linked inhibitor of apoptosis (XIAP) siRNA
ggtagagtgggtgtagtgagtgt

SEQ ID NO: 14965 - DNA, 23 bp, Artificial Sequence
  X-linked inhibitor of apoptosis (XIAP) siRNA
gtagagtgggtgtagtgagtgta

SEQ ID NO: 14966 - DNA, 23 bp, Artificial Sequence
  X-linked inhibitor of apoptosis (XIAP) siRNA
tagagtgggtgtagtgagtgtat

SEQ ID NO: 14967 - DNA, 23 bp, Artificial Sequence
  X-linked inhibitor of apoptosis (XIAP) siRNA
agagtgggtgtagtgagtgtata

SEQ ID NO: 14968 - DNA, 23 bp, Artificial Sequence
  X-linked inhibitor of apoptosis (XIAP) siRNA
gagtgggtgtagtgagtgtatat

SEQ ID NO: 14969 - DNA, 23 bp, Artificial Sequence
  X-linked inhibitor of apoptosis (XIAP) siRNA
agtgggtgtagtgagtgtatata

SEQ ID NO: 14970 - DNA, 23 bp, Artificial Sequence
  X-linked inhibitor of apoptosis (XIAP) siRNA
gtgggtgtagtgagtgtatataa

SEQ ID NO: 14971 - DNA, 23 bp, Artificial Sequence
  X-linked inhibitor of apoptosis (XIAP) siRNA
tgggtgtagtgagtgtatataat

SEQ ID NO: 14972 - DNA, 23 bp, Artificial Sequence
  X-linked inhibitor of apoptosis (XIAP) siRNA
gggtgtagtgagtgtatataatg

SEQ ID NO: 14973 - DNA, 23 bp, Artificial Sequence
  X-linked inhibitor of apoptosis (XIAP) siRNA
ggtgtagtgagtgtatataatgt

SEQ ID NO: 14974 - DNA, 23 bp, Artificial Sequence
  X-linked inhibitor of apoptosis (XIAP) siRNA
gtgtagtgagtgtatataatgtg

SEQ ID NO: 14975 - DNA, 23 bp, Artificial Sequence
  X-linked inhibitor of apoptosis (XIAP) siRNA
tgtagtgagtgtatataatgtga

SEQ ID NO: 14976 - DNA, 23 bp, Artificial Sequence
  X-linked inhibitor of apoptosis (XIAP) siRNA
gtagtgagtgtatataatgtgat

SEQ ID NO: 14977 - DNA, 23 bp, Artificial Sequence
  X-linked inhibitor of apoptosis (XIAP) siRNA
tagtgagtgtatataatgtgatt

SEQ ID NO: 14978 - DNA, 23 bp, Artificial Sequence
  X-linked inhibitor of apoptosis (XIAP) siRNA
agtgagtgtatataatgtgattt

SEQ ID NO: 14979 - DNA, 23 bp, Artificial Sequence
  X-linked inhibitor of apoptosis (XIAP) siRNA
gtgagtgtatataatgtgatttg

SEQ ID NO: 14980 - DNA, 23 bp, Artificial Sequence
  X-linked inhibitor of apoptosis (XIAP) siRNA
tgagtgtatataatgtgatttgg

SEQ ID NO: 14981 - DNA, 23 bp, Artificial Sequence
  X-linked inhibitor of apoptosis (XIAP) siRNA
gagtgtatataatgtgatttggc

SEQ ID NO: 14982 - DNA, 23 bp, Artificial Sequence
  X-linked inhibitor of apoptosis (XIAP) siRNA
agtgtatataatgtgatttggcc

SEQ ID NO: 14983 - DNA, 23 bp, Artificial Sequence
  X-linked inhibitor of apoptosis (XIAP) siRNA
gtgtatataatgtgatttggccc

SEQ ID NO: 14984 - DNA, 23 bp, Artificial Sequence
  X-linked inhibitor of apoptosis (XIAP) siRNA
tgtatataatgtgatttggccct

SEQ ID NO: 14985 - DNA, 23 bp, Artificial Sequence
  X-linked inhibitor of apoptosis (XIAP) siRNA
gtatataatgtgatttggccctg

SEQ ID NO: 14986 - DNA, 23 bp, Artificial Sequence
  X-linked inhibitor of apoptosis (XIAP) siRNA
tatataatgtgatttggccctgt

SEQ ID NO: 14987 - DNA, 23 bp, Artificial Sequence
  X-linked inhibitor of apoptosis (XIAP) siRNA
atataatgtgatttggccctgtg

SEQ ID NO: 14988 - DNA, 23 bp, Artificial Sequence
  X-linked inhibitor of apoptosis (XIAP) siRNA
tataatgtgatttggccctgtgt

SEQ ID NO: 14989 - DNA, 23 bp, Artificial Sequence
  X-linked inhibitor of apoptosis (XIAP) siRNA
ataatgtgatttggccctgtgta

SEQ ID NO: 14990 - DNA, 23 bp, Artificial Sequence
  X-linked inhibitor of apoptosis (XIAP) siRNA
taatgtgatttggccctgtgtat

SEQ ID NO: 14991 - DNA, 23 bp, Artificial Sequence
  X-linked inhibitor of apoptosis (XIAP) siRNA
aatgtgatttggccctgtgtatt

SEQ ID NO: 14992 - DNA, 23 bp, Artificial Sequence
  X-linked inhibitor of apoptosis (XIAP) siRNA
atgtgatttggccctgtgtatta

SEQ ID NO: 14993 - DNA, 23 bp, Artificial Sequence
  X-linked inhibitor of apoptosis (XIAP) siRNA
tgtgatttggccctgtgtattat

SEQ ID NO: 14994 - DNA, 23 bp, Artificial Sequence
  X-linked inhibitor of apoptosis (XIAP) siRNA
gtgatttggccctgtgtattatg

SEQ ID NO: 14995 - DNA, 23 bp, Artificial Sequence
  X-linked inhibitor of apoptosis (XIAP) siRNA
tgatttggccctgtgtattatga

SEQ ID NO: 14996 - DNA, 23 bp, Artificial Sequence
  X-linked inhibitor of apoptosis (XIAP) siRNA
gatttggccctgtgtattatgat

SEQ ID NO: 14997 - DNA, 23 bp, Artificial Sequence
  X-linked inhibitor of apoptosis (XIAP) siRNA
atttggccctgtgtattatgata

SEQ ID NO: 14998 - DNA, 23 bp, Artificial Sequence
  X-linked inhibitor of apoptosis (XIAP) siRNA
tttggccctgtgtattatgatat

SEQ ID NO: 14999 - DNA, 23 bp, Artificial Sequence
  X-linked inhibitor of apoptosis (XIAP) siRNA
ttggccctgtgtattatgatatt

SEQ ID NO: 15000 - DNA, 23 bp, Artificial Sequence
  X-linked inhibitor of apoptosis (XIAP) siRNA
tggccctgtgtattatgatattt

SEQ ID NO: 15001 - DNA, 23 bp, Artificial Sequence
  X-linked inhibitor of apoptosis (XIAP) siRNA
ggccctgtgtattatgatatttt

SEQ ID NO: 15002 - DNA, 23 bp, Artificial Sequence
  X-linked inhibitor of apoptosis (XIAP) siRNA
gccctgtgtattatgatattttg

SEQ ID NO: 15003 - DNA, 23 bp, Artificial Sequence
  X-linked inhibitor of apoptosis (XIAP) siRNA
ccctgtgtattatgatattttgt

SEQ ID NO: 15004 - DNA, 23 bp, Artificial Sequence
  X-linked inhibitor of apoptosis (XIAP) siRNA
cctgtgtattatgatattttgtt

SEQ ID NO: 15005 - DNA, 23 bp, Artificial Sequence
  X-linked inhibitor of apoptosis (XIAP) siRNA
ctgtgtattatgatattttgtta

SEQ ID NO: 15006 - DNA, 23 bp, Artificial Sequence
  X-linked inhibitor of apoptosis (XIAP) siRNA
tgtgtattatgatattttgttat

SEQ ID NO: 15007 - DNA, 23 bp, Artificial Sequence
  X-linked inhibitor of apoptosis (XIAP) siRNA
gtgtattatgatattttgttatt

SEQ ID NO: 15008 - DNA, 23 bp, Artificial Sequence
  X-linked inhibitor of apoptosis (XIAP) siRNA
tgtattatgatattttgttattt

SEQ ID NO: 15009 - DNA, 23 bp, Artificial Sequence
  X-linked inhibitor of apoptosis (XIAP) siRNA
gtattatgatattttgttatttt

SEQ ID NO: 15010 - DNA, 23 bp, Artificial Sequence
  X-linked inhibitor of apoptosis (XIAP) siRNA
tattatgatattttgttattttt

SEQ ID NO: 15011 - DNA, 23 bp, Artificial Sequence
  X-linked inhibitor of apoptosis (XIAP) siRNA
attatgatattttgttatttttg

SEQ ID NO: 15012 - DNA, 23 bp, Artificial Sequence
  X-linked inhibitor of apoptosis (XIAP) siRNA
ttatgatattttgttatttttgt

SEQ ID NO: 15013 - DNA, 23 bp, Artificial Sequence
  X-linked inhibitor of apoptosis (XIAP) siRNA
tatgatattttgttatttttgtt

SEQ ID NO: 15014 - DNA, 23 bp, Artificial Sequence
  X-linked inhibitor of apoptosis (XIAP) siRNA
atgatattttgttatttttgttg

SEQ ID NO: 15015 - DNA, 23 bp, Artificial Sequence
  X-linked inhibitor of apoptosis (XIAP) siRNA
tgatattttgttatttttgttgt

SEQ ID NO: 15016 - DNA, 23 bp, Artificial Sequence
  X-linked inhibitor of apoptosis (XIAP) siRNA
gatattttgttatttttgttgtt

SEQ ID NO: 15017 - DNA, 23 bp, Artificial Sequence
  X-linked inhibitor of apoptosis (XIAP) siRNA
atattttgttatttttgttgtta

SEQ ID NO: 15018 - DNA, 23 bp, Artificial Sequence
  X-linked inhibitor of apoptosis (XIAP) siRNA
tattttgttatttttgttgttat

SEQ ID NO: 15019 - DNA, 23 bp, Artificial Sequence
  X-linked inhibitor of apoptosis (XIAP) siRNA
attttgttatttttgttgttata

SEQ ID NO: 15020 - DNA, 23 bp, Artificial Sequence
  X-linked inhibitor of apoptosis (XIAP) siRNA
ttttgttatttttgttgttatat

SEQ ID NO: 15021 - DNA, 23 bp, Artificial Sequence
  X-linked inhibitor of apoptosis (XIAP) siRNA
tttgttatttttgttgttatatt

SEQ ID NO: 15022 - DNA, 23 bp, Artificial Sequence
  X-linked inhibitor of apoptosis (XIAP) siRNA
ttgttatttttgttgttatatta

SEQ ID NO: 15023 - DNA, 23 bp, Artificial Sequence
  X-linked inhibitor of apoptosis (XIAP) siRNA
tgttatttttgttgttatattat

SEQ ID NO: 15024 - DNA, 23 bp, Artificial Sequence
  X-linked inhibitor of apoptosis (XIAP) siRNA
gttatttttgttgttatattatt

SEQ ID NO: 15025 - DNA, 23 bp, Artificial Sequence
  X-linked inhibitor of apoptosis (XIAP) siRNA
ttatttttgttgttatattattt

SEQ ID NO: 15026 - DNA, 23 bp, Artificial Sequence
  X-linked inhibitor of apoptosis (XIAP) siRNA
tatttttgttgttatattattta

SEQ ID NO: 15027 - DNA, 23 bp, Artificial Sequence
  X-linked inhibitor of apoptosis (XIAP) siRNA
atttttgttgttatattatttac

SEQ ID NO: 15028 - DNA, 23 bp, Artificial Sequence
  X-linked inhibitor of apoptosis (XIAP) siRNA
tttttgttgttatattatttaca

SEQ ID NO: 15029 - DNA, 23 bp, Artificial Sequence
  X-linked inhibitor of apoptosis (XIAP) siRNA
ttttgttgttatattatttacat

SEQ ID NO: 15030 - DNA, 23 bp, Artificial Sequence
  X-linked inhibitor of apoptosis (XIAP) siRNA
tttgttgttatattatttacatt

SEQ ID NO: 15031 - DNA, 23 bp, Artificial Sequence
  X-linked inhibitor of apoptosis (XIAP) siRNA
ttgttgttatattatttacattt

SEQ ID NO: 15032 - DNA, 23 bp, Artificial Sequence
  X-linked inhibitor of apoptosis (XIAP) siRNA
tgttgttatattatttacatttc

SEQ ID NO: 15033 - DNA, 23 bp, Artificial Sequence
  X-linked inhibitor of apoptosis (XIAP) siRNA
gttgttatattatttacatttca

SEQ ID NO: 15034 - DNA, 23 bp, Artificial Sequence
  X-linked inhibitor of apoptosis (XIAP) siRNA
ttgttatattatttacatttcag

SEQ ID NO: 15035 - DNA, 23 bp, Artificial Sequence
  X-linked inhibitor of apoptosis (XIAP) siRNA
tgttatattatttacatttcagt

SEQ ID NO: 15036 - DNA, 23 bp, Artificial Sequence
  X-linked inhibitor of apoptosis (XIAP) siRNA
gttatattatttacatttcagta

SEQ ID NO: 15037 - DNA, 23 bp, Artificial Sequence
  X-linked inhibitor of apoptosis (XIAP) siRNA
ttatattatttacatttcagtag

SEQ ID NO: 15038 - DNA, 23 bp, Artificial Sequence
  X-linked inhibitor of apoptosis (XIAP) siRNA
tatattatttacatttcagtagt

SEQ ID NO: 15039 - DNA, 23 bp, Artificial Sequence
  X-linked inhibitor of apoptosis (XIAP) siRNA
atattatttacatttcagtagtt

SEQ ID NO: 15040 - DNA, 23 bp, Artificial Sequence
  X-linked inhibitor of apoptosis (XIAP) siRNA
tattatttacatttcagtagttg

SEQ ID NO: 15041 - DNA, 23 bp, Artificial Sequence
  X-linked inhibitor of apoptosis (XIAP) siRNA
attatttacatttcagtagttgt

SEQ ID NO: 15042 - DNA, 23 bp, Artificial Sequence
  X-linked inhibitor of apoptosis (XIAP) siRNA
ttatttacatttcagtagttgtt

SEQ ID NO: 15043 - DNA, 23 bp, Artificial Sequence
  X-linked inhibitor of apoptosis (XIAP) siRNA
tatttacatttcagtagttgttt

SEQ ID NO: 15044 - DNA, 23 bp, Artificial Sequence
  X-linked inhibitor of apoptosis (XIAP) siRNA
atttacatttcagtagttgtttt

SEQ ID NO: 15045 - DNA, 23 bp, Artificial Sequence
  X-linked inhibitor of apoptosis (XIAP) siRNA
tttacatttcagtagttgttttt

SEQ ID NO: 15046 - DNA, 23 bp, Artificial Sequence
  X-linked inhibitor of apoptosis (XIAP) siRNA
ttacatttcagtagttgtttttt

SEQ ID NO: 15047 - DNA, 23 bp, Artificial Sequence
  X-linked inhibitor of apoptosis (XIAP) siRNA
tacatttcagtagttgttttttg

SEQ ID NO: 15048 - DNA, 23 bp, Artificial Sequence
  X-linked inhibitor of apoptosis (XIAP) siRNA
acatttcagtagttgttttttgt

SEQ ID NO: 15049 - DNA, 23 bp, Artificial Sequence
  X-linked inhibitor of apoptosis (XIAP) siRNA
catttcagtagttgttttttgtg

SEQ ID NO: 15050 - DNA, 23 bp, Artificial Sequence
  X-linked inhibitor of apoptosis (XIAP) siRNA
atttcagtagttgttttttgtgt

SEQ ID NO: 15051 - DNA, 23 bp, Artificial Sequence
  X-linked inhibitor of apoptosis (XIAP) siRNA
tttcagtagttgttttttgtgtt

SEQ ID NO: 15052 - DNA, 23 bp, Artificial Sequence
  X-linked inhibitor of apoptosis (XIAP) siRNA
ttcagtagttgttttttgtgttt

SEQ ID NO: 15053 - DNA, 23 bp, Artificial Sequence
  X-linked inhibitor of apoptosis (XIAP) siRNA
tcagtagttgttttttgtgtttc

SEQ ID NO: 15054 - DNA, 23 bp, Artificial Sequence
  X-linked inhibitor of apoptosis (XIAP) siRNA
cagtagttgttttttgtgtttcc

SEQ ID NO: 15055 - DNA, 23 bp, Artificial Sequence
  X-linked inhibitor of apoptosis (XIAP) siRNA
agtagttgttttttgtgtttcca

SEQ ID NO: 15056 - DNA, 23 bp, Artificial Sequence
  X-linked inhibitor of apoptosis (XIAP) siRNA
gtagttgttttttgtgtttccat

SEQ ID NO: 15057 - DNA, 23 bp, Artificial Sequence
  X-linked inhibitor of apoptosis (XIAP) siRNA
tagttgttttttgtgtttccatt

SEQ ID NO: 15058 - DNA, 23 bp, Artificial Sequence
  X-linked inhibitor of apoptosis (XIAP) siRNA
agttgttttttgtgtttccattt

SEQ ID NO: 15059 - DNA, 23 bp, Artificial Sequence
  X-linked inhibitor of apoptosis (XIAP) siRNA
gttgttttttgtgtttccatttt

SEQ ID NO: 15060 - DNA, 23 bp, Artificial Sequence
  X-linked inhibitor of apoptosis (XIAP) siRNA
ttgttttttgtgtttccatttta

SEQ ID NO: 15061 - DNA, 23 bp, Artificial Sequence
  X-linked inhibitor of apoptosis (XIAP) siRNA
tgttttttgtgtttccattttag

SEQ ID NO: 15062 - DNA, 23 bp, Artificial Sequence
  X-linked inhibitor of apoptosis (XIAP) siRNA
gttttttgtgtttccattttagt

SEQ ID NO: 15063 - DNA, 23 bp, Artificial Sequence
  X-linked inhibitor of apoptosis (XIAP) siRNA
ttttttgtgtttccattttagtg

SEQ ID NO: 15064 - DNA, 23 bp, Artificial Sequence
  X-linked inhibitor of apoptosis (XIAP) siRNA
tttttgtgtttccattttagtgg

SEQ ID NO: 15065 - DNA, 23 bp, Artificial Sequence
  X-linked inhibitor of apoptosis (XIAP) siRNA
ttttgtgtttccattttagtgga

SEQ ID NO: 15066 - DNA, 23 bp, Artificial Sequence
  X-linked inhibitor of apoptosis (XIAP) siRNA
tttgtgtttccattttagtggat

SEQ ID NO: 15067 - DNA, 23 bp, Artificial Sequence
  X-linked inhibitor of apoptosis (XIAP) siRNA
ttgtgtttccattttagtggata

SEQ ID NO: 15068 - DNA, 23 bp, Artificial Sequence
  X-linked inhibitor of apoptosis (XIAP) siRNA
tgtgtttccattttagtggataa

SEQ ID NO: 15069 - DNA, 23 bp, Artificial Sequence
  X-linked inhibitor of apoptosis (XIAP) siRNA
gtgtttccattttagtggataaa

SEQ ID NO: 15070 - DNA, 23 bp, Artificial Sequence
  X-linked inhibitor of apoptosis (XIAP) siRNA
tgtttccattttagtggataaaa

SEQ ID NO: 15071 - DNA, 23 bp, Artificial Sequence
  X-linked inhibitor of apoptosis (XIAP) siRNA
gtttccattttagtggataaaat

SEQ ID NO: 15072 - DNA, 23 bp, Artificial Sequence
  X-linked inhibitor of apoptosis (XIAP) siRNA
tttccattttagtggataaaatt

SEQ ID NO: 15073 - DNA, 23 bp, Artificial Sequence
  X-linked inhibitor of apoptosis (XIAP) siRNA
ttccattttagtggataaaattt

SEQ ID NO: 15074 - DNA, 23 bp, Artificial Sequence
  X-linked inhibitor of apoptosis (XIAP) siRNA
tccattttagtggataaaatttg

SEQ ID NO: 15075 - DNA, 23 bp, Artificial Sequence
  X-linked inhibitor of apoptosis (XIAP) siRNA
ccattttagtggataaaatttgt

SEQ ID NO: 15076 - DNA, 23 bp, Artificial Sequence
  X-linked inhibitor of apoptosis (XIAP) siRNA
cattttagtggataaaatttgta

SEQ ID NO: 15077 - DNA, 23 bp, Artificial Sequence
  X-linked inhibitor of apoptosis (XIAP) siRNA
attttagtggataaaatttgtat

SEQ ID NO: 15078 - DNA, 23 bp, Artificial Sequence
  X-linked inhibitor of apoptosis (XIAP) siRNA
ttttagtggataaaatttgtatt

SEQ ID NO: 15079 - DNA, 23 bp, Artificial Sequence
  X-linked inhibitor of apoptosis (XIAP) siRNA
tttagtggataaaatttgtattt

SEQ ID NO: 15080 - DNA, 23 bp, Artificial Sequence
  X-linked inhibitor of apoptosis (XIAP) siRNA
ttagtggataaaatttgtatttt

SEQ ID NO: 15081 - DNA, 23 bp, Artificial Sequence
  X-linked inhibitor of apoptosis (XIAP) siRNA
tagtggataaaatttgtattttg

SEQ ID NO: 15082 - DNA, 23 bp, Artificial Sequence
  X-linked inhibitor of apoptosis (XIAP) siRNA
agtggataaaatttgtattttga

SEQ ID NO: 15083 - DNA, 23 bp, Artificial Sequence
  X-linked inhibitor of apoptosis (XIAP) siRNA
gtggataaaatttgtattttgaa

SEQ ID NO: 15084 - DNA, 23 bp, Artificial Sequence
  X-linked inhibitor of apoptosis (XIAP) siRNA
tggataaaatttgtattttgaac

SEQ ID NO: 15085 - DNA, 23 bp, Artificial Sequence
  X-linked inhibitor of apoptosis (XIAP) siRNA
ggataaaatttgtattttgaact

SEQ ID NO: 15086 - DNA, 23 bp, Artificial Sequence
  X-linked inhibitor of apoptosis (XIAP) siRNA
gataaaatttgtattttgaacta

SEQ ID NO: 15087 - DNA, 23 bp, Artificial Sequence
  X-linked inhibitor of apoptosis (XIAP) siRNA
ataaaatttgtattttgaactat

SEQ ID NO: 15088 - DNA, 23 bp, Artificial Sequence
  X-linked inhibitor of apoptosis (XIAP) siRNA
taaaatttgtattttgaactatg

SEQ ID NO: 15089 - DNA, 23 bp, Artificial Sequence
  X-linked inhibitor of apoptosis (XIAP) siRNA
aaaatttgtattttgaactatga

SEQ ID NO: 15090 - DNA, 23 bp, Artificial Sequence
  X-linked inhibitor of apoptosis (XIAP) siRNA
aaatttgtattttgaactatgaa

SEQ ID NO: 15091 - DNA, 23 bp, Artificial Sequence
  X-linked inhibitor of apoptosis (XIAP) siRNA
aatttgtattttgaactatgaat

SEQ ID NO: 15092 - DNA, 23 bp, Artificial Sequence
  X-linked inhibitor of apoptosis (XIAP) siRNA
atttgtattttgaactatgaatg

SEQ ID NO: 15093 - DNA, 23 bp, Artificial Sequence
  X-linked inhibitor of apoptosis (XIAP) siRNA
tttgtattttgaactatgaatgg

SEQ ID NO: 15094 - DNA, 23 bp, Artificial Sequence
  X-linked inhibitor of apoptosis (XIAP) siRNA
ttgtattttgaactatgaatgga

SEQ ID NO: 15095 - DNA, 23 bp, Artificial Sequence
  X-linked inhibitor of apoptosis (XIAP) siRNA
tgtattttgaactatgaatggag

SEQ ID NO: 15096 - DNA, 23 bp, Artificial Sequence
  X-linked inhibitor of apoptosis (XIAP) siRNA
gtattttgaactatgaatggaga

SEQ ID NO: 15097 - DNA, 23 bp, Artificial Sequence
  X-linked inhibitor of apoptosis (XIAP) siRNA
tattttgaactatgaatggagac

SEQ ID NO: 15098 - DNA, 23 bp, Artificial Sequence
  X-linked inhibitor of apoptosis (XIAP) siRNA
attttgaactatgaatggagact

SEQ ID NO: 15099 - DNA, 23 bp, Artificial Sequence
  X-linked inhibitor of apoptosis (XIAP) siRNA
ttttgaactatgaatggagacta

SEQ ID NO: 15100 - DNA, 23 bp, Artificial Sequence
  X-linked inhibitor of apoptosis (XIAP) siRNA
tttgaactatgaatggagactac

SEQ ID NO: 15101 - DNA, 23 bp, Artificial Sequence
  X-linked inhibitor of apoptosis (XIAP) siRNA
ttgaactatgaatggagactacc

SEQ ID NO: 15102 - DNA, 23 bp, Artificial Sequence
  X-linked inhibitor of apoptosis (XIAP) siRNA
tgaactatgaatggagactaccg

SEQ ID NO: 15103 - DNA, 23 bp, Artificial Sequence
  X-linked inhibitor of apoptosis (XIAP) siRNA
gaactatgaatggagactaccgc

SEQ ID NO: 15104 - DNA, 23 bp, Artificial Sequence
  X-linked inhibitor of apoptosis (XIAP) siRNA
aactatgaatggagactaccgcc

SEQ ID NO: 15105 - DNA, 23 bp, Artificial Sequence
  X-linked inhibitor of apoptosis (XIAP) siRNA
actatgaatggagactaccgccc

SEQ ID NO: 15106 - DNA, 23 bp, Artificial Sequence
  X-linked inhibitor of apoptosis (XIAP) siRNA
ctatgaatggagactaccgcccc

SEQ ID NO: 15107 - DNA, 23 bp, Artificial Sequence
  X-linked inhibitor of apoptosis (XIAP) siRNA
tatgaatggagactaccgcccca

SEQ ID NO: 15108 - DNA, 23 bp, Artificial Sequence
  X-linked inhibitor of apoptosis (XIAP) siRNA
atgaatggagactaccgccccag

SEQ ID NO: 15109 - DNA, 23 bp, Artificial Sequence
  X-linked inhibitor of apoptosis (XIAP) siRNA
tgaatggagactaccgccccagc

SEQ ID NO: 15110 - DNA, 23 bp, Artificial Sequence
  X-linked inhibitor of apoptosis (XIAP) siRNA
gaatggagactaccgccccagca

(The sequence listing continues in the following parts.)

What is claimed is:

1. An siRNA molecule that silences Eg5 expression comprising a sense strand and a complementary antisense strand, wherein the antisense strand consists of the nucleic acid sequence of SEQ ID NO:44.

2. The siRNA molecule of claim 1, wherein the siRNA molecule is chemically synthesized.

3. The siRNA molecule of claim 1, wherein the sense strand comprises the nucleic acid sequence of SEQ ID NO:20.

4. The siRNA molecule of claim 1, wherein the sense strand consists of the nucleic acid sequence of SEQ ID NO:43.

5. The siRNA molecule of claim 1, wherein the siRNA molecule comprises at least one modified nucleotide.

6. The siRNA molecule of claim 5, wherein the modified nucleotide is a 2'-O-methyl (2'OMe) nucleotide.

7. A composition comprising the siRNA molecule of claim 1 and a pharmaceutically acceptable carrier.

8. A nucleic acid-lipid particle comprising:
(a) the siRNA molecule of claim 1;
(b) a cationic lipid; and
(c) a non-cationic lipid.

* * * * *

UNITED STATES PATENT AND TRADEMARK OFFICE
CERTIFICATE OF CORRECTION

| | | |
|---|---|---|
| PATENT NO. | : 8,598,333 B2 | Page 1 of 1 |
| APPLICATION NO. | : 11/807872 | |
| DATED | : December 3, 2013 | |
| INVENTOR(S) | : MacLachlan et al. | |

It is certified that error appears in the above-identified patent and that said Letters Patent is hereby corrected as shown below:

On the Title Page:

The first or sole Notice should read --

Subject to any disclaimer, the term of this patent is extended or adjusted under 35 U.S.C. 154(b) by 1404 days.

Signed and Sealed this
Seventh Day of July, 2015

Michelle K. Lee
*Director of the United States Patent and Trademark Office*